(12) United States Patent
Harris et al.

(10) Patent No.: US 7,534,875 B2
(45) Date of Patent: May 19, 2009

(54) COMPOSITIONS FOR GLIOMA CLASSIFICATION

(75) Inventors: Cole Harris, Albuquerque, NM (US); Lisa Davis, Albuquerque, NM (US)

(73) Assignee: Exagen Diagnostics, Inc., Albuquerque, NM (US)

( * ) Notice: Subject to any disclaimer, the term of this patent is extended or adjusted under 35 U.S.C. 154(b) by 231 days.

(21) Appl. No.: 10/981,277

(22) Filed: Nov. 3, 2004

(65) Prior Publication Data

US 2005/0181389 A1 Aug. 18, 2005

Related U.S. Application Data

(60) Provisional application No. 60/516,817, filed on Nov. 3, 2003.

(51) Int. Cl.
  C07H 21/02 (2006.01)
  C07H 21/04 (2006.01)
  C12Q 1/68 (2006.01)

(52) U.S. Cl. .................. 536/23.5; 536/23.1; 536/24.31; 536/24.33; 435/6

(58) Field of Classification Search ........................ None
See application file for complete search history.

(56) References Cited

U.S. PATENT DOCUMENTS

| 5,750,340 | A | 5/1998 | Kim et al. |
| 6,022,689 | A | 2/2000 | Sarto et al. |
| 6,344,316 | B1 * | 2/2002 | Lockhart et al. ............... 506/9 |
| 6,664,057 | B2 | 12/2003 | Albertson et al. |
| 6,706,867 | B1 * | 3/2004 | Lorenz ....................... 536/23.1 |
| 2003/0187584 | A1 | 10/2003 | Harris et al. |

FOREIGN PATENT DOCUMENTS

| WO | WO 96/17958 | 6/1996 |
| WO | 2003083760 | 10/2003 |

OTHER PUBLICATIONS

Affymetrix Human Genome U95Av2 Array. Affymetrix Product Catalog for GeneChip Human Genome 95 Set, 2000.*
Coleman. Drug Discovery Today. 2003. 8: 233-235.*
Liu et al. Clinical Immunology. 2004. 112: 225-230.*
Nutt, et al., (2003), Cancer Research, "Gene expression-based classification of malignant gliomas correlates better with survival than histological classification", vol. 63, pp. 1602-1607.
Hyman, et al., (2002), Cancer Res., "Impact of DNA amplification on gene expression patterns in breast cancer", vol. 62(21), pp. 6240-6245.
Hanash, et al., (2002), Proteomics, "integrating cancer genomics and proteomics in the post-genome era", vol. 2(1), pp. 69-75.
Kim, et al., (2002), Molecular cancer therapeutics, "Identification of combination gene sets for glioma classification", vol. 1(13), pp. 1229-1236.
Pollack, et al., (2002), Proc. Natl. Acad. Sci. USA, "Microarray analysis reveals a major direct role of DNA copy number alteration in the transcriptional program of human gliomas", vol. 99(20), pp. 12963-12968.
Pollack, et al., (1999), Nature Genetics, "Genome-wide analysis of DNA copy-number changes using cDNA microarrays", vol. 23(1), pp. 41-46.
Crawley, et al., (2002), Genome Biol., "Identification of frequent cytogenetic aberrations in hepatocellular carcinoma using gene-expression microarray data", vol. 3(12), pp. 1-8.
Barlund, et al., (2000), Cancer Res. "Multiple Genes at 17q23 Undergo Amplification and Overexpression in Breast Cancer", vol. 60(19), pp. 5340-5344.
Kauraniemi, et al., (2001), Cancer Res., "New Amplified and Highly Expressed Genes Discovered in the ERBB2 Amplicon in Breast Cancer by cDNA Microarrays", vol. 61(22), pp. 8235-8240.
Monni, et al., (2001), Proc. Natl. Acad. Sci., "Comprehensive Copy Number and Gene Expression Profiling of the 17q23 Amplicon in Human Breast Cancer", vol. 98(10), pp. 5711-5716.
Strauss-Soukup, (1997), Biochemistry, "Effects of Neutralization Pattern and Sterochemistry on DNA Bending By Methylphosphonate Substitutions" vol. 36, pp. 8692-8698.
Milligan (1993), J. Med. Chem., "Current Concepts in Antisense Drug Design", vol. 36, pp. 1923-1937.
Pearson, et al., (1983), J. Chrom, "High-Performance Anion-Exchange Chromatography of Oligonucleotides", vol. 255, pp. 137-149.
Pastinen, et al., (1997), Genome Res., "Minisequencing: A Specific Tool for DNA Analysis and Diagnostics on Oligonucleotide Arrays", vol. 7, pp. 606-614.
Wan, et al., (1996), Nature Biotechnology, "Cloning Differentially Expressed mRNAs", vol. 14, p. 1685-1691.
Chee, et al., (1995), Science, "Accessing Genetic Information with High-Density DNA Arrays", vol. 274, p. 610.
Kros, et al., (1999), J. Pathol., "Genetic aberrations in oligodendroglial tumors: an analysis using comparative genomic hybridization (CGH)", vol. 188(3), pp. 282-288.
Maruno, et al., (1999), Cancer Lett., "Chromosomal aberrations detected by comparative genomic hybridization (CGH) in human astrocytic tumors", vol. 135(1), pp. 61-66.
Nigro, et al., (2005), Cancer Research, "Integrated Array-Comparative Genomic Hybridization and Expression Array Profiles Identify Clinically relevant Molecular Subtypes of Glioblastoma", vol. 65, pp. 1678-1686.
Progenetix CGH online database. Baudis M., (2000-2003); www.progenetix.net.

(Continued)

*Primary Examiner*—Carla Myers
(74) *Attorney, Agent, or Firm*—McDonnell Boehnen Hulbert & Berghoff LLP; David S. Harper

(57) ABSTRACT

The present invention provides novel compositions and their use in classifying gliomas. In a preferred embodiment, the methods are used to discriminate between oligodendroglioma and glioblastoma.

14 Claims, 9 Drawing Sheets

OTHER PUBLICATIONS

Baudis, et al., (2001) Bioinformatics, "Progenetix.net: An online repository for molecular cytogenetic aberration data.", vol. 17 (12), pp. 1228-1229.

Watson, et al., (2001), Cancer Research, "Gene Expression Profiling with Oligonucleotide Microarrays Distinguishes World Health Organization Grade of Oligonucleotides", vol. 61, pp. 1825-1829.

* cited by examiner

Figure 1A

| Accession Number | gene name and SEQ ID NO | BAC name | chromosome | begin at bp# | end at bp# | size | BAC SEQ ID NO |
|---|---|---|---|---|---|---|---|
| X68194 | h-Sp1 (SEQ ID NO:1) | RP11-193P05 | 7q22.3 | 105,166,071 | 105,313,293 | 147,223 | (SEQ ID NO:21) |
|  |  | RP11-532G04 | 7q22.3 | 105,210,207 | 105,362,088 | 151,882 | (SEQ ID NO:22) |
|  |  |  |  |  |  |  |  |
| D80012 | KIAA0190 (SEQ ID NO:2) | RP11-339O21 | 16q24.1 | 84,378,486 | 84,573,849 | 195,364 | (SEQ ID NO:23) |
|  |  | RP11-80H06 | 16q24.1 | 84,400,522 | 84,560,725 | 160,204 | (SEQ ID NO:24) |
|  |  | RP11-816N18 | 16q24.1 | 84,411,033 | 84,584,732 | 173,700 | (SEQ ID NO:25) |
| X69490 | titin (SEQ ID NO:3) | RP11-65L03 | 2q31.2 | 179,222,165 | 179,394,989 | 172,825 | (SEQ ID NO:26) |
|  |  | RP11-702K16 | 2q31.2 | 179,315,141 | 179,497,648 | 182,508 | (SEQ ID NO:27) |
|  |  |  |  |  |  |  |  |
| AL050050 | DKFZp566D133 (SEQ ID NO:4) | RP11-624P12 | 9q31.2 | 101,698,606 | 101,859,415 | 160,810 | (SEQ ID NO:28) |
|  |  | RP11-556N18 | 9q31.2 | 101,720,729 | 101,900,415 | 179,687 | (SEQ ID NO:29) |
|  |  | RP11-355C03 | 14q13.2 | 33,940,954 | 34,096,525 | 155,572 | (SEQ ID NO:30) |
|  |  |  |  |  |  |  |  |
| Z35491 | GCHRAP (SEQ ID NO:5) | RP11-126M06 | 9p21-p13 | 33,172,137 | 33,355,182 | 183,046 | (SEQ ID NO:31) |
|  |  |  |  |  |  |  |  |

Figure 1B

| | | | | | | |
|---|---|---|---|---|---|---|
| AB029003 | KIAA1080 (SEQ ID NO:6) | RP11-29K03 | 16p12.2 | 23,343,152 | 23,508,690 | 165,539 (SEQ ID NO:32) |
| D87343 | DCRA (SEQ ID NO:7) | RP11-70N15 | 21q22.13 | 37,429,095 | 37,579,576 | 150,482 (SEQ ID NO:33) |
| | | RP11-348K16 | 21q22.13 | 37,454,954 | 37,631,049 | 176,096 (SEQ ID NO:34) |
| X17644 | GST1 (SEQ ID NO:8) | RP11-634H03 | 16p13.13 | 11,906,946 | 12,073,481 | 166,536 (SEQ ID NO:35) |
| | | CTD-2380E14 | 16p13.13 | 11,840,607 | 11,991,131 | 150,525 (SEQ ID NO:36) |
| D13642 | KIAA0017 (SEQ ID NO:9) | RP11-6M02 | 16q22.1 | 70,265,390 | 70,415,708 | 150,319 (SEQ ID NO:37) |
| M80244 | E16 (SEQ ID NO:10) | RP11-389M10 | 16q24.2 | 87,489,494 | 87,670,772 | 181,279 (SEQ ID NO:38) |
| | | RP11-53P23 | 16q24.2 | 87,565,332 | 87,689,927 | 124,596 (SEQ ID NO:39) |
| | | CTD-2195G01 | 16q24.2 | 87,587,950 | 87,741,140 | 153,191 (SEQ ID NO:40) |
| | | RP11-280O07 | 16q24.2 | 87,600,268 | 87,753,011 | 152,744 (SEQ ID NO:41) |
| M63175 | AMFR (SEQ ID NO:11) | RP11-598M09 | 16q12.2 | 56,027,976 | 56,215,372 | 187,397 (SEQ ID NO:42) |
| | | RP11-413H22 | 16q12.2 | 56,075,110 | 56,268,183 | 193,074 (SEQ ID NO:43) |

Figure 1C

| | | | | | | |
|---|---|---|---|---|---|---|
| AJ009771 | RING (SEQ ID NO:12) | RP11-422O02 | 15q24.1 | 70,413,542 | 70,585,384 | 171,843 (SEQ ID NO:44) |
| | | RP11-612A09 | 15q24.1 | 70,333,553 | 70,521,721 | 188,169 (SEQ ID NO:45) |
| AB028985 | KIAA1062 (SEQ ID NO:13) | RP11-466K05 | 9q34.3 | 133,220,670 | 133,371,170 | 150,501 (SEQ ID NO:46) |
| | | RP11-229P13 | 9q34.3 | 133,232,112 | 133,391,761 | 159,650 (SEQ ID NO:47) |
| AB028944 | KIAA1021 (SEQ ID NO:14) | RP11-708D05 | 13q34 | 112,452,696 | 112,628,951 | 176,256 (SEQ ID NO:48) |
| M81118 | ADH5CHI (SEQ ID NO:15) | RP11-571L19 | 4q23 | 100,232,660 | 100,439,398 | 206,739 (SEQ ID NO:49) |
| | | RP11-603F22 | 4q23 | 100,347,459 | 100,497,895 | 150,437 (SEQ ID NO:50) |
| AF070596 | 24796 (SEQ ID NO:16) | RP11-768I19 | 16p12.3 | 20,963,245 | 21,159,395 | 196,151 (SEQ ID NO:51) |
| | | RP11-470O13 | 16p12.3 | 21,007,478 | 21,157,775 | 150,298 (SEQ ID NO:52) |
| | | RP11-480G09 | 16p12.3 -12 | 21,067,644 | 21,232,553 | 164,910 (SEQ ID NO:53) |
| AB018290 | KIAA0747 (SEQ ID NO:17) | CTD-2291O12 | 12q13.2 | 56,229,559 | 56,332,949 | 103,391 (SEQ ID NO:54) |

Figure 1D

| AL050025 | DKFZp564D066 (SEQ ID NO:18) | RP11-417N10 | 16q22.2 | 71,481,584 | 71,631,858 | 150,275 | (SEQ ID NO:55) |
|---|---|---|---|---|---|---|---|
| | | RP11-456N13 | 15q22.2 | 61,089,837 | 61,240,409 | 150,573 | (SEQ ID NO:56) |
| AC002394 | CIT987SKA211C6 (SEQ ID NO:19) | RP11-481A02 | 16p12.3 | 20,749,100 | 20,961,192 | 212,093 | (SEQ ID NO:19) |
| AB011170 | KIAA0598 (SEQ ID NO:20) | RP11-47G11 | 10q26.13 | 125,741,771 | 125,891,011 | 149,241 | (SEQ ID NO:57) |

Figure 2A    Ranking of 5 reporter set glioma biomarkers

| Probe set rank | A | B | C | D | E | gene expression score % (x 100) correct | cgh score % (x 100) correct | average for ranking combinations |
|---|---|---|---|---|---|---|---|---|
| 1 | X68194 (SEQ ID 1) | D80012 (SEQ ID 2) | X69490 (SEQ ID 3) | Z35491 (SEQ ID 5) | D87343 (SEQ ID 7) | 0.875 | 0.944444 | 0.909722 |
| 2 | D80012 (SEQ ID 2) | X69490 (SEQ ID 3) | Z35491 (SEQ ID 5) | D87343 (SEQ ID 7) | AF070596 (SEQ ID 16): | 0.87013 | 0.944444 | 0.907287 |
| 3 | D80012 (SEQ ID 2) | X69490 (SEQ ID 3) | AL050050 (SEQ ID 4) | Z35491 (SEQ ID 5) | D87343 (SEQ ID 7) | 0.857143 | 0.944444 | 0.900794 |
| 4 | X69490 (SEQ ID 3) | Z35491 (SEQ ID 5) | D87343 (SEQ ID 7) | M63175 (SEQ ID 11) | AF070596 (SEQ ID 16): | 0.847403 | 0.944444 | 0.895924 |
| 5 | D80012 (SEQ ID 2) | X69490 (SEQ ID 3) | Z35491 (SEQ ID 5) | D87343 (SEQ ID 7) | AB028985 (SEQ ID 13) | 0.847403 | 0.944444 | 0.895924 |
| 6 | X68194 (SEQ ID 1) | X69490 (SEQ ID 3) | Z35491 (SEQ ID 5) | D87343 (SEQ ID 7) | M63175 (SEQ ID 11) | 0.847403 | 0.944444 | 0.895924 |
| 7 | X69490 (SEQ ID 3) | Z35491 (SEQ ID 5) | D87343 (SEQ ID 7) | M80244 (SEQ ID 10) | AL050025 (SEQ ID 18) | 0.842532 | 0.944444 | 0.893488 |
| 8 | D80012 (SEQ ID 2) | X69490 (SEQ ID 3) | Z35491 (SEQ ID 5) | D87343 (SEQ ID 7) | AB018290 (SEQ ID 17) | 0.842532 | 0.944444 | 0.893488 |

Figure 2B

|   | | | | | | | |
|---|---|---|---|---|---|---|---|
| 9 | X68194 (SEQ ID 1) | X69490 (SEQ ID 3) | AL050050 (SEQ ID 4) | Z35491 (SEQ ID 5) | D87343 (SEQ ID 7) | 0.839286 | 0.944444 | 0.891865 |
| 10 | X68194 (SEQ ID 1) | X69490 (SEQ ID 3) | Z35491 (SEQ ID 5) | D87343 (SEQ ID 7) | M80244 (SEQ ID 10) | 0.834416 | 0.944444 | 0.88943 |
| 11 | X68194 (SEQ ID 1) | X69490 (SEQ ID 3) | Z35491 (SEQ ID 5) | AB029003 (SEQ ID 6) | D87343 (SEQ ID 7) | 0.832792 | 0.944444 | 0.888618 |
| 12 | D80012 (SEQ ID 2) | X69490 (SEQ ID 3) | Z35491 (SEQ ID 5) | D87343 (SEQ ID 7) | M80244 (SEQ ID 10) | 0.829545 | 0.944444 | 0.886995 |
| 13 | D80012 (SEQ ID 2) | X69490 (SEQ ID 3) | Z35491 (SEQ ID 5) | D87343 (SEQ ID 7) | M63175 (SEQ ID 11) | 0.824675 | 0.944444 | 0.88456 |
| 14 | X69490 (SEQ ID 3) | Z35491 (SEQ ID 5) | D87343 (SEQ ID 7) | AF070596 (SEQ ID 16):: | AB018290 (SEQ ID 17) | 0.824675 | 0.944444 | 0.88456 |
| 15 | X68194 (SEQ ID 1) | X69490 (SEQ ID 3) | Z35491 (SEQ ID 5) | D87343 (SEQ ID 7) | AL050025 (SEQ ID 18) | 0.824675 | 0.944444 | 0.88456 |
| 16 | X69490 (SEQ ID 3) | Z35491 (SEQ ID 5) | D87343 (SEQ ID 7) | AF070596 (SEQ ID 16):: | AL050025 (SEQ ID 18) | 0.824675 | 0.944444 | 0.88456 |
| 17 | X69490 (SEQ ID 3) | Z35491 (SEQ ID 5) | D87343 (SEQ ID 7) | M80244 (SEQ ID 10) | AB018290 (SEQ ID 17) | 0.819805 | 0.944444 | 0.882125 |
| 18 | X69490 (SEQ ID 3) | AL050050 (SEQ ID 4) | Z35491 (SEQ ID 5) | D87343 (SEQ ID 7) | AF070596 (SEQ ID 16):: | 0.816558 | 0.944444 | 0.880501 |
| 19 | X68194 (SEQ ID 1) | X69490 (SEQ ID 3) | Z35491 (SEQ ID 5) | D87343 (SEQ ID 7) | AF070596 (SEQ ID 16):: | 0.816558 | 0.944444 | 0.880501 |

Figure 2C

| | | | | | | | |
|---|---|---|---|---|---|---|---|
| 20 | X68194 (SEQ ID 1) | D80012 (SEQ ID 2) | X69490 (SEQ ID 3) | D87343 (SEQ ID 7) | AB028985 (SEQ ID 13) | 0.87013 | 0.888889 | 0.879509 |
| 21 | X69490 (SEQ ID 3) | Z35491 (SEQ ID 5) | D87343 (SEQ ID 7) | AB028985 (SEQ ID 13) | AF070596 (SEQ ID 16):: | 0.811688 | 0.944444 | 0.878066 |
| 22 | X69490 (SEQ ID 3) | AL050050 (SEQ ID 4) | Z35491 (SEQ ID 5) | D87343 (SEQ ID 7) | M80244 (SEQ ID 10) | 0.811688 | 0.944444 | 0.878066 |
| 23 | X69490 (SEQ ID 3) | Z35491 (SEQ ID 5) | AB029003 (SEQ ID 6) | D87343 (SEQ ID 7) | M80244 (SEQ ID 10) | 0.810065 | 0.944444 | 0.877255 |
| 24 | X69490 (SEQ ID 3) | Z35491 (SEQ ID 5) | D87343 (SEQ ID 7) | D87343 (SEQ ID 7) | AL050025 (SEQ ID 18) | 0.806818 | 0.944444 | 0.875631 |
| 25 | X69490 (SEQ ID 3) | AL050050 (SEQ ID 4) | D87343 (SEQ ID 7) | M80244 (SEQ ID 10) | AB028985 (SEQ ID 13) | 0.806818 | 0.944444 | 0.875631 |
| 26 | X69490 (SEQ ID 3) | Z35491 (SEQ ID 5) | AB029003 (SEQ ID 6) | D87343 (SEQ ID 7) | AB018290 (SEQ ID 17) | 0.805195 | 0.944444 | 0.87482 |
| 27 | X69490 (SEQ ID 3) | Z35491 (SEQ ID 5) | D87343 (SEQ ID 7) | D13642 (SEQ ID 9) | AB018290 (SEQ ID 17) | 0.805195 | 0.944444 | 0.87482 |
| 28 | X68194 (SEQ ID 1) | D80012 (SEQ ID 2) | X69490 (SEQ ID 3) | D87343 (SEQ ID 7) | AB018290 (SEQ ID 17) | 0.86039 | 0.888889 | 0.874639 |
| 29 | X69490 (SEQ ID 3) | AL050050 (SEQ ID 4) | Z35491 (SEQ ID 5) | D87343 (SEQ ID 7) | M63175 (SEQ ID 11) | 0.801948 | 0.944444 | 0.873196 |

Figure 2D

| | | | | | | | |
|---|---|---|---|---|---|---|---|
| 30 | X68194 (SEQ ID 1) | D80012 (SEQ ID 2) | X69490 (SEQ ID 3) | AL050050 (SEQ ID 4) | D87343 (SEQ ID 7) | 0.857143 | 0.888889 | 0.873016 |
| 31 | D80012 (SEQ ID 2) | X69490 (SEQ ID 3) | D87343 (SEQ ID 7) | M80244 (SEQ ID 10) | AB018290 (SEQ ID 17) | 0.855519 | 0.888889 | 0.872204 |
| 32 | X69490 (SEQ ID 3) | AL050050 (SEQ ID 4) | Z35491 (SEQ ID 5) | AB029003 (SEQ ID 6) | D87343 (SEQ ID 7) | 0.797078 | 0.944444 | 0.870761 |
| 33 | X69490 (SEQ ID 3) | Z35491 (SEQ ID 5) | D87343 (SEQ ID 7) | M80244 (SEQ ID 10) | M63175 (SEQ ID 11) | 0.797078 | 0.944444 | 0.870761 |
| 34 | X68194 (SEQ ID 1) | X69490 (SEQ ID 3) | Z35491 (SEQ ID 5) | D87343 (SEQ ID 7) | D13642 (SEQ ID 9) | 0.797078 | 0.944444 | 0.870761 |
| 35 | X68194 (SEQ ID 1) | X69490 (SEQ ID 3) | Z35491 (SEQ ID 5) | D87343 (SEQ ID 7) | AB011170 (SEQ ID 20) | 0.857143 | 0.881944 | 0.869544 |
| 36 | X69490 (SEQ ID 3) | Z35491 (SEQ ID 5) | D87343 (SEQ ID 7) | M80244 (SEQ ID 10) | AF070596 (SEQ ID 16): | 0.793831 | 0.944444 | 0.869138 |
| 37 | X69490 (SEQ ID 3) | Z35491 (SEQ ID 5) | D87343 (SEQ ID 7) | M81118 (SEQ ID 15) | AF070596 (SEQ ID 16): | 0.793831 | 0.944444 | 0.869138 |
| 38 | X69490 (SEQ ID 3) | D87343 (SEQ ID 7) | D87343 (SEQ ID 7) | AB018290 (SEQ ID 17) | AL050025 (SEQ ID 18) | 0.792208 | 0.944444 | 0.868326 |
| 39 | X69490 (SEQ ID 3) | Z35491 (SEQ ID 5) | D87343 (SEQ ID 7) | D13642 (SEQ ID 9) | M80244 (SEQ ID 10) | 0.792208 | 0.944444 | 0.868326 |
| 40 | D80012 (SEQ ID 2) | X69490 (SEQ ID 3) | D87343 (SEQ ID 7) | M63175 (SEQ ID 11) | AF070596 (SEQ ID 16): | 0.847403 | 0.888889 | 0.868146 |

Figure 2E

| | | | | | | |
|---|---|---|---|---|---|---|
| 41 | X69490 (SEQ ID 3) | Z35491 (SEQ ID 5) | D87343 (SEQ ID 7) | AF070596 (SEQ ID 16): | AB011170 (SEQ ID 20) | 0.852273 | 0.881944 | 0.867109 |
| 42 | D80012 (SEQ ID 2) | X69490 (SEQ ID 3) | Z35491 (SEQ ID 5) | D87343 (SEQ ID 7) | AB011170 (SEQ ID 20) | 0.852273 | 0.881944 | 0.867109 |
| 43 | X69490 (SEQ ID 3) | Z35491 (SEQ ID 5) | AB029003 (SEQ ID 6) | D87343 (SEQ ID 7) | AB028985 (SEQ ID 13) | 0.787338 | 0.944444 | 0.865891 |
| 44 | X69490 (SEQ ID 3) | Z35491 (SEQ ID 5) | D87343 (SEQ ID 7) | D13642 (SEQ ID 9) | AB028985 (SEQ ID 13) | 0.787338 | 0.944444 | 0.865891 |
| 45 | X68194 (SEQ ID 1) | X69490 (SEQ ID 3) | D87343 (SEQ ID 7) | M80244 (SEQ ID 10) | AL050025 (SEQ ID 18) | 0.842532 | 0.888889 | 0.865711 |
| 46 | X69490 (SEQ ID 3) | AL050050 (SEQ ID 4) | D87343 (SEQ ID 7) | M80244 (SEQ ID 10) | AL050025 (SEQ ID 18) | 0.842532 | 0.888889 | 0.865711 |
| 47 | X69490 (SEQ ID 3) | AL050050 (SEQ ID 4) | Z35491 (SEQ ID 5) | D87343 (SEQ ID 7) | AJ009771 (SEQ ID 12) | 0.847403 | 0.881944 | 0.864674 |
| 48 | X69490 (SEQ ID 3) | Z35491 (SEQ ID 5) | D87343 (SEQ ID 7) | M63175 (SEQ ID 11) | AB011170 (SEQ ID 20) | 0.847403 | 0.881944 | 0.864674 |
| 49 | D80012 (SEQ ID 2) | X69490 (SEQ ID 3) | Z35491 (SEQ ID 5) | D87343 (SEQ ID 7) | M81118 (SEQ ID 15) | 0.784091 | 0.944444 | 0.864268 |
| 50 | X69490 (SEQ ID 3) | Z35491 (SEQ ID 5) | AB029003 (SEQ ID 6) | D87343 (SEQ ID 7) | D13642 (SEQ ID 9) | 0.782468 | 0.944444 | 0.863456 |

COMPOSITIONS FOR GLIOMA CLASSIFICATION

CROSS REFERENCE

This application claims priority to U.S. Provisional Patent Application Ser. No. 60/516,817 filed Nov. 3, 2003, which is incorporated by reference herein in its entirety.

INCORPORATION OF SEQUENCE LISTING

Two copies of the sequence listing (Sequence Listing Copy 1 and Sequence Listing Copy 2) on CD-ROMs, each containing the file named 03-968-US SeqListing.ST25, which is 7.35 MB and was created on Nov. 2, 2004, are herein incorporated by reference.

BACKGROUND

Primary central nervous system ("CNS") tumors, such as gliomas, are so named by the types of cells they contain, their location, or both. Detection of such tumors is difficult because of the diverse symptoms that patients with CNS tumors may present. Furthermore, once a CNS tumor is suspected, expensive imaging techniques are generally required for diagnosis, these various imaging techniques all suffer from one or more inadequacies, and none provide any definitive prognostic value. Laboratory tests such as electroencephalograms provide information on brain activity that might indicate a tumor, but are not able to identify and characterize CNS tumors or their prognosis.

Malignant gliomas are the most common primary brain tumor, and are classified histologically, with pathological diagnosis affecting prognostic estimation and therapeutic decision-making more than any other variable. (Nutt et al., Cancer Research 63:1602-1607 (2003)) Oligodendrogliomas, which are often chemosensitive, have a more favorable prognosis than glioblastomas, which are resistant to most available therapies. (Nutt, supra).

The maturation of microarray technology has enabled the routine collection of genome-wide gene expression (RNA) data. In cancer diagnostics, several authors have shown that microarray data collected from tumors may be useful in differential diagnosis, tumor staging, and prognosis. The data produced by these studies ideally represents a valuable resource for the development of new diagnostics. However, at present, the application of microarray technology requires steps in sample collection and sample preparation that inhibit routine clinical adoption.

In contrast, DNA-based markers are commonly used in cancer diagnostics. Diagnostic implementations utilizing fluorescence in situ hybridization (FISH) and RT-PCR technology are in widespread use. New diagnostic products based on such accepted technology will more quickly find clinical acceptance.

It is established that specific genetic aberrations are often associated with clinical characteristics. Examples include the association of 1 p/19 q deletions in breast cancer with improved response to chemotherapy, and the association of 8 q gain with poor prognosis in prostate cancer. Such aberrations have been detected with comparative genomic hybridization ("CGH"). However, the relationship between tumor karyotype and phenotype is often subtle, and may be difficult to determine from the typically available datasets consisting of low-resolution CGH data collected from a small number of samples.

Several studies have demonstrated the association of genetic aberrations with gene expression changes. In independent studies, Hyman et al (2002) and Pollack et al (2002) both found a strong relationship between high amplification and high expression in breast tumors. Crawley et al (2002) has reported on a data analysis method that accurately predicts regions of copy number aberrations in hepatocellular carcinomas using only gene expression data. These investigations support the notion that gene expression data can be used as a window to the underlying genetic defects, and thus the idea that a combined analysis of gene expression data and CGH copy number data with the aim of identifying DNA markers is viable.

SUMMARY OF THE INVENTION

The present invention provides novel compositions and their use in classifying gliomas. In a preferred embodiment, the methods are used to discriminate between oligodendrogliomas and glioblastomas.

BRIEF DESCRIPTION OF THE FIGURES

FIGS. 1A-D describe the various marker genes and related genomic sequences.

FIGS. 2A-E provide data on the most accurate 5 reporter set glioma biomarkers.

DETAILED DESCRIPTION OF THE INVENTION

All publications, GenBank Accession references, references to bacterial artificial chromosome ("BAC") accession numbers (sequences), patents and patent applications cited herein are hereby expressly incorporated by reference for all purposes.

Within this application, unless otherwise stated, the techniques utilized may be found in any of several well-known references such as: *Molecular Cloning: A Laboratory Manual* (Sambrook, et al., 1989, Cold Spring Harbor Laboratory Press), *Gene Expression Technology* (Methods in Enzymology, Vol. 185, edited by D. Goeddel, 1991. Academic Press, San Diego, Calif.), "Guide to Protein Purification" in *Methods in Enzymology* (M. P. Deutshcer, ed., (1990) Academic Press, Inc.); *PCR Protocols: A Guide to Methods and Applications* (Innis, et al. 1990. Academic Press, San Diego, Calif.), *Culture of Animal Cells: A Manual of Basic Technique*, $2^{nd}$ Ed. (R. I. Freshney. 1987. Liss, Inc. New York, N.Y.), *Gene Transfer and Expression Protocols*, pp. 109-128, ed. E. J. Murray, The Humana Press Inc., Clifton, N.J.), and the Ambion 1998 Catalog (Ambion, Austin, Tex.).

The present invention provides novel compositions and methods for their use in classifying gliomas, particularly to distinguish between glioma types such as oligodendrogliomas and glioblastomas. Malignant gliomas are the most common primary brain tumor, and are classified histologically, with pathological diagnosis affecting prognostic estimation and therapeutic decision-making more than any other variable. (Nutt et al., Cancer Research 63:1602-1607 (2003)) Oligodendrogliomas, which are often chemosensitive, have a more favorable prognosis than glioblastomas, which are resistant to most available therapies. (Nutt, supra). Thus, the ability to more accurately classify gliomas into oligodendrogliomas and glioblastomas will provide information on glioma diagnosis, patient prognosis in the presence or absence of chemotherapy, a predicted optimal course for treatment of the patient, and patient life expectancy.

The inventors of the present invention have identified compositions to permit improved glioma classification over that possible using prior art diagnostic and predictive compositions and methods. Prior art methods for genetic-based prognosis have either focused on (a) analysis of expression or copy number of single gene or genomic region, which is likely to be relevant for only a small subset of tumors; or on (b) analysis of a large array of many genes or genomic regions, which are impractical for use in clinical diagnostic laboratories and most research facilities.

These compositions are defined relative to the following nucleic acid sequences that are identified herein as being useful as markers for glioma classification:

Gen Bank Accession No. X68194:*H.sapiens* h-Sp1 mRNA (SEQ ID NO:1)
Gen Bank Accession No.D80012:Human mRNA for KIAA0190 gene (SEQ ID NO:2)
Gen Bank Accession No. X69490:*H.sapiens* MRNA for titin (SEQ ID NO:3)
Gen Bank Accession No. AL050050:*Homo sapiens* mRNA; cDNA DKFZp566D133 (from clone DKFZp566D133) (SEQ ID NO:4)
Gen Bank Accession No. Z35491 :*H.sapiens* mRNA for novel glucocorticoid receptor-associated protein (SEQ ID NO:5)
Gen Bank Accession No. AB029003:*Homo sapiens* mRNA for KIAA1080 protein (SEQ ID NO:6)
Gen Bank Accession No. D87343:*Homo sapiens* mRNA for DCRA (SEQ ID NO:7)
Gen Bank Accession No. X17644:Human GST1-Hs mRNA for GTP-binding protein (SEQ ID NO:8)
Gen Bank Accession No. D13642:Human mRNA for KIAA0017 gene (SEQ ID NO:9)
Gen Bank Accession No. M80244:Human E16 Mrna (SEQ ID NO:10)
Gen Bank Accession No. M63175:Human autocrine motility factor receptor MRNA (SEQ ID NO:11)
Gen Bank Accession No. AJ009771:*Homo sapiens* MRNA for putative RING finger protein (SEQ ID NO:12)
Gen Bank Accession No. AB028985:*Homo sapiens* MRNA for KIAA1062 protein (SEQ ID NO:13)
Gen Bank Accession No. M81118:Human alcohol dehydrogenase chi polypeptide (ADH5) gene (SEQ ID NO:15)
Gen Bank Accession No. AF070596:*Homo sapiens* clone 24796 mRNA sequence (SEQ ID NO:16)
Gen Bank Accession No. AB018290:*Homo sapiens* mRNA for KIAA0747 protein (SEQ ID NO:17)
Gen Bank Accession No. AL050025:*Homo sapiens* mRNA; cDNA DKFZp564D066 (from clone DKFZp564D066) (SEQ ID NO:18)
Gen Bank Accession No. AC002394:Human Chromosome 16 BAC clone CIT987SK-A-211C6 (SEQ ID NO:19)
Gen Bank Accession No. AB011170:*Homo sapiens* mRNA for KIAA0598 protein (SEQ ID NO:20)

While statistically significant, we believe that the clinical diagnostic utility of subsets of these nineteen gene markers will be greater than the clinical diagnostic utility of individual genes. Such combinations consisting of more than two different probe sets may better classify the complexity of genomic aberrations associated with particular phenotypes in gliomas.

Many studies have demonstrated that when genomic regions are amplified (as in a tumor), the amplified region most commonly consists of a number of genes, in spite of the tendency to describe such amplified genomic regions in terms of a single gene. (Barlund et al., cancer Res. 2000 Oct. 1; 60(19):5340-4; Kauraniemi et al., Cancer Res. 2001 Nov 15; 61(22):8235-40; Pollack et al., 2002; Hyman et al., Cancer Res. 2002 Nov. 1; 62(21):6240-5; Monni et al., Proc. Natl. Acad. Sci. USA 2001 May 8; 98(10):5711-6). For example, a "her-2" amplified genomic region generally contains the her-2 gene and many flanking genes in the region of altered copy number. Physical distances between the genes used in these studies, as described in publicly available databases (for example, UCSC human genome web site at genome.ucsc.edu) reveals that, while the sizes of the altered copy number region vary among tumors, the size of an "average" altered copy number region is reasonably estimated as at least 1 megabase.

Thus, in a first aspect, the present invention provides compositions comprising a glioma biomarker, wherein the glioma biomarker consists of between 2 and 47 different probe sets, wherein at least 40% of the different probe sets comprise or consist of one or more isolated polynucleotides that selectively hybridize to a genomic region selected from the group consisting of 2q31.2; 4q23; 7q22.3; 9q31.2; 9p21-p13; 9q34.3; 10q26.13; 12q13.2; 14q13.2; 15q24.1; 15q22.2; 16q13.13; 16q22.1; 16q22.2; 16q24.1; 16q24.2; 16p12.2; 16p12.3; and 21q22.13; wherein the different probe sets in total selectively hybridize to at least two of the recited genomic regions.

The term "glioma biomarker" as used herein for all of the aspects and embodiments of the invention, refers to its use in classifying gliomas. The recited genomic regions correspond to the genomic position of the markers identified by the inventors of the present invention, which permit improved glioma classification over that possible using prior art diagnostic and predictive compositions and methods. FIG. 1 provides a detailed summary of the genes, their GenBank accession number, genomic region at which the genes are located, and the names and SEQ ID NOS. of bacterial artificial chromosomes ("BAC") that contain the gene (discussed in more detail below).

Thus, the compositions of the present invention are useful, for example, in classifying human gliomas. The compositions can be used, for example, to identify one or more genomic regions as present in an abnormal copy number (for example, more than two copies of the gene per cell in a chromosome spread or fewer than two copies) in a nucleic acid sample from a human specimen, such as brain tissue samples (including but not limited to biopsies and solid tumor samples), cerebrospinal fluid, blood samples, (such as blood smears), and bone marrow cells, with special attention given to circulating tumor cells that have been shed from a tumor.

Alternatively, certain embodiments of the compositions (as discussed in more detail below) can be used to classify gliomas by determining the expression levels in tissue of the mRNA encoded by the genes recited above.

The compositions according to each of the aspects and embodiments of the invention provide an improvement over prior art glioma classification compositions, which require many hundreds or thousands of probes to classify a glioma, and do so with reduced accuracy compared to the glioma biomarker of the present invention. As a result, the compositions of the present invention are much more amenable to use in clinical diagnostic testing than are prior art methods for glioma characterization.

The term "polynucleotide" as used herein with respect to each aspect and embodiment of the invention refers to DNA or RNA, preferably DNA, in either single- or double-stranded form. It includes the recited sequences as well as their complementary sequences, which will be clearly understood by those of skill in the art. The term "polynucleotide" encompasses nucleic acids containing known analogues of natural nucleotides which have similar or improved binding properties, for the purposes desired, as the reference polynucleotide. The term also encompasses nucleic-acid-like structures with synthetic backbones. DNA backbone analogues provided by the invention include phosphodiester, phosphorothioate, phosphorodithioate, methylphosphonate, phosphoramidate, alkyl phosphotriester, sulfamate, 3'-thioacetal, methylene(methylimino), 3'-N-carbamate, morpholino carbamate, and peptide nucleic acids (PNAs), methylphosphonate linkages or alternating methylphosphonate and phosphodiester linkages (Strauss-Soukup (1997) Biochemistry 36:8692-8698), and benzylphosphonate linkages, as discussed in U.S. Pat.

No. 6,664,057; see also Oligonucleotides and Analogues, a Practical Approach, edited by F. Eckstein, IRL Press at Oxford University Press (1991); Antisense Strategies, Annals of the New York Academy of Sciences, Volume 600, Eds. Baserga and Denhardt (NYAS 1992); Milligan (1993) J. Med. Chem. 36:1923-1937; Antisense Research and Applications (1993, CRC Press).

In each of the aspects and embodiments of the compositions and methods of the present invention, it is further preferred that the isolated polynucleotides are labeled with a detectable label. In a preferred embodiment, the detectable labels on the isolated polynucleotides in one probe set are all the same, and are distinguishable from the detectable labels on the isolated polynucleotides in the other probe sets in a given glioma biomarker. Such labeling of the isolated polynucleotides facilitates differential determination of the signals from different reporter sets in a given glioma biomarker. Useful detectable labels include but are not limited to radioactive labels such as $^{32}P$, $^{3}H$, and $^{14}C$; fluorescent dyes such as fluorescein isothiocyanate (FITC), rhodamine, lanthanide phosphors, Texas red, and ALEXIS™ (Abbott Labs), CY™ dyes (Amersham); electron-dense reagents such as gold; enzymes such as horseradish peroxidase, beta-galactosidase, luciferase, and alkaline phosphatase; colorimetric labels such as colloidal gold; magnetic labels such as those sold under the mark DYNABEADS™; biotin; dioxigenin; or haptens and proteins for which antisera or monoclonal antibodies are available. The label can be directly incorporated into the polynucleotide, or it can be attached to a molecule which hybridizes or binds to the polynucleotide. The labels may be coupled to the isolated polynucleotides by any means known to those of skill in the art. In a various embodiments, the isolated polynucleotides are labeled using nick translation, PCR, or random primer extension (see, e.g., Sambrook et al. supra). Methods for detecting the label include, but are not limited to spectroscopic, photochemical, biochemical, immunochemical, physical or chemical techniques.

An "isolated" polynucleotide as used herein for all of the aspects and embodiments of the invention is one which is separated from other nucleic acid molecules which are present in the natural source of the polynucleotide. Preferably, an "isolated" polynucleotide is free of sequences which naturally flank the polynucleotide in the genomic DNA of the organism from which the nucleic acid is derived, except as specifically described herein. Moreover, an "isolated" polynucleotide is substantially free of other cellular material, gel materials, and culture medium when produced by recombinant techniques, or substantially free of chemical precursors or other chemicals when chemically synthesized. The polynucleotides of the invention may be isolated from a variety of sources, such as by PCR amplification from genomic DNA, mRNA, or cDNA libraries derived from mRNA, using standard techniques; or they may be synthesized in vitro, by methods well known to those of skill in the art, as discussed in U.S. Pat. No. 6,664,057 and references disclosed therein. Synthetic polynucleotides can be prepared by a variety of solution or solid phase methods. Detailed descriptions of the procedures for solid phase synthesis of polynucleotide by phosphite-triester, phosphotriester, and H-phosphonate chemistries are widely available. (See, for example, U.S. Pat. No. 6,664,057 and references disclosed therein). Methods to purify polynucleotides include native acrylamide gel electrophoresis, and anion-exchange HPLC, as described in Pearson (1983) J. Chrom. 255:137-149. The sequence of the synthetic polynucleotides can be verified using standard methods.

As used herein with respect to all aspects and embodiments of the invention, a "probe set" refers to a group of one or more polynucleotides that each selectively hybridize to the same target (for example, a specific genomic region or mRNA) that correlates with glioma characterization, including glioma diagnosis, prognosis, and classification. Thus, a single "probe set" may comprise any number of different isolated polynucleotides that selectively hybridize to for a given target. For example, a probe set that selectively hybridizes to SEQ ID NO:10 may comprise probes for a single 100 nucleotide segment of SEQ ID NO:10, or for a 100 nucleotide segment of SEQ ID NO:10 and also a different 100 nucleotide segment of SEQ ID NO:10, or both these in addition to a separate 10 nucleotide segment of SEQ ID NO:10, or 500 different 10 nucleotide segments of SEQ ID NO:10 (such as, for example, fragmenting a larger probe into may individual short polynucleotides). Those of skill in the art will understand that many such permutations are possible.

In this first aspect, the glioma biomarker can be any glioma biomarker that contains between 2 and 47 probe sets as defined herein, wherein at least 40% of the probe sets comprise or consist of one or more isolated polynucleotides that selectively hybridize to one of the recited genomic regions. Such glioma biomarkers thus can contain other probe sets for use in glioma classification, diagnosis, or analysis, so long as at least 40% of the probe sets comprise one or more isolated polynucleotides that selectively hybridize to one of the recited genomic regions, and so long as no more than 47 probe sets are present in the glioma biomarker.

In preferred embodiments of the first aspect of the invention, at least 45%, 50%, 55%, 60%, 65%, 70%, 80%, 85%, 90%, 95%, or 100% of the probe sets comprise or consist of one or more isolated polynucleotides that selectively hybridize to one of the recited genomic regions. As will be apparent to those of skill in the art, as the percentage of probe sets that comprise or consist of one or more isolated polynucleotides that selectively hybridize to one of the recited genomic regions increases, the maximum number of probe sets in the glioma biomarker will decrease accordingly. Thus, for example, where at least 80% of the probe sets comprise or consist of one or more isolated polynucleotides that selectively hybridize to one of the recited genomic regions, the glioma marker will consist of between 2 and 23 probe sets. Those of skill in the art will recognize the various other permutations encompassed by the compositions according to the various aspects of the invention.

The composition of each aspect and embodiment of the invention may further comprise other polynucleotide components that are beneficial for use in combination with the glioma biomarker, such as competitor nucleic acids and other control sequences (such as sequences to provide a standard of hybridization for comparison, etc.) Such other polynucleotide components are not probe sets for purposes of the compositions and methods of the invention. The compositions may optionally comprise other components, including but not limited to buffer solutions, hybridization solutions, and reagents for storing the nucleic acid compositions.

As used herein with respect to each aspect and embodiment of the invention, the term "selectively hybridizes" means that the isolated polynucleotides bind to the particular genomic region or other target to form a hybridization complex, and minimally or not at all to other sequences. The exact conditions used will depend on the length of the polynucleotide probes employed, their GC content, as well as various other factors as is well known to those of skill in the art. (See, for example, Tijssen (1993) Laboratory Techniques in Biochemistry and Molecular Biology—Hybridization with Nucleic Acid Probes part I, chapt 2, "Overview of principles of hybridization and the strategy of nucleic acid probe assays," Elsevier, N.Y. ("Tijssen")). In one embodiment, stringent hybridization and wash conditions are selected to be about 5° C. lower than the thermal melting point (Tm) for the specific sequence at a defined ionic strength and pH. The Tm is the temperature (under defined ionic strength and pH) at which 50% of the target sequence hybridizes to a perfectly matched probe. High stringency conditions are selected to be equal to the Tm for a particular probe. An example of stringent conditions are those that permit selective hybridization of the isolated polynucleotides to the genomic or other target nucleic acid to form hybridization complexes in 0.2×SSC at 65° C. for a desired period of time, and wash conditions of 0.2×SSC at 65° C. for 15 minutes. It is understood that these conditions may be duplicated using a variety of buffers and temperatures. SSC (see, e.g., Sambrook, Fritsch, and Maniatis, in: Molecular Cloning, A Laboratory Manual, Cold Spring Harbor Laboratory Press, 1989) are well known to those of skill in the art, as are other suitable hybridization buffers.

In various preferred embodiments of this first aspect of the invention, the glioma biomarker includes three, four, five, six, seven, eight, nine, ten, eleven, twelve, thirteen, fourteen, fifteen, sixteen, seventeen, eighteen, or nineteen different probe sets that comprise one or more isolated polynucleotides that selectively hybridize to a genomic region selected from the group consisting of 2q31.2; 4q23; 7q22.3; 9q31.2; 9p21-p13; 9q34.3; 10q26.13; 12q13.2; 14q13.2; 15q24.1; 15q22.2; 16q13.13; 16q22.1; 16q22.2; 16q24.1; 16q24.2; 16p12.2; 16p12.3; and 21q22.13, wherein the different probe sets in total selectively hybridize to at least three, four, five, six, seven, eight, nine, ten, eleven, twelve, thirteen, fourteen, fifteen, sixteen, seventeen, eighteen, or nineteen of the recited genomic regions. In each of these embodiments, it is further preferred that at least 45%, 50%, 55%, 60%, 65%, 70%, 80%, 85%, 90%, 95%, or 100% of the probe sets for a given glioma biomarker comprise or consist of one or more isolated polynucleotides that selectively hybridize to one of the recited genomic regions.

Those of skill in the art are aware that multiple resources are available to identify specific nucleotide sequences associated with these genomic regions. In one example, such sequences can be found as follows:

Go to the UCSC web site at, genome.ucsc.edu/index.html?org=Human. At this site, select the Genome Browser on the menu at the left. Then in the "position" field enter, (in this format, e.g. for chromosome 16p13): 16:11,000,000-12,000,000 and then select "jump" (position entries have to be either by gene name, clone name, accession number, etc. or base pair position, usually in millions) Once the image of the chromosome is in view, which has the base pairs at the top of the image, and the chromosome bands immediately below, the navigation tools can be used to zoom in or out, move to the left or right as necessary. To get to the sequence itself (for 16p13 as an example), select the band designation within the image, which leads to the "Chromosome Bands Localized by FISH Mapping Clones (p13.2)" page, which has the "View DNA for this feature" button. Choose the "View DNA . . ." button which leads to the "Get DNA in Window". At the bottom of that page choose the "Get DNA" button, and the sequence appears. At the very top of the sequence page the exact base pairs are shown.

Those of skill in the art will understand how to apply this disclosure to identify nucleotide sequences with other genomic regions of interest.

In a second aspect, the invention provides compositions comprising a glioma biomarker consisting of between 2 and 47 different probe sets, wherein at least 40% of the different probe sets comprise one or more isolated polynucleotide sequences that selectively hybridize to a nucleic acid sequence according to formula 1, or its complement:

X1-X2-X3 wherein X2 is a human genomic nucleic acid sequence selected from the group consisting of SEQ ID NO: 19, SEQ ID NO:21 to SEQ ID NO:47, and SEQ ID NO:49-57 (see FIG. 1); and wherein X1 and X3 are independently 0-500 kB of human genomic nucleic acid sequences flanking X2 in the human genome; and wherein the different polynucleotide probe sets in total selectively hybridize to at least two non-overlapping genomic sequences according to formula 1.

SEQ ID NO: 19, SEQ ID NO:21 to SEQ ID NO:47, and SEQ ID NO:49-57 provide the human genomic sequence encompassing the marker genes (and portions of the genomic regions of the first aspect of the invention) discussed above, cloned into BAC vectors. (See FIG. 1) As will be apparent to those of skill in the art in reviewing FIG. 1, genomic regions for each of the cloned markers for glioma classification described above (SEQ ID NO:1-13 and 15-20) are disclosed as SEQ ID NO: 19, SEQ ID NO:21 to SEQ ID NO:47, and SEQ ID NO:49-57. For some of the 19 cloned markers, multiple overlapping BAC insert sequences are provided (see, for Example, SEQ ID NOS:23-25, which are overlapping genomic fragments that each include at least a portion of the gene for KIAA0190 (SEQ ID NO:2).

In various preferred embodiments of this second aspect of the invention, the glioma biomarker consists of three, four, five, six, seven, eight, nine, ten, eleven, twelve, thirteen, fourteen, fifteen, sixteen, seventeen, eighteen, or nineteen different probe sets that selectively hybridize to a nucleic acid sequence according to formula 1, or its complement. In each of these embodiments, it is further preferred that at least 45%, 50%, 55%, 60%, 65%, 70%, 80%, 85%, 90%, 95%, or 100% of the probe sets for a given glioma biomarker comprise or consist of one or more isolated polynucleotides that selectively hybridize to a nucleic acid sequence according to formula 1, or its complement, wherein the different polynucleotide probe sets in total selectively hybridize to at least three, four, five, six, seven, eight, nine, ten, eleven, twelve, thirteen, fourteen, fifteen, sixteen, seventeen, eighteen, or nineteen non-overlapping genomic sequences according to formula 1.

As will be apparent to those of skill in the art, as the percentage of probe sets that comprise or consist of one or more isolated polynucleotides that selectively hybridize to a nucleic acid sequence according to formula 1, or its complement, the maximum number of probe sets in the glioma biomarker will decrease accordingly. Thus, for example, where at least 80% of the probe sets comprise or consist of one or more isolated polynucleotides that selectively hybridize to a nucleic acid sequence according to formula 1, or its complement, the glioma marker will consist of between 2 and 23 probe sets. Those of skill in the art will recognize the various other permutations encompassed by the compositions according to the various embodiments of the second aspect of the invention.

In a further preferred embodiment of each of the above embodiments of the second aspect of the invention, X1 and X3 are 0.

In a preferred embodiment of the various embodiments of the second aspect of the invention, the different probe sets of a glioma biomarker comprise or consist of one or more polynucleotide sequences of at least 10 nucleotides of a nucleic acid sequence according to formula 1, or its complement. In a further preferred embodiment, of each of the above embodiments, X1 and X3 are 0.

In various further preferred embodiments of each of the above embodiments of the first and second aspects of the invention, the polynucleotides in the probe set independently comprise or consist of at least 10, 15, 20, 25, 30, 35, 40, 45, 50, 55, 60, 65, 70, 75, 80, 85, 90, 95, 100, 150, 200, 250, 300, 350, 400, 450, 500, 550, 600, 650, 700, 750, 800, 850, 900, 950, 1000, 1100, 1200, 1300, 1400, 1500, 1600, 1700, 1800, 1900, 2000, 2100, 2200, 2300, 2400, 2500, 2600, 2700, 2800, 2900, 3000, 3100, 3200, 3300, 3400, 3500, 3600, 3700, 3800, 3900, 4000, 4100, 4200, 4300, 4400, 4500, 4600, 4700, 4800, 4900, 5000, 5100, 5200, 5300, 5400, 5500, 5600, 5700, 5800, 5900, 6000, 6100, 6200, 6300, 6400, 6500, 6600, 6700, 6800, 6900, 7000, 7100, 7200, 7300, 7400, 7500, 7600, 7700, 7800, 7900, 8000, 8100, 8200, 8300, 8400, 8500, 8600, 8700, 8800, 8900, 9000, 9100, 9200, 9300, 9400, 9500, 9600, 9700, 9800, 9900, 10,000; 15,000; 20,000; 25,000; 30,000; 35,000; 40,0000; 45,000; 50,000; 60,000; 70,000; 80,000; 90,000; 100,000; 110,000; 120,000; 130,000; 140,000; 150,000; 160,000; 170, 000; 180,000; 190,000; 200,000; 210,000; or 220,000 nucleotides of the relevant sequence.

The BACS disclosed herein are as defined on the University of California at Santa Cruz (UCSC) Genome Browser on the Human April 2003 Freeze and are available from the Children's Hospital Oakland Research Institute (CHORI) at www.bacpac.chori.org. The human genomic inserts cloned into the BACS disclosed herein range in size from approximately 100 kB to 220 kB in length. The applicants have also provided a sequence listing that contains the sequence of the human genomic insert cloned into the BACs disclosed herein.

The BACs in this application are included in the "32K BAC re-array" at CHORI. To get to the 32K re-array, the CHORI BACPAC Resources Center (BPRC) can be accessed at the web site bacpac.chori.org/. Choose "Libraries" from the "Quick Links" menu on CHORI web page to get to the "Library Resources" page. On the "Library Resources" page, select "-By library type" and then select: "BAC Rearray CHORI-Human 32K Set: Chromosome Specific Rearray set." This takes you to the "Human genome high-resolution BAC re-arrayed clone set (the "32k set")" page. On that page, under: "Related Links:" select "bcgsc.ca/lab/mapping/bacrearray/human/," which takes you to: Canada's Michael Smith Genome Sciences Center "Full-Genome BAC Rearrays" page. At the very bottom of that page is a browser link to the UCSC Genome page. Select the word "browse" in the "Browser" paragraph, which returns to the UCS site. Enter the accession number in the "position" field (e.g. enter "X68194"), select "jump" and the BACs that contain that accession number will automatically show up. Select the BAC clone of interest. For example, selecting "RP11-193P05" leads to the Custom Track" for that BAC. On the Custom Track page are the position numbers for that BAC (e.g. Position: "chr7:105166071-105313293", (and other information) and a link to view The DNA: "View DNA for this feature". Choose the "View DNA" link to get to the "Get DNA for" page, and then choose the "get DNA" button on the bottom of that page. The complete sequence for that BAC is retrieved. One exception: UCSC doesn't find accession number M81118; this can be found by searching "ADH5", and choosing the "chi" subunit.

Furthermore, human genomic nucleic acid sequences flanking the genomic sequence cloned in the BAC of interest can also be retrieved as follows:

Once the BAC of interest has been found in the database, as described above, the sequence of each BAC be found by selecting the name of the BAC. The first click connects to a "Custom Track" for that BAC. On the Custom Track page there is an option called "View DNA for this feature", which is a link to the "Get DNA" window, for that specific BAC. Once the "Get DNA" page for a specific BAC has been called up, the "Get DNA" button retrieves the complete DNA sequence for that BAC clone. Furthermore, sequences flanking the BAC of interest can also be retrieved from the "Get DNA" page by using "Sequence Retrieval Option": the number of bases desired both upstream and downstream of the BAC are entered and, and those flanking sequences are then retrieved along with the sequence of the BAC itself. Furthermore, the detailed information on the BACS provided herein discloses the genomic location in terms of base pair position of the human genomic insert cloned in BACS as of the Human April 2003 Freeze.

As will be understood by those of skill in the art, the human genome sequence is frequently updated, with the updates made available to the public. Those of skill in the art will thus be able to identify the human genomic nucleic acid sequences flanking the genomic sequence cloned in the BAC of interest and disclosed herein by accessing the human genome information at (e.g. http://genome.ucsc.edu/). Therefore, the "flanking sequences" as recited herein refer to flanking sequences as disclosed on the web sites provided above, as well as updates thereto. For example, one can go to the CHORI site as disclosed above and review the BAC information as of the Human April 2003 Freeze to get the relative base pair position on the chromosome that the human genomic insert cloned in a BAC of interest was derived from. By reviewing the human genome sequence data available as of the Human April 2003 Freeze (as described above), one of skill in the art can obtain the nucleic acid sequences flanking the human genomic insert cloned in a BAC of interest disclosed herein. Those of skill in the art can further use this sequence to identify human genomic nucleic acid sequences flanking the human genomic insert cloned in a BAC of interest from this same site as currently updated in the human genome sequence.

In a third aspect, the present invention provides compositions comprising a glioma biomarker consisting of between 2 and 47 different probe sets, wherein at least 40% of the different probe sets comprise one or more isolated polynucleotides that selectively hybridize to a nucleic acid sequence according to one of SEQ ID NO:1-13 and 15-20 or their complements; wherein the different probe sets in total selectively hybridize to at least two of the recited nucleic acid sequences according to SEQ ID NO:1-13 and 15-20 or their complements.

In various preferred embodiments of the third aspect of the invention, the composition comprises a glioma biomarker consisting of three, four, five, six, seven, eight, nine, ten, eleven, twelve, thirteen, fourteen, fifteen, sixteen, seventeen, eighteen, or nineteen different probe sets that selectively hybridize to a nucleic acid sequence according to one of SEQ ID NO:1-13 and 15-20 or their complements, wherein the different probe sets in total selectively hybridize to at least three, four, five, six, seven, eight, nine, ten, eleven, twelve, thirteen, fourteen, fifteen, sixteen, seventeen, eighteen, or nineteen of the recited nucleic acid sequences according to SEQ ID NO:1-13 and 15-20 or their complements. In each of these embodiments, it is further preferred that at least 45%, 50%, 55%, 60%, 65%, 70%, 80%, 85%, 90%, 95%, or 100% of the probe sets for a given glioma biomarker comprise or consist of one or more isolated polynucleotides that selectively hybridize to a nucleic acid sequence according to SEQ ID NO:1-13 and 15-20, or their complements. As will be apparent to those of skill in the art, as the percentage of probe sets that comprise or consist of one or more isolated polynucleotides that selectively hybridize to a nucleic acid sequence according to SEQ ID NO:1-13 and 15-20, or their complements, the maximum number of probe sets in the glioma biomarker will decrease accordingly. Thus, for example, where at least 80% of the probe sets comprise or consist of one or more isolated polynucleotides that selectively hybridize to a nucleic acid sequence according to SEQ ID NO:1-13 and 15-20, or their complements, the glioma marker will consist of between 2 and 23 probe sets. Those of skill in the art will recognize the various other permutations encompassed by the compositions according to the various embodiments of the third aspect of the invention.

In a preferred embodiment of the various embodiments of the third aspect of the invention, the different probe sets of a glioma biomarker comprise or consist of one or more polynucleotide sequences of at least 10 nucleotides of a nucleic acid sequence according to SEQ ID NO:1-13 and 15-20, or their complements.

The nucleic acid compositions of this third aspect of the invention are especially preferred for analysis of RNA expression from the genes in a tissue of interest, such as brain tissue samples (including but not limited to biopsies and solid tumor samples), cerebrospinal fluid, blood samples, (such as blood smears), and bone marrow cells, with special attention given to circulating tumor cells that have been shed from a tumor. Such polynucleotides according to this aspect of the invention can be of any length that permits selective hybridization to the nucleic acid of interest. In various preferred embodiments, the isolated polynucleotides according to this aspect comprise or consist of at least 10, 15, 20, 25, 30, 35, 40, 45, 50, 55, 60, 65, 70, 75, 80, 85, 90, 95, 100, 150, 200, 250, 300, 350, 400, 450, 500, 550, 600, 650, 700, 750, 800, 850, 900, 950, or 1000 nucleotides according to a nucleic acid sequence selected from the group consisting of SEQ ID NO:1-13 and 15-20, or their complements. In a further embodiment of this aspect of the invention, an isolated polynucleotide according to this third aspect of the invention comprise or consist of a nucleic acid sequence according to one of SEQ ID NO:1-13 and 15-20, or their complements.

FIG. 2 provides a ranking of the overall accuracy in classifying gliomas of preferred combinations of 5 gene marker sets. Thus, in a further embodiment of each of the above aspects and embodiments, the glioma biomarkers include reporter sets to selectively hybridize to each of the genes, their corresponding BAC sequences, or the corresponding genomic regions (compare FIGS. 1 and 2) present in one of marker sets 1 to 50 shown in FIG. 2.

The compositions of the various aspects and embodiments of the invention can be in lyophilized form, or preferably comprise a solution containing the isolated polynucleotides, including but not limited to buffer solutions, hybridization solutions, and solutions for keeping the compositions in storage. Such a solution can be made as such, or the composition can be prepared at the time of hybridizing the polynucleotides to a target sequence, as discussed below.

Alternatively, the compositions can be placed on a solid support, such as in a microarray, bead, or microplate format. The term "microarray" as used herein is a plurality of probe sets immobilized on a solid surface to which sample nucleic acids are hybridized (such as glioma MRNA or derived cDNA).

Thus, in a fourth aspect, the present invention provides microarrays comprising a support structure on which are arrayed probe sets according to the compositions of the invention, as disclosed above. In this aspect, a single probe set can be present at a single location on the array, or different polynucleotides from a single probe set can be present at different and defined locations on the array.

In this aspect, the polynucleotides are immobilized on a microarray solid surface. Other nucleic acid sequences, such as reference or control nucleic acids, can be optionally immobilized on the solid surface as well. Methods for immobilizing nucleic acids on a variety of solid surfaces are well known to those of skill in the art. A wide variety of materials can be used for the solid surface. Examples of such solid surface materials include, but are not limited to, nitrocellulose, nylon, glass, quartz, diazotized membranes (paper or nylon), silicones, polyformaldehyde, cellulose, cellulose acetate, paper, ceramics, metals, metalloids, semiconductor materials, coated beads, magnetic particles; plastics such as polyethylene, polypropylene, and polystyrene; and gel-forming materials, such as proteins (e.g., gelatins), lipopolysaccharides, silicates, agarose and polyacrylamides.

A variety of different materials may be used to prepare the microarray solid surface to obtain various properties. For example, proteins (e.g., bovine serum albumin) or mixtures of macromolecules (e.g., Denhardt's solution) can be used to minimize non-specific binding, simplify covalent conjugation, and/or enhance signal detection. If covalent bonding between a compound and the surface is desired, the surface will usually be functionalized or capable of being functionalized. Functional groups which may be present on the surface and used for linking include, but are not limited to, carboxylic acids, aldehydes, amino groups, cyano groups, ethylenic groups, hydroxyl groups, and mercapto groups. Methods for linking a wide variety of compounds to various solid surfaces are well known to those of skill in the art.

In a preferred embodiment of this fourth aspect, the locations on the array containing probe sets of the present invention range in size between 1 µm and 1 cm in diameter, more preferably between 1 µm and 5 mm in diameter, and even more preferably between 5 µm and 1 mm in diameter. The polynucleotides of the probe sets may be arranged on the solid surface at different densities, depending on factors such as the nature of the label, the solid support, and the size of the polynucleotide. One of skill will recognize that each location on the microarray may comprise a mixture of polynucleotides of different lengths and sequences from a given probe set. The length and complexity of the polynucleotides fixed onto the locations can be adjusted to provide optimum hybridization and signal production for a given hybridization procedure, and to provide the required resolution.

In a fifth aspect, the present invention provides methods for classifying a glioma, comprising (a) contacting a nucleic acid sample obtained from a subject having a glioma with nucleic acid probes that, in total, selectively hybridize to two or more genomic regions selected from the group consisting of 2q31.2; 4q23; 7q22.3; 9q31.2; 9p21-p13; 9q34.3; 10q26.13; 12q13.2; 14q13.2; 15q24.1; 15q22.2; 16q13.13; 16q22.1; 16q22.2; 16q24.1; 16q24.2; 16p12.2; 16p12.3; and 21q22.13; wherein the contacting occurs under conditions to promote selective hybridization of the one or more nucleic acid probes to the two or more genomic regions;

(b) detecting formation of hybridization complexes;

(c) determining whether one or more of the genomic regions are present in an altered copy number in the nucleic acid sample; and (d) correlating a decreased copy number of one or more of the genomic regions with a classification of the glioma as an oligodendroglioma, and correlating an absence of decreased copy number for one or more of the genomic regions with a classification of the glioma as a glioblastoma.

Further optional steps can include, but are not limited to, pre-hybridization of the nucleic acid sample and use of competitor nucleic acids.

The nucleic acid sample used in the methods of the present invention can be from any source useful in characterizing a glioma, including but not limited to brain tissue samples (including but not limited to biopsies and solid tumor samples), cerebrospinal fluid, blood samples, (such as blood smears), and bone marrow cells, with special attention given to circulating tumor cells that have been shed from a tumor. The nucleic acid sample is preferably a cellular DNA or RNA sample, such as a sample prepared for in situ hybridization.

In the fifth aspect of the invention, a decreased copy number of one or more of the genomic regions correlates with a classification of the glioma as an oligodendroglioma, and an absence of decreased copy number for one or more of the genomic regions correlates with a classification of the glioma as a glioblastoma Thus, the methods of this aspect of the invention provide the ability to more accurately classify gliomas into oligodendrogliomas and glioblastomas, and provide information on glioma diagnosis, patient prognosis in the presence or absence of chemotherapy, a predicted optimal course for treatment of the patient, and patient life expectancy. For example, classification of the glioma as an oligodendroglioma indicates that the patient is more likely to respond to chemotherapy treatment then if the glioma was classified as a glioblastoma.

Thus, the invention further provides methods for treating a glioma patient, comprising carrying out the methods for classifying a glioma according to the different aspects and embodiments of the present invention, and then determining a course of treatment based on the results of the classification.

In various preferred embodiments of the methods of the fifth aspect of the invention, the nucleic acid probes are selected from the various aspects and embodiments of the compositions disclosed above. In a most preferred embodiment, the polynucleotides of the probe sets comprise a detectable label, as disclosed above, and in particular the different probe sets comprise distinguishable detectable labels, to facilitate analysis of which genomic region(s) is/are the site of the an altered copy number.

In various other preferred embodiments of the methods of the invention, the one or more nucleic acid probes, in total, selectively hybridize to three, four, five, six, seven, eight, nine, ten, eleven, twelve, thirteen, fourteen, fifteen, sixteen, seventeen, eighteen, or nineteen genomic regions selected from the group consisting of 2q31.2; 4q23; 7q22.3; 9q31.2; 9p21-p13; 9q34.3; 10q26.13; 12q13.2; 14q13.2; 15q24.1; 15q22.2; 16q13.13; 16q22.1; 16q22.2; 16q24.1; 16q24.2; 16p12.2; 16p12.3; and 21q22.13; wherein the contacting occurs under conditions to promote selective hybridization of the one or more nucleic acid probes to the three, four, five, six, seven, eight, nine, ten, eleven, twelve, thirteen, fourteen, fifteen, sixteen, seventeen, eighteen, or nineteen genomic regions. This is preferably accomplished using nucleic acid probes selected from the compositions of the various aspects and embodiments thereof disclosed above.

Any conditions, including hybridization reagents and wash conditions to remove unbound probe, in which the nucleic acid probes bind selectively to the target in the nucleic acid sample in the nucleic acid sample to form a hybridization complex, and minimally or not at all to other sequences, can be used in the methods of the present invention, as discussed above.

Any method for detecting formation of hybridization complexes and determining an alteration in gene copy number can be used, including but not limited to in situ hybridization (such as fluorescent in situ hybridization (FISH)), polymerase chain reaction (PCR) analysis, reverse transcription polymerase chain reaction (RT-PCR) analysis, Southern blotting, Northern blotting, array-based methods, and/or comparative genomic hybridization.

In a preferred embodiment, detection is performed by in situ hybridization ("ISH"). In situ hybridization assays are well known to those of skill in the art. Generally, in situ hybridization comprises the following major steps (see, for example, U.S. Pat. No. 6,664,057): (1) fixation of tissue, biological structure, or nucleic acid sample to be analyzed; (2) pre-hybridization treatment of the tissue, biological structure, or nucleic acid sample to increase accessibility of the nucleic acid sample (within the tissue or biological structure in those embodiments), and to reduce nonspecific binding; (3) hybridization of the probe to the nucleic acid sample; (4) post-hybridization washes to remove probe not bound in the hybridization and (5) detection of the hybridized nucleic acid fragments. The reagent used in each of these steps and their conditions for use varies depending on the particular application. In a particularly preferred embodiment, ISH is conducted according to methods disclosed in U.S. Pat. Nos. 5,750,340 and/or 6,022,689, incorporated by reference herein in their entirety.

In a typical in situ hybridization assay, cells are fixed to a solid support, typically a glass slide. The cells are typically denatured with heat or alkali and then contacted with a hybridization solution to permit annealing of labeled probes specific to the target nucleic acid sequence. The polynucleotides of the invention are typically labeled, as discussed above. In some applications it is necessary to block the hybridization capacity of repetitive sequences. In this case, human genomic DNA or Cot-1 DNA is used to block nonspecific hybridization.

In a further embodiment, an array-based format can be used in which the polynucleotides of the invention can be arrayed on a surface and the human nucleic sample is hybridized to the polynucleotides on the surface. In this type of format, large number of different hybridization reactions can be run essentially "in parallel." This provides rapid, essentially simultaneous, evaluation of a large number of nucleic acid probes. Methods of performing hybridization reactions in array based formats are also described in, for example, Pastinen (1997) Genome Res. 7:606-614; (1997) Jackson (1996) Nature Biotechnology 14:1685; Chee (1995) Science 274:610; WO 96/17958. Methods for immobilizing the polynucleotides on the surface and derivatizing the surface are known in the art; see, for example, U.S. Pat. No. 6,664,057, and are also described above.

In a sixth aspect, the present invention provides methods for classifying a glioma comprising:

(a) contacting a mRNA-derived nucleic acid sample obtained from a subject having a glioma with nucleic acid probes that, in total, selectively hybridize to two or more nucleic acid target sequences selected from the group consisting of SEQ ID NO:1-13 and 15-20 or their complements; wherein the contacting occurs under conditions to promote selective hybridization of the nucleic acid probes to the nucleic acid target sequences, or their complements, present in the nucleic acid sample;

(b) detecting formation of hybridization complexes between the nucleic acid probes to the nucleic acid target sequences, or their complements, wherein a number of such hybridization complexes provides a measure of gene expression of the one or more nucleic acid sequences according to SEQ ID NO:1-13 and 15-20; and (c) correlating a decrease in gene expression of the one or more nucleic acid sequences according to SEQ ID NO:1-13 and 15-20 relative to control with a classification of the glioma as an oligodendroglioma, and correlating a lack of increase in gene expression of the one or more nucleic acid sequences according to SEQ ID NO:1-13 and 15-20 relative to control with a classification of the glioma as a glioblastoma.

The method according to the sixth aspect of the invention detects changes in gene expression of one or more of the markers according to SEQ ID NO:1-13 and 15-20 relative to a control (for example, glioblastoma and/or oligodendroglioma standards), with a decrease in expression relative to control correlating with a classification of the glioma as a oligodendroglioma, and no increase in expression correlating with a classification of the glioma as an glioblastoma.

Thus, the methods of this aspect of the invention provide the ability to more accurately classify gliomas into oligodendrogliomas and glioblastomas, and provide information on glioma diagnosis, patient prognosis in the presence or absence of chemotherapy, a predicted optimal course for treatment of the patient, and patient life expectancy. For example, classification of the glioma as an oligodendroglioma indicates that the patient is more likely to respond to chemotherapy treatment then if the glioma was classified as a glioblastoma.

Thus, the invention further provides methods for treating a glioma patient, comprising carrying out the methods for classifying a glioma according to the different aspects and embodiments of the present invention, and then determining a course of treatment based on the results of the classification.

The mRNA-derived nucleic acid sample used in the methods of the present invention can be MRNA or cDNA derived from the mRNA. The nucleic acid sample used in the methods of the present invention can be from any source useful in characterizing a glioma, including but not limited to brain tissue samples (including but not limited to biopsies and solid tumor samples), cerebrospinal fluid, blood samples, (such as blood smears), and bone marrow cells, with special attention given to circulating tumor cells that have been shed from a tumor. The nucleic acid sample is preferably a cellular DNA or RNA sample, such as a sample prepared for in situ hybridization.

In various preferred embodiments of the methods of the sixth aspect of the invention, the nucleic acid probes are selected from the various aspects and embodiments of the compositions disclosed above, particularly the-third aspect of the invention and preferred embodiments thereof. In a most preferred embodiment, the polynucleotides of the probe sets comprise a detectable label, as disclosed above, and in particular the different probe sets comprise distinguishable detectable labels, to facilitate analysis of which genomic region(s) is/are the site of the altered copy number.

In various other preferred embodiments, the nucleic acid probes in total selectively hybridize to three, four, five, six, seven, eight, nine, ten, eleven, twelve, thirteen, fourteen, fifteen, sixteen, seventeen, eighteen, or nineteen different nucleic acid sequences according to SEQ ID NO:1-13 and 15-20 or their complements. Such probes according to this aspect of the invention can be of any length that permit selective hybridization under stringent conditions to the nucleic acid of interest, and preferably are at least 10 nucleotides in length. In various further embodiments, the probes according to this embodiment are at least 15, 20, 25, 30, 35, 40, 45, 50, 55, 60, 65, 70, 75, 80, 85, 90, 95, 100, 150, 200, 250, 300, 350, 400, 450, 500, 550, 600, 650, 700, 750, 800, 850, 900, 950, 1000 nucleotides in length. In a further embodiment, the probes according to this aspect of the invention are complementary to the entire deposited nucleic acid sequence as deposited under the recited accession numbers. The probes of this embodiment may be RNA or DNA and may be single or double stranded.

In a most preferred embodiment of this aspect, the nucleic acid probes comprise or consist of single stranded anti-sense polynucleotides of the nucleic acid compositions of the invention. For example, in mRNA fluorescence in situ hybridization (FISH) (ie. FISH to detect messenger RNA), only an anti-sense probe strand hybridizes to the single stranded mRNA in the RNA sample, and in that embodiment, the "sense" strand oligonucleotide can be used as a negative control.

Alternatively, DNA probes can be used as probes, preferably those according to the compositions of the invention. In this embodiment, it is preferable to distinguish between hybridization to cytoplasmic RNA and hybridization to nuclear DNA. There are two major criteria for making this distinction: (1) copy number differences between the types of targets (hundreds to thousands of copies of RNA vs. two copies of DNA) which will normally create significant differences in signal intensities and (2) clear morphological distinction between the cytoplasm (where hybridization to RNA targets would occur) and the nucleus will make signal location unambiguous. Thus, when using double stranded DNA probes, it is preferred that the method further comprises distinguishing the cytoplasm and nucleus in cells being analyzed within the bodily fluid sample. Such distinguishing can be accomplished by any means known in the art, such as by using a nuclear stain such as Hoechst 33342, or DAPI which delineate the nuclear DNA in the cells being analyzed. In this embodiment, it is preferred that the nuclear stain is distinguishable from the detectable probes. It is further preferred that the nuclear membrane be maintained, i.e., that all the Hoechst or DAPI stain be maintained in the visible structure of the nucleus.

Hybridization conditions and other details of the methods of this aspect are as described above for altered copy number analysis. In a preferred embodiment, RNA FISH is employed using standard methods in the art.

In each of the above aspects and embodiments, detection of hybridization is typically accomplished through the use of a detectable label on the nucleic acid probes, such as those described above. The label can be directly incorporated into the polynucleotide, or it can be attached to a molecule which hybridizes or binds to the polynucleotide. The labels may be coupled to the probes in a variety of means known to those of skill in the art, as described above. In a preferred embodiment, the detectable labels on the different probe sets of the compositions of the invention are distinguishable from each other, as discussed above. The label can be detectable can be by any techniques, including but not limited to spectroscopic, photochemical, biochemical, immunochemical, physical or chemical techniques, as discussed above.

In a further aspect, the present invention provides kits for use in the methods of the invention, comprising the compositions of the invention and instructions for their use. In a preferred embodiment, the probe sets are labeled, preferably so as to distinguish different probe sets, as disclosed above. In a further preferred embodiment, the probe sets are provided in solution, most preferably in a hybridization buffer to be used in the methods of the invention. In a further embodiment, the probe sets are provided on a solid support, such as those described above. In further embodiments, the kit also comprises wash solutions and/or pre-hybridization solutions.

EXAMPLES

Integrated Analysis of Disparate Data Types

The end aim of our analysis method is to identify significant DNA markers of disease stage or progression. We employ a method similar to meta-analysis, a technique for increasing statistical power by combining the results of independent but related studies. Conceptually, gene expression data and comparative genomic hybridization ("CGH") data analyses may be thought of as independent processes, followed by integration of the results. In practice, the analyses are conducted in parallel. The steps involved include:
  Mapping CGH band-resolution data to gene-resolution
  Search through putative markers for markers informative in both datasets
  Computation of significance of discovered markers Example Glioma Diagnostic Markers Background As a demonstration, we have analyzed publicly available microarray gene expression and CGH data collected from glioma tissue samples. The gene expression data was collected by Nutt et al (2003) in a study aimed at identifying patterns discriminative between high-grade oligodendroglioma and glioblastoma. CGH data for these two glioma subtypes, obtained from the Progenetix CGH data repository (www.progenetix.net), was originally collected in two independent studies by Kros et al (1999) and Maruno et al (1999). The microarray dataset consists of expression values for 12,558 genes measured across 22 oligodendroglioma and 28 glioblastoma samples. The CGH data, collected from 9 oligodendroglioma and 8 glioblastoma samples, consists of identified regions of gains and losses binned at a resolution of 862 cytogenetic bands.

Analysis of CGH Data without Gene Expression Data

Ideograms corresponding to the two CGH datasets were analyzed. The 862 bands contained in these datasets were ranked according to differential DNA content between the glioma subtypes as measured by t-scores. We employed a sample label permutation test (1000 permutations) to access the significance of these scores. Our analysis of only the CGH data did not identify statistically significant univariate marker bands indicative of glioma subtype, with the most significant band reaching a p-value of only 0.22. This lack of significance is the result of the common CGH data analysis situation wherein there are relatively few samples and low incidence of specific copy number aberrations.

Integrated Analysis of CGH and Gene Expression Data

Next we investigated whether the addition of gene expression information to the CGH data would enable the identification of significant markers. The initial step required by our technique is the mapping of the CGH data to the resolution of the gene expression data. Specific cytogenetic band mappings were available for 7583 of the microarray probes, and CGH data for each band was mapped to an artificial gene-scale resolution by transferring the data for each band to all genes within that band.

Following this preprocessing step, gene markers were evaluated using a combination of t-scores computed independently in the gene expression and CGH datasets. In this demonstration, the test statistic is simply the sum of the t-scores. The significance of these combined scores was again determined with a sample label permutation test (1000 permutations). Nineteen gene markers, located on 11 unique chromosome arms, were found to be significant (p=0.05). The significant genomic regions are detailed in FIG. 1, together with further information about the gene markers and genomic regions containing them.

Based on the above analysis, we have identified the following genes showing statistical significance (p<0.05) as glioma markers (ie: they tend to be present in decreased copy number in oligodendrogliomas relative to glioblastomas, and they tend to be expressed at a lower level in oligodendrogliomas relative to glioblastomas), based on the combined analysis of CGH and gene expression data:

Gen Bank Accession No. X68194:*H.sapiens* h-Sp1 MRNA (SEQ ID NO:1)

Gen Bank Accession No.D80012:Human MRNA for KIAA0190 gene (SEQ ID NO:2)

Gen Bank Accession No. X69490:*H.sapiens* MRNA for titin (SEQ ID NO:3)

Gen Bank Accession No. AL050050:*Homo sapiens* mRNA; cDNA DKFZp566D133 (from clone DKFZp566D133) (SEQ ID NO:4)

Gen Bank Accession No. Z35491 :*H.sapiens* mRNA for novel glucocorticoid receptor-associated protein (SEQ ID NO:5)

Gen Bank Accession No. AB029003:*Homo sapiens* mRNA for KIAA1080 protein (SEQ ID NO:6)

Gen Bank Accession No. D87343:*Homo sapiens* mRNA for DCRA (SEQ ID NO:7)

Gen Bank Accession No. X17644:Human GST1-Hs mRNA for GTP-binding protein (SEQ ID NO:8)

Gen Bank Accession No. D13642:Human mRNA for KIAA0017 gene (SEQ ID NO:9).

Gen Bank Accession No. M80244:Human E16 Mma (SEQ ID NO:10)

Gen Bank Accession No. M63175:Human autocrine motility factor receptor mRNA (SEQ ID NO:11)

Gen Bank Accession No. AJ009771:*Homo sapiens* mRNA for putative RING finger protein (SEQ ID NO:12)

Gen Bank Accession No. AB028985:*Homo sapiens* mRNA for KIAA1062 protein (SEQ ID NO:13)

Gen Bank Accession No. M81118:Human alcohol dehydrogenase chi polypeptide (ADH5) gene (SEQ ID NO:15)

Gen Bank Accession No. AF070596:*Homo sapiens* clone 24796 mRNA sequence (SEQ ID NO:16)

Gen Bank Accession No. AB018290:*Homo sapiens* MRNA for KIAA0747 protein (SEQ ID NO:17)

Gen Bank Accession No. AL050025:*Homo sapiens* mRNA; cDNA DKFZp564D066 (from clone DKFZp564D066) (SEQ ID NO:18)

Gen Bank Accession No. AC002394:Human Chromosome 16 BAC clone CIT987SK-A-211C6 (SEQ ID NO:19)

Gen Bank Accession No. AB 011170:*Homo sapiens* MRNA for KIAA0598 protein (SEQ ID NO:20)

While statistically significant, we believe that the clinical diagnostic utility of subsets of these nineteen gene markers will be greater than the clinical diagnostic utility of individual genes. Thus we investigated the potential diagnostic utility of 5 marker reporter sets of these nineteen gene markers. A genetic algorithm global search technique was employed to determine the most accurate 5 reporter set glioma biomarker from all possible 5 reporter set combinations within the 19 gene markers identified herein. The 50 most accurate combinations are presented in FIG. 2. This exemplary data confirms that probe sets consisting of 5 genes are highly diagnostic in both the gene expression data and CGH data.

REFERENCES

Crawley J J, Furge K A. Identification of frequent cytogenetic aberrations in hepatocellular carcinoma using gene-expression microarray data. Genome Biol. 2002; 3(12)

Hyman E, Kauraniemi P, Hautaniemi S, Wolf M, Mousses S, Rozenblum E, Ringner M, Sauter G, Monni O, Elkahloun A, Kallioniemi O P, Kallioniemi A. Impact of DNA amplification on gene expression patterns in breast cancer. Cancer Res.2002 Nov. 1; 62(21):6240-5.

Kros J M, van Run P R, Alers J C, Beverloo H B, van den Bent M J, Avezaat C J, van Dekken H. Genetic aberrations in oligodendroglial tumours: an analysis using comparative genomic hybridization (CGH). J Pathol. 1999Jul.; 188(3): 282-8.

Maruno M, Yoshimine T, Muhammad A K, Ninomiya H, Kato A, Hayakawa T. Chromosomal aberrations detected by comparative genomic hybridization (CGH) in human astrocytic tumors. Cancer Lett.1999 Jan. 8; 135(1):61-6.

Nutt C L, Mani D R, Betensky R A, Tamayo P, Cairncross J G, Ladd C, Pohl U, Hartmann C, McLaughlin M E, Batchelor T T, Black P M, von Deimling A, Pomeroy S L, Golub T R, Louis D N. Gene expression-based classification of malignant gliomas correlates better with survival than histological classification. Cancer Res.2003 Apr. 1; 63(7): 1602-7.

Pollack J R, Sorlie T, Perou C M, Rees C A, Jeffrey S S, Lonning P E, Tibshirani R, Botstein D, Borresen-Dale A L, Brown P O. Microarray analysis reveals a major direct role of DNA copy number alteration in the transcriptional program of human gliomas. Proc Natl Acad Sci USA.2002 Oct. 1; 99(20): 12963-8.

Progenetix CGH online database. Baudis M. (2000-2003): www.progenetix.net.

SEQUENCE LISTING (57 sequences)

SEQ ID NO: 1 - DNA, 2130 bp, Homo sapiens
tgaaccgaggcaagggggcgcggcgcacgcagtatggcgcccaacatctacttggttcgccagcggatcagtcgactcggccagaggatgtccggcttccagatcaacctcaacccgctcaaggagccactcggcttcatcaaggtcctcgagtggattgcttctatctttgcttttgccacctgtggaggttttaagggccaaacagaaattcaagtgaattgtcctcctgcagttactgagaataaaactgttacagctacttttggttatccattcaggttgaatgaggcatcatttcagccacctccaggtgtaaacatatgtgatgtaaattggaaagattacgtcctcataggcgattactcttcttctgcacaattctatgttacctttgcagtctttgtgttcctgtactgcattgctgcccttctgctttatgttggctacacgagtctgtatctggatagtcgtaaacttcctatgatagactttgttgttacacttgttgccacttttttgtggttggtgagcacttcagcctgggctaaagctctgacagatattaaaatagctactggtcacaatattattgatgaacttccgccttgtaagaagaaagcagtactgtgttactttggctctgtgaccagtatgggatccctaaatgtatctgtgatatttggctttctaaatatgatactctggggaggaaatgcttggtttgtgtacaaggagaccagcctacacagtccatcaaatacatctgcccctcatagccaaggaggtattccacctcctaccggaatataattaaagggagaaatacactgtatgaagtatatgttgatactatgacatgttgccaacaccttgagaagcattatttgtttctaataaaagtaatggctttgtcaatatattggtgggtttaaaactttgctgcttttttacataaagcctgtgcctttcctagaaagttaagatgtaaatgtattctcacatgtaaatttgaaagttcaggggtctattatgaaatggattacacattttaaatgaacccataatttttttcactaaagctgtttgccctccaaagtgtttacacctaagcctaacatgtatcgctcattcagaaaactgttatattgtcataccatagtaggaagaaaaacctttatttggaatatacactactgtaagtttgtacagatcatatacctaccacctgtctttgcttaaagagccttgattacataaatatgtaggaaaaaacatattgagttcaaaatttatatctaacattgtttatgttatgattttttttaattgcaaagactaggtgtatatttttttctgtttttctaaatgacccgtggtacttaataggtgtactaaaattgtgttgggagcagggatttggaaatttctgagagatgtgtagttaattagtaattctgtttcatgagatatgatctgttatgctagtggtttaataggcttgctatgtaagtagaacgtggctcaactagatatcttatatgtatgggcattacctcttagtgatatttgtttcctgtcctttgttgctcatgctgtttaagtgcaggctgagacccagcctctttgtaagtacagtaaaataatccaccgttttttacagaccctagtcaaagggttaaaaaaattaagattgctttccatgtttgaaatttaccattgagagtcaatgaagttgctattttgagtttagcattgatattgtgaaaataagtgcaatttggatttcatgtttcttaatattcattcttgtttcacaaatgaatgattaaggaattatgcatcataaaggaacctaagtgaggtatatgatgagtgtattgtctttgcacacacatataggtatattctgaatacaagcttattcattttgcttcctaatctttttgttgtacagggattcaggtttcttattcttacaacatgattgtttatatgtgaagcacatcttgctgttgccttatttttgatgcttttattcatgacaagaattgtcaatataagaatgtatatctttgccgcaaccaatttaataaaggagttgaaagaaaaaaaaaaaaaaaaaaaaaa

SEQ ID NO: 2 - DNA, 3280 bp, Homo sapiens
gcgtgagcagccggaggatcgcggagtcccaatgaaacgggcagccatggccctccacagcccgcagtatatttttggagattttagccctgatgaattcaatcaattctttgtgactcctcgatcttcagttgagcttcctccatacagtggaacagttctgtgtggcacacaggctgtggataaactacctgatggacaagaatatcagagaattgagtttggtgtcgatgaagtcattgaacccagtgacactttgccgagaacccccagctacagtatttcaagcacactgaaccctcaggcccctgaatttattctcggttgtacagcttccaaaataacccctgatggtatcactaaagaagcaagctatggctccatcgactgccagtacccaggctctgccctcgctttggatggaagttctaatgtggaggcggaagttttggaaaatgatggtgtctcaggtggtcttggacaaagggagcgtaaaaagaagaaaaagcggccacctggatattacagctatttgaaagatggtggcgatgatagtatctccacagaagccctggtcaatggccatgccaattcagcagtcccgaacagtgtcagtgcagaggatgcagaatttatgggtgacatgcccccgtcagttacgcccaggacttgtaacagcccccagaactccacagactctgtcagtgacattgtgcctgacagtcctttccccggagcactcggcagtgacaccaggactgcagggcagccagaggggggccccggggctgattttggtcagtcctgcttccctgcagaggctggcagagacaccctgtcaaggacagctggggctcagccctgcgttggtaccgatactactgaaaaccttggagttgctaatggacaaatacttgaatcctcgggtgagggcacagctaccaacggggtggagttgcacaccacggaaagcatagacttggacccaaccaaacccgagagtgcatcacctcctgctgacggcacgggctctgcatcaggcacccttcctgtcagccagcccaagtcctgggccagcctctttcatgattctaagccctcttcctcctcgccggtggcctatgtggaaactaagtattcccctcccgccatatctcccctggtttctgaaaagcaggttgaagtcaaagaagggcttgttccggtttcagaggatcctgtagccataaagattgcagagttgctggagaatgtaaccctaatccataaaccagtgtcgttgcaaccccgtgggctgatcaataaagggaactggtgctacattaatgctacactgcaggcattggttgcttgcccgccgatgtaccacctgatgaagttcattcctctgtattccaaagtgcaaaggccttgtacgtcaacacccatgatagacagctttgttcggctaatgaatgagttcactaatatgccagtacctccaaaaccccgacaagctcttggagataaaatcgtgagggatattcgccctggagctgcctttgagcccacatatatttacagactcctgacagttaacaagtcaagcctgtctgaaaagggtcgacaagaagatgctgaggaatacttaggcttcattctaaatggacttcatgaggaaatgttgaacctaaagaagcttctctcaccaagtaatgaaaaacttacgatttccaacggccccaaaaaccactcggtcaatgaagaagagcaggaagaacaaggtgaaggaagcgaggatgaatgggaacaagtgggcccccggaacaagacttccgtcacccgccaggcggattttgttcagactccaatcaccggcatttttggtggacacatcaggtctgtggtttaccagcagagttcaaaagaatctgccactttgcagccatttttcacgttgcagttggatatccagtcagacaagatacgcacagtccaggatgcactggagagcttggtggcaagagaatctgtccaaggttataccacaaaaaccaaacaagaggttgagataagtcgaagagtgactctggaaaaactccctcctgtcctcgtgctgcacctgaaacgattcgtttatgagaagactggtgggtgccagaagcttatcaaaaatattgaatatcctgtggacttggaaattagtaaagaactgctttctccaggggttaaaaataagaattttaaatgccaccgaacctatcggctctttgcagtggtctaccatcacggcaacagtgcgacgggcggccattacactacagacgtcttccagatcggtctgaatggctggctgcgcatcgatgaccagacagtcaaggtgatcaaccagtaccaggtggtgaaaccaactgctgaacgcacagcctacctcctgtattaccgccgagtggacctgctgtaaaccctgtgtgcgctgtgtgtgcgcccagtgcccgcttcgtaggacaccacctcacactcacttcccgcctctctttagtggctctttagagagaaactctttctccctttgcaaaaatgggctagaatgaaaaggagatgccttggggttcgtgcacaacacagcttctgttgactctaacttccaaatcaaaatcatttggttgaaacagactgttgcttgattttagaaaatacacaaaaacccatatttctgaaataatgctgattcctgagataagaaagtggatttgatccccagtctcattgcttagtagaataaatcctgcaccagcaacaacacttgtaaatttgtgaaaatgaattttatctttccttaaaaaagaaattttttaatccatcacacttttcttccctaccctttagtttttgataaatgataaaaatgagccagttatcaaagaagaactagttcttacttcaaaagaaaaataaacataaaaaataagttgctggttcctaacaggaaaaattttaataattgtactgagagaaactgcttacgtacacattgcagatcaaatatttggagttaaaatgttagtctacatagatgggtgattgtaactttattgccattaaaagatttcaaattgcattcatgcttctgtgtacacataatgaaaaatgggcaaataatgaagatctctccttcagtctgctctgtttaattctgctgtctgctcttctctaatgctgcgtccctaattgtacacagtttagtgatatctaggagtataaagttgtcgcccatcaataaaaatcacaaagttggttt

SEQ ID NO: 3 - DNA, 14985 bp, Homo sapiens
cctaattacatagttgaaaagcgtgaatcgggtacaacagcttggcagcttgtcaattccagtgtcaagcgcactcaaattaaagtcactcatctcacaaaatacatggaatattctttccgtgtcagttcagagaacagatttggtgtcagcaaacctctagaatcagcaccaataattgctgaacatccatttgtcccaccaagcgctcctaccagacctgaggtctaccatgtgtctgccaatgccatgtctattcgttgggaagaaccctaccacgatggtggcagtaaaatcattggctactgggttgagaagaaagaacgtaatacaattctttgggtgaaagaaaacaaagtgccatgcttagagtgcaactacaaagtaactggtttagtagaaggactggaatatcagttcagaacttatgcactcaatgctgcaggtgttagcaaggccagcgaagcttcaagacctataatggctcaaaatccagttgatgcaccaggcagaccaggggtgacagatgtccaaagatcaacagtatcactgatttggtctgccccagcgtatgatggaggcagcaaggttgtgggctacatcatagagcgtaagccagtcagtgaggtaggagatggtcgctggctgaagtgcaactacaccattgtatctgacaatttcttcaccgtgactgctctcagtgaaggagacacttatgagttccgtgtgttagccaagaatgcagcaggcgtaattagcaaagggtctgaatctacaggccctgtcacttgccgagatgaatacgctccacccaaagccgaactggatgcccgattacacggtgatctggttaccatcagagcaggttctgatcttgttctggatgctgcagttggtggcaaacctgaacccaaaattatctggaccaaaggagacaaggagctagatctctgtgaaaaagtctctttgcagtatactggcaaacgagcaactgctgtgatcaagttctgtgacagaagtgacagtggaaaatacactttaacagtgaaaaatgccagcgggaccaaggccgtgtctgtcatggtcaaagtgcttgattcccctggcccatgtggaaagctcaccgtcagcagagtaacacaggagaagtgcactttagcctggagccttccgcaggaagacggaggagcagaaatcactcactacatcgtggaaagacgcgagactagcaggctcaactgggtgattgttgaaggcgaatgcccaaccctatcctatgtcgttaccaggctcatcaagaacaatgagtacatattccgagtgagggcagtaaacaaatatggccctggtgtgcctgttgaatcagagccaattgtagccagaaactcattcactattccatcaccacccggcatacctgaagaagttgggactggcaaagagcatatcatcattcagtggacaaaacctgaatctgatggtggcaatgaaatcagcaactacctagtagacaaacgtgagaaggagagcctgcgctggacacgtgtcaacaaagactatgtggtgtatgataccaggctgaaggtgaccagcctgatggagggttgtgattaccagttccgggtgaccgcagtgaatgcagctggtaacagtgagcccagcgaacgttccaacttcatctcatgcagagaaccatcatatacccctggaccaccttctgctccaagagttgtggataccaccaaacacagcattagtttggcatggaccaaacccatgtacgatggtggtactgacattgtaggatatgttctggaaatgcaagagaaggacactgatcagtggtaccgagtgcataccaatgccacaataagaaatactgaattcactgtgccagaccttaaaatgggccagaaatattccttcagagttgctgccgtgaacgtgaagggtatgagcgaatacagcgaatcaattgctgaaattgagcccgtggaaagaatagaaataccagatcttgagcttgcagatgatctaaagaagactgtgaccatcagggctggggcctccttgcgcttgatggtgtctgtatctggaagaccacctcctgtcataacgtggagcaagcagggcattgaccttgcaagccgggcaattattgacaccactgagagctactcattgctaatagtggacaaagttaatcggtacgatgctggaaaatacacaattgaagctgaaaaccaatctggcaagaaatcagcaacagtccttgttaaagtctatgatactcctggtccctgtccttcagtgaaagttaaggaagtatcaagagattctgtgactataacttgggaaattcccacgattgatggtggagctccaatcaacaattacatcgttgagaagcgtgaagctgctatgagagcattcaaaacagtaactaccaaatgcagcaagacactttacagaatttctggacttgtagaaggaaccatgcactatttcagagtgctgccagaaaatatttatggcattggagaaccttgtgaaacatctgatgcagtactggtctcagaagtgcctttggtgcctgcaaagctagaagtggtcgatgtcaccaaatccactgttacccttgcctgggaaaaaccactctacgatggtggtagccgactcactggatatgttctcgaggcctgcaaagctggcacagagagatggatgaaggttgtcaccttaaaacccacagtcctagagcacactgttacttccttaaatgaaggtgaacaatacttatttagaataagggcacaaaatgagaaaggtgtgtcagaaccaagagagactgtcacagccgtgactgtacaagacctcagagtgttgccaacaatcgatctttctacaatgcctcagaagaccatccatgtcccagctggcagaccagtagagctggtgatacctattgctggccgtccacctcctgctgcttcctggttctttgctggttctaaactgagagaatcagagcgtgtcacagttgaaactcacactaaagtagctaaattaaccatccgtgaaaccactatcagagatactggagaatacacacttgaattgaagaatgttaccggaactactttagaaaccattaaagttatcattcttgacaagcctggtccaccaacaggacctattaagattgatgaaattgatgctacatcaattaccatttcctgggaaccacctgaattggacggtggtgctccactgagtggttatgtggtagaacaacgtgacgctcatcgtccaggatggctgcccgtttctgaatcagtgactaggtccacgtttaagtttaccagactcaccgaaggaaatgagtatgtgttccgtgtggctgcaacaaaccgcttcgggattggctcttacttgcagtctgaggtcatagagtgtcgcagcagcatccgtattcctggacccccagaaacattacagatatttgatgtttcccgtgatggcatgacacttacttggtacccaccagaggatgacggtggctcccaagtgactggatatattgtggagcgcaaagaagtgagagcagatcgatgggtccgtgtaaataaagtacctgtgacaatgacacggtaccgctccactggccttactgaaggcttagaatatgaacaccgtgtcacagccattaatgcaagagggtctgggaaaccaagtcgtccttccaaacccatcgttgccatggatccaattgctcctccaggaaagccacaaaacccaagagttactgatacaacaaggacatcagtctccctggcctggagtgttccagaagatgaaggaggatctaaagtcacaggctacttgattgaaatgcaaaaagtagatcaacatgaatggaccaagtgtaacaccactccaaccaagattcgagagtatactctaacacacctacctcagggtgcagaatacaggttccgcgtcctagcttgtaatgctggtggacctggtgagcctgctgaggtaccaggaacagtcaaagtcactgaaatgcttgaatatcctgattatgaacttgatgaaagataccaagaaggtatctttgtaaggcaaggtggcgtcatcagacttaccataccaatcaaagggaaaccattcccaatatgtaaatggaccaaggaaggccaggatattagtaagcgtgccatgattgcaacatctgaaacacacactgagcttgtgatcaaagaagcagacaggggtgattctggcacttatgacctggttctggaaaataaatgtggcaagaaggctgtctacatcaaggtcagggtgataggaagtcccaacagtccagaagggccactggaatatgatgacatccaagtccgctctgtgagggtcagctggagacctcctgctgatgatggtggtgctgacatcttaggctacatcctcgagagacgagaagtgcctaaagccgcctggtataccattgattccagagtccgaggtacatctctggtggtaaaaggcctcaaagagaatgtagaataccatttccgtgtttcagcagaaaaccagtttggcataagcaaacccttgaaatctgaggaaccagtcacaccaaaaacaccattgaatcctccagaacctccaagcaatcctccagaagtactcgatgtaaccaagagttctgttagcttgtcctggtcccggcccaaagatgatggtggttctagagtcacaggctactacatcgaacgcaaagagacatccactgacaaggtggtcagacacaacaagactcagatcaccaccacaatgtacactgtcacagggcttgttcccgatgctgagtatcagttccgcatcatcgcacagaatgatgttggcctgagtgagaccagccctgcttctgaaccagttgtttgcaaagatccatttgataaaccaagccaaccaggagaacttgagattctttcaatatccaaagatagtgtcactctacagtgggagaaacctgaatgtgatggtggtaaagaaattcttggatactgggttgaatatagacagtctggagacagtgcctggaagaagagcaataaggaacgtattaaggacaagcaattcacaataggaggtttgctggaagctactgagtatgaattcagggtttttgctgagaatgagactgggctgagcagacctcgcagaactgctatgtctataaagactaaactcacatctggagaggccccaggaatacgcaaagaaatgaaggatgttaccacaaaattgggtgaagctgctcaactctcatgccagattgttggaaggcctcttcctgacattaaatggtacagatttggtaaagagctcatacaaagccggaaatacaaaatgtcttcagatggacgcacacacactcttacagtaatgacagaggaacaggaagatgaaggtgtttatacctgcatagccaccaatgaggttggagaagtagaaaccagtagtaagcttctcctgcaagcaacaccgcagttccatcctggttacccactgaaagagaaatattatggagctgtgggttccacacttcggcttcatgttatgtacattggtcgtccagtacctgccatgacttggttccatggtcagaaacttttgcaaaactcagaaaacattactattgaaaacactgagcactatactcatcttgtcatgaagaatgtccaacgtaagactcatgctgggaaatacaaagtccagctcagcaatgtttttggaacagttgatgccatccttgatgtggaaatacaagataaaccagacaaacctacaggaccaattgtgatcgaagctctattgaagaactccgcagtgatcagctggaaaccacccgcagatgacggaggctcctggatcaccaactatgtggtggaaaaatgtgaggccaaggagggggctgaatggcaattggtgtcttcagccatctcagtgacaacctgtagaattgtgaacctcacagaaaatgctggctattacttccgggtttcagctcagaacactttcggcatcagtgaccctctagaagtgtcctcagttgtgatcattaagagtccatttgaaaagccaggtgctcctggcaaaccaactattactgctgtcacaaaagattcttgtgttgtggcctggaagccacctgccagtgatggaggtgcaaagattagaaattactaccttgagaagcgtgagaagaagcagaataaatggatttctgtgacaacagaagaaattcgagaaactgtcttttcagtgaaaaaccttattgaaggtcttgaatacgagtttcgtgtgaaatgtgaaaatctaggtggggaaagtgaatggagtgaaatatcagaacccatcactcccaaatctgatgtcccaattcaggcaccacactttaaagaggaactgagaaatctaaatgtcagatatcagagcaatgctaccttggtctgcaaagtgactggtcatccaaaacctatcgtcaaatggtacagacaaggcaaagaaatcattgcagatggattaaaatataggattcaagaatttaagggtggctaccaccagctcatcattgcaagtgtcacagatgatgatgccacagtttaccaagtcagagctaccaaccaagggggatctgtgtctggcactgcctccttggaagtggaagttccagctaagatacacttacctaaaactcttgaaggcatgggagcagttcatgctctccgaggtgaagtggtcagcatcaagattcctttcagtggcaaaccagatcctgtgatcacctggcagaaaggacaagatctcattgacaataatggccactaccaagttattgtcacaagatccttcacatcacttgttttccccaatggggtagagagaaaagatgctggtttctatgtggtctgtgctaaaaacagatttggaattgatcagaagacagttgaactggatgtggctgatgttcctgacccacccagaggagtcaaagttagtgatgcctcacgagattctgtcaacttaacatggactgagccagcctctgatggtggcagcaaaatcaccaactacattgttgaaaaatgtgcaactactgcagaaagatggctccgtgtaggacaggcccgagaaacacgttataccgtgatcaacttatttggaaaaacaagttaccagttccgggtaatagctgaaaataaatttggtctgagcaagccttcagagccttcagaaccaaccataaccaaagaagataagaccagagctatgaactatgatgaagaggtagatgaaaccagggaagtctccatgactaaagcatctcactcttcaaccaaggaactctatgagaaatatatgattgctgaagatcttgggcgtggtgagtttggaattgtccatcgttgtgttgaaacatcctcaaagaagacatacatggccaaatttgttaaagtcaaagggactgatcaggttttggtaaagaaggaaatttccattctgaatattgctaggcatagaaacatcttacacctccatgaatcatttgaaagcatggaagaattagttatgatctttgagtttatatcaggacttgacatatttgagcgcattaacacaagtgcttttgaacttaatgaaagagaaattgtaagttatgttcaccaggtctgtgaagcacttcagtttttacacagtcataatattggacactttgacattagaccagaaaatatcatttaccaaaccagaagaagctctaccattaaaatcatagaatttggtcaagcccgtcagctgaaaccaggggacaacttcaggcttctattcactgccccagaatactatgcacctgaagtccaccagcatgatgttgtcagcacagccacagacatgtggtcacttggaacactggtatatgtgctattgagtggtatcaacccattcctggctgaaactaaccaacagatcattgagaatatcatgaatgctgaatatactttcgatgaggaagcattcaaagagattagcattgaagccatggattttgttgaccggttgttagtgaaagagaggaaatctcgcatgacagcatcggaggctctccagcacccatggttgaagcagaagatagaaagagtcagtactaaagttatcagaacattaaaacaccggcgttattaccacaccctgatcaagaaagacctcaacatggttgtgtcagcagcccggatctcctgtggtggtgcaattcgatctcagaagggagtgagtgttgctaaagttaaagtggcatccattgaaattggcccagtttctgggcagataatgcatgcagttggtgaagaaggaggacatgtcaaatatgtatgcaaaattgaaaattatgatcagtctacccaagtgacttggtactttggtgtccgacagctggagaacagtgagaaatacgaaatcacctacgaagatggagtggccatcctctatgtcaaagacattaccaaattagatgatggtacctacagatgcaaagtagtcaatgactatggtgaagacagttcttatgcagagctatttgttaaaggtgtgagagaagtctatgactattactgccgtagaaccatgaagaaaattaagcgcagaacagacacaatgagactcctggaaaggccaccagaatttaccctgcctctctataataagacagcttatgtaggtgaaaatgtccggtttggagtaactataactgtccacccagagcctcatgtaacatggtataaatcaggtcagaaaatcaaaccaggtgacaatgacaagaagtacacatttgagtcagacaagggtctttaccaattaacaatcaacagtgtcactacagatgatgacgctgaatatactgttgtggcaaggaacaaatatggtgaagacagctgtaaagcaaagctgacagtaaccctacacccacctccaacagatagtaccttaagacccatgttcaaaaggttactggcaaatgcagaatgccaagaaggccaaagtgtctgctttgagatcagagtgtctggcatccccccaccaacattaaaatgggagaaagatggtcagccactgtccctcgggcctaacattgaaattatccatgaaggcttggattattatgctctgcacatcagggacactttgcctgaagacacgggttattatagagtcacagccactaacacagctgggtccaccagctgccaggctcacctacaagtggaacgcctgaggtacaagaaacaggaattcaagagtaaggaggagcatgagcgacacgtacaaaaacaaattgacaaaaccctcagaatggctgaaattctttctggaactgaaagtgtaccactgacacaggtagctaaagaggctctgagagaagctgctgtcctttataaaccggctgtaagcaccaagactgtaaaaggggaattcagacttgagatagaagaaaagaaggaggagagaaaactccggatgccttatgatgtaccagagccacgcaagtataagcagactaccatagaagaagaccaacgcatcaagcagttcgtgcccatgtctgacatgaagtggtataaaaagatacgtgatcagtatgaaatgcctgggaaacttgacagagttgtacagaaacgacccaagcgcatccgcctttcaagatgggaacagttctatgtgatgcctcttccacgcattacagatcaatacagacctaaatggcgtattcctaaactgtcccaagatgatcttgagatagtgagaccagcccgccggcgtacaccttctcctgattatgacttttactaccgacctagaagacgttctcttggggacatctctgatgaagaattactcctccccattgatgactacttagcaatgaaaagaacagaggaagagaggctgcgtcttgaagaagagcttgagttaggtttttcagcttcacccccaagtcgaagccctccacactttgagctttctagcctacgttactcttcaccacaagctcatgtcaaggtggaggaaacaagaaaaaacttcaggtattcaacctatcacatcccaacgaaggctgaagctagtacaagttatgcagaactgagggaacggcatgcccaggctgcgtacagacagccaaagcaacggcaaagaatcatggctgagagggaggatgaagagttgcttcgcccagttacgaccacccagcatctctcagaatacaaaagcgaacttgacttcatgtcaaaggaggaaaagtctagaaagaaatcaaggcgacaaagagaagtgacagaaataacagaaattgaggaagaatacgaaatctcaaaacatgctcaaagagaatcatcctcatctgcgtctagactactgagacgacggcgctccctgtctccaacttatattgagttaatgaggccagtgtctgagctgatccggtcacgtccacaaccggctgaggaatacgaagatgacacagaaagaaggtcacctactccagagagaactcgcccacgatcccccagccctgtgtctagtgagagatcactctcgagatttgagaggtctgcaagatttgatatcttttccaggtatgagtccatgaaagctgctttaaaaactcagaagacatcagaaaggaagtatgaagttttgagtcagcagcctttcacactggaccatgcccctcgaatcacactgagaatgcgctcgcacagggtaccatgtggccaaaatacacgttttattttaaatgttcagtctaagccaactgccgaagttaaatggtaccacaatggtgtggaactccaagaaagcagtaagattcattacaccaacacgagtggagttctcaccctggaaattctggactgtcatactgatgacagtggaacctaccgtgctgtgtgcaccaactacaagggcgaacgttctgactatgcaacgttggacgtgacaggaggggattataccacctatgcttcccaacgcagagatgaagaggtccccagatctgttttccctgagctgacaagaacagaggcgtatgctgttccatcatttaagaaaacatctgagatggaagcttcgtcttctgtcagggaagtgaaatcacagatgacggagacaagggaaagtctctcctcatatgaacactctgcatctgcagaaatgaaaagtgctgcattagaagaaaagtcactggaagaaaaatccacaaccagaaagatcaagacgactttggcggcaagaattctaacaaagccacggtccatgaccgtctacgagggcgagtctgcaaggttttcttgtgacaccgatggtgagccggtaccaactgtgacctggctgcgtaaaggacgagtgctaagtacttctgcccgccaccaagtgaccaccacaaagtacaaatcaacctttgagatctcttcagtccaggcttccgatgagggcaattacagcgtggtggtagaaaacagtgaagggaaacaagaagcagagttcactctgactattcaaaaggccagggtaactgaaaaggctgtgacatcaccaccaagagtcaaatccccagagcctcgggtgaaatccccagaagcagttaagtctccaaaacgagtgaaatctccagaaccttctcacccgaaagccgtatcacccacagagacaaaaccaacaccaatagagaaagttcagcacctcccagtctctgccccaccaaagattactcagttcctgaaagcagaagcttctaaagagattgcaaaactgacctgtgtggttgaaagcagtgtattaagggcaaaagaggtcacctggtataaagatggcaagaaactgaaggaaaatgggcatttccagtttcattattcagcagatggtacctatgagctcaaaatcaataacctcactgaatctgatcaaggagaatatgtttgtgagatttctggtgaaggtggaacgtctaaaaccaacttacaatttatggggcaagcctttaagagtatccatgagaaggtatcaaaaatatcagaaactaagaaatcagatcagaaaaccactgagtcaacagtaaccagaaaaactgaaccaaaagctcctgaaccaatttcctcaaaaccagtaattgttactgggttgcaggatacaactgtttcttcagacagtgttgctaaatttgcagttaaggctactggagaaccccggccaactgccatctggacaaaagatggaaaggccattacacaaggaggtaaatataaactctctgaagacaagggagggttcttcttagaaattcataagactgatacttctgacagtggactttatacttgtacagtaaaaaattcagctggatctgtgtcctctagctgcaaattaacaataaaagctataaaagatactgaggcacagaaagtctctacacaaaagacttctgaaattacacctcagaagaaagctgttgtccaagaggaaatttcccaaaaagccctaaggtctgaagaaattaagatgtcagaggcaaaatctcaagaaaagttagccctcaaagaggaagcttcaaaggttctgatttctgaagaagtcaagaaatcagcagcaacctccctggaaaaatccattgtccatgaggaaatcactaaaacatcacaggcatcagaagaagtcagaactcatgctgagattaaagcattttctactcagatgagcataaacgaaggtcaaagactggttttaaaagccaacattgctggtgccactgatgtgaaatgggtactgaatggcgtagagcttaccaactctgaggagtaccgatatggtgtctcaggcagcgatcagaccctaaccatcaagcaagccagtcacagagatgaaggaatcctcacctgcataagcaaaaccaaggaaggaatcgtcaagtgtcagtatgatttgacactgagcaaagaactctcagatgctccagccttcatctcacagcctagatctcaaaatattaatgaaggacaaaatgttctctttactcgtgaaatcagtggcgagccatcccctgaaatcgaatggtttaaaaacaacctgccaatttctatttcttcaaatgtcagcataagccgctccagaaatgtatactcccttgaaatccgaaatgcatcagtcagcgacagtggaaagtacacaattaaggccaaaaatttccgtggccagtgttcagctacagcttccttaatggtccttcctctagttgaagaaccttccagagaggtagtattgagaacaagtggtgacacaagcttgcaaggaagcttctcgtctcagtcagtccaaatgtctgcctccaagcaggaggcctccttcagcagtttcagcagcagcagtgctagcagcatgactgagatgaaatttgcaagcatgtctgcccaaagcatgtcctccatgcaagagtcctttgtagaaatgagttccagcagctttatgggaatatctaatatgacacaactggaaagctcaactagtaaaatgcttaaagcaggcataagaggaattccgcctaaaattgaagctcttccatctgatatcagcattgatgaaggcaaagttctaacagtagcctgtgctttcacgggtgagcctaccccagaagtaacatggtcctgtggtggaagaaaaatccacagtcaagaacaggggaggttccacattgaaaacacagatgacctgacaaccctgatcatcatggacgtacagaaacaagatggtggactttataccctgagtttagggaatgaatttggatctgactctgccactgtgaatatacatattcgatccatttaagagggcctgtgccttatactctacactcattcttaacttttcgcaaacgtttcacacggactaatctttctgaactgtaaatatttaaagaaaaaaagtagttttgtatcaacctaaatgagtcaaagttcaaaaatattcatttcaatcttttcataattgttgacctaagaatataatacatttgctagtgacatgtacatactgtatatagccggattaacggttataaagttttgtaccatttattttatgacattttacaatgtaagttttgaaactaactgttggtaggagaaagtttcttatggaacgaataccctgctcaacatttaatcaatctttgtgcctcaacatactgttgatgtctaagtatgcctcagtgggttgagaaaatccccattgaagatgtcctgtccacctaaaagagaatgatgctgtgcatatcacttgatatgtgcaccaatacctactgaatcagaaatgtaaggcattggtgatgtttgcatttaccctcctgtaagcaacactttaacgtcttacattttctctgatgatgtcacacaaaattatcatgacaaatattaccagagcaaagtgtaacggccaacactttgttcgctcattttacgctgtctctgacataaggagtgcctgaatagcttggaaaagtaacatctcctggccatcccttcatttaaccaagctattcaagtattcctatgccagagcagtgccaactcttggaggtcccagagtgcagccaatgcctttgtgtggtagttctaaattttaattgcacctgaaaaacctgggcacctaagcaatgagccacagcaaaaagtaaagaacaacaacaaaataaagctgttgttaaattttaaacaatattactaattgcccaaaatgtcaatttgatgtagttcttttcatgcaagtataaattcaattgttagttataattgttggacctccttgagatagtaacaacaaaataaagcaagctatctgcacctcaaaaaaaaaaaaaaa

SEQ ID NO: 4 - DNA, 2121 bp, Homo sapiens
aaagatggactttccagtttaaaagatttagagaaactgtaccaacttgggatacaataagagatgaagaagatgctcttgatgaactcttgcagtatttgggtgttactagtcctgaatgcttacagagaactggaatctcacttaatattcctgctccacaacctgtgtgcatttctgaaaaacaagaaagtgatgttattaatgctatccttaagcaacatacagaagaaaaagaatttgttgagaagcactttaatgacttaaacatgaaagctgtggaacaagatgaaccaatacctcaaaaacctcagtcagcattttattattgcagattgcttcttagtatattgggaatgaattcctgggacaaacggaggagctttcatctcctgaagaaaaatgaaaagctacttagagaacttaggaacttggattcaaggcagtgccgagagacacacaagattgcagtattttatgttgctgaaggacaagaagacaaacactccattctcaccaatacaggaggaagtcaagcatatgaagattttgtagctggtcttggttgggaggtaaatcttacaaaccattgtggttttatgggaggactacaaaaaaacaaaagcactggattgaccactccatattttgctacctctacagtagaagtaatatttcacatgtcaacaagaatgccttctgattctgatgattctttgaccaaaaaattgagacatttgggaaatgatgaagtgcacattgtttggtcagagcatactagagactacaggagaggaattattcccacagaatttggtgatgtccttattgtaatatatccaatgaaaaatcacatgttcagtattcagataatgagaaaaccagaggttcccttctttggtcccctttttgatggtgctattgtgaatggaaaggttctacccattatggttagagcaacagctataaatgcaagccgtgctctgaaatctctgattccattgtatcaaaacttctatgaggagagagcacgatacctgcaaacaattgtccagcaccacttagaaccaacaacatttgaagattttgcagcacaggttttttctccagctccctaccaccatttaccatctggtgccgatcattaaatatcagttctgtttatctgaaggctcctacccagagattctacccagtgaaactcccacagcagcgcaggtagatggggctgacctggcctctccaatgtctcctcgaactagcaaaagccgcatgtccatgaagctgcgtcgttcctctggctcagccaataaatcctaaggagacaagcagcccagcagtgatcagcagtagccaccttagcatggacatagggttaaccctttcaggccttcatgtctgccataacatgcatgtttcttcctgtacatttatttgagaaaacactggatttaaataattttaaataatttgtagcttaatattaaagatttaagttatttattgtttcatttttttcccacaatccaagctgccatattttgagggcagggggagttttattctacaccctttaccttcctagataattatgtctaagtagttttatctttaatttcatggttaactgtgagccaaaatacaattggacaattagtctcattatttattgtgctccattgcaactttatggttcaataaatatataattttttacaaatgtaaaattttacatttaagcatttgtaaagttacagcaaaagatgtacctgttaatacacagaatgtgtacagattatttgttatgacaataaaacactcaaaataaatggtctttagcatctcaaattccaactgaaatcattttagtattaactcttcttcccaaagcaatgtctcatttcttggctgtgcaggtgatgccatgttatatccaataactagaaaaatcactgtgctgaacttttatgtttagcttccaagtatttttctaatgttttgcatttcaagtggtatcactgttaaatgccatttgttttcagattgtggccttttattattggctgctagatcctggtgtttctatgttcttttttaagcaccaaaaaaaaaaaaaaaaaa

SEQ ID NO: 5 - DNA, 1322 bp, Homo sapiens
tagtcgggcggggttgtgagacgccgcgctcagcttccatcgctgggcggtcaacaagtgcgggcctggctcagcgcgggggggcgcggagaccgcgaggcgaccgggagcggctgggttcccggctgcgcgcccttcggccaggccgggagccgcgccagtcggagcccccggcccagcgtggtccgcctccctctcggcgtccacctgcccggagtactgccagcgggcatgaccgacccaccaggggcgccgccgccggcgctcgcaggccgcggatgaagaagaaaacccggcgccgctcgacccggagcgaggagttgacccggagcgaggagttgaccctgagtgaggaagcgacctggagtgaagaggcgacccagagtgaggaggcgacccagggcgaagagatgaatcggagccaggaggtgacccgggacgaggagtcgacccggagcgaggaggtgaccagggaggaaatggcggcagctgggctcaccgtgactgtcacccacagcaatgagaagcacgaccttcatgttacctcccagcagggcagcagtgaaccagttgtccaagacctggcccaggttgttgaagaggtcataggggttccacagtcttttcagaaactcatatttaagggaaaatctctgaaggaaatggaaacaccgttgtcagcacttggaatacaagatggttgccgggtcatgttaattgggaaaaagaacagtccacaggaagaggttgaactaaagaagttgaaacatttggagaagtctgtggagaagatagctgaccagctggaagagttgaataaagagcttactggaatccagcagggttttctgcccaaggatttgcaagctgaagctctctgcaaacttgataggagagtaaaagccacaatagagcagtttatgaagatcttggaggagattgacacactgatcctgccagaaaatttcaaagacagtagattgaaaaggaaaggcttggtaaaaaaggttcaggcattcctagccgagtgtgacacagtggagcagaacatctgccaggagactgagcggctgcagtctacaaactttgccctggccgagtgaggtgtagcagaaaaaggctgtgctgccctgaagaatggcgccaccagctctgccgtctctggagcggaatttacctgatttcttcagggctgctgggggcaactggccatttgccaattttcctactctcacactggttctcaatgaaaaatagtgtctttgtgattttgagtaaagctcctatctgttttctaaaaaaaaaaaaaaaaaaaaaaaaaa

SEQ ID NO: 6 - DNA, 4791 bp, Homo sapiens
gttccacagcgaggtggccaaatttcgtttcctgaacgaactgatcaaagtgttgtccccaaagtacctggggtcctgggccacaggaaaagttaaaggaagagtcattgaaatactcttcagttggacagtctggtttccggaagacatcaagattcgagacgcttatcagatgctgaagaaacaaggaattataaaacaagaccctaaactaccagtggataaaatcttacccccaccatctccctggcccaagagctccatctttgatgctgatgaagaaaagtccaagcttctgacaaggcttctaaagagcaaccaccccgaggaccttcaggctgcaaaccggttaatcaagaatttggtcaaggaggaacaagaaaaatcggagaaggtgtccaagagggtcagtgcggtggaggaagtgcgaagccatgtgaaggtgctgcaggagatgctgagcatgtaccgcaggccagggcaggccccgcccgaccaggaggccctgcaggtcgtgtatgagaggtgtgaaaagctgcggcccacgctgttccggttggcgagtgacaccactgatgacgatgatgcactcgcggaaattctccaggcaaatgacctcctcacccaaggagttctgctgtacaaacaggtgatggagggccgggtcacctttggaaacagagtgaccagctcattgggagacatccctgtctccagagtctttcagaatccagcaggctgcatgaagacctgccccctgattgacttggaggtggacaatggacctgcgcagatggggactgtggtgccatctttgcttcatcaggacctggcagccttgggaatcagtgatgctcctgttacaggcatggtttctggtcagaattgctgtgaggaaaagaggaatccctcctccagcacgctgccaggcggtggtgttcagaacccttctgcagacaggaatttgctggacctcctctcagcacagccagctccgtgccctctgaattatgtttcgcagaaaagtgtccccaaggaagtgccaccaggtactaagtcctctccaggttggtcctgggaggctggcccgttggctccttccccatcttcacagaatacacctctggctcaagtgtttgtccctttggagtctgttaagcccagcagcctgccgcctctcattgtgtatgaccggaatggattcagaattctgctccacttctcccagacgggagcccctgggcacccagaggtacaggtgctgctcttgaccatgatgagcacggctccccagcctgtctgggatatcatgtttcaagtggctgtgccaaagtcaatgagagtgaagctgcagccggcatccagctccaagcttcctgcattcagtcctttgatgcctccagctgtgatatctcagatgctgctgcttgacaatccacacaaagaacctatccgcttacggtacaagctgacattcaaccaaggtggacagcctttcagcgaagtaggagaagtgaaagacttcccagacctggctgtcttgggcgcagcctaacttttcacaagatggacccttcatttcaagcttaggctggcgttacttttgctgtctagtcaggactaatcacggtgtttcagtgcggagtgccaagagtcctatcctgacgtcaggctctgggtgtcaacctctgacttattctgcagatgctctgtgtgtgtgtgtgtgtgtgtgtgtgtgtgtgtgtgtgtgtgtgtgtgtgtgtgtgtgtgtgtgtgttcggggagagggtggtagcacagggcttgggatatcggcagtgtgggaaatgcgaagcatttctcatcatcatcatctctgctacagtcatgtttctgcatgtcagcgagcgacactgtccctgcctcaggttggaggttttatcagccaaagtgtttttttcatgtatcgttcgttccattcatccactctgtgccttgtcagcctttgaaaggcttggttgctcccaggctgctgttctcagggaccttaaaagggacctggttagtcttggggcagagagtatctacttgggcactctcttccaagaaagaccttgtctccattttcattagacaatgcttcttgtgtgtgttctggaagatcttctaaatggaatgcttgttgcactgttcccaggcgagtggctgccatgagacctgaggaccacacttgggggaccaatcatgtccttcaccactgtgccttagaatcgcccctggacagagttcctgggcagaggggaaagcagctcccaggccttactcaggcctcaggtccatgggttgggcagccagtctgggcccttctcaggatcctcatctccatcctcatcctcttccttcacagcatttacttggagctctttgtgacacaccatgtcagtcatgatgaatcggccaacagccagcccttgccagctgacgtcacagtctaagatgggaaactggtacagatagacatgaagagagcttagcagtgattgaggtggtgactaaatatacagtcattgaataaataccatgtagcaagtgtactttgtggagtgttgagtaagtggaaaatggaaagccagttgcatttagagatgataggcctaaagggaactgtcttctgtcgagaagtaaaggaaacttcatgaaggatgtagaagcttagctgcctcagagaagagagaacctgaagatctgaggcaagctggacaggagaggtggatatttgttgatggaagaattcaagtttataatcaattcccacttagcacctactgtgtgctaggaacttgaatgtgtatgtttgacaagtcctgcttggcctgatgggtgggagaaggaacctgagcctggctgagatggctaggcggagggctttgaagtccaagcagctgaactggctgggtgggtttctacctttgaaactgcaagacttgtttggagctcttaattacaatatctgatatttttacagtctgatcttttgacttctacatatagtggaaatctgccaatactaattggtggagatgggaactgtaaaagatcaagtatgctaattttaagcaaatgtaaaaactcataaaacaggtaaacagtggggtgatttcatttgccataattcacataagacgaattttaatctaaaagtactttcttgcttgtattctgtgtggcttttttttgttttttgaggccatatctcactctgtcactcaggctggagtgcggtggtataatctcagcctctcgagtagctgggactacaggcgtgagccagcacgcccagctaatttttgtatttttagtagagacaggatttcaccatgttggccaggctggtctcgaactcctgacctcaggtgatccgcctgccttggcctcccagagtgctgggattacaggcgtgagccaccgcacccggcctctgtgtagcttttataggctctgttactgttgcgtagtcttgaagaggtacccatcataatgacagcatctccctctgaagggttttggtcaaaatgggtgaatgagacttatacataaagacaggctttctcccctatagttaggaggtgaactcacacatgtgtacctgaacattcttgcttttgaggagacagactcccagtggtactactatgcttaggtgttggacaggataggggtaggaggagaggaggcaggctgctgtcctgaaagtggctgtggtttatggcatcactcccttctaatcagcaagtccagtggccacttagagcccagctcctacctcttcattcacttaacaagtagttattggctgtgcacagtggctcacgcctgtagtcccagcattttgggaggctgagtgggatgaccgcttgagcccaggatttcaagtccagcctgggctacatagtgagaccgtgtctctgtttttttaaaagctagttgttgaccagctaccctgagccaggcaccaccctgaaggagcttcttttcctctggggagaagcaaattcatgatgtgtgtgctggagatctggcactcatggccagtgctttccagtatcttgaactcttcgggggtcctgttgacccatttcgtgacctacctccgtgactgctctttttcctctgtctcttaagtgtgatggttttccagagtccaatcctcaggactttcccgtccacacacaggcctggtagtcaggtggctctaaaccattaggtgggttgtagacctctctcaagctgccacctccttgctgtcgccagatcgtatttcagtctgtcaggggttatctgtatctggaggttccactgttgcttcagtctcagttacttagaatggaacccagagtcctgcccctttccacctacatgctcttacttgaaagcacctgagacttattgggtccctgattcctgcttcgtctgtatccgcagagtagttgcatgtcatttggcctgttttctaaataatcccacatcatgtcctccctgcacttacattgccactgctctgatttgggcttttttttttttgggacaatgcctctgtcccaattctgagtaacagctctggttcttgccactaccagagttctctagcaaatctgagcatctgacagggtgaaaaattctgaatggcttcctgatgcctgactttatgggatcaaattcaagttgcacgctggcactcagtgcccttctggtatcatctgccaagaccagggcctgcttcaccacagccacaataaagtcctttcaagccct

SEQ ID NO: 7 - DNA, 3252 bp, Homo sapiens
ggggtgaaccgtgacagcgcttcggcccgcactaaggccggctcttgtgccggaaggaggaaggcgtggggcattcgcccctcggagctagggagtgtgtgcgacgccgctgcgaggtcacgtgagccactgccggcagagagggaaaggggcggggcccagaacgaagcggggaggcgccccttgtttccctggggtcacgcgcagccggaagtggcggctgctgcggagaattggagatggggaccgccctggacatcaagattaaaagagcgaataaagtttatcacgccggggaagtgctctctggcgtggtggtcatatcgagtaaggattcagtccaacaccagggagtgtctttgaccatggaaggaactgtaaacctccagctcagtgccaaaagtgtgggtgtgtttgaagctttttataattctgttaagcctatccagattatcaacagcaccatagaaatggtgaagccggggaaatttcccagcggcaaaacagaaatcccttttgaatttcctctgcacttgaagggtaacaaagttctgtatgagacgtatcatggcgtgtttgtcaacattcagtatacactgcgctgtgacatgaagcggtctctgttggccaaggacttgacaaagacctgtgaatttatcgttcactccgctcctcagaaggggaagtttactcccagtcccgtggacttcacgattacacctgaaaccttacagaacgtcaaagagagagctttgcttcccaaatttctccttcgaggacatctcaactcaacaaactgtgtcatcacgcagccactaacgggagagctggtggtggagagctcggaagccgccatcagaagcgtggagctgcagctggtgcgcgtggagacgtgcgggtgtgcagaaggctatgcccgcgacgccacggagattcagaacattcagatcgccgacggggatgtgtgcaggggcctctctgtccccatctacatggtcttccctaggctgttcacctgccctacactggagaccaccaacttcaaagtggaatttgaggttaacatcgtggtgctgcttcaccctgaccacctcatcacggagaacttcccgctgaagctctgcaggatatagcccggaggagggaagcatagagaacgggagtggccatctggaaatccagctggttatccaaatcctaaggggagctacagccagcggcatatacttgtttttgtgattattctgtatcagaaatgaaacagaccctcaaattaactttccttcctcatttcttgaggcttctgcttccaacaggcacctctaatcagaccttttctttgaaattcaacaagatttcttaatgctatttgccaagaccatttcacagaaaacattgactgtggctcttgccttatctgttcctttttaggtacagtaaaacaattgtgacagcagtttgagcttgctggagagtggcatcatggggacaaaaggaaacctctgacttgctaatggatgtagccagggactccccatagcaaagggtctgtggccagttgacatccaggatggctgcaagcgcacttgatggtcaggaagtttgcagatactcgccaaggcagagcgcaaagtgctagccactggaaatgcatgacttccctccacccctactctattctgtagttttttggttttgtttctgagacggagtctcagtctgtcacccaggctggagtgatctcagctcactgcaacctccacctcccaggttcaagcgactctcctgcctcagcctcccgagtagttgggattacaggtgactgccaccgtgcccggctaatgtttgtatttttagtagagacggggcttcaccatcttggccaggctggtcttgaactcctgacctcgtgacccacccgccttggcctcccaaagtgctgggattacaggtgtgagccaccacacccagcctctgtagttctttttacaacatttttcattataactttaaattttttaagcaactggaaaagtgttccttgctctcttggggggatttggctggtgccgaagtgtttctgaagtctcaagaactgccataaaatctcacgctgccatttccctgaacagatacatacatagagagagacagttttccaaactgtgtcacgcaggctgagtgcactggcaggatcacagctcacggcagcctcaacctccctggctcaagcgatccctcccctcagcctcctgagtagctgagactacaggtgagtgccaccacactcagctaattttcaaattttttgtagacagggtctccctatgttgcccaggctggtcttgaactcctagactcaagtgatcctcctgtcttggcctcccaaagtgctgagattacaggtgtgagccactgtgcccagcagtttcccagaatatatttaaatgcaaagttacatgaggggaaaacatgtatgtttgctcctgttgttactgggtaggttctgaacagcagaaacccatgtgcagggtgggctggtgaaggcccctctccgcaaggtggtagcaggaaaaggtccttgacttgatgaatttggtctgcctctgagccactggaggaagctgttttgagccagggttttttggcctaaagccagcatttcctcagtctccctttgtggttcgaaggatatggactattgcaatacatttcttccttcaaatcctgccactgttttgttggcccacaactaataggacctcaaaataagccatgctgctttgcacacacactagccttcttttgtacttttcattctggatgggcttggccaaaacaggctcaggccaaagacctcccaagctgtatgtacttccagtatcctgaaacagtgtttggtgacataatgccaagggtaaacaagcctgatttaggcactgctttatccaggggcttcacccatgaaattaataaaacttatctgagtcacttgaaacttggttcccagaaaacacatttctggtttataatctccttttatgctcacctgacattaattatctatccttgatgatgtgtttaaactgagtagcagaaaacagaggccacactttctgggaaattttaaaggaagaaaccatttttaatgagatgaaaatatttaacgaatttaaaaagctaatgacaattttgagaaaaggtttgggatgtatattgctatgtaatttaataaactgattttatggatat

SEQ ID NO: 8 - DNA, 2587 bp, Homo sapiens
ggcacacacgaggaggagggttgagctgctgccgccgccgcctctgtcgtcgtcgcgagtgtggagtcgggactggagctgctgccgcggcgacgccggggatctttgtcgctagctcccggcccttctgccccgccgccttccctcagtcagcgttgcccactcctctccggccgggcgcccctgcctccatttctcgctctctgtccaccacacacacggcccccccgatcatggatccgggcagtggcggcggcggcggcggcggcggcggcggcgggagcagcagcggcagcagcagcagcgactcggcgcctgactgctgggaccaggcggacatggaagcccccgggccgggcccttgcggcggcggcggcttccctggcggcggcggccgaggcccagcgggagaacctcagcgcggccttcagccggcaactcaacgtcaacgccaagcccttcgtgcccaacgtccacgccgccgagttcgtgccgtccttcctgcggggcccggcagcgccgccacccccagctggcggcgccgccaataaccacggagccggcagcggcgcgggaggccgtgcggcacctgtggaatcctctcaagaggaacagtcattgtgtgaaggttcaaattcagctgttagcatggaactttcagaacctattgtagaaaatggagagacagaaatgtctccagaagaatcatgggagcacaaagaagaaataagtgaagcagagccagggggtggttccttgggagatggaaggccgccagaggaaagtgcccatgaaatgatggaggaggaagaggaaatcccaaaacctaagtctgtggttgcaccgccaggtgctcctaagaaagagcatgtaaatgtagtattcattgggcacgtagatgctggcaagtcaaccattggaggacaaataatgtatttgactggaatggttgacaaaaggacgcttgaaaagtatgaaagagaagctaaagagaaaaacagagaaacttggtacttgtcttgggccttagacacaaatcaggaagaacgagacaagggtaaaacagtagaagtgggtcgtgcctattttgaaaccgaaaagaagcatttcacaattctagatgcccctggccacaagagttttgtcccaaatatgattggtggtgcctctcaagctgatttggctgtgctggtaatctcagccaggaaaggagagtttgaaactggatttgaaaaaggaggacagacaagagaacatgcaatgttggcaaagacagcaggtgtaaaacacctaattgtgctaattaataagatggatgatccaacagtaaattggagcaatgagagatatgaagaatgtaaggagaaactagtgccatttttgaaaaaagttggcttcaatcccaaaaaggacattcactttatgccctgctcaggacttactggagcaaatctcaaagagcagtcggatttctgtccttggtacattggattaccgtttattccatatctggataatttgccgaacttcaatagatcagttgatggaccaatcaggctgccaattgtggataagtacaaggatatgggcactgtggtcctgggaaagctggaatcaggatctatttgtaaaggccagcagcttgtgatgatgccaaacaagcacaacgtggaagttcttggaatactttccgatgatgtagagactgataccgtagccccaggtgaaaacctcaaaatcagactgaaaggaattgaagaagaggagattcttccagggtttatactttgtgatcctaataatctttgtcattctggacgcacatttgatgcccagatagtgattatagagcacaaatccatcatctgcccaggctataatgcggtgctgcatattcatacctgtattgaggaggtggaaataacagccttaatctgcttggtagacaaaaaatcaggagaaaaaagtaagacccgaccccgttttgtgaaacaagatcaagtatgcattgctcgcttaaggacagcaggaaccatctgccttgagacctttaaagacttccctcagatgggtcgtttcaccttaagagatgagggtaagaccattgcaattggaaaagttctgaaactggttccagagaaagactaagcattttcttgatgaccctgcacaatactgtgaggaaaattgactgcagaagcctacttcacaccgccttctcttattttctgcccattgataaacctctccccatattttgcaaagaggaaattcacagcaaaagtccacattatgtcagctttctcatattgagagctctgctatgccactgttgaatttttcccaagattcctgtccctagccctcacttcaaactctgcttccttggacagatttggcaatagctttgtaagtgatgtggacataattgcctacaataatgaaaacctacaggaatttttttatttttcattttccccttaggcatatttagtatttttcccccaggccagatcattcgtgagtgtgcgagtgtgtgtgcacatgttacaaaggcaactaccatgttaataaaatattcaatttg

SEQ ID NO: 9 - DNA, 4753 bp, Homo sapiens
cttcaatcaagtagccttcccactgcagtacacacccaggaaatttgtcatccaccctgagagtaacaaccttattatcattgaaacggaccacaatgcctacactgaggccacgaaagctcagagaaagcagcagatggcagaggaaatggtggaagcagcaggggaggatgagcgggagctggccgcagagatggcagcagcattcctcaatgaaaacctccctgaatccatctttggagctcccaaggctggcaatgggcagtgggcctctgtgatccgagtgatgaatcccattcaagggaacacactggaccttgtccagctggaacagaatgaggcagcttttagtgtggctgtgtgcaggttttccaacactggtgaagactggtatgtgctggtgggtgtggccaaggacctgatactaaacccccgatctgtggcagggggcttcgtctatacttacaagcttgtgaacaatggggaaaaactggagtttttgcacaagactcctgtggaagaggtccctgctgctattgccccattccaggggagggtgttgattggtgtggggaagctgttgcgtgtctatgacctgggaaagaagaagttactccgaaaatgtgagaataagcatattgccaattatatctctgggatccagactattggacatagggtaattgtatctgatgtccaagaaagtttcatctgggttcgctacaagcgtaatgaaaaccagcttatcatctttgctgatgatacctacccccgatgggtcactacagccagcctcctggactatgacactgtggctggggcagacaagtttggcaacatatgtgtggtgaggctcccacctaacaccaatgatgaagtagatgaggatcctacaggaaacaaagccctgtgggaccgtggcttgctcaatggggcctcccagaaggcagaggtgatcatgaactaccatgtcggggagacggtgctgtccttgcagaagaccacgctgatccctggaggctcagaatcacttgtctataccaccttgtctggaggaattggcatccttgtgccattcacgtcccatgaggaccatgacttcttccagcatgtggaaatgcacctgcggtctgaacatccccctctctgtgggcgggaccacctcagctttcgctcctactacttccctgtgaagaatgtgattgatggagacctctgtgagcagttcaattccatggaacccaacaaacaaaagaacgtctctgaagaactggaccgaaccccacccgaagtgtccaagaaactcgaggatatccggacccgctacgccttctgagccctcctttcccggtggggcttgccagagactgtgtgttttgtttcccccaccaccatcactgccacctggcttctgccatgtggcaggagggtgactggataattaagactgcattatgaaagtcaacagctctttcccctcagctcttctcctggaatgactggcttcccctcaaattggcactgagatttgctacacttctccccacctggtacatgatacatgaccccaggttccagtgtagaacctgagtcccccattccccaaagccatccctgcattgatatgtcttgactctcctgtctacttttgcacacacccttaatttttaattggttttcttgtaaatacagttttgtacaatgttatctctgtgggaggaaggaggcaggctgtggtgggactgggtagggtatagtatcactcctgagttccactgctctagaatctaaccagaaatagaaacctagtttttaaggtgactggcatccatgtgtcttgttctggagatgaggatgtaggtgggaggtttgaacccaagttagagcaggaagaactgagtagactccttccttccagataccgacttggacttgcggcactctgtggctccccacccccaggtctgtggtggtttctttgttttttcctggttctttttgctgtgctgatgaaacatgacctcaataaccatgtgtatacccacccctcttcccactgggtattgaggaagggtggctgattcttcctcctcttctactctgaggatgttagtatggggattttagcatgaattccagctggggagtcttaacagatgccccttttactgatagagcacctaaagcgatctttggctccataggaccataggaagggtcagtacagaagaacctagatactgccctgcccctgagaactgtgtatatgtggggcctgtctgcagcacccatctcaggtgggttccagagggcctttagggtataatgagagcctgttaggtggaagaggcccagttccagaaatgttccagcccacccctgagaattcctcctgtttagttgtgtgggaagccctcgtcttccaggctgtccttgcgccttgaacctggagaagtgagctcactgttctcaatacttcacaaatgtaaaactttctttcgtctgcatgtgctcagccatctaaattgagcaaatgatctggtgagcactgggttagaatcaggaatggtggaatacaatctgaacctctcagagcccagaacagagggttcctgacactgtgacactgtctcctggaactaagtatctcttgaatcatgacttggttttagatcagtcaagagagacccaggttttgccaggaatcgaatccctaaataacatgtttttttctcacttagctcatgaatttgcatagtagacagtagttctgaattagattttgaaaacctaatttcagggctcattttttcctgtggccctaaatccattctatcaaattgtgtgatactgacatgcagtcatctgaggaactcagcgtagatacttgagcagctcctcgcctcttttctaactcaagtttgactaaaatacatacactccgtacagaaggtagggggttatgtaagaaaggaaaacctaatctatggaatcaggagttgtcaccaccgagcttcctctggaagtctgcccatcagcttgcttgttctctgttaagaggaagggctaggacaaggatttgggcttgaatatgtggaaaggaattttcatagttgttgctgcaggacctacaaaagtttaaaattagattggatgtgactcaatgacaagtcccatctgtgtaattgttaaggggacctgattgactcctgtggtttgattgagcaaccaggtaaatagagacctctctccagctttggcaaaacccatcagaggctgctgcagaactcagacagagggatctgcccttgggtttgcttccatcctgttccattgctaagcccttgtgacttggatcctaggactgaaaagtttttagctgcctcagctttcccctgaccttactggcagaggttctgcagatgtttcctttggaagatctcttgccaagaatagcattcctttggaggaggggggttctagttggaatgttgcttttcttggttagtgtaaatgtattgctagtgagacagctgccggcgctggaaaaggctcgtctcacagggagagtgctggtccccagaatgtgtgctgttcccacgctgctgcctttcttgagcttgttagaggaaagccagaaaggcattcagatgggatcagtctggctttcaaattttttttaattcctaagttctgttttattttttaattttttaaaaaaaattttattagagacagtctctctctcttgcctagctgggagtgcagtggagtgatcatagctcactgaggcttgaactcctgggctcgagcaatccacctcagcctccagagtaggggagactacagatgtgtgccaccatactcagctagtttttaaactttcgtagagacagggtctccctgtgttgcccaggctggcctcgaactcctgacctcaaaaaatcttcctgccttggcctcccagcgctttgagaggctgaggcaggaggatcccttgagcccaggagtttgagaccagcctgggcaacatgacaaaaccccatctctccaaaaatacaaaaattggccaggcatggtggtgcacacttgtagtcccagtaattagggggctgagacaggaggatcacttcagcctatgagtttgaggctgcagtgagctgtgattgcgccactacactccagcctggatgacaggacgaaacctgtctcaaaaacaccaaaaaacaaaaaccggtctcctggggtcatggtagcacaaacgcacatgactgagtgctcaggggttctgaggcttgtccgctgacctggggctctggccctgggagatctgggggacctgctgtcctatatgtgatgctttgaaagaaaggggcatcattccaagccaagaggccccagagagggcaccgtggggtgttcaggcttctgtgaggccccagtgagatcctgtggctgtgcccccatcacctccacccactctgccctcccactagctgcccaacggatgaatcaacgccttggcagagttttccagcagggccttgcagagagtgtgtgtgacctgtgtggccactgccttggggacgggtgaggagttagcctggaacattccagcgtgggcattattgtcctgttgcaagttcagggcaaaaccaggaatccagttttgtcgatccaattgagaaaacatttcatgaacaactacttgtggcatgcattggcactcggaataaagcgcactattgtcact

SEQ ID NO: 10 - DNA, 3984 bp, Homo sapiens
gtcctttcacgcgtgtcttcgtgttggtgcgcttttcactggtcataaagtgctgctcacggccgtgaactgctacagcgtgaaggccgccacccgggtccaggatgcttttgccgccgccaagctcctggccctggccctgatcatcctgctgggcttcgtccagatcgggaagggtgatgtgtccaatctagatcccaagttctcatttgaaggcaccaaactggatgtggggaacattgtgctggcattatacagcggcctctttgcctatggaggatggaattacttgaatttcgtcacagaggaaatgatcaacccctacagaaacctgcccctggccatcatcatctccctgcccatcgtgacgctggtgtacgtgctgaccaacctggcctacttcaccaccctgtccaccgagcagatgctgtcgtccgaggccgtggccgtggacttcgggaactatcacctgggcgtcatgtcctggatcatccccgtcttcgtgggcctgtcctgctttggctccgtcaatgggtccctgttcacatcctccaggctcttcttcgtggggtcccgggaaggccacctgccctccatcctctccatgatccacccacagctcctcacccccgtgccgtccctcgtgttcacgtgtgtgatgacgctgctctacgccttctccaaggacatcttctccgtcatcaacttcttcagcttcttcaactggctctgcgtggccctggccatcatcggcatgatctggctgcgccacagaaagcctgagcttgagcggcccatcaaggtgaacctggccctgcctgtgttcttcatcctggcctgcctcttcctgatcgccgtctccttctggaagacacccgtggagtgtggcatcggcttcaccatcatcctcagcgggctgcccgtctacttcttcggggtctggtggaaaaacaagcccaagtggctcctccagggcatcttctccacgaccgtcctgtgtcagaagctcatgcaggtggtcccccaggagacatagccaggaggccgagtggctgccggaggagcatgcgcagaggccagttaaagtagatcacctcctcgaacccactccggttccccgcaacccacagctcagctgcccatcccagtcctcgccgtccctcccaggtcgggcagtggaggctgctgtgaaaactctggtacgaatctcatccctcaactgagggccagggacccaggtgtgcctgtgctcctgcccaggagcagcttttggtctccttgggccctttttcccttccctcctttgtttacttatatatatattttttttaaacttaaattttgggtcaacttgacaccactaagatgattttttaaggagctgggggaaggcaggagccttcctttctcctgccccaagggcccagaccctgggcaaacagagctactgagacttggaacctcattgctaccacagacttgcactgaagccagacagctgcccagacacatgggcttgtgacattcgtgaaaaccaaccctgtgggcttatgtctctgccttagggtttgcagagtggaaactcagccgtagggtggcactgggagggggtgggggatctgggcaaggtgggtgattcctcccaggaggtgcttgaggccccgatggactcctgaccataatcctagccccgagacaccatcctgagccagggaacagccccagggttggggggtgccggcatctcccctagctcaccaggcctggcctctgggcagtgtggcctcttggctatttctgttccagttttggaggctgagttctggttcatgcagacaaagccctgtccttcagtcttctagaaacagagacaagaaaggcagacacaccgcggccaggcacccatgtgggcgcccaccctgggctccacacagcagtgtcccctgccccagaggtcgcagctaccctcagcctccaatgcattggcctctgtaccgcccggcagccccttctggccggtgctgggttcccactcccggcctaggcacctccccgctctccctgtcacgctcatgtcctgtcctggtcctgatgcccgttgtctaggagacagagccaagcactgctcacgtctctgccgcctgcgtttggaggcccctgggctctcacccagtccccacccgcctgcagagagggaactagggcaccccttgtttctgttgttcccgtgaatttttttcgctatgggaggcagccgaggcctggccaatgcggcccactttcctgagctgtcgctgcctccatggcagcagccaaggacccccagaacaagaagacccccccgcaggatccctcctgagctcggggggctctgccttctcaggccccgggcttcccttctccccagccagaggtggagccaagtggtccagcgtcactccagtgctcagctgtggctggaggagctggcctgtggcacagccctgagtgtcccaagccgggagccaacgaagccggacacggcttcactgaccagcggctgctcaagccgcaagctctcagcaagtgcccagtggagcctgccgcccccacctgggcaccgggaccccctcaccatccagtgggcccggagaaacctgatgaacagtttggggactcaggaccagatgtccgtctctcttgcttgaggaatgaagacctttattcacccctgccccgttgcttcccgctgcacatggacagacttcacagcgtctgctcataggacctgcatccttcctggggacgaattccactcgtccaagggacagcccacggtctggaggccgaggaccaccagcaggcaggtggactgactgtgttgggcaagacctcttccctctgggcctgttctcttggctgcaaataaggacagcagctggtgccccacctgcctggtgcattgctgtgtgaatccaggaggcagtggacatcgtaggcagccacggccccaggtccaggagaagtgctccctggaggcacggaccactgcttcccactggggccggcggggcccacgcacgacgtcagcctcttaccttcccgcctcggctaggggtcctcgggatgccgttctgttccaacctcctgttctgggaggtggacatgcctcaaggatacagggagccggcggcctctcgacggcacgcacttcctgttggctgctgcggctgtgggcgagcatgggggctgccagcgtctgttgtggaaagtagctgctagtgaaatggctggggccgctggggtccgtcttcacactgcgcaggtctcttctgggcgtctgagctggggtgggagctcctccgcagaaggttggtggggggtccagtctgtgatccttggtgctgtgtgccccactccagcctggggaccccacttcagaaggtaggggccgtgtcccgcggtgctgactgaggcctgcttccccctccccctcctgctgtgctggaattccacagggaccagggccaccgcaggggactgtctcagaagacttgatttttccgtccctttttctccacactccactgacaaacgtccccagcggtttccacttgtgggcttcaggtgttttcaagcacaacccaccacaacaagcaagtgcattttcagtcgttgtgcttttttgttttgtgctaacgtcttactaatttaaagatgctgtcggcaccatgtttatttatttccagtggtcatgctcagccttgctgctctgcgtggcgcaggtgccatgcctgctccctgtctgtgtcccagccacgcagggccatccactgtgacgtcggccgaccaggctggacaccctctgccgagtaatgacgtgtgtggctgggaccttctttattctgtgttaatggctaacctgttacactgggctgggttgggtagggtgttctggcttttttgtggggtttttatttttaaagaaacactcaatcatcctag

SEQ ID NO: 11 - DNA, 1810 bp, Homo sapiens
ggggggaaggccaagcagtgaccaggaagagggagaaacttctgctcagaccgagcgtgtgccactggacctcagtcctcgcctggaggagacgctggacttcggcgaggtggaagtggagcccagtgaggtggaagacttcgaggctcgtgggagccgcttctccaagtctgctgatgagagacagcgcatgctggtcgcagcgtaaggacgaactcctccagcaagctcgcaaacgtttcttgaacaaaagttctgaagatgatgcggcctcagagagcttcctcccctcggaaggtgcgtcctctgaccccgtgaccctgcgtcgaaggatgctggctgccgcgcggaacggaggcttcagaagcagcagacctcctagcgctcccttgccttcctcagctgcctcctgcgccctgtgcccgactgactggaggaggcctgtcccaattctgccgctccatggaaaagcgggcttgactgcattgccgctgtataaagcatgtggtcttatagtgtttggacagctgataaatttaatccttctttgtaatactttctatgtgacatttctcttccccttagaaacactgcaaattttaactgtaggtatgatctcttctggtgttgactggactgcttggggtgggggacgatcaggaggaagtgagccagtcgcctgcctgcagcaggcagcttctactcctgcctcatgcatacgtcccacaaatgcaggtgtcctgagcaccacacccagtgggaagagtgtgggggaggcgcacagtgtgagcccgcccccacgtcgtggggtaacatctgttatcaaactgctgtcgttgttgtggaagcatgtagactgtgccagagccagacccacgggctcatgcacccctgagcagcagggcatcttggaaaaggaactcttggttcgatacctggagcagaggaggggaaagtccagggctatagggtgtgatgaagtcacccctttctgtcccactacatctgggactgactttccgagcctccagtccaaagccggcttgatttccgtgaactctggtgctcctgcatctcatgagtgtgccccatgggtcccctcccctctcagcatttccttgtcccgtctggacctggggagtggttaggcagcaagctttggtttatggttttcattcattggtgaagtaaattaggcagtgctaaagcctgtgggtttggtccttgaacaagatgtgggccttgcaagatgggagagtaaaccttgaagggctttattaaagaaataaaaaagaacttttgtatcttttatcctgggagcactgcgttttcctagctgtgttattcctggtttaattcagcagagaaggtaaggtgtgaacctacctgccttggagaggcccaggtcccaaatctcttcaaattcttcacatgtttaactttaaggatttgaaccatgaagtcataggttacagacctcagttttatgccccattggattacttttttttttttttttttttttttactctttgaaagctttgttttgtggtagtcgcttttgggaagaatccagtattatctacaattattggcaaagtttaaatgtattttacataacggaaagtttttagaatgttgaaaagtaattgaaaaaggtgataggtaaatttttaggcaaagataatttatttcaataaatctttcaaaagccttaccttgaaatgctgttagtaaatttctgtgcattttttttttttaatttgttttgctgagagcatagctatttgtttttattgtaaacccgccc

SEQ ID NO: 12 - DNA, 3038 bp, Homo sapiens
caaatgtgggcgccaatcctgctttaactgtggagccattggcatgatcctgttccaatgtaagtggttaaagacatggattaaaaagtgtgatgatgacagtgaaacctccaattggattgcagccaacacaaaggaatgtcccaaatgccatgtcacaattgagaaggatggtggttgtaatcacatggtctgtcgtaaccagaattgtaaagcagagttttgctgggtgtgtcttggcccatgggaaccacatggatctgcctggtacaactgtaaccgctataatgaggatgatgcaaaggcagcaagagatgcacaggagcgatctagggcagccctgcagaggtacctgttctactgtaatcgctatatgaaccacatgcagagcctgcgctttgagcacaaactatatgctcaggtgaaacagaaaatggaggagatgcagcagcacaacatgtcctggattgaggtgcagttcctgaagaaggcagttgatgtcctctgccagtgtcgtgccacactcatgtacacttatgtcttcgctttctacctcaaaaagaataaccagtccattatctttgagaataaccaagcagatctagagaatgccacagaggtgctctcgggctaccttgaacgagatatttcccaagattctctgcaggatataaagcagaaagtacaagacaagtacagatactgtgagagtcgacgaagggttttgttacagcatgtgcatgaaggctatgaaaaagatctgtgggagtacattgaggactgagaatggccctgcataaaatgaactctgaaaactttaccatctagagtgctcatgcaattaaaacaaaacaaacacaaacaaggaggcactaaggcctattctgacaccactggtctgtagtaccagaattgttttgttaatggaaagtttaagtaaattatattgtaataaaaaggtagataaacccattgtacaacagtattctaggccgccaacaaaagtgtgacagacacactaaaagccctccaactttaacttgtaacgtagcttcattctcaaagctgactccttttttttctttttccttttcctgagtgtagtacagttaaaatttcaaacagctccttgacactgcttttcatgttcaaaccagccattttgttgtactttggtaaaggacctcttccccttcctcccctacacatacagatacacccacacacagactgactctctttctctcataccccaaggtcatgagtgaatgatgcttagttccttgtaaagaaaatcttgggatggggaaaggggtaggcagcaagaggattcaacaaacgaaaaacataaaaactttgtatatgacttttaaaacaagaggacaacacagtatttttcaaaattgtatatagcgcatatgcatggacaaagcaagcgtggcacgtgtttgcataatgtttaattacaaaaaaatatttattctttaaaaatcttcaagattatgtctatttgctgtgcattttctttcagtttgcttatctttcccgggttggggttgggataaaggtgtgtcggtttagcacctctggaagacctatctagagctctttcactttcctgaggttattttgccctttctggtgttggtatgtctgttgccggccatgggcctcatgccttgaattcctgctcttgatcagggacaagggaggtcaagctctgactaatgccatgacctgattaaggggtacagcagggagttttgttgctacagctcatgaattaacctgtcccaacctaatccccctccatggcatcatgcctctacccaagcctttgtgtgcccatgttatgcacacagctgtaggcattcttaagtcccctgtcgcatccagtggaagcattttaaaatttcttttactttttggttttcccttaattgctgcttttcagattttagttatggctcgtctgctcaccccttctctacattagggtgtcaaagagaatgttttgctttaaatataaatagccattcatttagtctcagattgtgaatttaaaatggtggataccgaaattgcttgtgtgtgttgctgtgggtttggtttgaaggcaaacacccctagaacatgatattcccatctagtgcatttaaatagaaatcactgagtttgctgcttttttattgtcagcagataggagaattaataatgcattttagctgtgatgtccatttttatgaaattcctactaagagctatgttaaaagtaaaggatggtggtggttgtattaactatatacctgtttaggccattctggctgtggtatttttcaatagctcagcatctgtaaatctgtcagttttatacaggagtgcagagtgaactaggcaactagattaagaggtctaaatatgaaataccagttgaggctgaggacctcttcgtcttcctttaaatgtcttttgcctagggagtgtttaccatttgtgaggcagctttgtctgctcttacactgtacatcctattactccattgggaagtaggttcactttcctctggccttttgcctaagttaggctttgctgaatcaaccctacttttccttttagaaaaggttgttacaggagatttactggcaactgttcttttcccatcaaaaatcagtgaatgtttgctgagtataaatgctgcttccttaaaccacttgtcgctttaggatcaactttacctgtaccttttctcctttcctcccttgccacctcaggtgcaaatctgaactcagtgtctgcttcttccattttctcgtctctctcccctcttcccccattatccatatgacattattttacttcaaatgacagcatcaatcttaaaaagatatacattaaaactaaggagtttttttaaagaaagcctgaataagttcctttccctggtaactttgaaaagcagtcagagttgctatatagatatatgtggctcctttaaaatgctttgtgtatgtgtggtgtttaaaaaaaaaaaaaaaaaa

SEQ ID NO: 13 - DNA, 6011 bp, Homo sapiens
atgatggagcgcgccatcatcgacacttttgtggggcacgacgtggtggagccaggcagctacgtgcagatgttcccctacccctgctacacacgcgatgacttcctgtttgtcattgagcacatgatgccgctgtgcatggtgatctcctgggtctactccgtggccatgaccatccagcacatcgtggcggagaaggagcaccggctcaaggaggtgatgaagaccatgggcctgaacaacgcggtgcactgggtggcctggttcatcaccggctttgtgcagctgtccatctccgtgacagcactcaccgccatcctgaagtacggccaggtgcttatgcacagccacgtggtcatcatctggctcttcctggcagtctacgcggtggccaccatcatgttctgcttcctggtgtctgtgctgtactccaaggccaagctggcctcggcctgcggtggcatcatctacttcctgagctacgtgccctacatgtacgtggcgatccgagaggaggtggcgcatgataagatcacggccttcgagaagtgcatcgcgtccctcatgtccacgacggcctttggtctgggctctaagtacttcgcgctgtatgaggtggccggcgtgggcatccagtggcacaccttcagccagtccccggtggagggggacgacttcaacttgctcctggctgtcaccatgctgatggtggacgccgtggtctatggcatcctcacgtggtacattgaggctgtgcacccaggcatgtacgggctgccccggccctggtacttcccactgcagaagtcctactggctgggcagtgggcggacagaagcctgggagtggagctggccgtgggcacgcaccccccgcctcagtgtcatggaggaggaccaggcctgtgccatggagagccggcgctttgaggagacccgtggcatggaggaggagcccacccacctgcctctggttgtctgcgtggacaaactcaccaaggtctacaaggacgacaagaagctggccctgaacaagctgagcctgaacctctacgagaaccaggtggtctccttcttgggccacaacggggcgggcaagaccaccaccatgtccatcctgaccggcctgttccctccaacgtcgggttccgccaccatctacgggcacgacatccgcacggagatggatgagatccgcaagaacctgggcatgtgcccgcagcacaatgtgctctttgaccggctcacggtggaggaacacctctggttctactcacggctcaagagcatggctcaggaggagatccgcagagagatggacaagatgatcgaggacctggagctctccaacaaacggcactcactggtgcagacattgtcgggtggcatgaagcgcaagctgtccgtggccatcgccttcgtgggcggctctcgcgccatcatcctggacgagcccacggcgggcgtggacccctacgcgcgccgcgccatctgggacctcatcctgaagtacaagccaggccgcaccatccttctgtccacccaccacatggatgaggctgacctgcttggggaccgcattgccatcatctcccatgggaagctcaagtgctgcggctccccgctcttcctcaagggcacctatggcgacgggtaccgcctcacgctggtcaagcggcccgccgagccggggggcccccaagagccagggctggcatccagccccccaggtcgggccccgctgagcagctgctccgagctccaggtgtcccagttcatccgcaagcatgtggcctcctgcctgctggtctcagacacaagcacggagctctcctacatcctgcccagcgaggccgccaagaagggggctttcgagcgcctcttccagcacctggagcgcagcctggatgcactgcacctcagcagcttcgggctgatggacacgaccctggaggaagtgttcctcaaggtgtcggaggaggatcagtcgctggagaacagtgaggccgatgtgaaggagtccaggaaggatgtgctccctggggcggagggcccggcgtctggggagggtcacgctggcaatctggcccggtgctcggagctgacccagtcgcaggcatcgctgcagtcggcgtcatctgtgggctctgcccgtggcgacgagggagctggctacaccgacgtctatggcgactaccgccccctctttgataacccacaggacccagacaatgtcagcctgcaagaggtggaggcagaggccctgtcgagggtcggccagggcagccgcaagctggacggcgggtggctgaaggtgcgccagttccacgggctgctggtcaaacgcttccactgcgcccgccgcaactccaaggcactcttctcccagatcttgctgccagccttcttcgtctgcgtggccatgaccgtggccctgtccgtcccggagattggtgatctgcccccgctggtcctgtcaccttcccagtaccacaactacacccagccccgtggcaatttcatcccctacgccaacgaggagcgccgcgagtaccggctgcggctatcgcccgacgccagcccccagcagctcgtgagcacgttccggctgccgtcgggggtgggtgccacctgcgtgctcaagtctcccgccaacggctcgctggggcccacgttgaacctgagcagcggggagtcgcgcctgctggcggctcggttcttcgacagcatgtgtctggagtccttcacacaggggctgccactgtccaatttcgtgccacccccaccctcgcccgccccatctgactcgccagcgtccccggatgaggacctgcaggcctggaacgtctccctgccgcccaccgctgggccagaaatgtggacgtcggcaccctccctgccgcgcctggtacgggagcccgtccgctgcacctgctctgcgcagggcaccggcttctcctgccccagcagtgtgggcgggcacccgccccagatgcgggtggtcacaggcgacatcctgaccgacatcaccggccacaatgtctctgagtacctgctcttcacctccgaccgcttccgactgcaccggtatggggccatcacctttggaaacgtcctgaagtccatcccagcctcatttggcaccagggccccacccatggtgcggaagatcgcggtgcgcagggctgcccaggttttctacaacaacaagggctatcacagcatgcccacctacctcaacagcctcaacaacgccatcctgcgtgccaacctgcccaagagcaagggcaacccggcggcttacggcatcaccgtcaccaaccaccccatgaataagaccagcgccagcctctccctggattacctgctgcagggcacggatgtcgtcatcgccatcttcatcatcgtggccatgtccttcgtgccggccagcttcgttgtcttcctcgtggccgagaagtccaccaaggccaagcatctgcagtttgtcagcggctgcaaccccatcatctactggctggcgaactacgtgtgggacatgctcaactacctggtccccgctacctgctgtgtcatcatcctgtttgtgttcgacctgccggcctacacgtcgcccaccaacttccctgccgtcctctccctcttcctgctctatgggtggtccatcacgcccatcatgtacccggcctccttctggttcgaggtccccagctccgcctacgtgttcctcattgtcatcaatctcttcatcggcatcaccgccaccgtggccaccttcctgctacagctcttcgagcacgacaaggacctgaaggttgtcaacagttacctgaaaagctgcttcctcattttccccaactacaacctgggccacgggctcatggagatggcctacaacgagtacatcaacgagtactacgccaagattggccagtttgacaagatgaagtccccgttcgagtgggacattgtcacccgcggactggtggccatggcggttgagggcgtcgtgggcttcctcctgaccatcatgtgccagtacaacttcctgcggcggccacagcgcatgcctgtgtctaccaagcctgtggaggatgatgtggacgtggccagtgagcggcagcgagtgctccggggagacgccgacaatgacatggtcaagattgagaacctgaccaaggtctacaagtcccggaagattggccgtatcctggccgttgaccgcctgtgcctgggtgtgcgtcctggcgagtgcttcgggctcctgggcgtcaacggtgcgggcaagaccagcaccttcaagatgctgaccggcgacgagagcacgacggggggcgaggccttcgtcaatggacacagcgtgctgaaggagctgctccaggtgcagcagagcctcggctactgcccgcagtgtgacgcgctgttcgacgagctcacggcccgggagcacctgcagctgtacacgcggctgcgtgggatctcctggaaggacgaggcccgggtggtgaagtgggctctggagaagctggagctgaccaagtacgcagacaagccggctggcacctacagcggcggcaacaagcggaagctctccacggccatcgccctcattgggtacccagccttcatcttcctggacgagcccaccacaggcatggaccccaaggcccggcgcttcctctggaacctcatcctcgacctcatcaagacagggcgttcagtggtgctgacatcacacagcatggaggagtgcgaggcgctgtgcacgcggctggccatcatggtgaacggtcgcctgcggtgcctgggcagcatccagcacctgaagaaccggtttggagatggctacatgatcacggtgcggaccaagagcagccagagtgtgaaggacgtggtgcggttcttcaaccgcaacttcccggaagccatgctcaaggagcggcaccacacaaaggtgcagtaccagctcaagtcggagcacatctcgctggcccaggtgttcagcaagatggagcaggtgtctggcgtgctgggcatcgaggactactcggtcagccagaccacactggacaatgtgttcgtgaactttgccaagaagcagagtgacaacctggagcagcaggagacggagccgccatccgcactgcagtcccctctcggctgcttgctcagcctgctccggccccggtctgcccccacggagctccgggcacttgtggcagacgagcccgaggacctggacacggaggacgagggcctcatcagcttcgaggaggagcgggcccagctgtccttcaacacggacacgctctgctgaccacccagagctgggccagggaggacacgctccactgaccacccagagctgggccagggactcaacaatggggacagaagtcccccagtgcctgccagggcctggagtggaggttcaggaccaaggggcttctggtcctccagcccctgtactcggccatgccctgcggtcactgcggttgccgcccctaattgtgccaaaggctgacccggcccgggctgcgtacacccttgccctgctttgccttaaagcctcggggtctgcccggcccctcgcccctgcctggcactgctcaccgcccaaggcgacgccggctggaccaggcactgctggcctttctcctgcccggcctcggaaccagcttttctctcttacgatgaaggctgatgccgagagcgggctgtgggcggagctgggtcagtcccgtatttattttgctttgagaagaggctcctctggccctgctctcctgcagggaggtggctgtcccgcgggaagccatcagcttgggccagctggcaggtggcaggaatggagaagctgaccctgctggccaggcaaggggccagaccccccccaacccccagctgccatcgctctcccacccagcttggccccctgcccgcccacctccctgggagccgggcctgtacatagcgcacagatgtttgttttaaataaataaacaaaatgtc

SEQ ID NO: 14 - skipped

SEQ ID NO: 15 - DNA, 1519 bp, Homo sapiens
tgtgatttcttttaggatggaagagtgtagaaagtgtcccaaagttggtgtctgaatatatgtccaaaaagataaaagttgatgaatttgtgactcacaatctgtcttttgatgaaatcaacaaagcctttgaactgatgcattctggaaagaggtaggctttctctttatatatcatagaatgtaataatgatgttgagtttgaggggatggagagtcgaaaaacacaattttagttgtcttaaaggtatcatttaaaacttagtatgttgcttccttttacagcattcgaactgttgtaaagatttaattcaaaagagaaaataatgtccatcctgtcgtgatgtgataggagcagcttaacaggcagggagaagcgcctccaacctcacagcctcgtagagcttcacagctactccagaaaatagggttatgtgtgtcattcatgaatctctataatcaaggacaaggataattcagtcatgaacctgttttctggatgctcctccacataaataattgctagtttattaaggaatattttaacataataaaagtaatttctacatttgtgtggaaattgtcttgttttatgctgtcatcattgtcacggtttgtctgcccattatcttcattctgcaagggaaagggaaaggaagcagggcagtggtgggtgtctgaaacctcagaaacataacgttgaacttttaagggtctcagtccccgttgattaaagaacagatcctagccatcagtgacaaagttaatcaggacccaagtctgcttctgtgatattatctttaagggaggtactgtgccttgttcatacctgtaccccaaattcctaggatggcatctgccttcagggggcactaaaatgtattattgaaacagcattctgggcttaaataggtgtatgtatgtgttggttgtgactgtactatttctagtatagtgaactacatactgaatatccaagttctcagcacctacttttgtcaaatcttaacattttgccacttcgagatcacattgccattcctcccctccaagaggtaacaattatccacaatttgatgtttatcattcctgtgttgttgtactttcactgtgtataacctaaaccatctactctttagtactgttttatatatttttaagcctcatacttgctcattctacagcttttttcactcattattgtataattatatctgaagctctcgttcattaattttagtcctgtgtagcagaattcaattacgggaactaccataatttatctgttctccagtccagttgaaggcatgaagttgttgccagtttctgtattataacactgtagtggaacattcttctgcattgggctcactgcgtgttacctaagacgtatcacagaataaacacatttagccttatagacattgccaaattgctcttcaaagtaaatgtgagtttttgtgaattacatgagtatggaatggtgttttattatgactttagtttgcattttcctcaa

SEQ ID NO: 16 - DNA, 1593 bp, Homo sapiens
tgtcttgaaggtggtctgagctttctcactccaagccagtcgtgtgggaagggacactctctgagcctcagtttcctcagctgtcaacctctcagggcttgttctagtggctccgaaagccagtgggagcaagcgcgctttgcaaagccttgggcgccgggccttggcgcgcctttgccggatccttccggccacgggcggggcgagcccagaggagaagagccgaggggcggtgcccgggccagggggcggaggcaggcggctctggctccctctcgggacgctctttccttcttcctcttgttcctcctcctgcctctcttcgcttcgcctgcaaacgcggtgggggctgctcggcggtcaggagcagcaagagacagagcgacatgagagattggaccgcgggctgcactggagaatttactggtaggataattcatccctaaagagattgaagtgagcttcagaatggcaaaagaggagccccagagtatctcaagggacttgcaggaactgcagaagaagctgtctctgctgatagactccttccagaataactcaaagctgccccaacacagcaggatctcactggactctgatgatggagtgtccaggctgggcagtgctggctccaaggtggtggcctttatgaagtctccagtgggtcagtacttggacagccatccgtttctggccttcaccttgctggtgttcattgtcatgtcggccgttcctgttggattcttcctgctcatcgtggtgcttaccaccctggctgctctgctgggggtcataatattggaaggattggtcatctctgtgggtggcttctcactgctctgcatcctctgtggtttgggcttcgtatcactcgccatgtcggggatgatgatagcatcttatgtagtggtctccagcctcatcagctgctggttttctcccaggtctcacgagatctgatggttttataaagggcatttcccctgcacatgctctcttgcctgccgccatgtaagaagtgcctctgatcttcctttgccttccaccatgattgtgaggcctccccagccatgtggaattgccactgacacagcaaaacaccagttgtgactttctgccagccatgaagtctgcagacttcgaggggctttaccaggaatgagtgactgctcagaggccgggcttcttttcaagtactgctggatcatactcaccccttgggattatggcttagaagaagggggctgggtaggcaagcactccttggctgtgtcctctcgctttttcacttacttgtaggatcccgcagcagccaatttagggattgtgttgttcttgtgttggttcccatgtaaagaagcagcagagaaatgcgatggttcaacagctcgccctgccccaagtatgcagacttgaccttggcggggtcctgggcttctagagtctagcccgttgaccccaaagcctcagggcttatgtccaacggtcccattgggagcaacagtgattgtttatagttttttgttttcagaaatgagggcagctgttaattttttcactcatgtgaaacaaaatgaaaaaaaaaaaaaaaaa

SEQ ID NO: 17 - DNA, 4026 bp, Homo sapiens
tgctggccctggcgcggcgggtgaggccctggcggtgctgacttcattcgggaggcggttgctggtgctgatacctgtgtatttggccggggcagtgggactcagcgtgggtttcgtgctcttcggcctcgccctctacctgggctggcgccgggtccgcgacgagaaagaacggagccttcgagcagcgaggcagctactggacgacgaggagcagctcactgcgaaaactctctatatgagtcatcgagagctacctgcctgggtcagcttcccagacgtggaaaaggctgaatggctcaataagattgtggcccaggtctggcccttcctgggccagtatatggagaagcttctggctgaaactgtggctccggctgttaggggatctaacccccatctgcaaacatttacatttacacgagtggaactgggtgaaaagccattgcgcatcattggagtcaaggttcacccaggtcagagaaaagagcagatcctgctggacttgaacatcagctatgtaggtgatgtgcagattgatgtggaagtgaagaaatatttttgcaaagcaggagtcaagggcatgcagctacatggcgttttgcgggtgatactggagccactcattggggaccttcccttcgtgggggctgtgtcaatgttcttcatccgacgcccgaccctagacatcaactggacagggatgaccaacctgctggatatcccaggacttagctcactctctgacaccatgatcatggactccattgctgccttcctcgtgttgcccaaccgattactggtgccccttgtgcctgaccttcaagatgtggctcagttgcgttcccctctgcccaggggcattattcgaattcacctgctggctgctcgagggctgagttccaaggacaaatatgtgaagggcctgattgagggcaagtcagacccatatgcacttgtgcgtttgggtacccagacattctgcagtcgtgtcattgatgaagaactcaacccacagtggggagagacttatgaggtgatggtacacgaggtcccagggcaggagattgaagtggaggtgttcgacaaggatccagataaagatgactttctgggcagaatgaagctggatgtagggaaggtgttacaggctagcgttctggatgattggttccctctacaaggtgggcaaggccaagttcacttgaggctagaatggctgtcacttttgtcagatgcagagaaactggagcaggttctacagtggaattggggagtctcctctcgaccagatcccccgtcagctgccatcttagttgtctacctggatcgggcccaggatcttcctatggtgacctctgaattgtacccaccacagctgaagaaggggaacaaggaacccaaccctatggtacaactgtcaattcaggatgtgactcaggagagcaaggctgtctacagtaccaactgcccagtgtgggaggaagcgttccggttcttcctacaagaccctcaaagccaggagctcgatgtgcaagtgaaggatgattccagggccctgactttaggagcactgacgctgcctctggcccgcctgctgactgccccagaactcatcctggaccagtggttccagctcagcagctctggtccaaactccagactctatatgaaactagtcatgaggatcctgtacttggattcatcagaaatatgcttccccacggtgcctggttgtcctggtgcttgggacgtggacagtgagaatccccagagaggcagcagtgtggatgccccacctcgaccctgtcacacgactcctgatagccagtttgggactgagcatgtgcttcggatccatgtattagaggcccaggacctgattgccaaagaccgtttcttggggggactggtgaagggcaagtcagacccctatgtcaaactaaagttggcaggacgaagcttccggagccatgttgttcgggaagatctcaatccccgctggaatgaggtttttgaggtgatcgtcacatcagttccaggccaagagctagaggttgaagtctttgacaaggacttggacaaggatgattttctgggcaggtgtaaagtgcgtctcaccacagtcttaaacagtggcttccttgatgagtggctgaccctggaggatgtcccatctggccgcctgcacttgcgcctggagcgtctcaccccccgtcccactgctgctgagttagaggaggtgctgcaggtgaatagtttgatccagactcagaagagtgcggagctggctgcggccctgctatccatctatatggagcgggcagaggacctcccgctgcgaaaaggcaccaagcacctcagcccttatgctactctcactgtgggagatagttctcataaaaccaagactatttcgcaaacttcagcccctgtctgggatgagagtgcctcctttctcatcaggaaaccacacactgagagcctagagttgcaggttcggggtgagggcactggcgtgctgggctcattatccctgcccctctcagagctcctcgtggctgaccagctctgcttggaccgctggtttacactcagcagtggtcaggggcaggtgctactgagagcacagctagggatcctggtgtcccagcactcgggagtggaagctcatagccacagctacagccacagctcctcatcgctgagtgaagaaccagagctctcggggggaccccctcacatcacctcctcagccccagagctccggcagcgcctaacacatgttgacagtccccttgaggctccagccgggcctctgggccaggtgaaactgactctgtggtactacagtgaagaacgaaagctggtcagcattgttcatggttgccggtcccttcgacagaatggacgtgatcctcctgatccctatgtgtcactgttgctactgccagacaagaaccgaggcaccaagaggaggacctcacagaagaagaggaccctgagtcctgaatttaatgaacggtttgagtgggaactccccctggatgaggcccagagacgaaagctggatgtctctgtcaagtctaattcctccttcatgtcaagagagcgtgagctgctggggaaggtgcagctggacctagctgagacagacctttcccagggtgtagcccggtggtatgacctgatggacaacaaggacaagggcagctcctaggagctggcgagtcccagcctgactgctctgtcttcctgccttcgtctcgctccatcaccgcctcaatgtgatgagcctaaagctagggtccaagggcagagcctgtgcccttcagccctttcacctaacaggcccatattcgggcctttgcctgaccaaagagaagaaccgtatgttccctttactgcacggcctttatccttctgggcccctggggcggggacctgagctggctgtttcctgctttgcctgcacattgttctcccttcctcccaactcctcagggccttctgtatctgtgcctggccagtggcagcactagcagtggtattagcttatgccaaatacagctttggaaggatctttttttctttaactagatggtcaccttcttccctaccacacatgggtgggaaggtggacaggctaacctctccagctgtgagcctcttagactactgcatgtagcaaatgttcagcagctcaggcccccatgtccagttctgtccccactgtcctcaaccctgtcctgaaaattctactgctttgatggctggggccagtctcttgtcactttggaaactgaggacgcgtggattctactcaagcctccaagtagtggcatatcagtcttggagctcctagctggtgatacggagagggctttggaggacttgggacagcagggccaatttttttgcccaagtgcctaggctgctaactcactgactagaacttaatctggtactttacagttttgcaccaactctgccaagccactggatcttacattaaacatcatactc

SEQ ID NO: 18 - DNA, 4012 bp, Homo sapiens
tgggtttttaccagcaacaaaaaatttattgaatgagaagaaccatggtgtcctccacacatctgtagtcctcctcacagaaatgtgtgagcgaagcccagacatgcttgcgcatttcagagagaatgaaaagcttgtgccccaattagttcgtattttaaagaacctcatcatgtccggatattcaccaggacatgatgtttctggtatcagtgacccctttttgcaggtacgaattttgcggttattaagaattttaggacgaaatgatgatgattcaagtgaagctatgaatgatatattagcacaggttgccactaatactgagactagtaaaaatgtaggaaatgctattctttatgaaacggttttgactatcatggatattaagtcagagagtggattgcgagtcctagccataaatatcctgggtcgtttcttattgaacaatgacaagaatattaggtatgtggctctgacatctttgttgaagactgtacagacagatcataatgcagtacagaggcacagaagcacaattgtggactgtcttaaagatttggatgtctcaataaaacggcgtgcaatggaattgagttttgccctggtaaatgggaataatatccgaggcatgatgaaagaattactttattttctggattcgtgtgagccagaatttaaagcagactgtgcatctggaatctttcttgctgcagaaaagtatgcaccttccaaacgatggcatatagacacaattatgcgtgttttgacaacggcaggaagttatgttcgtgatgatgcagtccccaatttaatccagttaataactaatagtgtggagatgcatgcctatactgtccagcgcctgtacaaagcaattcttggtgattattctcaacaacctttggtacaagtggctgcatggtgtataggtgaatatggtgatcttcttgtatctggccagtgtgaagaggaagagcctattcaggtaacagaggatgaagtgttggatattttagaaagtgtcctaatctctaatatgtccacctctgtgacacgaggttatgccctcactgccattatgaagctttccactcgattcacttgtactgtaaaccgaattaagaaagtggtttccatctacggaagcagcattgatgtggaactccagcggagggcagtagaatataatgcacttttcaagaaatatgaccacatgaggtctgccctacttgagagaatgcctgtcatggaaaaagtgaccacaaatggccctactgagattgtgcagacaaatggagagacagaaccagctccactagagaccaaaccgccaccctctgggccacagcccaccagccaggccaatgatttattggatttgttgggaggaaatgacataacacctgttattccaactgcgcctacaagcaaaccatcttctgctggtggagaacttcttgatttgctgggagacatcaaccttacagggtctcactctgtcagccaggctggagtgcagtgggattatctcggctcacttcaacctctgcctcctgcgttcaggtgagcctcctgcctcggcctcctgagtagctgggattataggcgaatgccaccatgcccggctaattttttgtatttttagtagagacggggttttgctgtcttctttaaggggataatgaagagttaaagcacacatgaccttgagtaaaaaatagacataggataacaagttggatggttagctaagctcattcccacaggctgattttttttttcctaatacagtggagtcacagagtataggatttatgtctgtgtcttaacaaaatttcaaaatgttacttgtcatgtacttatgaatcatttacaaatggtcaatttcaaatcctcaaatgtcaaagctgtactggataaccggcaaagaaaaaacaaccccacagttaaaccatagcatatacttcacctaatatgttagtatttccatgttaatatatatagccttcataattataattttaggtgactaatactttatcaacaaatttgctctgtttactcagttcgttagtattgggtagtttggcttttttttttggtttttttgaaacggaatcttgctttgttgcccgggctggagtgcaacagcacgatcgcggctcactgcaacctctgcctcccgggttcaagtgattctcctgcctcagcctcccgagtagctgggatttataggcacgtgccaccatgcccagctaatttttgtatttttttatttgagatggggtttcaccatgttggccaggctggtcttgaactcctgacctcggatgatcctcccgccttggcctcccaaagtgctgggattacaggcatgagtcaccgcacccagccagtatggggtattttgtttctagatttttctacctagcggccccaacaaatattacatcaatttgttcttattttagattaatttgttagactaagtgacttagtctttctgaatctggttaaaattaggatgattaatacttactccataagatatttgtgaggcccattgacctattcagtgcatgatacatagtaggcacttggtaaatattatttaccttttcctcaatttatatgtttaaccgcacagtcataagcattgtatattatcattttaaaaagccctattgggtgaaaatttggtcctattatattttatttttattattatttttttaaattttgtagccctctgccaggcttggtcagcagagagaggccctattattttttgatcacagagcgagactccatctcaaaaaaaaaaaaaaaaaaaaaaattattctgtaccatcacaacttttcacaacgatggcaagccttatgtcttgggagcctgttttgctaggcaaagttacaagtgacctaatgggagctcaaatgtgtgtgtgtctctctgtgtgtttgtgtgtgtgtgtgcactcaagacctctaacagcctcgaagcctggggtggcatcccggccttgccattagcatgcctcatgcatcatcagatgacaaggacaaccctcatgacgaagcaacatgaattagggggcctcttggccttggtccaaaattgtcaatcagaaatgaacataaaggactccagagcagtgggactgtctgtcaaaagactctgtatatcttttgcggatgagttttgtgagagaacagagagaccattgtacctggcacaagggctcttcatgaaaagggagacttactgggaggtgcaagacagtggcatttctcctctcctcttgctgctcagcacagccctggattgcagccccgaggctgagaccagacaaagcccgggaggcagaaagatgctccaagaaccaacactatcaatgtctttgcaaatcctcacaggattcctgtgggtccagctttggaactgggaaacctttcttcggatccgcactcattccactgatgccagctgcccctgaaggatgccagtactgtggtgtgtgagtctcagcagccgcccacacgctcctaactctgctgcatggcagatgcctaggtggaaatagcaaaaacaaggcccgggctggggccagggccagaggggaaggccctggattctcactcatgtgagatcttgaatctctttctttgttctgtttgtttagttagtatcatctggtaaaatagttaaaaaacaacaaaaaactctgtatctgtttctagcatgtgctgcattgactctattaatcacatttcaaattcaccctacattcctctcctcttcactagcctctctgaaggtgtcctggccagccctggagaagcactggtgtctgcagcacccctcagttcctgtgcctcagcccacaggccactgtgataatggtctgtttagcacttctgtatttattgtaagaatgattataatgaagatacacactgtaactgcaagaaattataaatgtttttcacaaaaaaaaaaaaaaaaaaa

SEQ ID NO: 19 - DNA, 107910 bp, Homo sapiens
aagcttggtatgtgggaggtcaacacccatgtttggagtctgaggatcctgtacttatctggattgtttttcaaagaataaaaattgttactcaatatcatgttggtagaagctcccagtgggtaaattttgccccagaataaagtcactgtttttttttttttgtagaaatatcaatattcaagtaaacaaatttattaaatccaacagcaggtaaccttccaaataaaaaacattaaaggaaaaaatgtagacatcaaagacaaaaatgtgtgtaacaagtcaataaaaatactcaaggggccatttggagagtgcaacagtgcagaaaatacaaacaaaagtattaacttttgtcaagtttgtacaacctcaacaaacagacacactggtcacaaaccaagagggatccacaaaggtggagggtcacatgagcagtggactcatcacctcagcggcttaaggcagggtatatctgtgggaccaattcatccaagccccatgtgcctattgcttcacattccccctttaaaacctagtcatattcattagtgcaacaggtaagagcaattaagcacagacggagctggggaccagggtcagagggaagacacttctcccagagcaaatgtatgcatgtcagggggatgaaaaaccccagcagctgctgaatggcttcctttggcaatatccaagatttgtgttgaaaggagcagggaggttggatgggtggcggaagtaggtatttatgagataggctgggtttccaagaagagaagaatagggaggacatgatgcccagcacctgaatcagaagcagaacccaatggttatgcaaagctatttgaactattttggcttctgcaaccagtgctcaagaatctatttcatctttcgaaaagggggaaaacccctgccgatcctcaccaacatgcagtcccagtccagtttaaactggatatgcaattacagcttaccaggggaataaactctgagggggatggatggttcggaaccttctttatatgatcagaaaacacactgtggaataagaggaggatcaatgtcgcatttcctcaatgagtcccaattaacacaattcaacaaccttaatagtcctttcagtcgtttaaacaagatactgctggagtcctccaagaagacctgtcatttaccaagatgttcaagtcccccaaggaagacctttgtcagttaccaagatgctcaagtcatagctaaccaaacatgagagacaagaaaaacagcagagcagtcaagtaaaatgcaacaaaaacctagcagcagctttcttctacgccttaaccttataattgcataactgagtctacaccttttgggctttgctgcactgaagacctcatttggaatctggcaaaccaaacattcttaaatacataggttggtgtaaaagtaattgtggtttttgccatacttaatggcaatacattaagtatggcaaaaacttacttttgcaccaacctaacagatctgttttggtttgtaaacttttagacaagttcttatcccagtaactccccaccactgtttaatacaatttggcacagtatatagtacatgaggccatcgagtgtaactactatgggactccattttggcaccagcccctagagaccagtactgcttcaaagactaatactgtgtggcttaatcctttctccctttccaaaaagactagtttgtgctttccttggggaagtttaatattgaaaacactgccttgtacattttcaattgttattttcctgggcccaggggtttggttaaaatttagatcttcacccagctctagattcatcttcccttatcagaagggcagacatggtttcctggacccaactcacacaggtgggcagcacttcagctgctgagacaaccagctgaagcatagcaaagccccttacaggaggtggggttaagaacgatacattgagatttggcaaagatgggggaaagagcaattcaatgaagcagcacgtcatctcataccatctttccaataaactgctaaagaaacatcacaaaagctgacaaagccagttgtcaaaactgagttatttcttatttcccaacacacttgtttgttgttgccctcagatgttgccgatttccaaagtggcgtccacatcctgcccctctccacatcaccctgatgttctgttgctaagcaaggagtgtactggcttatctgaggggcatgcattcagcctcttacacagacttactgctcactcattaagtggcaaacctatttctaggttgaaaggaacaagacttttcacttcccagaagtataacttcaaaccctacacacacctcaccttggatccctttgcagaaaaactgcatttcttgtggtcatgaaagagtcaagcattggcccagagctactgcagaagcttgaaatctttgctgagcatcaagtactcaaacttgaaaggaacttgtaagtccctccctgactgctcccttttctggcttctcatttgcaaatggatcaatataaccaaaaaataactaaatggcttttttggtgggggatgaggaggctaaatagttaatttaaaaaacaacaaaatacatccactctagtacatctaatgcacggaatgtcttcttaaagggtggggaaggaacctagtttctccagagtactcagggtcctgggctgcctgcctcttttgtgcagctttctctgatacactctgatctgggatggaaagggccttatctggccaagagcagcctggcttttccctcagtcaaccactacccaatccagaaccggggaaaatgagttgcaaactggcttaatgaaaaagcagtctttttaaaacctcagtctgggtacccagctacaactgatcccacagaacctgctgggacccctggagacttattcaagagtcttatttagctagaacagaagccaggcatctggcccaagacccccttcagctttctagcagtactataccgtgggtgatcttaaagtttcccatttgcccctctgaaggaggaactgtcaggtttaggatttaaaaaaaaaaacaaattccaagtatgttccctatggtcaatatcagttttagaaaaataccaactgccaaaactctttaataatccttaagatgggagcccagagctgtaaggctgctcacaatggaactcaaaacatgcaattcctgcccaggctgagaaacatacctgggacgcagcggggtattaggttaagggagaaacctccaaatgtttaacagacaaagtctcattacctcaagagtataaatatttttatacgtttttatttaaaagattccctttttaatctgttccaaagtgttggaagctgaactatacaagttcctgccacccatccttccagtacagttttctgaggacatactttttaaatggaaaaataacaggaggaccctctaactgaaaccaggtaggcccagagtgagctcctcaggcccctgtggcagcctggccaaagctggcctttatggagccagcgcgtggagaagtctggggaaccggggccctccctcttgtgaggaaagggctgagcaaactcatgttctctttagtgaaatggtccaaattcagatccaaaagcctccattatggcattccctggcactcttcttatactttatacattgaaggcagctccctcttttatggccagtataagcaggcaaagaaacaaaggaatatagatacatatatgtgtatatatatatattttatataggtaaaatatatacatattttatatatgtatatatacatatttgggggtagggaaaggagaggagggtcatgtaaacctaaacagtcatcacattaccccaaatgagcctgactttaacaaaaagataataaataactcctgggggttaagtgacaacatgggtgcagcaagaagggaaagggcacaaatttaactattaaatacactttgatatttgtttggcagagttcaggccaaccccaggcttctgcccttgccagacaagtaagctgatgatattcaaagaaaaaaataaaaatattaaaaaaaaaaaaattcaagcagagctccataccacagttttccttcaagtcagttggccggcaggcagtttcccgaccaccaggaacagaaactttggctccaaggcaaatgaaacaaacaaacaaaaaaaagtatttccacttacaacatgaaaatacagaaacttcatcaaagaaagaaaactatcaaagaagtctacttccagcaaaactgaggtagcactgctttctccgcattcaatgcttaagtggttctcagtacaatgtgttcttaaaaaatgctcacttgactgacaggtgcagcatgttgatggaaaaactcaacatgaaatgcaataggtcaaagaaggaatgagcaagaagtgagggaaatcagggttctggataaattagcttaaaagggggttgtcaccagactacaaatgctcttggctggccttggctctccaagagctctaaatcgcctgggaattaatgcaatgtggttaacagttaacactgctattcaaatctgtgtaaatctttaaaaataattattacaacctaaattcatctatgtaaacagcactacacacagtacagacctgccctgaaaaacaatatgcgaaactgagatctggcactgtatcattttgtaatgttaattcaacctaacagtcccatccccccgccctgctctatgccctcccctaccaaaaaaaaaaaaaaaaaaacaaaaaaaaacaaaaaaaaaacctaaatttgtgcaagaaatggcaggcttattctatctgaaggcttcaaaaaaagatacacaacatgtaaccaggttcaaatattctgggagatccccccaaaaaggaaataaccaaaataaccaaaaaaatgaagaaagtgcctaaaacatgatacagcattttagagccctttcagatacaaggcagagaaaggtgtaaagtagaaaatatccggatcttcagtaatttccaaaatggtccaattcctcagttggctgcagggcagctggcagatccttgctgctgctcctgggacagagccactaagtctgctcctcgggacacaagccctcaggccctgagctgagtgcacctctcccttccccttctcttttccttcgctccatttcccactccacaaaggtgtcaaagagacttggccaggcctcatcttcactgtagttgctgaggtcagggccaatcacctgagtgaagttaaggaacatgttccaagtgtcccgggagatgcccttgatccccgaggggttctctgttaggaagtttagccattggtccaataccggaggattgttctgggtaaagactagtttccacagggcaatggctatttcccgatgcagtgaccgctgcccttcttcagagtccaggccaaactgaaatgtaaaccggtagagatccttgaatttatcctcttgtttggcttctgttaagaggctagggaaccgtgcacagattccgtcaatgctgtctgcacttattgctttgcagccatcaaaaaactccttcctgcaacagaaaggaaaaggacaattaatcattataaactatactatttacaggcaatatacatagtgattaagagcaaggctttcaggccagatggtctgaatttgaattctaactcctccaactaattagtcctatttccttacttgtcaaatggtaaaaataccaccttacttcatagggttttggtgaggactaaacaaattactattctgcttctaacagtgcctggcacacggttggcagctgataatggttcatttattcattcattcatcttcccaaagctaaactcaagtctcctgctccctgccctgtttcccgctctgcaatagcgattaagctgcggattctttctccttccagaggaggaggcttcctgtttcccttctgattctctatgggttgtttgtttggggtatatttttagagattgccaagggagacttctggagccaaggattctgaacctgagtaattctaccaccagagatcaaaattctattattaaaaaacaaaaattatgtatgtatttttaacatctatacaaccctttcagcttacagcatggtctcgcattgatcgtcttctcagggactgtagtatctgctgaagaggtgaggcctctgaggtctggagggtaaccttcctggggtggggggcatgcaaactacaaattgtatggctaggcctcacagtcagttcttattcacaaccccgtgctctacaaaccacattctacagggacatatgaccagaacaatatgcacagctactgcttagtaactgaggccaactgaccttattatacacaggcctggctgagggcgggcaacatgctaagtaccagaaagggcaagtggcttcatggagggagagaggcgtatcccctccccagaggcacttactatattggtactcacagtgcaagtggcttcatggagggagagaggcgtatcccctccccagaggcacttaccatattggtactcacagtgcaagtggcttcatggagggagagaggcgtatcccctccccagaggcacttaccatattggtactcacagtgcaagtggcttcatggagggagagaggtgtatcccctccccagaggcacttactatattggtactcacagtgcctggcacatgctgggcatacaataaatatcaagtgagtgaactgacatgtaaaggagtaaaagaaaagaaaggtccaagacagcagtggggccgagcagcaacttggccacctggctcaccctggcttatttctcatttaaggcaaagatgagcagtgcccagttactcagaagctgccaaataatgctatgataggcctgaaatttgacctatgaattaggcaaaggcgttattctgcaaaaaaaaaaagaaaaagaaaaagaaaaaaaaaaccatagcgtacacattagaaccagacatgaatctctatcaaaatccaagtgcctgggccttccctgctgagattcctattcagtaggtctgctgcagagccagagagatatattttaaacccttagagtccagaggggcttctcagcatcataaccacaacttggctcaaaagattcaagctttagagaacctgatcagaaaaataaaaacttacccaaaaccctatgaagccaacccagtcctatcctagctgggcaccactgcccaatgctgttccctttcctccactgctcacctggtgacataaagtgtttgtgactaacctggtgaatttgcacatggttgcagcctggaacttccaagccaagagcagcactcgaaattctgtggggtcaacacacaggtcattgcaaaagcgctccatgccttcctccaaaattgcatcttcccgctcatccttgtagcgcctgaacagttcttccaatctttgcaaggaagactcctcggcattggacttggactccctcccagcatctcccgaggacgttggcagctggcaggcctcagtggcagcctcggccttcttggtcccgttgacgaggatatctccacctggcttgccacagggtggtacctgctcctcacggtggcctgcacccctcctgctatgtgacttgttgctgggctcacggtctccatttttgctgcccagggtcgatgagggattcttacacttggtgacacactggcccatggtgctggtggcctggcctctagagtggacccctctggattggatgccctcgctgccgctggcccatgtacctcaacatgccatcagccagaggagccagccaacctggaaggaaattagaaagccatcacctctgggtgggggaaatggggtatggaccctaccttctagggtgcacactggttcaccgctctatttccatgagccaacaacgaaccatgggagagaccctgagttcatcatccccttcacaggccagctccgtaacttcaccttggcgacgcagaggctggggcacatatggagaaccaatgagggaaattcctaaaattcttaaggtaacatagatttcaaagaggccgattcatatgtagaatgcatcaaagactgacagaaatattccagaggaaatctgtcttgccaacttgccatcacataagaaaagttatttggacctgggttaagccagaaggcacaaaggaagggttcatcttctaattcctaatgccaacattctcagattttctttttaagtaggatgagtagggagaaggggtggccatattcagaacaatagtctcataatgccctaatgatgaggttgtcaagactacaagcaggggcctaagccaagcagcaaaatgaaatttgcctctgatctctccagattcctttctgggcctatcccacacagtaggtgaaatgcccttgctttgccctactccatccacctatagaaaccatccaccaagcctatactccaaaccaagtttcccaactgaggagcttcttctcccccaggtcctcagcaaggctgtacttagaatgcaagccaagtccacaataaatgtgattgtcctatagggcctataggctgagccttccaaagaagcatgtctccactttaaaagaaggactggggccggttgcagtggctcacatctgtaatcccaacattttgggaggcaaggtgggtgggcagatagcttgagtgcagcagtttgtgactagcctgggagacatagcaagaccctgtctctacgaaaaatagaaaaaaattagttgggtgtggtgatgcacacctgtactcccagctacaagggaggctcaggtgggaggatcaactgagcccaggtcaaggctgcagtgagctgggatagcaccactccactgcaacctgggtgacaaagaccctgtgtaaaaaaattgaaaaaatcactggtacaaaaacaggcacacagaccaatggaacagaatggagagcccaaaaataaggccacacatctacaaccatctgatcttcaacaaagctgacaaaaacaagcaatggggaaaagactccctattcaataaatggtgctgggataaccggctagccatatgcagaagactgaggctggatcccttccttacaccatatacaaaaatcaactcaagatggattaaagacttaaatgtaaaaccccaaactataaaaaccttagaaggcaacctaggcaataccatcctggacatagaaccaggcaaagatttcataacaaagacaccaaaagcaatcaaaacaaaagcaaaaattgacaagtgggatccataataattaaacttaagagcttctgcacagcaaaagaaactatcgagagatagcaaatatgaaactatcaagagattcctacagaatggaagaggaaatatgcaaactatgcatctgacaaaggtctaatatccagcatctataaggaacttaaatttacaagagaaaaacaaataaccccattaaaaagtgggcaaagtacatgaatagacacttctcaaaagaagacatacatgtggccaacaagcatatgaaaaaaagctcaatatcactgatcattagagaaatgcaaatcaaaaccacaatgagataccatctcacaccagtcagaatggctattactaaaaagtcaaaaaaaaaaacaggagatggttaggttgtagagaaaagggaacacttatacacggctggtgggagtgtaaattacttcgaccaccgtggaaagcagtatggtgattcctcaaagagctaaaagcagaactacattcgaactagcaatcccattactgggcatatacccagatgaataaaaaccattctgccacaaagacacacgcatgcgaatgttcactgcagcactattcacaatagcaaagacatggaatcaacctaaatgcccatcagtgacagataagataaagaaaatgtggtccatatacaccacggaacgctatgcagccataaaaaagaacgagatcatgtcttttgtgggaacacacatggagctggaggctatgatcctcagcaaactaacgcagggacagaaaaccaaatactcacttataaagtgcgagctaaatgatgagaacttatgaatacaaagaaggaaacaacagaaactggggtctacttgagggtagagggtggagggtggtaggagggagaggagcagaaaagataattactgggctctggacttaacacctgggtgatgaaataatatgtacaacaaacccccatgacacatgtttacctgtgtaacaaaccttgacatgtacccccaaacctaaaataaaagctaaaaaaaaaaagttaccaaaaataaataaataaaaatgctcaggatattcagaaaaaaagaaaaaactgaaaaaagtgggaaaaaaatagaaaaacaaaagaaggacagatttacccaaatacaatctttaaatggtaggataattgctagatgaaaaagaaaagtttgcactgatacataacaaactcgtcatggtggtttattaattatttatataatttaaaagtggttttttaaacaaattgctagacatttctgagccagaagcgaggtgatttctctaagatgactctggctacttaggactcttattcctaccttcaactggtttgttggaaaatccatgtacaatttagtatttataaaactttgccaactgctataataatggcagccactgaaattacgttgttaatgaagtgtggaccaggagccagaagtgtagcaggaaacagacactaaacagaagtcaacgtcagtcacccgggcctccccaggtctagggagctttcatggacctctatgatccaaactaaaagatctttgaaaaccggcagtgggacagaaggtgttttttatgaaaggctggagctttaaactttgcctaaaatacttggcttcctccaaatagtgcctggataaattgggggtcgtcttcaagaggaattctctctgaggataagctctgagtatacagtaagtttaaaatgaagagcacaatcattcctgtagttattagagattagtcatatcaaggcctgtccccttctccacccgcaaagagagcaatgacaaaaatacatgtccaaacatgccctcaaagacttgtagttttacttaggcttcaaaaatacactgaagctcttataagggcttttggtatggaaaacaaccatcctaagtaagttttttaaaagactttttatgctttaagactacagctagtaagccataagtacaactcattacaatttcaaatggcaaggggttaattcttggaagaccatggtacaagggaagcaactgtgcgagctgaattatctcaaaacaaggactgtaccatgtggagggcctggtttccagatttgtgttcctaaagactagaatgctgaaagaaacaaaaggcccaaacttacacaaaccccacatgctcacagactggcaactctaattcccaggcacgctgactcaccagggtttactgctcagctcctgctgctgagtgaggcatgggcacccagcgagataagaggatttcctggcctccatctgacccacctaccccaggccactcaccccgcccccactggacagatgcttcatcctagcagcttcctccaaatcctggcgccaaggccttcaggtagggacagaacagatggggctcccaaagaggccctaatcccattgagccaaccagccctccatgtaagagtatcttttgactacctgacacagcagaaccagctgaaacctgaaagcttttaacatgaccagcagatgaaaaaaaggagaagaaaattagtttcaacagatgatcaatcagcaaatgccagaaggttggatcgttcttccactctggtctctttctttgaaatgcccccattccattgagtgttgaggcgagtggtggtctaaacccagaagaaaatatctccagatctggtaagtatggtcccccgattactctgattactgcccagtggtctaccttcttctgtgtctacccccttctctgggaaaatacttttgctctcccagagctttccccaggctccatcacagtgcccagccccatggcccaggctggcagcacttcaagtgttttaaagttgaaggtctcccgtagactcactagctgatggctaacagctaataatagcagtcatcaattattgagcacttgatacggtgccaggcactatgctaagcacttttggggacatgaactcacatatactcatcacagcctcatttaaaaacaaggaaactgaggctgaggaaagtaaattacccatgatcacacatctggctcaagataccatgacatttacccctaggctagattgctgagcccacccccagcaaagcatctagagagaacacatgacggaccggccccaagttcaggagtgacaccacagcaaccccagagcagcaaatctcaccatcagccactggagagagaacacatggtctgtgctcggtgctcaagaaggatctcctactcgctgccatgatccaggcaagcaccatgcacccaggctcagccccaccagacgtggaaacgagaattagtccagatgccctaaacgtgtgacgtttttgtccaccagcacagttaaaagctccagctctgaaaaggacgcccaactgcgccactggctaattgtttgaccctaatggaagcctgaatttcctcaatctgcaaaatgatatctgcctgatagagctcttgaaaggattcagtgaggaactgcagattaaaggtacatggcttcagagaaaacacttgatatgacagctgttactgtatcagtagtagtagtagctcagtagtatctggttagcctgttggaagccccaacttaccccatctgaacaatgggctccaggcctcagattccacaggcccagctggccaggacttcctatccctgcactgagtcactggcccagggcttgttccaaaaccgattatcttgccacagcactgatcctactcaaatacaccactacccagtaatgcttggaggatcagactctccacaacacaggatttccttgtgattgatcctgaataaaatcaagctgagtatctgctgtgcccaacggacaatgaattgctggttatgcccagtccctaacctggagcaggctttcagccagttccaaactccttcccctctccacttagtcccaactctgtagatctctgcaaaagaaaggatgtctagctttccactcagttactaatttaatggaactgccttcccagttggtcctcctccccatcactgccacctctgaagtggacagcctcagcacaatctggacatcccagcaccaaattttcaacagcaacagagcattattagtcctgaatatcatttggtatttgttaatacattaagaaagctatatataaatgtagctctgtgaagcaattacccccattttacaggaaactaaacacagacaaactgaggtcaaggagtctatttaggaatggaggaaacagaagcgcagtgatgaagaggatgagctcagacaaaccaagacaaaccattgccattgccatggcaatctcaccaaataatgggaactgtccgcatggaactttaaatcgaggcagttgtacctcaaagcactattgggtagaataaataacgcaggtaaatgctctgctcaatacctgactcacagaaagcatttggttggtgttagcctctataatagttataattattgtcacaactttggtgacagaatcgtctcccttctcctagaacagtgctcttttcaggagccagcccagatctcccatagcgattcaggtctgctcacaataagtgaccattctcctgcattagcaagggacacaaatgggttgaatggagccagagacaaggagggatgtggagaaagaaaaggcagaagaaagaaggaaaaaaaaaacccatgcactggggaaaccaacttctaggctttttttcttttctacttatagctttgagtgtttacctgaaagaccaaagacagcagctctgctcagcttctgctggaccaagatcagcctccagcttctctccctcagtctcagcccagctgctctgcctctccctccctcctctgcacatcagcctccagactctttcctcccctgtgccagcgctggccgctgttcctggggatgggcttggctggctgcctggtcctaggcctggagcggccactgctgagcccaaagggcaatcccagaggctgcagtccctgggttgctctagctccaaagagggatcaggaagttgttcccatctcctaggcagatcatgaaatgacaaccaggcaagtccctgtcttctaggggcttactctcaactgtgtcttacagaacagaaccaccacagaggacaaactcacactgagactctgtacaaatgcagacaggagaaggagagagaagtgtgaactactattacggaaagaaaggtagggagggactggggacgtgaaatcagtatctgtggagcctggggctacatgcttcatattcatcatcaccttcaagcctcccaacaacctcaagaaaatagttgttgcagctttcatagattaggaaacaggtctcttaactactaagcagtaaggctggaaaataaaaccagtctgccagactttccatgggcaagtttcagagagaaggcaggtttaattctggtccttaaatgtctataagcatgaaatggaaaggaggagggagagggttgatatggttggctcatgttattaatgtatattaataacaatattgtaaaaataattacatatatttattggcatgaattatcacatgtaatccacgactctataaggaagacaatataatcttcattttacagagggaggaagtgaatagagcttgagggaggtagcctgaggtcacacagccaatggaggagaaggattcaaatccaggcagtctgactctaaactcgccactttccatcactggtctcactactgttctctgctatgatgtgtgccaggatattcccctacccctaaggaggtcctggtgccccaagaagaaaatgtccaacatcctatcaatgcctaagtatattcctgaggaaccaagtcaataggaacagaatacgcccccaggaagcctttggttctggtgtgaaatcctcctgagcaatgtgcactctcgagcaagccacttaacctctctgagtttctgtgacactgacattaaagtgagaggtctgggttagtctttccaaggtctaatattctgggactacttcaccttttttggcattcagtgaggccaaagttctaaatgtgcaaccctcctaaggacaggcactttgcctccttggtgaacagatctcacactactccttgcccaagactatcagagtcaaagaaaaagcagaagtccaaaagcagagggaaagcagggctactccaatctgaacaacgagggataggaaacaccagttttgcagccttccctctccttaatcatcttagtttgatctctggagggtcagtaacaggtccagacatggaaaacagacccaagtaaactgctgcagctcgctgggtcaggaagcccactcagaggaatgcatgttggctactactaatggacagcctgtcacccaaggaacagacttgtgaaatgaggagctaaaaaacaggaggcaaatgctggcaccaaaagtcagtgtcagcaaagcacttgagatctgctctgaggcttccttgacagaagggaccaatccattccactcctccattctgttcccatctagaatctattcagcagcaagaaaccactgccagatgctggtgctcctacatattaacaatataaaaagcccatcttttcaactttcatctaaatagtttgtagagctagctgggtgcagctttttatttcttcctacatatgtcagatacccaaaggccagagaacataagtacatgaattcctcagacagcttttctacagctgccaggggctgaggcggttgtactggcacagccatcctccggagagtctcaaggaccacaggagccccttgatcccacctgggagcaagactctgaatgacctgagaaaaagacggaatatggctggtgtccatttgtaaactacttcctagaaagtaaatgtgcaaaaataacaaggaagactgagggaacactttaaatgcacagttgctgctgccacttccaacttaagacttcaaagatcacctttggagattaggtcttacccagagctacttgggagggaaagttgatccctctgccaaagcaaacgagacccgtctgcttctattttccagcttttaaaagactttttgtcctaaaatgtacagcagcaacaagcaacagcagttccagttagggttggggaggaacccatgactttttacatcaaccaatctcaaaagtgcaaaagaaaagagggaggaaggaagggagaaagggggtagggaggacagagaaaacttttaaaaaagaaaactggctatgtttctataaaaatcatcttaggtcacatgactaagaccagccagtttagcataaagtcatttctttttgaaagtgttctcaatgtccctcgcattgcaccctttgaattcactactaagaatatatgtccagttgaggcctcaggactgaagccagtgtgggctggctagaacaaatgcctacttgccaaatacagccaagccaacacacgcacatactataaagtttccaaataccaaataatgaaccatttttttggtctctgggcttccaaactgagctacatgtttaatcccacataactcaaaataaccaaaaaagggctatatcatttcactgacccatacttgaaatattttttgctgtcactattgatctgggcatttctaactacccacttatgtgcaagggggagcatcataaatgggcaccaaatttctaggtcattctttgttttcacaccagcttttccagtgactttccctgtttaaaaccagaaagccatcctggatttgtactgaaccttaactctaataaaaacggcatgcctgctgcactcttcatctccgttataagcttgcagcttgttttattccttaggatggagcctcagtagagcccactgaaagtaaaccactgattagcactaataccctccttccagtcagcatatggttatcagccaccctggaggtttacctgattgtagctgattagtcctcaaaacacccaattaccacatcaactgctcatttttcaatcaccttctgagaacttgggagtcagcaactcactgaaaattagtgaactggagataaggttagatttttgcatctaagtaaaaggcaagaaaggaaattatgaaatgagtccaaagacgacgaaggaacacaacatacagatgataaatgactgcatccaaatgtcttaaagggcacctggatgaccacaaatgtagatatgtggtttcgggagccaaaggcctctaagtaggcctcaggttcaccacgtggtaaccaatcaacctcttaatgtttgctaattcttaaaaaaaaaaaaaaaaatctaaatccattaagaccacatttatcagctttttccccacgatggaggttgactgctaatgcatagcagacaggaagaggaagagggacagaaaagatccacacaataaaagaattcctgctttcaaccacatcagtaacctggtcagaaaagtgaggtcactagactctctttcctgctggcaaattcaaaagtattacataattattttgtgaagtttagaaagtacagagaggcataaagaaaaaaaaagccaatcactaatttcaccacctacggttaatattttggagtatatcctttcagtcttgcttcactgcgaatcacatcaaaaaggctaaccaggctaggcgcagtggctcacgcctgcaatcccagcactttgggaggccaaggcaggtggatcacgaggtcaggagttcaagaccagcctggccaacatggtgaaaccccgtctctactaaaaatacaaaaattagctgggcatggtggcacatgcctgtaatcccagctacttgggaacctgaggcaggagaactgcttgaagtgggacctgggaggcagaggtagcagtgaggaagactgtgccactgcactccagcctgggctacagagcgagactctgtctcaaaaaaaaaaaaaaaaacaactaaccaatccaatgatccagtgattctggctccagggattttaaggaagtgtttttaaatgatgggggaatggggagaaaagcagcttaatcctaaagacatctttcacttatatctaaatttcctcaatttattctttcaaaagaagatcaacttcctcctcacactccctccaaggaaaagaagaggacaaagatgatgaccatcttaaggtctaatgagtaacagtccccttatcaaaggtttaacatcaggggtagaagggtctggcccatggattgagtgattcacattcccagggagcaagaggctcattcaaaagagaaatgtggaatgcctggaaatggtcaatgggctggatttagtgtgaagactaacatgggctgtcaagctgcagactgggtcaaaggacagatttgtagcagacgtgtctgccttcccagcatccaggctcttcatcaggtgattacccaattttcaccagcagatccttttccctcgctctcggccatatggctgggtggggttcataaagaactatgggactcagccccaccaaggcctcacatgcccctggctttaatgactggacccaggatatgcccatgacaagccagccagacagaatctcaaccctgaaaatacaggaggctggagatgctaccagaaagagctaccagagaaaataagaatgcctagggggtcactgtgaggattaaatggtccctgtttatcacatggggctcagctcaaatgcatgtagaacccaaaaatgaaatcaccaagtggaaagcagtatgaagagacaaagggaaactgaattttgaaggcattatttacaccctgaatccaactgttcctagagtcaagatcaaagcctgaacttcacaggtgtgagccaacaaactctcctttgcataagttagatatcaggttttctatcacaactgaaagagtccctaccaagacacagctatgtcactcagatctcttctattcagagagcaaagagagagaagatctaattgccagatgttctgattcatggttcagaaccaactgactaggccacaatttctagtcgaatatatcataggacccttagctgaacaacaggaccaatgatcccaagttcatgaaagctgtcaaattccattataactacgtggaccagtaggatgctatttaaaagatggtatgactaactggctacaagaatctttccaattgcaatttttacaccgttagacctccttcaagtagatatgccacagaatacttcaggagctttattctattgtgtacatatttgctgtcatcatcttgttcccaaagaggaaccccgtcccagcattcagacaccatgtgaaaggctgaaagcaaaaatctctcagaagtctttctctgtacaataacatgatcaaccttccagctgaaacaggtatttgatctaaaccatatcccatgaaactgaaagcccaaatctaacctgaacttggctaccctcttggtttcaattcctatcactgagacaatttctctttgattttacatgccgaagagcctattaagaaagtgtttaagtttcaaagactgacaggaaatgctcatgtttgcacatctttatttgaatacgttctctgcaggttgaaacttgaggccccaaggtttaggctttgatttttttttttaagttacttattttcacaaatgctcatgtagcatgaggccccagagtacattaacatgtgcaaagataagcaggtaattaaaaatggagctctatacctgttggaaggcactgtggtactgcaagctttgcaaagtaagacatctgatgattcgttcctgcccacttcccacccacatgacctgccaaaattgctgccacctaatggccaccacaatgctgtctattaaaaccctgccctagcagctatgccctattttaagaaacaacataaaaaatttataaaataaagcagcagcaccataagttctttcagtcatcaataagtctgaagactcaaagacaactatggccccagaataaactgcgtgcgctcatgcacacacacacacacacacacacacacacacacacacacacacacaaatgttgcatccaacaatagggggtccatgaaattacatgcaacttttctgaattgcgttcagtgtcttgactgttctgcaaccaacattcaattctctcactcaaaaaccagttgcacagatattgcagctccttcagctgctccagtatagtcatgtgccttccaggagggaaagtacatgcattggatgcaaaatgactaggtttgtacagcccagctctaccaactctctagctcacacttaaccatattccatctcagtcttctcagttgaaaacgggaactaaaacaaatcactgtgaactaaatgactatatgcagaagaataaaactagatcccctctctcacactatatacaaaaatcaaatcaaagtggattgaagatttaaatataagacatgaaactatgaaactactagaagaaaacactggggaaatgatctaggacactggtctgggcaaagattttttgtgtaagaccttaaaagcacaggcaaccaaagcaaaaagagacaaatggggttatatcaagctaaaaagcttctacacagcaaagtaaacaatcaacaatgtgaagagacaatccacagaatgggaaaaaaaatctgcaaactatccatctgacgagggattaacagccagaatatataaggagctcaaacaacttaatagcaaaataataataataataatctgatttttattttatttatttattttttttgagacagagtctcactctgtcacccacgctggagtgcagtggcatgatctcggctcactgcaaccaatcacctccgaggttcaagtgattctcttgccttagcctctcgagtagctgggattacaggcgcatgccaccaggcccagctcatttttgtattttcagtagagacagtgtttcaccatgttggccaggctggtctcaaactcctgacctcaggtgatccgcctgcctcagcctcccaaagtgctgggattacaggctcgagccactgtgcccgactctaatctgatttttaaatgggcaaaagatctgaatagatgtttctcaaaaggagacatgaaaatagccagcaggtatacgaaaaaatgctcaacatcactaatcatcacagaaatgtaaataaaagccacaacgaaatattatctcaccccagttaaaatggttatgaaaaaaaaaaaaaacagaataatgaatggcaaggatgtggaaaaatgggaaccctcgtatactgttggtggaaatgttaatgagtatagccactatggaaaacagtataaagggccctcaaaaaactgaaaatagaactactgtatgatccagcaattgcactactaggtatatgtgcaaaggaaagaaaatcaatatactggagagatctgcactcccatgtttattgtagcattattcacaatagccaaaatatggaatccacctgagtgcccatccatggatgaatggataaagaaaatgtggtacatatacacaatggaatattattcagccataaaaaagtatgaaaccctgtcataggcaacacggttggaactagaggtcattacgttaagtgaaataaaccaagcacagaaagacaaatagcacatgttctcactcatgtgtgagctaaaaaagtggatctcaggaagagagagacagttatcttctctaggtagttaccagaggcagggaaggggagcgggaggggagatgaaaagaagtgggttagtgggtacaaacagaagtaagacctagcgttggaaaaatcagtagggtgactccagtcaacaataatctaatgtacatttcaaaataggtggaagagaataatttaaatgatcccggcataaagaaaagataaatatttaaggtgatataatatcccaattaccctgatttgatttttacacataatgtgaatgtatcatattatcacatgtctcaaaactacatatattatttatcaattaacaaaaaaatgggactgagttctgcgatgaaaaaaaaaaggtcacggtgaagaataaatggctgcttcatatgagatgggtctcagttcacgtgctgacatgtgttccatgttcaaccaatccaaatgccacttccctctaattcagcacaacgctgttttacttcttcacggcacttacaactctgtgaaattctaatttgctgacttatttattgcctgctccctctaatagcaggcattttacctgccttattcgccactttaccctgtgcacctaggctatgtggcacatggcacattgataagtatctgtagaaggaataatagtcactgatactgagcacatgctctgtacaaggctttattgctttaaatatattaactcgtgattgaataaatgctgaatctgagatgtttagcactttctcacacacaattaatactcaataaatggtagctatttataccaattcaaattataggatgatgtcaacaaacactcaacaggaaagagtaaagggagttgagtcctaagaatgcagaactcaattcagttctcaagagctgattttttctttttagagacaggatctggctctgttgccagcccagagtgcagtggtgcaatcataactcactgttaacttcaaacttctgggcttaaacgatcctcccaccttagcctcccaaagcagctaagactacaggcacatggtgccacacccagctacttttttcatttttatttttgtacagacagggtcttgctatgttgcccaggctggtctcgaactcctgggctcaagcaatccttctgcctcagtctcccaaagcacttggtttatgggtgtgagcactgggcccagccctgattcttaaggtctattttttcttggactccccccattcgaagcacccactaccttcagagaggaaagagaggagaggattatcttattactccaattattctttaccttatgagtttctcagataatgtgatacaaacacagcttctcagccagcagtacacaggtccatctctcctcacttcacaagctaattttcacctcaaatacagcaaaagccagaatatgaagctgacatagggagatgttcaacctgtcatgtctctttttgacctgtacctcaggatcttagaaaaaattcacattaatggaaatcacttctgcctctcttttcagtcagggtgttatgtccaagggtttactgaagccacagccatgcactgcactctaggaagaccaaggggctcaccaactgggaacactccagtgaaaagcctcaggctgctggtctgaactgcatcttccccacctcaacaaataaaggcatcatatttaaggtgtctagagatgcaggagcaacagccagcagcttttttgaatactgcatactacttgctttaaatacgaattcaactgcttaaaacacaaggactcatggccagtgttacacctcttgagatgttataccactgttcacttgatgacagagtgacttttaacttggagggctgaagcacataccttatcaaagagggtaagtgatacagacaataaaggtcctccatctctttacagccaccagagacaatgaactttgtttcacatgactgcgagaaaggccaacaactaaagtcctcaacggggcccccaaagccagaggtacttgctgagaaagcaaagggcagattccacctccgctggctggcagacccacacattctgcttaaccatgtgaaacagccagctcttactctgcccgcccccaggcccagttatgatatttggggtagaaagagaatagcaacaccggtgacttttctaggaggctgttttataaaaacagagcttccaattttaggcctaaaattgaaaagaaaaatagccagaattagaagtctgttttaacacaatatattgaaaattacaagtttaaacactggtagctggagacggggtatcacactaccacatgacttctcagtgagtcataaaaaatagtaccggcttgtttaacagtgatcgtccaccagtgacagaattaagaagtccgcttgtgtcaaatgatggaaaaccaaactgatacccctcttgtgtttgtttcagcagtggcagaactgacacaaatgaattgcagcaacaatctacaagacaaacactgataaaccttttttgaggctggtcaaagaggaaatgtttgaaaccctgaatatgactcatttttcagaagtcagtttaacaggagaaaaaaaaatctctaaactattaataaatcactaactgaaatatttctggattgctaacatccaatcttgattagcatacctttgtgtcaaagcaaaagccaaatgcaggcatttaacaagtcactaccctttcagttaggagaatcgctctggtggaactagatgagaacaacaaaaattaatcttcaggcatagatggatactgtcatgataataagataataaagacctccccaaaggatttctgggtatcataaattatataacaaatccacttctgccaggcagccaagattaactcctattcacccaggttatgactcggtattgccaatgggcttattgaagtggaagtctcattatccaccactgctcagcaaaaggcacagtcatctttctcattgcaaatcaatttgctgacaccaactactcactgtaagagaagtcaacctaataatcttaaaaacaactttgacacttgtttcttccaggccaaaaacatattttaagaaccagaaaagaaaatgttccgtaatttctccctcccagtaagtccttaaaccgaattttttaagtgcctaagatgacattttattataatatactttattatgtctatcgtgcgtccaaggcttaaatgcattacacattatttattcccttgggacaaaaacattcatggctcccaagcaaatagtcaaatataaaaagtacatagaagagaaaggctgttgtcattttagtgacagcatcttagactgcaagctccaagaagacagggaatgtgtatgatgacacaaaaagggtcaacttggcataatgcgaaggctcacacctgcagacccagcactttgggagaccaaggcaggaggactgcttgagcccagtagttcgagaccagcttgggcaacatagggagacccaatttctacaaaatcacaaataaaaaaattagccagccttggtggtacatgtctgtggtcccagctacttgggagactgagataggaggatcccttgggcccagagggctgagactgcagtgagcagtgatcatgcctgggtactccagccagggtgacagagtaagaccctgtctcaaaaaaaaaaaaaaaaaaaaaaaaacagaaaaaagaaaaaagaaaagaaaatggctaactggcatctaagagatactttctaaagaatcaaatggaaaataagcacctactatgtccctagtgcactgcacaaatctacctaaatgcagagtactaccacttttacatagtaacatccacaaatagtttcccaaggtttactacgtaccaggcatcattctcaaaacatttttacacatatcaactaataaaacaatccaactctccaataataataccctaggagatagtaagcagcagagccaaaattcagactcttaaattaaggatgcttttcaaagctatttttttttaagcctgaaggtttaaattgcttctttcaaaacagcatactccgatagagtggttttttgtttgctttggtgtgctaagtctttgagtcactgagaaatgagagtttggactatacaagtagttttcaaactttaactgcaaccttcagtgagaaatatattttatatccttacccaatgcacacatataaagccatgtacaactcaaagaaaagttccatgaatatttaaccttttaaatatttacccaagcctgggcaacacagcgatactctgtctctacaaaaaaatttaaaacaattaagtgggtgtgatgatgtacacctctagtcccagctactcaggaggctgaggggagagaactgcttgagcccaggaatttgaggttacaatgaccgatgagtgtgccactgcactccagcctgggtgacagagcaagatcctgtctcaaaataaataatctactcaatatttacccttacttctatgatgcactgatttgcactatttgttttctttttttcccattttgtttttaattgttgcttataacccaccaatgagatatgacccatagcttggaaatctcaaccaagcttgataaacgttccctccatcacctttattgtgcctgaaacaacgttaggcattttacagtcatgatagcatttactctccacagctactctcggaggttcctatggctatccctattttacggatgaggaaataagctcagaactaaagcagcttatgcaagcccttagcctgtgacagagacagaggaaattcaccaaactgctcccctaatttcaaacatcctttcagttaggtggggaaatgtgtttacttttttattttttgagacagaatctcactctgtcacgcgtgctggagtgcagtggtacaattttggctcactgcaacctccgcctcccaggttcaagcgattctcctacctcagcctcccaagtagccaggattacaggcgcatggtaccacgcccagctaattcttgtatttttagttgagatggggttttgccgtgttggtcaggctggtctcaaactcctgaccttgtgatctgcccgcctcagcctcccaaagtactgggattacaggcatgagccaccgtgcccggcctagtcttatacacactgttaccactgctcagaatccctccccattcctttctctagtctttcatgccttatgctgggattttacttcccacaggactccttcctgactgagagcctctctgcccctgagcaccttcatttataacattgctatttttttttttttttttgagatagagtttcgcttttgtcacccaggctggagtgcaatggtgcaatctcagctcaccaaaacctccacctcccgggttcaagcaattctcctgcctcagcctcccgagtagctgggattacaggcatgtgccaccacactctgctaattttgtatatatatatatattttttagtagagacggggtatctccatgttggtcagactggtctcgaactcctgacctcaggtgatctgcccacctcagcctcccaaagtgctgggattataggcgtgagccaccatgcccggccagcactgctatttttacagcactggttttacaacattttctaattgtcactatcttatgttccaaccagacaataaagtccttaagagcaagatctacaataggcactaaaaattattggaacaagtagctggcaacatataaacacatttcttcttcctgaaacacgatgtgtccaatcctagagtcagtctttcagaaaaattcagaatacatacgcttcactttgaatacaaccatgaaagcattacattttggaggccaacattttttagcttacaaaactggtttttagtttcagaagtaccctatgaatggtccacattctgtctgagaatgccagtcttttgcttatagatttctaacttaaaaataacagtctggttcttcttagggagaaaatatcttgtacaggttgagtatcccttatcccaaatgcttgagaccagaagtgttctggattttgaacttcagattttagaatattaacattgtacttaccagtagagcatccctaatatgaaaatctgaaatctgaaattcttcaatgagcatttcctttgggcctcatgtcagggatcaaaagttctaaattttggagcatttcaggtttcagagtttcagtaacttcagtactttaaaagtgtgtttttgaaagttttgttctggccggatgcggtggctcacgcctgtaatcccagcactttgggaggccgaggcggacggatcacgaggtcaggagatcgagaccatcctggctaacacggtgaaaccccgtctctactaaaaatacaaaacatttagccgggcatggtggcgggcacctgtagtcccagctactagggaggctggggcaggagaatggcatgaacctgagaggcggagcttgcagtgagccgaggtcgagccactgcactccagcctgggtgacagagcgcaactccatctcaaaaaaaaaaatttttgttctgttaaactgctatcataattgaaaattcttttgcttaagctggttgtatcagaagtattaaatactggagatctttagaactttctgttgagtgaatcaattgaagtactgtatgaaaatagcaaatatgcaaatcagaaaggggaggagcttaggccaaactgttcagaaggaaagaaaaacaggtttccttccaaatggggaaaaggcaactggaaagatttttacctgttgcacaactttttattatctctttctgctaggccaatcaacgattgagagctgtgaacttggaaaagcaaatgctctgataaattaagcaactccagctctttgactaggaaagttttaaagtcagagttaaagattaagtcttcaattaaacatttttatttttttacttgaagttgccatgaatattcaagtttctaacatcctaaaagggctttattttaggagtgaaaagattctggataaactaaaaggttattctaccatgagaagaccgcgataagtggtgctggaacatgtaagaatggcttgtaaaggtactgacctctgccactatgttgtacatctttccttctgactctgttatatgttaagtttttaaatgtgtggtctcgaatgctcatacttcttatggagattatacgaccatggagataatcatttgtatgactaggaaagaacagtcttctttcatgtggctttcatctttaaaagcccaactgctcagctacccacaaaagatcttaaccaagacaaactgatccaatggcaatttcccaagaagagaagaaaacaaacagccccactctagctttgcaaaacttggtctgcagaccaagggtgaatgtcacaactcggcccctcccctttcagaatgtatccagactcatcaaccattgcctacacataatgactaacttccataccacaggaaataggctgttctagaaacctgacatctacaagtaaggtggtcttataattgtatatccaaggagttgcttggtttgaactcaaaatctgctcaaaggatgcttgctgcgtgtcatcaattagatcttagtgggaaggcagacttgtaatcctgcaaaacacagccttcagtaaaaggctttttccaccttgccaatgtgcccaatgacacaggtcacgacacctctctgagacaagacagtaagaatgacaaaatcgaaatttacaaagtatgaggaattgaagcacagatcccacctcagttggggaacatttgagagtttctcattatgaagtcatgtagaaaccttgtattaaataaatgaagttcgaggttgcagggaaccatgattaggctactgcactcagcctgggcaacagagtaagaccccatctcaaaataaataaataaaataaattaggagaataatgttgggctatatcactgccaccattttgctttttttttttttttttgagacggagtctggctctgtcaccaggctggagtacaatggcacaatcttggctctctgcaacctctgcctcctgggttcaagcaattctcctgcctcagcctcctgagtagctgggactacgggcacccgccaccatactcggctaatttttgtatttttagtagagacatggtttcaccatgttggccaggatggtctccatctctttacctcgtgattccgcccgcctcagtctcccaaaagtgctgggattacaggtgtgagccattgcacccggcattttgctctattttaacctaatcttcactagtaacacttggcacagggacctatcagacttggatccatctttatagcaattttttaaaactaaaatctgaaacactaaataacttattacaaggagctataccagatccatggccctttacagcgtgttaactcagaacaagatcacttgcaaacacagaccaatccccaactgtagataataaaagatgacagtgtaaagatacacagaaaatgtttagggactacaggtaattaaggctttaaaaaaaaaaaaacataaactacatctgaaagcagctttttcggcttctattgcttaacagagatttccattttattctgggttttactgaaaaagcaagtgcctcccacagtagtctgtatcatttctactactactcgtttcccttctcaagaccccactatgttgaattatgagcaatatgacaaagtgaaatgagattttaaatactgcctgcctcagtgtttaacatcattttagggcacatatcccactgtccctttaaagcagtcaccaggaagaagtaatctacaggtcagctcttgagatgggacagagccttgaatccatgcactggcttgggttcaagaagcaattaggctttttctcccaccccaacagaacaagtcagaccctaactttacttctaacatggggagtcccaacagcaaacaatgaggaactgaggagcaatccaggtagccgggaaactgctaaaggtgaaagagtaaacaatattattcattttttcattgaaaaaaaaaaaaaaggccaccaatactaatggctatggtattttaaattctacataacctacttgtgggtatttttgtcacaaatgcaaaaaaagaaatttgtcaatttgcttgagttagtcaagtctttatttttttgcctgagacttctgaaggcaagtctttaagtcctgaaatcgggacctgctcagcagtggccatcaccacaaagacttcattgaataaggtgtggcgctgcactagagttactgagtcttggaacctacaaacttcagccattcatatcccatctttaccatcccatctactgttcacctaatatttttcttaaaagcttctttaaaaactgcatctactgttaaataaaaatgatagaagaccatggttctggactaagctcctgcactaggctccaagagaccagactaaaaatcaaaatggagtcattcatgcccaaactaagtttgttatctgaccttcccagaaaccaggagaaagagataacatccaacttcccaaactccatgtttaaatcttcaactggcacgataatgaagttccctagttttaaaccttacacacaaacacacacaaaagtctgaagtaatctaatgttaactattcagttatttctctattgttctgtttccctgtcctgccttacaagaaaagcagctttaaaaggactgatacactctttgttctttgcttctgctttcttcagcccttctgtctataaagccaactcctgctttagctcatctaaacacttattctatattatggaatgaaacattgcccaattctagaattgcaatacagccagttgagatctggaaactaaattggttgcaattttgtctttgacatgactttagtatcatcctaagcactattgtccatgaattcataggtgtgatatgatagttatgttttcattcatacacattaaaaaacagaactagtaggctgggcgctgtggctcacacctgtaatcccagcactttgggaggccaaggagggtggatcgcctgaggtaaggagttcaagaccagcctggccaacatggtgcaaccctgttacaaaaattagcagggcgtggtggcgggtgcctgtaatcccagctactcgggaggctgaggcaggagaatcacttgaacccaggaggcagaggttgcagtgagccaagatagcgccactgcactccagcctgggagacagagcaagattccatctcaaaaagtaagtaaatacaataaaaaacagaactagtaaatgaaaagtattcatcatgtgccaccaaaaatcatcttatgcaccatcagcagtaaaaaaacacatgagtattcatttcagcaacacataaattacaagtgtaaccaaagccacactttgagaaacagtgatttagtcctaaatcctttatgtcatagttaaagaaacagactgagaggggatgtgatctgcccaaggaaaagcagcaatggtggcagagtctagactagaactaaggacttaatccaatggtagtcccactacagtagactgtcttggttcttgagctacaggaagaattagagacctggcctcagaggagttcaccaacaagtaaactctaagcagtcaggaagcccttttgcatgtggatctgggcttttctctttatctgagactctgtcaaacattatctagactggctgaaataaatctatttcttttcccaaagtctaatgtggttttgcccaactcactgaacctcaaggcatacagtcaaagataaaaatgtctcctggatcagtttcccaatttttgatccaacagtatcctagcccctgtccccactgctagacttatacaggctccatagggtttcaggaggaagattttccatctctgggttttaggccagctttggaaacatgctggaagtttccattacagagtcactagtgtatttcccagatacccagaggacaggttttattttcaaatgatacataacttgtgtctactgtgtgcctagcaatctttttatacactgtcccataaactgactataagaggaggtaaaatgatatacatgattcttgactccttgggaattagctgccattccaggtgggcatagcaatggatgccatgtagccaataatagctaatgttattaaatgtttgtttttatgcccagcactgtgccatgtccttcgaatgtactatcttattgaatcctcacaaccatttactgtgattaccctcactccatacatgaggaagctgaggcttagagagagaaatggctcatccaaggtcaagtggcaagtcggtgataaagttcagactcaaacccagactgactctagagactatgttctcttaaccaaggcactatgtacatctattttttgtttgttttgagcagggtctcactttgtcaccccgaatggagtgcagtgacacgatcacagctcactacagcctcaactttccgggctagggtgattctcctcagtctcccaagtagctgggaccacaggcgggcaccaccatgcctggctaacttttgtattttctgtagagccagggtttcaccatgttgcccaggctagtcttgaactggtgggcttaagtgatcctccctggctaggcctcttaaaatgctaggactacaggcatgagccaccatgcctggcccactatgtatatctaaatcttttaaaaagtcatattaaaaagtaacatgggccaggtgccgtggctcacacctgtaatccctgcactttgggaggccgaggcaggtggatcacttgaggtcaggagttcgagaccagcctggccaacataatgaaaccccatttcttctaaaaatacaaaaattagccagggccaggcacagtggctcacatctgtaatcccagcactttgggaggccaaggtgggtagatcacttgaggtcaggaattcgagaccagtctggccaatatagtgaaaccccatctctactaaaaacacaaaaattagccgggcgtggtggcacatgcctgtagtcccagctacttgggaggctgaggcagaactgcttgagcccaggaggcggaggttgcagtgagctgagatcgcaccactgcactccagcctaggtgacaaagtgagactccatctcaaaaaaaaaaaaaaaaaattagccaggcgtggtggcacatgcctgtaatcccaactactcgggaagctgaggtaggagaatcgcttgaacctgggagggagaggttgcagtgagctaagatcgtgccactgcactccaggctgggcaacagagtgaagaaaaaaaaaaaaggtaacatgaaatctgtattataaagtaagctggtttcttgcattagggaagtctagacctaatgcacctttgaagttcaagaatactgactattctgggaatgccatttcatactaattgaaggaggaatttgctgcttataatctaaagctaatcaacttgcagtatctggtgtgtcaagaaatgacaattgttaattatcatttaaatcaactttaggtacccttattccgttactacttacaagatacaaaactggagtactaatggagtattagaaaaatgtatttggtctttgtccctggttcctgccagagatcctaaaacccttggaattttctgtcttttattattcatgaagagccctctggaccacatgccagagtttatgctaacaaggtgatttcaccatgggcccttatagtttccagtgaagggctagccaaaccagaaagaccaagcacatgattagacctcaaagccctactttctgagctttggggaggggagggctggctagagacagagttcaatcaccaatggtcaatgatcatgcctaagtaatgaaacctcaatcagaactccgaaacaatgaggctgggagagcttccaggttggtaaaagcatttatgagctaggagtggcacaccagaaggggcatggaagctctgcacccccaactcataccttgccctatgcgtctcttccattcagctgttcctgagttataaataaatcctttgtaacaaaactgtaatcctaaatatcatgctttcctgagttctatgactcatgatagcaaattatcaaacctgggatggggagtcatgggaacctccaaatttatagtctgctgggcagaagttcaggtaacgtacaaatacccaatacctgcagctggcatctgaagtggggcaattttgaggtaatgcgtaagtaatatgtgggatctgagggtgtgggggcccacacctgtaatcccagcactttgagaggccaaggcaagaggatcgcttgaggcagtttgagaccagcctgggcaacaagcaagactccatctctacaaaaaaaaaattttttttaactagccagccatggaggtgtgtgcctctggtcctagctacttgggaggctgaggtggggagatcacttgagccccagagtttgaaatgacagtgagctatgatagcaccactgcactctagcctgggcgacagggcaagaccctgtctctataaacaaaaaatgaaataaacaggtggggtctgtgctaactccacgcagtaacagaactaaactgctggacactcaactgctgcccaagaactgttggaatgatataattaatcacctcattaagaggtccacactaaaactaaccattctgatgctcagaagccacttccctgcttgatctaatcattaaatctacacctgtcaccaattcagagcactgcttgcaggtcggcactagcaggaaatcaggtcctatggacagatcacagcacctggtcaaaatttttttttttttttttaaagaagaaagactaatttggcctgccaaagagaacatggatgttgtagaaatgtgaagtaaaaaatgattttttttttttgagatggagtctcactctatcgcccaggctgaagtgctgtggcgcgatcttggctcactgcaatctctgccaccagggttcaagcaattctcctgcctcagcctcccgaatagctacgattacaggcgcctgccaccatgcccggctaatttttgtatttttagtagagatggggtttcaccatcttggccaggctagtcttgaactcctgacctcgtgatccacccacctcggcctcccaaagtgctgggattaccggcgtgagccaccatacccggccgattttctttaattagttttttcacattacagttcccacaagagaatcattaattacctcagcaattgacatgtaactgttccgtttggatagcaaacattgttaaatgtcaagagccactatccagtgttctctaatgctctaacggatacaaataattacaatcccttctttaccaacttccgatttgtcaaaataaagccctaagagacagggatggaggccgggggaattggccagcagtctgtaaagatgactggtctccaagatgggaagttgtcagagaggaggacatgtagggtagccggccttcgagggggcacagtggtgatgggtggtgggtgtggagtggggagaaatgcccatcagtggtctagcctggaccagggataactcctgattatggctgattagtccatcttggagaacaatttggccaaaccagccactgtgtccctgtgctcatccctcttaggcagaaatatgctttccagttgggagaggacttgtgatcagagccctggccagggccagtacactgcccaactccagaggaccctgtcccctccttgtgaacggcattccctggagttgggcaatcttgtgggcctgctccttccctaccctctgtccccagtaagtgcactgttagtattttgcagcctctcccagctagaccactgatgggcttttctccccagtccacaataccaccaaccaccgtgtcctctcaaaggccagctaccctacacaagctcatctccgacaactgaacctcccatcttagtgctctgggagtctttaggcttttctctttcctaaaaagttaggaaactctcaagcagaatgctcctcaccgtgggcatgagatacaccaactgttttgagtaaatgactgaacaactgactatttcaaagaacaactaaatttctaagagaaaaagaatctgacaacattctcaaaagtagacacacagcattcactctatcactcctcactctctaattccacttactgagaaggaagaaaatgtcacaactggggaaaaacacctcctcagagggcctgagacttccagtgtgcccctagatgctgtctcataggacccacactgctagagtcccggcaccttcactgtaatggtattattcacctccccctcctgtttaaagagcacttactaggcaagtcattaagtagacataaagcaactatttaattgaaagccaatttgctttacagatattttttaaaaataaggaatgcatgtccatggtggttatttccacagagctgttcagaagctgttctgtccatggatccacctggattctcctcttcaaattccagggcaggtcacaggaaatggaagtctggtttagcattttgcactggtgttcgagaacaggcccacttgcttatctgaaaaacttacagtgcactgaccattttggggttggtttgggggggaaaaaaagaaaacttacagggataatgcctcaactcctatttgaatgtaatatggtcactttcagaactattctgaagaaaaaagcccagctttctatcaagtatccacaaccactactaaaactaagaagcctctcatcccactaccattaataacctcgcttcacatatgcttcactatagggagtcttctttgaaagatgaagagtttgtgacaaaatgtttgagtacagaacccaagaacacagagtccaaacaccaaggattcaattaaactttatcgggtgcctacaccaacttgtttgagagatgcagtgcaacagacagaacaagaattagtgcagagaaggcctgattctagccttgctgctgcctagagcttgctctgtaactttaagcatttactcatctttttttttttttttaaatgagacagggtctcactctgtcaccaaggctacagtgcagtggtgcgatctcagctcactgcagcctgaccttctgggctcaagtgatcctgctgcctcagcctcccaagcaggtgacactacaggtgcacaccaccacgcccagctcctttcccttatttcttgtaaaatgaggtctcactgtgttgcccagactggtctcaaactcctgggctcaagagattctcccgtctaagcctcccaaagtactgggattacacgcatgcagtgcattaccatgcctggcctacttatttttcttgatttctgttttcccactgaaaataaccacttttcaacctgttttcagcctcagaacattttattcaactagaatctaatagggtagcccaatataacagaatattacagtaacttttcacagactgaagtagtaacgtgaaacagaaggaaaacagcaaaaccccctcatccctgccacaagcatacttcaacaatggcggagagggctcctcaaagcccagcttgaaataaacaccagatatgctaagattctgcaagggtctgactttttcctgcttctcctaaacttcaggaaggggaattaacagcattcaaagtagtaatgctatgacttgagactcgttcagaatcaaaattaaaggacacatactaatccactttaagcaaacactgcatagagttcaaacccatcatgaatgatagagagctaaaagctgtaacccaactctgccgcttgtgtggaaacaatctgctactaaaataaaggagcaggccaggtgtggtggctcacgcctgtaaccccagcactttgggaggccgaggcaggcagatcacttgaggtgagaagtctgagaccagcctgggcaacacagcgaaaccccatctctattaaaaatacaataaattagtggtgcatggtggtgcaggcctgtagtcccagctactcaggagggctgagacaggaggatcgcttgagcctgggaggtcgaggctgccgtgagccttgatcatgccactgcattccagcctgggccactgagtccagcctgagactctgtctcaaaaaataaatgaatacataataaatcaaaaaggggcaggttttttcaacactttctcttggcccaacaggcagaaagaggggcagtggctccgagatgctaagcagtctcaaaaatgaagagtcccacactatacactgctgctatctgagattcttagtcagtcatcagacctggtatgaatctgcaggcccaagtgacagaattatttctagtcaccaggtcctgcggttgagccctccagcagagcagggcacaaaaggatcagggatgatgcttcccaacactatgcaatccaagcttctgtgtggcaattcaatcccaagcctaacaatatagtacagctcaaaggacactcttgaacaaggtcaagccctcaggaaggtagacgaagtcattgacatgtctgcctttgcatgcaaccaggctggtatccaggctctgggcacaggtgacttattttgccacaagagctaatcaccacctcaagactgatttactaagcttccctgttctgatgtatggtatttaaagaaggtctcatttgcacacatcttaaagaaaatgatttccctatctgccattctcttctttcaacatgtcacaacttcaaagaataagagtttgagccacttccaatcttttctttcattttcagtgcaattggccatctgtatcaataggttctacattggcagattcgaccaaccatgggtcaaaaatatttggaaaaaaaaaacctaataacaatacaacaataaaaaataatatgaattttttaaaatacagcatagcaactatttacataccacttacattgtatttggctgttgtttttgagatggggtcttgctctgtcacctaggctggagtgcagcagctccatcacggctactacagcctcaacttcctgggttcaagcaattctcctgccttagccaccccagtagctgggactacaggcatgcaccaccatgcctggctaagttttttaaatttttttagagacagggcctgactatcttgcgtaggctggacttgaactcctggcctccaagcaatcctcccacataataaaacaaaaagggggcaggtatttgtagtagcctcctaacgtgctgggattacaggaatgagccaccacacccaaactgtattaggcattataagtaatctggaaatgcctcctgagtagctgggactacagatgtgcatcaccgccactccctgcaccttcccatatactaccactttatgtaagtcttgatcatttgtgaatttggtaactaaggggtccaaaaccaatcccccaggataccaaggggatgtaaatatgttacgctctagtttgtaattattcactgattaaacggtcaagttctgtggtaatcccttctcaccacccaaaagaataggattcaccatcatctaggaacacagacgtaagaactagtgaaactagatttgaactgaaagacactaactcaattaaccctggtccattgtgcaaagagctccagaacagtctaaacagacacaaagagataattttaagttatcaagacccgggaaaacaggagttaccacgtcattaccattgtttcaatctaagttaccacttcttcacctcaaaacaactggcaactactgcacaattaaatgtccttacttcagcacatagacagtcccagactacttcaagtacttacacaaccattctgtttttcacttccagtattcactcaataaattacatgagatattcaatattttattataaaataggctcattagatgcatttgccaaacatgccaaacatgcaggttcttggcatgtttaaggtaggctaggctaagctatgatgttcggtaggtgaggtatattaaatgcatttttttactaacaatattttcaacttatgatggggttataaaaggtaaccccactgtaaatcaaagagcatctgtacaccaaaacagtagcaaaatctgattaccttttagtcgtgtaatgcaatgtaaaaccacttacccacaactccaatagcaagtggcatcaactggctttctaggttgcccacctttcagaagagtttgtccaaaagcctgcaaagtgtaagaaataaatccactggtaccctaaattaaaaggccagctcagctccgaaaatccaatccacttaaatttgtggattctttccccaaacacaattagtagccaatgtaggagacaatggcttctccttgtgttcaagtcccctcctacccacccgccccctttcaaaaattagaaaagagccaccagtctccaaactggctgatgaaacttcagcctacaggatattttcatatttgagttacaataaaccattgaaatgaaaatgaagtggagagcttaataacccatcagatagagcattttatgccaagcatcagcatataagttaagtccaaaacctttaacctgggccaaagccaaataattaaattaacaaatctcactaccaattctctattcctttgagatactctagtatgaagagtagaagttgcctgttcctagatgtttactttagtcatttgcttgctaactaaaagacattctgtttgcaatcaaatcagaattagtaattcagtaccaggatctacctcgtccccttcattgcccccagaactgcccagaaagctctgttcaagttttcgataatccttctacaggtgccacgagaatactagaacctaaaacaggtgacaagtcctcaatttctgattcgttttccccaaacactaaaaggttttatttagcatttctaatactgagtttactacaaatagcccaagcaacatttaagtctctcaactgcctggctcaaagagccaattcactcaaagaacacactagtcactgttgtagggttcaagagaagaaaaaagcatattctgtttcagcccagtgtgacatggctcaagagggccaaatcaaggagtcttgattgggcctctcaagtggacggtctggtcaaggtgaggctgaaaagcagcacaccattagagatgaatgccctcagcagaaggcaaaagtaggttacatcccttggttacgtgccagcccaaagatgccgacacagtggaattgagccccacaatggtcatttatctaatgtaatccactgagtgaacttttagtaccaacctacacctcagctgagtgttattagtcatcagaaggatcagacaagagtggaactattgcaacataaactgcctccctacaaaagacaacttgaaacttagatcctgatggtcatcttggtagatggataagggcatattattaacacttgcccagtccttaaattcatacagagctggaaacaaaggaggattcgtatactagaacacattcagagaacttattatgcagttttaaacagcagtatataagacaaaataaagaaagaggtgtgtcctcaattgaacatcctgctgaaaatctgaacacccagcttgaaatttatctgccagaaaagacccaggtgaccactgcctcttcctctcccactcagcagagtgactttattatgatagtccaacagtacctgcaaaaacagtaagtgataagaccctagttaaggcgacagaattaatcaacaagcagcatcattttctacttcctactccttctggcaatttgtttgcctacctattctgagccccatatccacctctctgaccttatctccaactctcccccgtgttcactaagctctggctattactcacccaacccatcctctttccactacctcccacctaccctgaccctttcttcccattccctggaacttgacaagcgcattccagccagtttctgcaccagctgttccctgaacctggaaggatcttccccttttctttggatggctggctccttctttatacttaaagctcaacttaagtgtcacttcctcagaaagatcctctttgactgcatctacagttaagacactttcaatcacatcactcttattttcttcagcgcttgatcaaaatctggtttactgggatatatattatgtctctctctgtccccagctcccactccgatgtaagctccatgaaagggtgaaccttttgcttgtgttcacctgtgtacacccagtgcctgaaacactggctagcacttaggagtcaataaatgtttgttgaattaatgaactgtgaactttttagtcaatggcaaactaggttctaaatcagttaaagtgagaacagtagtcattcttctgttgtatttttgtgaaacatctaaacacgctgttactggtataatcaagcattaaatattctgttttttagggcccgaaagccctgaataggacttcctagcatcagatcttcctagcactatgcatatcaagctcagttacagaaggacaggacttacgggcactttctaatcaaaggactccgaaaatgtaggcactatctcttaaagttcttcagaaaacagtttcagattctacaaaagatttccgaagaatgtatcaacaccaaaaggaaaatcataacacttcactctgatatctgtctgagaggctagaagagtgctccttgattttttttaaaccaacagcatatcaacaaagaggccttctttccattctttgcttcaaataattttttcacatccgttattggtttgtattcgcccttaaaccaaaactaaacagatcacactgtctcatttaggacccccatacacaaagaatcagctacgtaaagatgaaaatcagcacaagctgaacgtgtcactgatgatttgtgtgtcacacataaatggagaaaaacataaaagagctattgtccaattgtagaaacaaaaaagtaatatggggttttctgttctctgaagtgcatcatgaaaagtgggtggagagaaacacagaaatccagaattagcctagcaaatcattttgggaagagctgacaacatgtaaattcctcacacataaagtatttcgagcaagagaccttgattcctgggctatgatgccattcaggattccttgcaaaggctctggaattccagtattcataaaagaaaatgctcattataatcggagcgtaagaggtactcccaacgtgacagcctgtatgaagtattacaaagcttacagttaagatctgggatagaggctgaacaccaaattcaaaagaggtaaccaaggcactaagtgccataaaggaggaaaggggaagaaaaaaaaatccactattgccactcagccacagagaattaaagtggaaaccaggggtgtgcatgggggaggatgaggggtgagaagtgcggggggtgtggtggaggaacaaacaatacatttgtcaccccgtcccacttcctatagaggatacaggcaaagcctccagcctcattacctcggacacagatggttatcgtttatagcaaaggtgcacaaaaaggccttcaggtctgagccccttaattccagggctgttaatgattaaagagaacgatgggggtggggagggaaatgagggcggagggagctgggagattcacccaccacctccccctagggctcctacctcacagcgctcacccaggacagaggaccagagtctgcaccccctccagggcagctccaaccccatatccccaggccctgggttgaggggtgctggcggtggggaggcagggacagtaggtaagttttctgagccctgcggctgacacgccacaggctcccctcacagcctcttctttcagaggtaccactccagacaacgcgctgacttccactcctccctttccacccccctttctcgaaggtacccaacccccgccccttcatctctcaatgcccccccgccttttcctcaactccccccctccccaaaactcacagctgctccagaggttcctccagtcaaaccctttctggaaacgacggcggcccggcgggtccaaaccacctaccatccccgctcgcgtttccaggctccctacccccgccgccgccgcctcttcttccaccactgccaccgcctcctcttcatctgcggcccaccggcggcggccgccccgaagccccgccccctccatcgcctcctgcatcatcacttccggtaaccccgccggccgccagctccaggagggagaatgggagaggggcaaggagggaacgagtggaagattgcgtcacgacgcacataaagacgtacgaagccgtcgccaagtaagggcaaagacctagcaacccggagggagctgggctggaccatttttttttcttgttttacgggaatggagcggggaggataatgaaagcgtaaaggaaaaatagggggaggaggagctcagcttattgttggatgcggcgggagatgggtagagtcagtcagtcgagactcccccagacctggaactggtgctcccacagaggtgggcccggtggtttggtccggcctggcctactggaccagcctgtgctcggtcggccacggctctgctgggctcctggcgccgcctcctcccagcccgccgcgggctgcgcgcttctgtgggtgggggaaggcaggactgacgcagagtgagtgtaggggatggaggcgccgactccaggcgcgggagactggcggggaaggggttggctccccacgggcagggatggtttggaggttgggctgcggcgttgccgggagacgggcctgtgtgaccccagcttcgcgggggcggctcggtgtcatcgccaccggcctcggggacctgcctcacggaagtggctcgcgcgtccaagaggggaggcctggtgtggggacgctcaggtgccggcgtggggccccctcggaggctgtgaatcttttggacccccgaatgtaaatgggagatggtaggggccggtccgggggcgagaggtgtctggctggggaacgttgacccacaccaggtcccgtacaggaacggagactccctaggaccgtgagagccagcttcgtaattctcttgctcttcaaacctgagagtagggtgttgctccgttaccttccattcgtgtgcaggagagagttaagtaaatcaataaagaaggtatcagcaagtgagaaatgccccccaaagaccggatgaggtgacagaagatggggggagggcccctcgaaatcgggtaaggtcgttcaaaggaggccacggttttgcggggatccgagacaatgggttttctgggtggagagaagagccaatgagaaggacttttaggttggaaacagccagaaggccatgtggctgaagcaaacagagccagggccggagtgccctgtgatgtagttggggaagtggcatgactgtagcagcgccttttagcccaaggcaggggtttggctaatgtgtaccttaagggttttaagaagggaagtgacctgacctgatttacatttttaaaaatccgctctgcctgctggatagagaagggtggaagtagttagacctgttaggagactgttgcactgtaagacaaaggagaggtgaagatagtgttgaaagggccggccgggcgcggtggctcacgcctataaacccagtactttgggaggcctaggcgggcggatcacgaggtcaggagatcgagatcatcctggccaacatggtgaaaccccatctctactaaaaatacaaaaatcagctgggcgtagtggcacgcgcctgtaatctctgctactcaggagaatcgcttgaacccgggaggtggaggttgcagtgagccaagatcgcgccacttcactccagcctgggcaacggagtgagactccgtcttaagaaaaaagaaaaggccctcagtcacagtggaaatggagagaattccattcagcatatatttgggaggtagtgcttgcaggacttgctggggaattggatgtgaagtgtgtaggagagggaggaaccaaggttaactccctacgggaaaacagtttagaaaggaatatcgaaagttctcttttgaacatattaagtttgataagtctattaacaagtcaaatgaagttgtcaagaagttagatatacaagtcggggaaaaatcatagttggagataataaataaggaaggcagggaggagctcccagatcacctaagaagagcgtgtaaataaaagaggaagacccctaaatcccttgggttcttaccatttagagagtacccagagaaggagaagccagcaaaggagacgacacagacaagacctcagagatcaaaggaagaggccccttaatatcctggaataatgggacccatccccgtaatcagtgaatctcatccacccgcttgccagcttctacccgcagcaagtagaagctaagtcctggctcaaatctcttccctccctccctctcccagctgtcagtgcttttggacttgtgctcaggtaatttgtgtccgttatagaaaacctgactttttggataaattgtctgtttatatggctgtctcccccaggtactgtttcttatttgtgtcttcctggctcctggtacagagccttgtccatatggtggttgtagctgggcaggaacactgtgttcataaggtatcagccatacaatccaacagcttctcacaaaaaggggcttttgtccctgccactgctgccaagcccaccacaattacgatcagttccacaatatagtgtaaagggtatcagaagatgaataagaaggcctgggtttcaatcctggatctgccactgaccagcagagtggccatggataaagctcttctctctgagctgaagggttggcctagatttgaagttgcatactgacaagacagatattgcctgcaaacatattgttcagcccacacagtgatttaaattcttttttaaatttacttgccaacatttaaaaattggacatcaaaatccagactttgggcttcatttgaaaaatccgacaatctgacaacaccagcctgaagttcctagaggttcctacacagcaactgtcagccagagctgaagagctgtctcccgtctatgtggctcatgctcagggtttgccaaaaaggcctctcctctcctgctacctggctgacccctgtgggcatttgatttgcaattcttggtctagggctgtgctatccctgtgtagccactgaccacatgtgactatttaaataaaaattcagttcctccaacacagtatgtttcaagtgccagtagctacctgtgacaggtgtgtgtcctattggacagagcagatagaacctttccttcacagaaagttatcttggtcagcattggactggaggaactcgagggtactatgtaggctagtcattctccgcatgtgaaactcaagggacttagcctactgaggagctctggtgcctctgcagatgggaaagttgcgcattcagtagttatttgatggtggaggaagctgtcctgaaggcctggacccctgcacagaatgtggttatttatcagagagttggatcaagggtcaggtgctagaaagccccaactgtatctagtgtggcatgcaaagctctttggtcagtttcctaatccagttcctcagaaaactataacaaagcaagaacttaagtcagtgtcttgtgttctcagacttttcgatttgatatgaagggtgaaagatcctggctggggagttatgaatgaatgaatgaatgaatgaatgaatgatctttagcattggccttcaattccagcccccccaccacatctcttccactgccttctactactagtaactggtgactgctttttcaccacctctgactgacccgtaccttttctttgcctgttaaaatatgctaataaggaaacatacttccatttcttttgaattgaggggcccataacttttcatttagaacttctatccctgatgggaaaaatagctgtatatctattggttgttatcttggttacagtagcctgattggagttcccctgtacaaatataatcttgtgtgcgctccggtgctggtatgatatatttagaatgggtgtgcttgcctcctgtgatcttgtttgggatagacattttagaagtctttcagacattttttgttttggccccgtgttctaaaaacttcccatattacagggcctaaactaaattattttcccttaggtaaaataaaaatgccatccaccctctcctccctgccccctattgctgacagaccatattcttatcattttctgtgtaaaaagatgctgtttcataaaatagctgcggtatgattaagtataccacacaagcatatcctgaaatttgcaaaacagtgtgtggcatgtgaggcattacacttccctttttggattctagtaaccaaaaactgaatctgaaacaggaaataagtctgtggttgtgtgtgtgtgtgtgtgtgtgtgtgtgtgtgtgtttaattgataggaggatatgggaccagaaatgtatggagaacaatttcacttaaaggttattggattggggtaagaatatgggtgtacaccaaaaaggagggagtataacagatctaagagaaaagtgccctgagggataaacaaggagtaagagataaaggaagaaaaataggaagggaagcctggtcatgcctttggtgttggcacctgcattatatttccagtaagaagtatgcgctgtggtctgaagataagcggtgcttccaacagggttatttactcataccaaagaacaatagtcctttgctgtacagggattattaatgatcagagggaaacagctttaggaaaatccattactaccacaaagcaataaattcaccaacaggccacacatttctctcctattcagacaaagcttagcatagataaaagagacctcgttgttcttcctctgtttcctcctattcaggtaacatttgcctttgttaactctcagtgctaagtgatgttacatggattatttcatgaataatccttacgactctgaaaggggttctgctattaccccattgtacattctaagaaaccaagtctcaggcagttaataatttgcccaatggggtaaagtcaagattcaaacccagccttgtccgcccagagcccaaaataaatgttcatttattttgtattatatctgctattccttacaaatgggacagacattccctactctgctatacagggcaagaacatctggttgctctgacattagcaagagcatttcaattctgtagaggttttccaaatgatagttttaagtcacagttttctagattgattttaacccatgatcattgagtatagtggaccttattccccaaaaggattttttcaggaaaaaagtatcagaaccccattcttctatgtttggttctaaacttcatggaaatattataaggtatttcagtccagtggacaaaccctaaccagccttaagaaaacttaagagtgagggttacatcatagctgtgtctcttacgctgttctggatgaaactgatgaggattcctccccaagtaacactgagtctccagttctttatcctgacacacactgctcttgaaagcatcctagtaagggttaattagtatttaacccttcaatgctctgggatcatcagttgggaagcttgtccagataccatcgtgtgtatctcaggatgagaacatacgttatcaatgaccattctgtgtgtgtaaatttattcttctaatacatatttgtcatgttccaactatgtgccagcctaggcatgtaatgtacaagacagtcccaaatctccccctgctctccccacctcctactccctgcaacacacacatggtggaaaaagaaaggtaagtcatgcaaaattatgatagagtaggatgaacattatgacaggggtatgccagaggtgccaggagtgcacatagccgggacactgacccagccccagtgtgaaaagggcacccgtccagaagtgatggaagtcaaaaggtggaagcagcaaataggcaaagaaagggtatttcagttgtatgaagtagagaggcttcctatggcaaaaagagggacattgcacatacagaagaccatgatctcatttgggtggagtttatgattccccctccttgctaaaaaatcataaagtacttgggagagaaatttgactatactacggtcatgagttctgatgagggaaaaaattccacctaggggtaggtctttcctgaaataaatggaaaggggtgtttaacttcctggggcttgaaaatcagggtaaattcctcttgcctttgtcccatttcttatttgtactgcaacacattttctttagaaggcaaagcctcatgagagtccagcatttggaatttggacattcctgagaccagagtcatacttctataaatctcagctggggaaagggaattttcatctctgctcttaaattcctaagtgttcatgctgcaatggtctttccaaaggcagaggaactgttccagaggtggggtaaaagggcacagtggatgaggcccctcataccagcagatctttccatagtcctcctgtagaaacaccaagtgtctgggtatgccttgtacagtaagttcttggaacctccccagaccctctcactgcactttggacagtgagtggcagagtgggtgggtgtttggtgtttggtttttgtttttgttttttagactgatcgctgcccattatgagtccccattactgactccaaaatagaaaagcttgtggtcagtcaggaaaatgatcatccagcttttttggctcttgaccctgactcctgtcaactaattaggggcattaggcaagatcttgtttcaccatctgtacaagtgttggaattataagtagttatgatatacagtagtttgatatacagtgtatttaaaaagatataaatcagaccgtgttactccagcttgcataaaatctaccagtgtcttttgcgcttaagaccagaaacaaagtgcctttccaaggcctacccccaacctgtgctggattctgtggacctgtggcccctttcccaaaggctcttgttgcattcatgttcatcttttttattttcattttttgagatagagtctgactctgttgcccaggcttgagtgcagtggcgtgatcatagctcactgcagcctttatcacctgggctcaagggatcctcccacctcagcctctgaaagtgttgggcttataggcatgagccaccatgcctggctaatgtttttatttttcaatggagatgggatctccccgtgttgcccaggctggtctcaaactcttgggttcaagcaatcctcccacctcagcctcccaaagtgctgggattacaggcatgagccaccatgccctgcctcatgttcatctttgaagtcgattcccacgtcacatcctttgctcctgttgttccctctacttgcaccagcttccccttacctgggtccgttattaggttccatcacaccattcaggactcagctcaaatgtcactgaccacccagaaaataacccccacctctggtcatttgtatcttattactcttcagagcacatatgactgtctgaaattcttgttcttgtacatcatctgcctatgccactagaatataagctcaaggagggtagggaccatggctgcttatttatcactgtatccccagaaacggcaggtgtctggcacatggtggaccttcaataaatgttgagtgagtggatggatggatggatccttggaagggaagagtaaggcctaccaggtagtagcactgtagtgagcccctgcactggtggcttttatgttggctccattggagtcagaggggacagggttgccacggggaatggaagagcaaagcggtgcagccatgtgcccagcctgcttagagcatgctggtgtgtaacataattaaaaagggcggttgcaggttaggagcaggggcaggtggcaaatggggaaggctattggaattcacatcaatgtgcaaaaaaattgcttcctttgctctttgtatagaaagggactagaattatttagttccctttgtcacaactagctaagctctttaaagcaatcaacagacattcaacatttattgagattgaacagtgtatttcgtgattaaaagcatgggctctgacttcagaccagctgagtttgaatcctagccctgcctattgttagctgtgtgaccttggacaagttacttagtctctgcatcaggttcctcctttgtaaaatggggataatggtagtatctgcatatatagagtacctagcaaattatctggcacacagtaaatgcaaagcaaatgtaacttttaatatttttcttactgtaatgaacaagatacaatccctgcccttcaggaattcagactcagagaagaaaaaacagagtgaaagaaatgcagaactatctgctggccatgatagaagcaaggaaaaggttgctttggaaaagcttaatagcaagtaggtgtctgtttgatggtgtggggtggctagcagaaaggagacattgtaggcagaggaagactcagccaagacagacagaagtatgacatggcaaggcaccttagagcagtagctcccaaacttcagagtccacatcacagtttttgctgtttacctatattttaaactagcttaaaaagttttctaattcatttctttaaaggaagctgtatatcacataaaatctaaatcactcaaaattatgggtttgatgggcttttctaatatacagtttgtattgtatatctaagatcacctccccaaccaatctttgggacacttggcattaggggacacatctcttaactatgaccagaggccacaacacactggcagcaacatctgtcagccttttcttagtggcacaggcctgcacatcacagaggcttggaaatgatcctcacctccacacatgtatatccctgtgttataacagggcgtgatttttaagaaaagagaccagcttctagtcccatttctttccaggcacacctcatatcttctgtctttcttcattctgggatttgggggttagggagatgaaaaggagtaaagaattggaagaaatgtcggtctcagaataaagattatagaaggttaacttttaaaaatctacatggatagacttcgtgaccagctgagaccgcagttgaattgtggtcctctaaactactgaatattcctgatgtattgctggtaagaaaatcccagcagaccccattgtatcagatcaacccctgatgtagtgaagaaggaaaagggcttccttagtcttgcattaattgtgagagataattgatagttttagagcaataaatgttggtttcaagccattaaatccatattcgggaaaagctgatttttctaaataagttgctttctaggaacaaagacaaaaatataaaaaggaaaagagctttttaaactttttaaaaaatatatggctgattctgtttctagaatcacaaactttctatagcacaggatactctcaattattcagcaaacatttattgaatactgattatatacctttctaggtgctgagaattcagcagtaaagaagatgaatgtgatcattgtcccccataaaaatgagagtttactgggggaagactttaacaaaccattacttaagtgaggagtgctatacaaacaagaatattaggacctgtgagaaggttcaacagagagccccaacccaatgggtgtgagggaagcaggaagattttctgagacatccatattttcactgggaacggcaggatggatagggttggtcaggtaaaagggaggggttcaggggaaagccttctagaaagagaaaactgcatggatatgtgcccctaaggcaagaaagaacatggttccctcaaagacctgaaacaaacccagtaagaaaagaacaaaagaaacatttttcttttcttgccttttctctcaagacttggaaggaaatggtaggctagatttaataggacacaatggtgaatacagctttagacccttctctcaggaaatctttgaaacttgggttttctgggtcacctgatgttgcagagtgagacatcacataaatccctttcaggattagttttcaaaacacttaaacgttaattaaagtgttttgaaaatagtcctattaagtaccaattgttagcactgctcattaccttgagggtattaacctaattgcagggcttgtgtatcagattatggtatatgatcagttagagtttgaaacagtgattcttagagtcatagaaggaaactaattaaagttagatttttagagaaggttgctttagccagttgttgtggcgcacgcctgaggtcccagctactctggaggctgaggcaggaggctcactcgagcctgggaggtcaaagctgcagtgagccatgatcatgccactgtactccagcctgggtgacagagcgagaccctgcctctaaaaaaaaaaacaacaacaacaaaaaaccttgctgctgattgaatatgcctgaccttggtcacttttctcaagtgtcttgcagtcaaggaagttccgtctgttaatgacagggaagtgaagcaatcattaagagatgttagttacagactccctgtacctcacaggaactgactcatgtattttcatatgaaaccatggagttttagggagagccagaaactcagaaacctgtttccttaccaggaaaaatgtcatcatctcatctgggtttttattacaataagccacaaagcatgatgttctctcttggtttttatgaattccttgtaagcatttttttctgtgcagcctcatagactcagaattggtattgaatataactttggtccttttaacctttgaattaggtgaagtagtatttgaagcttttcatcagttggctcattctttactcaagaataaacctcaagaaacgtcatcagggtcagagtaagtgctcatattggaaagagaaattctctgtaagttgaattccttgcaagtacttagaattttgaggtaaacgtgcccacttccagctccaatctgcattctttagctgctcaaattctcataatttcaggactaccctaaagcatattatctccacctcttatgcctttccctccataagttgaaaatggatcatgttcccaaaagcaagcagtgagcagcttacttcccgatcctgatgagcctgttagaggaaaacccagaactcagaatgaggtgtccagctgcctggccttgctacttactcaccaaatctgccctccttgtcttcccaccctgtcttctggttcaaggctgtacaatattcattgttctaattctgactaatcagaatcttccagtagtgggacttttttttttctagcttccctgaatttattttagatatagaaatgtaaatagttatgaaaaaaggagagggggggctgaaatactttgttttttcatttttatagagatagggtctctttatattgcccaggctggtcctgaactcctggcctcaaatgatccttccatctcagcctcccaaagtactgggattataggaatgagccactggagccagcctgaagtttttaaataagttgttggggtttgcttgtttgtttttgagatggggtctcactctgtcacccaggctggagtgcaggggctcagtcttggcttgtagtgcaatctcagcttactttagcctcccgggctcatacgatcctcccacctcagcctcccaagtagctaggactacaggcacatgccatcagccctgtccaatttttgtatttttttacaaaatgaatgttttgttaaaaacatgttaccgaggtgggtctcaaactccagagcttaagtgacctgcctgtcccagcctcccaaagtgctgggattacaggcatgagccactgcacgtggccttaaataaatttttgttggtatttttgggttttttttgttttttttgagatggagtctcactctgtcacccaggctagagtgcagtggcgcaatctcggctcactgccagctccgcctcccgggttcacgccattctcctgcctcagcctcccgattagctgggacaggcgcccaccaccatgcccggctaatttttttttgtgtatttttagtagagacggggtttcaccttgttagccaggatggtcttgatctcctgactttgtcatctgcctgtcttggcttcccaaagtgctgggattacaggcatgagccaccgcgcccagccggccttaaataattttttttaaaaaggaaacacctaatatccatcagcaaaatagatagtacattgggatatcttcatacagcaggctgaattgcagcactgagaatatatgaaccagagccatgtgtaacaacatggatgaatcttatgaatgttatgggcaaataaagcaaattgcagaacttacctataaactttttaaacttgcaaagcaggcggggtgcggtggctcatgcctgtaatcccagcactttgggaggctgaggcaggtggatcatctgaggtcaggagctcgagaccagcctgaccaacatggtgaaaccccatctctactaaaaatacgaaattagccaggcgtgatggtgcgcacctgtaatcccagctaattgggaggctgagtcaggataatcacttgaacctgggaggcggaggttgcagtgagccgagattgcgccattgcactccagcctgggcaacaaaagcgaaactctgtctcaaaaataataataataataataataataataattaaataaataaataaaacttgcaaagcaatactataaatgttatgtgtaaagatatgcacaataaacaataaattcagcatagtgattccttctaggagaggaagggaaatgttatttggaaggggtacagtgggggtttctactggatacataatttattctttaaggtctgttgtaactgtatggctattatattggtctcagtatcttttctttgttttttttttttttttggagacagagtcactgttgcccaggctggaatacagtggcgtgatcttggcacactgcaaccttcacctcctgggttcaggtgattctcgtgcctcagcctccaaatagctgggattacaggtggttgccaccacacctggctaatttttgtatttttagtagagactgggtttcaccatgttgcccaggctggtcttgaactccttacctcaagtgatccacctgcctcggcctcccaaactgctgggattacaggcatgagccactgtacctggcctctatatctttttgtatctgaaatattttgtaataagaatttaaagatactgggaattatgcttttgaaaaatacaattagctttacagaatatacctacgtccgttctctcttggccacatcttctgaaattaaaactgatgtttgagactaaaaacccagaggggccttgagatcttcagtcatcagaaagattttttttttttcttttttttgagacagagtctcgctctgtcacccaggctggagtgcagtggccggatctcagcttactgcaagctccgcctcccgggttcataccattctcctgcctcagccttctgagtagctgggacgataggcactcaccacaacgcccagctaattttttgtatttttagtagagacggggtttcaccgtgttagccaggatggtctcaatctcctgacctcgtgatccacccacctcagcctcccaaagtgctgggataacaggcatgagccactgcacccggccagtcatcagaaagatttttaattatacttattggacaagaaagtagaccaacgattttgagaaatatttccaaaaaggttgtgacagactaaaagagaggttgcaacctgacaacctctgggtggaactgagcctacagactcattttgtttggcctgtacagtcgtcacttttttttttttttttttttttctttttggagacggagtttcactctgttgcccaggctggagtgcaatggtgcaatcttggctcactgcaacctctgcctctggggttcaagcaattctcctgactcagcctcccaagtagctgggactacaggcacatgccgccacacctggctaatttttttttttttttttttgtattttagtagagacaaggtttcaccatgttgcccaggctagtcttgaactcccgaggtcaagcaatccacttgcctcagcctcccagagtgctaggattacaggcgtgagccaccacgcctggcctcacattttcaaaaataatgacttagtgtgtttttttgagatgtcatatttttaaaatctggattgccacctatttttaagctatcaggaaatctggcattcctaggcacttctttctacatggcagctgctggctggagctgaatggcaactgttccctttcaagggggcatttcctgtccaggtggccactgtccccatccaagcaagtcctctcatttatattacctgccaggccgcagaggcacttgagtttgtaaccagtggattaaattccatttctcccttaactagaaaattcagttatcaaaaatatgccttcacctaggcattcaggtgagtaatataattttactggactggcttaaagaataataagtgtgagctttggttttgccgtgttcataaatgtggccaccatggcaaacgatgtggttaagcaaccctcaacctcgggatgaattacaaagccagttgagagatacggtgtttctattagatggtttcagcaatgctacccaacagatttgttgagaaagagcaattatttctagactaattaaaggtcttaattaaaaaactgtacatcagctgggcacggtggctcacgcttgtaatcccagcactttgggaggccgaggcgggcagatcacgaggtcaggagatcgagaccacggtgaaaccctgtctctactaaaaatacaaaaaattagccaggcgtggtggcgggcgcctgtagtcccagctactcgggcggctgaggcaggagaatggcgtgaacccgggaggcggagcttccagtgagccgagattgcaccactgcactacagcctgggcgacagagcaagactccgtctcaaaaaaaaaaaaaaaaaactgtacatctgcctggtgcctcctgtcaagttgcatttttatgcaaattttccctcttctattttggtgggtctgaagatgacaacggcaacacgacaagaagtccttggcctctaccgcagcattttcaggcttgcgaggaaatggcaggcgacatcagggcagatggaagacaccatcaaagaaaaacagtacatactaaatgaagccagaacgctgttccggaaaaacaaaaatgtaagtaggccccacttggagattgtgcagaggagagttgttccttatgatatttgtttatttcttttcggtctttaatcaagagggctgagccgcacagtcatggtggcagaacttggggcaggaaggggccagtgcacagcttggctagcttgcctgaccactgggaagcctgtgtttctctcttcacttgttccaggtctcaagccagccagtaagtggctcagtgtcctcagaagaccctatgagccaggtgacatgagcaggccaatgagttttcagaggaggagccagtcctcatactgtaccagttgctggccactcccataggaggtgtgcaggaaagtggttttttgttgttgttgttgttttttttttcaattcataaactattcaaagcctctaaatataaacccatttagaaggaagagaataggattaagacacagggtttccttcataacagctttgaactcaagcctctttggctagcagagtgagattgccctttgggaccacagaactgggtaaaatagtgtctccattagctggtttaagggaactgcacacacagcagggagccagattggaccacccccctacaaaccctaaagcgttagctgttagctccggggaagacctcccggcactaagcatggaaaaaggctttcacacccgacttctcttccgtctcctcactgatctaatggattcagcgcggtcactgctcccctcatgaaacttcctaacagtctactctcaccacttttccctctctgacctctgactgtctctcttcagccgtgtcatcacacaccctcccgccagctgcaggggtcctctgaaggtcagccctctgtgctgaggcctgtgcaacatgcagccaccttgtgatttaagctgtcacatctgaatccccagctttggcctctgcctggccacctgaaggacctcaccacggctcaatggtccaaagcagggtcatctttctacaggagtgcctccccttccccactggcccattggtgtcacagctcctgtcaccactctgcaactctttgttctcattcctcactcaacaaatatttgattgcccactatgtgccaaacacaagactagatgtcgaagacaaacataagccaaaccaagacacatctgtcaaaggcatttgagttagatggaaagaaatataaaattacagttgggaaaagtgctacaaaggctggacatggtggctcacgcctgtaatcctaccactttgggaggccaaggctggagggtcagttgagcccaggagttcgagacaaacctgggcaacatagcgagtccctgtctcttaaaaaaaaaaaaaaaaaagcgttactacagaagccctcctaatctgcagcaacttccccttctctgaatccctgatgcctctagcttttcaaggctgacttatgaagtttctctctaccctgctgaccttcctccaaacccaggttccccaaactttttctgctcttagcatagaccatgcttgccaaaccagagtatatgtaccccatgaggtccttaaacaatcctctaaggaatggaaataaaatacaactgctatttctatttatcctttcatctttctaaaaagtctgtctggtacacagttacaatgaacttgttagtacatatatataatttataaattaatacatttataaattaatataaatacatatatggggctgtgggctcagaaatatttcaatgaaaagagtaggtgattggccaggtgtggtggctcacgcctataatccttacactttgggaggctgaggctggtggatcacttgaggtcagaagtttaagatgagcctggccaacatggtgaaaccctgtctactaaaaatacaaaaattagctgggtgtggtggtgcacacctgtagttccagctactcaggaggctgaggcacgagaatttcttgaacccaggaggcagaggttacagtgagccaagatcatgccactgcaccccagcctgggcaacagaggaagactctgtcaccaaaaaaaccaaaaaaagagtagatgatcaaaaggcttggagatccctaaatagttgtttatattctccttttttcttctttattttatttatgttggcatggttttcccaaccagatcatcagttccttgaacatatagacacgttcttatacttatctagtatatcccaagggacctccttgtggttgtcactaaatgaatgagcagctataaatactttgatttaactgacctcctccaggaaatcttcctcagtttctctgcttccccctcaaccccatgctggccgcctgttctgaattcctatagctgtctgtagcagtcactgcatccattgattatataccactgtgccttttctgtagcttcaggtatcagagttgttctgcccaagtaataactttgatagttgaaggcactgtccagcctgcggtattggggatatcatagtacatgcccaataaacctttgcaagctcactcacctgaagactactcaagagtttcggttttcagttatcgcaataacccttcctttgcctcggcttggattggctcgaggagtgagccagagggaggtgtatgtgccactgatggtacatgagattatttgggagtgggcggaagaggtacatgggttcttaattttaagatacgtacttgctttagcatgtgttataaaggacagagaatattagaccacagtttcacaaatgctattgcttaagagagtccatttaatgaaaaattttaacattagtataagtagtatgtggatatggcagaatcatgcagccagcccgtgaatgactgaatttggagtactgtagcccaagcttgttcagatagacagctgaagccccagaagccccaacccccttaaccatatctttgtcaagggctttttctttcttcctagtccctcatgcagacataatgagtttcttgtaactttgattactcttaagagtttaataatccaaaggtatcccatgaactgctctgaatctcagtgggcaaatgggaacatggaactcttttccaacacagacagcaaatcagtggcttctgagaagcacagaggtcagaaagttgggcctctgccacaagggactcacagctgtggttctctgcattgctgttcctggaactcttctctgctccaagaggtaccataggacaggaacgcccttgaaatttccaagccacatggacccagactttgctgcgtgggtgtcatctggtgctgatgcaatcctagctcagctttgaagtccacttgcaaactcctagcagagccacgtcttgattcattttcctacctcataatgaaagagtttctccctttttcctacttggctgtttttcagaatgaactttttattcctttaattgagagtggattaccatgatttgactattttggaatttcaaaagccctttgttccccttactaatgagccaaggcagttgacagtttaagaggtgtagatcattctccagtgtcctactctgggggtttcaggacagcacttgcagaaaccatggggttactttaaagtttaatcaacatgaggggggtgtgaagaagcactctcagtcagtgtcggtgagaatataatttatagattgttggtaggaatgtaaattggtgtgaactctagagagtaatctgggaatatctgtgagaattaaaaatgcatgaatctatgcctttgtcctagcagtcctctctctctaggaattcatcttttagatacatatgcatgtaagcaaagtaattttagagagatccatagcggaatcatttataatagcaaaaaattggaaataacttaattatccatgggtaggagattggtgaaattataataaagccttctgttggaattttatatagctgttaaaaagaagggagcagctctatagatagaatatagaaggaacctcaagttatgttcatgaaaaagcaaggttcagaacaaagggagctattgtttgtgtgagaaaaataatcagcttctacatacatgtgcattttcacatatacatagaatacccctgcaagaacacacaagaaactgctaattgttgtctccgagatgaggaactggaatagaggagtaagagggaaacgtagttcttatgttacatccttttgtattatttgaattatttttacctactttaacgattttaaaagtttatggtaagctttaatattaaattgcttttgattttccaaattagtaacatttcatttactggctagtgaactaaaaaagtttgagaaaatgtatacctatactctatgtaccattagaaagatactatcagcctcatttctttctcccttttaatagctcacggacacagacctaattaaacagtgtatagatgaatgcacagccaggattgaaattggactgcattacaagattccttacccaaggccagtaagtgtgactccggttaacaagtgctgggtacttaccctcatcaacctggttatttccaagaatgtgtaacaagagggcgagtgcttgctgagaagcccagagctgctgtgggaggcatgttggaaataagctatcattgcatgctgccagcccatcacaacaaagtaaaatgtcaatgaatgcatgacgtatcctgcttacatagctttccacgtatggaagggaaaaccagctcacactgtagagctttttctcttttcactttcatcttttttatggaaatgtgtttaattataaaaggcaggtttgttgttactaaaagaataaagttcaaacatgaaaggaatgcataaagtagaaagtaaaaatggtcaaaaattctcatccaggctaggcactgcggctcatgcctataatcctagcactttgggaggccaaggcaggaggatcacttgaggttaggagtttgagaccagcctgggcaacacagtgagaccccattgctatacaaaatttaaaaattagccaggcatagtgacacactcctgtattcccagctacttggggaactgaggtgggagaattgcttcagcccaggaggttgaggcagcagtgacccatgatcacaccactgcgctccagcctgggtgacagagtgagaccctgtctcaaaaaataaataaaacttaaatttatatatataaatttaaaataaaaaaattatataaacttaatacattcagaaagttaagaaacaaaataaatttcaaatttatatgaatttaaaataataaatgtatataaatttatgttttcttaaattctttcataccataaatttaaaacaataatttaatttaaaagaagttttatttatttatttatttgtggagactgagtcttcgcttcatcacccaagctaggtacagtggtacagtcatggcccactgcagccttgacctcccaggctaaagtgattctcccacctcacttccccaagtagctgggactacaagcatgtgccaccacgcccagctaatgttttaattttttgtagagatggaggtctcactgtgttgcccaggctggtcttgaactcctgggctcaagcaatcctcccacctcagcctcccaaagctctgggataacaggcatgagccaccgtgcctggccagaaatcttttttgtttgttcgtttttttggagacagagtcttactctgtcgcccaggctggagtgcagcatgatttctgctcactacaacctctgccttcccagttcaagtgattctcattcctcaacctctcgaataggtggaactacagtcgtgcaccaccacacccagctaattttttgtattttaatagaaacagggtttcaccatgttgcccaggctggtcttgaactcctgagcttaggcaatctgcccaccgtggcctccaaaagtgctaggatgacaggcgtaagccactgcgcccagcccaaatttcttaaaaaaaaaaaaaaaaaaaaaaaatttctcattgtgcagagggtgaacactttaactgttaaatggaaaattgccaatattcaactcttttagctacaaaaacagcaattttatattgtagtggctcaacctaattagtttggtagtatacccttttagtctttttttctgtattcatgtacctacattttctttacatatgtaggattctggatataatgttatactgcgtacttattttacttcatgtcttctgcacatctttgtatgtagctctccctcaatctttttttttttttgagacagagcctcactctgtcacccagtctggagtgcagtgacgcaatcttggctcactgcagcctcctgggttcaagggattcacctgcctcagcctcctgagtagctgggattacagattacaggtacaccaccacacccacctaatttttgtatttttagtagtaacagggtttcaccatgttggccaggctggtctcgaactcctggcctcaagtgatccgcctgccttggcctcctaaagtgctgggattataggtatgagccaccacgcccagcccaatcttttttaaatgattgcattgtatgctattgtaagaatgtgccattgtgttagggttcttcaaagaaacagaaccagtagaatgaagatatgtacatctagggacagctagatgtatatgtgaagagatttattatgaggaattggctctctatttatctagacagagatacatctagatacgcctgaaaggagtttttttggttctttttttttagacggagtctcgcactgtcacccgggctggagtgcagtggcacgatctcggctcactgcaacctccacctcctgggttcaagcgattctcctgcctcaccctcccaagtagctgggattacaggcccccgccaccatgccagctaattttttgtacttttagtagatatagggtttcactatgttggccaggctggtctcaaactcctgacttggtgatccgcccacctcagcttcccaaagtgctgggattacaggcgtgagccactgtgcccggctgaaaggagatttattataaggaattggtgcatgtgattatagaggctgagaagtcctaggatttgccgtctgcaagctggagacccagaagaaagctggtggtattactcagtttgagtccacaggcctgagaacccaaggggccaatggtagaaatccccagtctgaggcccagagaagatgaggtgtcccagctcaaacaggcaggaagcaaaaggagccgcttccccttcttctgcctgtttgttctattcaggccctccatggattggatgatgcccattcacactggggagggccatgtgctttactaagtccactgattcaaatgctaatctcatccagaaacaccctcacagatacacctagaaatgatgtttaatctgggcacccattgccaatcagattgacacaaaaattaagcatcctaggccaggcacggtggctcatgcctgtaatcccagcactatgggaggccaaggcaggtggatcacttgaggtcaggaattcgagaccagcctggctaacatggcaaaaccccatatctattaaaaatacaaaaattagccgggcgtggtggcgagcacctataatcccagctactcgggaggctgagacagagaatcacttgaacctgggaggccgaggttgcagtgaactgagatcatgccactgcactccagcctgggtgacagagtgaaactgtgtctcaaaaaaaaaaaaaaagaaagaaagaaaaattaaccatcccagccataatttaaccagcccctctcttgctaggcagttagtttgatcccagttttctactatgcacagaacatctttatatacacacacttttctccccttctttggattctcaacttgctatgtgatccatgctcgttttttctcctctatgcaggcgatatagcaaagagcacaggctctggaatctgacagatctgggttcaaatcctggcttcccttcttaatgtataaccttaagcaagttttttaacttctctgaggtttcatttcctcatctgtaaatattagaataataatcccttatgaggttgttgtaggattaacttgtgtaaagattaatgaatcaatgtagatacagcacttagcagagaatatggtactttctgagtagatcctcagtgaatatgagctgctgcaatgatgatgaatatgattcttcatattattgttcttattcagattcatctgcctccaatgggccttaccccactccgaggccggggacttcgaagccaagagaaactgaggaaactttccaaaccagtatatctcagatctcatgatgaagtttcctaatctagaggaaagtttatttctgcaaatgatgagccaactagttattgaatgtaaaccagatggcaaaacacttcttgattaggggcaaaaattcaaatgtcttcttaaaacctccacaattgattctccccctgtgatgtaaacttagatatccctagagtttctcagcatctttcttcctgagtggatggcattatccctagaggtcatggaccttacatcctcactgcagtcacctttggaaacaagaccgaggcctgtagaaggaaagcggaaggatgtaagagctgttcatgggaattccattcaccacacatgccagctgatgcaaagaaatttgccagtcactggaagttactgtggctactataaaactatgtaccactctcagaatattcttaggctttttttttttcaagttatagatttgcttaaagtgaggttttttggtgtgtgcttttttgttgtcttttgacccttccagtttccagacaaacttgtcttaaaaagtgcatcattggattgaccatggtttttcatgaaattttatgagatttctgccttaacaaaatgcatatattccttatcttaaagcctgtcattacttaggatgcacttataggatctgaaaagctcactttaaactcatactacattcgttacgagtattttacgttaacataattgaaaagtacaaggtccaagctggctttcaaattatgtctaaacagaaatgggacaaatagacttgaaaatagaagggatttattccacccctgcaagggtagagtcaggtgagagtcccttggtgagtcatttgtacatcagtgtcatttcttcttaacctctgaagaagatgggcatcagaaataaagacaaagcactatcaatttttgtctgtctattctttttcaaaatggactcctgaccctcagaagaaatagctggaacctactcctatgaggaagagcacacgttttcacactcactcaaggtaacttatcacagggtttggcaataacgtagggaacaaatatgatgctgtatcagtggagtaatagtatatgtatatatataaaatttttttttttgaaacggagttttgctcacattgcccaggctggaatgcaatggtgcaatctcagctcaccgcaacctctgcctcttgggttcaagcaattctcctgcctcagccgctcgagtagctgggattacaggcatgtgccaccatgcctggctaatttcgtatttttagtagagacggggtttctccatgttggtcaggctggtcttgaactcctgacctcaggtgatccgcccgcctcagcctcccaaagtgctgggattacaggcgtgagccaccacgccaggcctcagtgtgtgcatatttaacacaaatgcaactagtacactttgtgctgctataatggaatatctaacactaggtactttatgaaaaacagagatttatgtcttaacagtgctggaggccaggaactacaagattgaggagtctgcacctggtgagggccttcttgctgtgtcgttataaggcagaaggcatcacatggtgagagagagtgagagagggccaaactcacttttataacaaacccagtctcgtgataatgaactcacacctgccattatgacattcattcatgagggcagagctctcatgatctaatcccctcttaaaagccctacttctcaacactgttgcaatggtgattaagtttccaacacatgaacttcagacgacacatttaaatcatagcattctatccctggcccccaaaactcatgtcattctcacatgcaaaatacattctatcccagtagcccagaagtttcaacttgtttcagtgtcaactcaaaagtccaaattccagactgatctaaatcagatatgggtgaggctcaaggcacaattcatcctgaggtaaatttccctccagctgtgagcctgttttatctactaccaggatacaattgcaggacaggcatcaaataggcattcccattccaaaaggaagaaataggcaagaagaaaggggtaacttcccaagtgagtgtaaaacccaagatagaaaacaatatcaaatcttaagataggccagacatggtggctcacgcctgtaatcccagcacttggggaggccgaggcaggtggatcacgaggtcaagagatcaagaccatcctggccaacatgatgaaaccctgtctttactaaaaatacaaaaaatagctgggtgtggtggcacacacctgtaatcccagctactcgggaggctgagtcaggagaattgcttgaacccaggaggtggaggttgcagtgagccaagatcacgccactgcactccagcctggcaacacagcgagactccatctcaaaaaaaaaacaacaaaaaaaaaaactgaagatatcagaatactcatctttgactgcatgtcctaaatcctgggcacactggggtaggaaattggccccccaaggcctcaggcagctggactcggtctatgcagcatctctcatgggttggaatctcatgcctgcagctatctcaggctggagttacacactggcggccttacagtttggggcctcaagaactgccccactctcatggctccactagccattgccctagtggggactctgaaatggccctgcccctgtgacaaatgtcttcctgagtccccagactgtctgcaacatcctttgagatggaggtggagcctgccaaggcaccacagcacttgttttctgtgcacctgtagaattagcatcacatggatgctgccaaggttcacggcttgtacttttacaaaaattatctttttaattgacacattgtatctaaacagaaatgggacaaattgtacattataattgtatatatttatagggtgcaatttgatgtttcaatacatatatatatatatatataatgatactgatctacagcttgtactttctggagtggcaggacccatgtgggcccatttgagccatggctggggcagctgagcttggaatttatctgcacctctctggaaaccttgccctcaaggtcctagcttgcctcaaagatctctgaaatgcctttggggttattttcccattgtcttgatgaataaaccctggcttccttctactcatattaatctcttttaaaagggctgcttgaccaaacccttaattttctctactgaacatgctttttaaaaattctttaaatccaggcacagtggctcatgcctgtaatcccagcactttgggaggccgaggtgggtggatcacctgagatcaggagttcgagatcaggccaacacggcaaaaccccgtttctactaaaaatacaaaaattagctgggcgtggtggcgggtgcctgtaatcccagatacttgggaggctgaggcaggagaatcgcttgaacccaggaggcagaggttgcagtgagcagagatcatgccactgcattccagcctgggcaacaggctgagaattttccaaatcttattctgcttcctttttcatcacacattccatctttaagtcatttctttcttctctcattttactataagccaccaaaagaagccattcaaagccttgaatgctttgctgcttagatattttttttttttttgccagatatgttcatcactcttaagttctgccttccacaaagtcctaggacatagacatggttccaccaagttattagcaactgtataacaaagatggactttactccagtttctaataccttgttcctcatttccatctgagacctcatcagaatggtctttactatccaattttctaccaacattttgatcacaacaacttaagtagtctctaaaagatttaggctcctactacagctcccgtcttctgagccctcaccagaattgcccttaatgctccattcacagcaacctaggctttttctagcctgctcctccaaattcttccagcctctacccattacccagttccaaagctgcctccacattttcaggttcttgttattgcagcagccctacttcttggtaccaattttctgtcttagttcatttcgtgctgctgtaacagaatacctgagactgggtaatttataaagaacagagatttctctcttacagttctagaggccacgaagtccaaatttgaggagcccacatctggcgagggctttctttctgtgtcatcatatggcagaagtcatcacatggtgaaagacagtgagagagagagctgaacttttattttttaatttttatttatttatttttttcctctgataacagagttttgcccttgctgcccaggctggagtgcaatggcacgatctcagctcactgcaacctctgcctcctgggttcaagcaattctcctgcctcagcctcccaaacagctgggattacaggcgcctgccactacactcggctaattttgtgtgtgtgtgtgtgtgttttgttgtttttttgtttgtttgttttcttgacaagtctcgctctgtcacccaggctagagtgcagtggcgcgatctcggctcactgcaagctccgcctcctgggttcaggccattctcctgcctcagcctcccaagtagctgggactacaggcgcccaccactacgcttggctaatttttttttttttttttttttttttgcatttttaatagagacgggtttcactatgttgcccaggctggtctcgaactcctgacctcagatgatccacctgcctcggcatcctgcagtgctgggattacaggagtgagccactgcgcccggtctgaactgacttttataacaaacccactctggcaataacattatctgtgacctcctgacctaatcacctcctaaaggttgcacttctcaacactgttgcttggggattttctaacacataaactttgggggatacattcaaaccacagcaaagcctttggtgaaaagagacagagaaatgtaaatatgctggcaggtgttctggccttcccatggccattcagtgagcacatagcccagcctagcttgaattgagagacatgaatctgctgttccttcagccactctccttccagctggtctcattgtagaggcatttccctgtccagagatggttctaatgtctaaaattaattgtttcccatgcaacatagggcttatgaaatcaagccaactacttcatctggtggtcagccagtgaaacccatctgtttctgcttggaggaaaaactggctgtgctggaccaagtgagacatgtctctcatctccatcatgggagatgggaaagttcctttctaagtaactcaaggtgattttaattatttgcatttttgccttactctactgagtgtagaaatcagccttctcacccagccttttcaggatgaaagtccatctcattgctagccagcctttgagcatcttccatttgccttagtgtgaattttacatgcctagcccctttgcaaacatgtgtatactgttacacaaaagcataattgtcaatttactctcaaaccttccatgtaacctgtgttctgttcttaatagtattttcctcactttctctccaaaactataaaatccccatcttgagtctctcaaaggcagaacccaccttccctacatccccaccttcaatgtaattatcttccaacactgataaggactgaacctaactgcttacccaagagctagattttttttttttttttgagacagagtttcactgttgtcacccaggctggagtgcagtggcacaatcttggctcactgcaacctccacctcccaggttcaagcaattctcgtgcctcagcctcctgagtagctgggattacaggcgcccgccaccacacccagctaatttttgtatttttagtagagacgacgtttcaccatgttggccaggctagtcttgaactcctgacctcaggtgatccgcctgcctcagcttctcaaagtgctgggattacaggagtgagccaccgcacccggcccccaagagctagatttttaaagaacaaggactagcttggtgacaaggtttgtctgatgtcatctgctgagctatttataggcaaggcctgcagcttctcaccgagctgatctctggccatctcttccccaggactccagcctctaactcaccatgatttctgaatagcatattgctctttcacaggaggagacattaactaccacattggcccgaatagaaaatgacctcaaatttcaagcagtctttctcttcaaagtagagaacattttttaaattacaaaaatttaatccatcatatgaaaacagtctgtcccttgacccctgaggaatgagaccagtccctgcctccctcagctttttgttgctgaagctgtggttggagaactataattaaaattcagttgttctcttagcaaccccctcactgacagctcctttacagcttgcgttgtgatttacctaccagtccaagaatcagggatttgagatcctgaccatccttctatccaaaatgactaacaatcttatttggaacaataggatagttccagctatctgttcattctgatttttcccccattggagaacatttatatttctttcttgaaaaaatagcttttgaccgggtgcagtggctcatgcctgtaatcccagcactttgggaggccaagatgggtggatcacttgaggtcaggagtttgagaccaccctggccaacatggtgaaaccctgtctctactaaaaatataaaaaaattagccaggcatggtggcaggcacctgtaatcccagctacatgggaggctgaggcaggagaattgcctgaacctgggaggcgaaggttgcagtgagccaaaattgtgccactgcactccagcctaggtgagagagcaagactgtctcaacaacaacaaaaaagaaatcaaagaccctgattcaaaacatttcttctagtgaagaggcagagaagccaaggccagacacatgaaaacccccaaacagtctcatgtctttgctcaactacgaagtgaccaagacagggccctgaaataagccacttagtgccacaagactacatgagagagttagtgaagaagtaatgcatcaagaatgtgatttttatctccctcaagagtctcttccagctggccctggggagaaacaagtgattgaaatttcttggacatagttgtgtagttggagctacacatctcttctaagattctacatcaaaacagagccaagtccttggcagggaggcagcgtgtggcggtgaaaaatgcatgggttcaagagccagaccagcacaaaccaggctttgcagtgtgaaaaagctgagcgattttagggacgataatctctctgaacctccaagggagaggacaggccttcccaccacagaggatcaagtgagaaatctaaaggcctgggcacaaagcatggcatatagtaggcatgcaataaagattgcttctctcacctcccctttcctcgggaaatttccacccatctgtgcaggctagtagagaaacaattgcgtcccagttctatcactgactagctgtggaactttgggctagttttctaaatctctgcattttcctctgtaaagtggagataatgataacacctcccatctaagattgttgtgaaaagtgcattttattttttgcccttaaataccaaaaagagtccattttaaatgtatcaaggggcttagcaaataaaagtggcccaaacctctgtcaacctttgagaggccttggtggtctcccttatggatagactaggaaagaagtgattgaaattcaatgacagttacagcaaaataaaaagaaaaaaaataagactgggtgcgatggctcacgactgtaatcccagcactttgggaggccaaggcgggcggatcacttgaggccaggaattcgagaccagcctggccaacatagcaaaaccccgtctctactaaaagtgcaaaaattagccaggcatggtggtgcacacctgtaatcccagctatttgggaggctgaggcacgagaatcacttgaacctgggaggcggaggttgcagtgagccgagattgtgccactgcactccagccagggcagcagagcaagaaactgtctcagaagaagaaaatcaccataagggagcttagccaactgaccaagagtctgtgttgaagagtcccactgcctgtattcagatactacttgagtagctatctgatttgggggagattacttatcttctctgtatcatggtttctgcagccataaaatgaggataataataataatgtactttatagagttgctaggaaatacctggctcatagcaattgctttattaatataattgtcatcaacatcatcaccaccaccatcatcaagaatgaaatgccttcgttctcactcataggtcggaattgaacaatgagaacacttggacacaggaaagggaacatcacacacctgggcctgtcgtggggtggggagggtggggggggaaggatagcattaggagatacacctaatgtaaatgatgagttaatgggtgcagcacaccaacatggcacatgtatacgtatgtaacaaacctgcacgttgtgcacatgtaccctagaacttaaagtataataataaaataaaataaaaagaatgaaatgccttttggccaggcgcggtggcgcctgtaatcccagcactttgggaggccaaagggggagtggattgcctgagctcaggagttcgagaccagcctgggcgacatggcaaaagccctgtctctactgaaaatacaaaaaaatagcctggcattgtggtgtgtgcctgtaatcccagctactcaggaggctgaggcacgagaatcacttgaacctggaaggcggaaggtgcagtgagctgatttcatgccactgcactccagcctgggtgacagagcaagactgtctcaaaacaaaaagaatgaaatgctttttattttctgtcttgagacaaatgccatcagttatccagctggcacagtgaggccacccctcggtttatccagtgcttctggggcatgtctgttggaagctcaatggagaggacatagttggtagagtggcctgtggtggagagggttcctctgcgggcacttgttttgtagactggacacacatagatgtcctgatgcagaaacattgcgctctccccaggtttcagccaaatgatgggcagtgggtcatagaggattttggggagagattccccaatctgcatcgttttcctgtcccaacgggcaccttctaagaagagccctttgatgtaggccccatcttcggggttattctccatcactgtttcttgtggggttacctggaagaataaaaagctatgagctccattgcctgccattttcctacatgggcagctttaagagcctggaatcttctgatactcaaagtgcaacctggttgcaatatctacctctcccaggatccagggacaatggggcttctgtgataatattcctgcccaccatacatgggccaggcctgactcctggtcagtatgctgcccttcccaatggtgggctagagaatgcactcaagtaggagtcacattattctaacacattacctctaactagcttagtgattgcacaatcccttccctttctggatctggatttataaagtgaggggttagattcagatacagagacagactggataaacagttctggagatgagtgtggggagaataaagccttgatttctagtttttgtggtataaagacttccaccatggtcaatttcagcctaccaactatttaacaaccagctcacaaaattcctgaaaatgtaacagttggccctggtgagctgatatgagtgagctccagcacaccactgcttagattcagaggtggtaaactcaaattcctttaggtaattgcagaaaatggacaaagcataggagaatagggaggggtggggattatggtgaaccagagagcacaaactccatttaaaatcattcaaattatactttaaaaaatttttatggtgaatggaattttttcccatttctaattctaagtatatattggaagaataggaaaaggctattgatttttataaatttaaccaatatccagtgaccttgtgaattcttctacagatgctcctcaacttacaatggggttatgtcctgataaacccatcataagttgaacatattgtaagccaaaactgcatttaatatacctaacctacaacaaatatcatagcttagcctagcctcccttaaatgtgcttagaacacttacattagcctatagtgggcaggaatcatctaacacaaagtctgttttatagtaaagtgttgagtatcttatgtaatttatcaaatactatactaaaagtgaaaaatggaatgggtgtatgggtactcaaggtgtggtttctcctgaatgtgtactgatttcacatcatgaagtcaaaaaattgtaagttgaaccattgcaagtaaaggactctatgtttttaatcacttcggatttctaggtatacaatcatttcaacatcaagaaagatggttttatctttttttcaatgtttatcctagtcattttttttcttgttgtatttattttggcttaacattgtcttcaaaggctaatcaagttaagttcattcataaactgatttaagacatagggcaaccagtttgtgacctctggactagatgatttcaaaggatctttccgtataatttaaaattctacaatgctctgtaacagtcaatcgtagccattctactctctatatatgacaggctgatgcttgactgttggccatgcttttaactttactccaagcaaaggactacctaagggcattaacattcttgtaaatgaagagtccaccacattgaacaaacagagtgggagagtgccttcatttttcttggtgttctgacggaatctggaaagattccctttttgtatacacagagacaaagcattgggaatcctctaattattttaggagtagcttttagagctactgtaaattatgctaaatgcttcatatgtaccatttcagaagcatttgggtcttaacacatccacattttttgactcataaggaaattggcaacattgctttctctggtcagccccttgagtgagcctaacccaaagcacccctacctcaaactcaaatccaatgtggtcaatggggatggtatatttccgggcataattttgagagacgccagtcaaaaaagactgtgtgaagtagaatccagagatccaaaataccacagggggccccttgtcaatccattcctggagagccacagaaatcaagattcaaaatcaacaacacatcaaagatagttcaaatgcaagtaatgtaacgagtaccatataaaatatgttttttcatatttttcttgaaacagccctcttggtttagcttctatcttcccacttttgaaataagggtacaaagaaatatatttacactttaagaaacgcctaggtactacaaaaattagccaggcgtggtggtgggcacctgcagtcccagctgcttgggaagctgaggcaggagaatcgcttgaacccaggaggcagaggttgcagtgagccaagatcatgccattgcactccagcctgagtgacaagagtgaaacttcatctcaaaaaaaaaaaaaaaagcccaggtgcaagctgatatcagggatacaacagagagtggtggggactgtagcagtggagaatatgtaccttgtctaaactgagcagctgccactcatctccagcaatagtcgccatgccatgcgagaacgcaggtgcattgtttcaggtcttctattttttgcagtacaaacatcggatttttatatgtaaaaaatcaatgtttacatgctggctcaaaaatgtttaaattaccaggtagccaaaccaaacataattattgtccaaatctatctcatgagccaccagtttgtgacattttttttctttttagacggagtcttgctctgtcgcccaggctggagtgaaatggcgtgatctcggctcactgcaacctctgcctcccaggttcaagccattttcctgcctcagcctcccaggtagctgagactacaggcataagccactatgccctgctgatttttttggtatttttagtagagacggggtttcaccatgctggccaggctggtgtcgaactcctgacctcaagtgatccgcctgcctcggcctcccagagtgctggcaatacagatgtgagccactgcgcccggccggctataatcttttccaggactttcaagtctccctcctgcttctaactccaggaagactgtttccagaggctcaatccaggatgttctgtggctgcctgccctcctccccctgcctctagtctgccatttcagaatgtcctctccacctaagcaagcatgccaggttcccggttacccctgactcccaggtacctggaagaaggtcaggcgggccagcaggtcagccacgtagccccccagaggcttcagtgatgggtaagacttggctgcccacatggctggcactttacccacaagcatgctgttaaagacttcctctagctccgaggacatcaggacctgtcctttgatggctcggccaagattgatgaggctcctccgaaccactttggtcagcctgcaagaacagaggagctggctgagctgggctctccggtggccacattctacccaagtccactgactgctgtcccctttaaaatgtcagttaattaatgcacagtcattaaatgaggaaaaattaaatcacccgttaccttgctacctaaagataacgttgatgtatatctttccagatttttctctatgtgaacacaaattatttttaatgagatcatactatattatctttccgtaatctgtttttctttcttagcatataggaaacatctttccaattcaatagagacctaaattgtcctttttttcttttttttagagatggggtttcactctgtcattcaggctggagtaagtagtgagatcagagctcactgcagcctcaaactcctgggctcaagtgatcctcctgcctcagcctctggagtagctgggactacaggtgtgcatcaccatgcctgtcctttgtaacgactgcaaaatgttccattttgtttaactattcctctattgttgacgtgttatttctagattgttgtcactatcaacaacattgctagcaaaattcatccatctcaatctttttgcaaattttaaattattattaaaaatatttctaggtcaaagagcacgcacagttttaaggctttcaattcatattgtcaaagttgttctttttttttttttttttttgagacagagtcttgccctgtcacccagggaagtgcagtggtggagtcatggctcactgcagcctcgatctcccaggctcaaggaatcctcccacctcagtctcctgagtagctgggactacaggcacatgccactatgcccacctgatttttttttaagtagagacaaggtctccctatgttgcccaggctggtctcaaactcctaaactcaagtaatcctcccacctcagcctcccaaagtgctgggattacagatgagctaccacgcctggccaaaggtccttttttatcgactataaggtgcacgcctgagaaaaggcaactgaagggcagcctgggagatgtcaaattcacctgcctctccctctgacctttatgttacgaggcccagccaagcccggaggtaattcacctgaggagaccaaagaatctgccactacaaagagcttttcatctccaaagctttatggaatctcaactgaatggacatgagaatgatcacatgcaggaagaggatttctggatgtgtaaccactaaaccattgtatcaagaggaatgtagctgggtgtgggggctcacgcctgtaatcccagcactttgaaaggcagaggtgggtggatcacttgaggtcaggagtttgagaccagcctggccaacatggttaaaccccgtctgtactaaaaatacaaaattagctgagcatgcgcgcctgtaattccagctactcaggaggctgaggcaggagaatcgcttgaacccagaaggtggaggttgcagtgagccgagctaagatcacgccattgcactccagcctgggcgacaagagtgaaactctgtctcaattaaaaaaaaaaaaaggaatgtaaaattcagacatgtgtttgctaagcagtcaagggtaaaagctgccatctgagggattacaccacagacctctattatacctaaagacctacttgcaaagattctctttctattcttgcaactatgagctctgctagttttaaggttttagtacccaaggaaagaacacttgcccagaagacacagtcacagttcccctgaagctgaactgtcgctgaatcattctgggcttcctatatcactgggtgaaaaggcaaaaaaaaaaaaaaaaaagggaaagaaaaaaaatagtggggaggaacgttagagtactgcttgagatgattaatcctgaccatcattggaaaataagattgctttccctgttctttttttcttttgagacagggtctcattctcttgcccaggctgaagtgcagtggcacaatcttggctcactgcaacctccacttcccaggcccaagcaatcctccctcctcagtctcctgagtagctggttctacaatgcccagataattttatgtatttttggtagagatggggttttgccatgttgcccaagctgatctccaactcctgagcaatctgcctgcctcagcctcctaaagtgctgggattacagtgctgggtggagtgagccacggcacctggcttgctgtcctttatagaatgcccagtggtgaaggccagtgaaagcccctgcaaccaccaagaaagagctccagtggccttagaggagaatgacagcagaggagggaagccattagttttggtgtccagttggacagtccaggactacagtccatcatgccaaggtgtctcacaacagaggtggcctcgtcctaggctcacaccccataccttgcttggtccctgctacggccaactgcctgttgactctaaagagtaaccctaggccgggcacagtggcttacacctgtaatcccagcactttgggaggccaaggtgggcggatcacctgaggtcaggagttcgagaccagcctggccaacatggcgaaatcctgtctctactaaaagtacagaaattagctgggcgtggtggcaggcacctgtaatcccagctacttgggaggctgaggcaggagaatctcttgaacctgggaggtggaggtcgcagtgagccgagatcgcgccactgcactccagtctgggtgacaagagtgagactctgtctcaaaaaaaaaaaaaaaaaagtaactttaaaattcaggaagcctaacaactctcaaataacactcctccagtcccctggtcctctggaatcagggctgtccttaaaatgaagcagtgacccaatgacacagaatagaggcagtaacacatgcagtgtctggagcagcaagaccttggtcttggaagcagaagtgataagttttagcccacttggctctgagtcacttgagacctacatcaaatcacagtcatctctggacctcagtttcctcatctggcctagatggtctttgataaccctttcagttttgactattcaaaaatcaaatccaggtgatcccactgggctccatgctgtagtaactggagaagaggactagaatacaaggccagagatccttgccccatggccagcctataatacccctaactgtgtggtagaggcactaggatgaacgtctcccacccctttctagatttacccagatttcacatattggataagtacacgggctctggaatcagacttagttctgggtttaaactgagttttcccgttgaatgattgaataactgagcaaccttgggcaagtcttaacccttctgaatctcagagtttttttttattttctttaagagatggggtcttgccatattgcccaggctggtcttaaacccctgggttcaagcaatcctcccggcttgcctcccaaagtgctgggattgtaggcgtgagtgatcatgctcagcctcagttttcttacttgtaaaatgctggtagcaggattagtaactggacgtatttcaaaagactattgtgtaatttttttttaagggatagggtctttctctgtcacccaggctggagtgcagtggcaagatcatagctcactgccgcctcgagctcctggcctccaagagatcctcccacttcaccctcccaagtagctgggactgtagacgtgcaccaccatgcctgccttttttttttttttcttttttggagagatggggtcttgctttgttgcccaggctggtcttggactcctggcctcaggtgatcctccctactctgcttctcaaagtgctggaattacaggcgttagccactgtgcccagccctattacagactttgaatgagacccatgcatagtgcttagaaccgtatctgtccctaaaggctcaatacaaatggctctaggccaggtgcagtggctcccacctgtaatcccaccactttacgaggccaaggctggaggcctgcttgaggccaggagttcaagaccagcctggccaacatgtcaaaactccatctctataaaaaataaaaaataaaaaaattagccagcatggtggcctgtgtctgtagactcagctactcaggaggctgaggtgggaggactgcttgagcccaggagttcgaggctgcaatgagtcatgatcacaccactgcactccaacttgagcgacagagagagacctcaactcaggaaagaaaaatgaaagtggctctaatgactacttttactattagcctgtgcttgatactggttttagcctaactttatagatgtcacatgaatgaatgggaatgaatgaatagaaggaatgattcaacccagggtcagcatgtgctggggatggtcctattcacagcccctattcacacccctaatacgggtggggcaaaccacttcctctgcatagcaaccccttctcagctactgcctgttagatcctactcctcacgttccaactcccaggattcaagctacatcatctggcccacctgttgaatctgatgagctcctgccttaggacggtattcatggattcttcatagaccacggggtacaacttcatgacctcttccaggtcaaagtctctgggaagcttggagagaatgtcttgtgccaactcctcaaccacttccttaaaatgcaggcagaagagaggtgagtgagaagcaagccctacaggctgtggctttggataaactttaagtactgagcatctgacttttcaaatgtattctgtgggactttcctgagaactctccaacagaagccatttctgcctccagtggggaaaggagtccctcatcaccccaccagccttggggagggcatcgcctcttggtccagaagagtagagtcctgtccttggcagagcacggtggctcacgcctgtaatcccagcactttaggaggccgaagtgggtggatcgcttgagtccaggagtttgagaccagcctgggaaacatagcgaaacccagtttctacaaaaaatacaaaaattagccattagccatgcatgatgctgcatgcctatggtcccagctatttgggaggctgaagcaggagaatcacttgaacccaggaggcggatgttgcagtgagctgagatctggccgctgcactccagcctgggtgacagaggaacacctgtctaaaagttaaaaaaaaaaaaaaaaagagtcgtgtcctgacacctcaggcaagagccgaagggccaggaagggaactcttgctcagccaggtagcttcagggcagcactaagcctctgtcttcaatgtcacacccaggtgagaatctcccacagcctctgacccctgaggattagctcctggtgccatggggccctttctcagtgcccgtgacacctgggaaagcagcaggccattcttcagcattggagcaagaaaagcacagaaccctcagcttagccaagtagggaggggacaggcctcgaggctcaaggaggaacaagacctgagtgtgggagagacagacaccctgtggtcctgtggatgtgggaggctgggatgtataattctttccctcttcccactgtgaggggaatttccactcctacatcgggatacaccaaccaggctggtttaccttcataccagtgatacttaatggcactaggaaccaaatcatgaaagcaaattagcaaattctacagttgggaggggttaaacaggaggtagcttggaaggtggagaagggaagggatgggagaggaagcgggtggagtcaggagacggtggctctggttctggctccgtccttgattttatgaaagcctggaagccggtcactttctctctcaggatttgtttctctcttcatttgtagacttaggagggtggcctgggtcaggtcatcacaaagagtgcactgggactactagaggtacccaggattttaggtgtttccaggacacagaaaaatcatgttgagtcacatggtgagaaagttactctttcaggttttgggttttttttcattgttgttgttactgttttgagatagtgtctcactctgtcgtccaggtgggagtgcaaaggcatgatcacagcctcgtgatcacagcctcactgcagcctcgacctcctgggttcaagtgatcctcctgccgcagcccccttagtagctgggactacaggcacgcaccaccacacccagttaactttttttaagacagggtctcactctgtcgcctaggctggagtgcagtggcatgatctcagctcactgcagcctcaacagcccagaatcaagcgatcctcccacctcagcttcctgagtagctgggattacaggtgcacgccactgagctcagctattttttttttttgtatagacggcgttttgctatgttgctcaggctggtctccaactccttggctcaagcaatccacccaccttggcctcccaaagtgctagggttataggcatgagccatggcacccagccctcggttaacttaaaaaaaatttttttgtagtgatgcggtctccttatgttgcccaggctggcctcgaactcctggcctcaagtgctcctcctgcttcagcctcccaaagtgctgggactacaggtgcgattcactgcacctggcctcttttccagttctgaccatctttctcttttcattcctctcaaaaagacagtttcgggtcagtgccaattctttgacactcacacatctttctccttttaacaagaagccagcaaagcctcagctcaggggctttggccagcaacatcatctgggaagaacttaacaactgttaacgctgggagcagtggctcacgcctgtaatcccagcacttttggaagccaacgcaagcagattgcttgagcccaggagtttgagacgatcctggacaatatgatgaaacactgtctctacagaaaatacaaaaaaatttagctgggcatggtggcatgtgcttgtagtcccagctactcgggaggctgaggcaggagaattgcttgagcctgggaggcggaggttgcagtgagacaagatcacgccactgcgctccagcctaggtaaccgagccaaaccgtgtctcaaaaaaaaaaaagaaaagaaaagaaaaacagcaacaacaacaaacagaaaccaaaaaacaccaactgttcactgttcagctttcattttctttttgtgcgtatcatgactttatggaaatgatactgggtttccacttatggttctgatgtgcaatcttttaaattaaaaaaaaaagagagttagttttaaaacattatgtagaaaaaaaagcaaaagaaaaaaaaaaagaataaaacccattatgtaaatggagtataggtgataggtggatatagcagaaaacatgaaggttatacaggaatagctgacattttggaaacactggttcccttgcagctctggatataaggactcccggcagtaaggccacagtgctccttccctgcccttggccaggaggctgccaggcccccactctctgcctcttggtcaccctccaatcctgtgtgcccactggatgaagaactgcctgggaaataggattaagccccctttcccgagcccagttacctgaggggacttgccacttcctcctgactgtctagggagggtcagcaggaccccctcaaacagctggttggtttcctggttgtctttggtgatgtctgcgttctcatggaggccgaacacttctgggtgggctgtgatggggagattcctgagatagtcgatataggactggaagggaaatcttcagttgaaatcaacgagggaccccagaatcccacagatgactccaggcttagcagaacccaatcagaacaggaatcatactgtatcagtagcacaggacacacacacacacacacacacacacgctgggagaacacaaccctagccctccctcatacagttttctggggagtgggcatgaaagcagatgagactgaattacctctcgcccaccctggcttcctctctgctcccccagtgggcctggctttggacccaaacagaactgagtttggatcctagctccatcccaaactgtcagaggcattcgaaccagagcaactccatcttgtatagggactgggtaaaataaggctgacacctagtgggctgcattcttaggaggtgagggcattctaagtcacaggatgagacaggagtcagcacaagatacaggtcacaaagaccttgctgataaaacaggttgtggtaaagaagccagtcaaatatccccaaaccaagatggccacggaagtgacctctagttgacctcactgctcattacacactaattataatgcattagcatgctatgagacactcccaccagcgccatgactgtttacagatgtcatgacaatgtcaggaagttgccctatatagtctagaaaggggaggaaccctcacttcttggaattgcccacccctttcccggaaaactcatgaataatccaccccttgtttagcatataatcaagaaataactgtaagtataatcagttgagcagcaacccatgtcattgctctgtctatgaagtagccattctttattcctttacttttttttttttttgagacagattcttgctgtctgccaggctggagtgcagtggtactatcttggctcactgtaacctccgcctcctggattcaagcaattctactgcctcagcctccctagtagctgggattataggcatatgccatcatgcccggctaattttttgtatttttagtagcgacggggtttcactgcgttagccaggatggtctcgatctcttaaccttgtgatccgacctctttggcctcccaaggtactgggattacaggcatgagccactgcgcccggcctcctttactttcttaattaacttgcttttgttgtactctatagactcgccccgaattctttcttgtgcaagatccaagaaccatccctttgggtctggatctggacccccttccgataataaaactatgtacccttgaacttgtcatctgaaaccccagtttccttatctgtaaatagaaaaacaagtgtagttatgaagtataaaccaaaagtaaaatcttaagaccctccaaccatctgaatggacttcctccttgtccggggcactctaaaatttaacctgaaagcctggttcaggccatgacgggaagtgggggtcagacatgcctcattatgcccctccagcattaccatcaacacagaccttaagtctgataagaaacatttacaatctattctctctgaagcctgctgcctggaggtttcatctgcatgataaaacttgggtctgcacaacctcttatcataacccaggcattcctttctattgataactctttcaaccaattgccaatcagaaaacgtttaaatctacctataacctgctggcctccacttcgagttttcccgtctttctggactgaaccaatggatatcctaaatgtatttgactgatgcctcgcgtctccctaaaatgtataaaatcaagccctgaccacctggggcacatgctctcaggatctcctgagggctgtgtcacgggccatggtcactcatatttggctcagtataaatctcttcaaatattttacagggtaagaaagagactcttttcatccacagaaggaatcaggccttggcatgtgacaggttgtggtgtaatatacatatatatctactggttttcatccatggttcctggcttctaactcccctagcccttgttacagtcacctgttataatgttgggtgtgttaggccttaggggcaggccgcaggaaacagaatctctctgaccttctctttccctccttttacctgcccccaagcaagactcaaatcttcccctgcctttctgattgtgagtcctttttttttttttttttttttttttgagacagggtcactctgtggcccaggctggagtgcagtggtgggaccttggttcactgcaacctatgcctcctgggctcaagcgatcttcccacctccgcctcctgagtagttgggactacaagtgcatgccatcacacccggctaatttttgtatttttagtagagacagaatttcaccacattggccaggctggtctcaaactcctgaccccaagccatccaccagcctcagcctcccaaagtgctgggattacaggcatgagccactgcacctgacctgattgtgagtcttaagactccacctagagagagagggtgctgccctatactctggggaatgtcatacagctttcataaaaacccaagaagactgggtgcggggagcttctggatagctgaccacgtggaggttcctggagggtatttcacccagggagggcatggaagttctcactccttccgccatacttcaccctatgcatctcttcatctatatcttttgtaatattcctttaataaaccaataaacctaagtatttctctgagttctgtgagctgctccagcaaattaattgaattaatttcaattaaagggggagtggtgagaaccccaacgtgaagctggttggtcagttcttgaggctgggacttgtgactggtgtctgggttgggggaaagaattggggactgagccctcaacccgtgggatctgacactatcaccaggtagatggtattggaattgaattagaggacacccagttggtgtccactgcttaatgtgtggggaaggggtaacctccacacatttggtcacagaagtcttcttctgtattgatggtggtggtggttgtggtgagacagtagtagaaaaatacaatttcagagtttttctgttccacaggtcatcaataaaagtaagtggttttttttgtttgtttgtttgtttttttgagacagtttcactgtcactcaggctggagtgcagtggcatggtctcagctcaccacaacctccacctcccagttcaagcaattcccctgcctcagcctcccaagtagttgggattacaggcaggcgccaccacacctggttaatttttatatttttagaagagatggggtttcaccatgttggtcaggctggtctcaaactcctgagcttaagtgatccacccgcctcagcctcccaaagtgctgagattacaggcgtgagccacagcatccaacctgtaagctcttttctatccctcagattgttttcatcttccttttgtcattccctgcccagtttttctgttcctccctttttgccaccttctgaatcttcgtcttcaagtagcaatttccatcttgctcacttccaaggctccatcttaatcatcgttctctctccttcctccacccagatggatcctatattttgaaacaccttgtctaccaaataccgaccccctccttaaacagtagccatgtctctcttgcaggcttttgggaatattgggaatagcttatggattcaattcaggaagcccaaggtcacccctgggatccctggctacactgcagccctgtagccatatagagatgacggagccctgtgggggaaagaggtaggcctccctgcccaccccttacctggtaggagccatgaggagggatgtagtaagtgtctccaggagcgagggagtaatagtcctcctcaatttccttacagtagaacatggacagaagtgacagcaggagacgccggtctttgtcatcagtcactctgcctccgtaattacattcccctggggacaaccaacagaaggagaggttgagcccagggaaggtcatcacgagcttggtggttgatgtaaaacacggcattcttccggccaaagatctctgctgggacatagtgatagggacagcaagcaggaaaattccgggcagaagatggcgggtcccctgcaagggccccaccctcaagctgaaaagcctgaaaccatggcccaaagtgagaacttacatccctgttttcccacttgaatgttgccttttccaaaaccacccatgacctgccccacccccacaacccatgcccatcaaaaccccaggctcagccagcagagagagagaagcagctggacatcagagagaagaggcttgacttcaggggaacagccttttcagctccctttcccgctgagagccactttcttcggcaataaaatcccccacatttaccatcttccattcgtttgtgcgaccccattcctcctggacactggacaagagcttgggtgccatgagtgcaagtgccaaagtctgtcacgctgacccaccactgggcggttaatacttgagctgtctggaccgcagagctacaagagtactgtaaaccttcctctgggtgacagagggagactgtctcaaaaaaaaaaaaaaaaaaaaagacctgcactccagcctgggcaacaagagcgaaacttcgtctcaaaaaataaataaataaataaatataaataaaaacagaaacaaaaaaaaagacatttaaagagcgagggagagaccacattcatataacttttattatagcatattgtaattgttctattttattactgttgttgttaatctctcgctgtgcctaatttataaattaaactttatcataggtatgtatgtataggataaaaaatagtatatatggggttcggtaaaatccgcagtttcaggcatccactgggggtcttggaacatatccctggtggataaagagggactagtgtatatgttgagatggtggcagtaacagtggttggagcctttgctaactgtgcccctgatagagaattacaacgagcaaagactcttgctaattcatgctggaaatgtagagtgggcaagaaatggatctatgatgtcttttatacccttgaggtttgaggattgtttgttatctcagcctaactagcctatcctgactggaacagttggaaggtaactactctcaagctggctggtttatgaccggcaggcagttggtttatggcttgcaggcagttctctaagcagaccatatcccagggcaatcatgcactcatgctatggtctgaagaggaaccctaggatgtgcttctgcatgacctggaactgtgggaatatggttcacttctatttattattattactagttttagagacgggatcttgctgttttgcccaggctggtcttgaatccctgggtccaagtaatccttcggcatcagcctcctgagtagctgggactatgggtgcaagccactgtgtccagctccaggcgcacttctttggagatgttctttcaccaaactgagacccactgtatgcgtactgtgtgtgtcatttggggctttgttttagggaacactctactgagttaaggtcaatgtgaccttctggcactgaacttaatcactgtaaagaacagtctttcaaccttggcactcttaacatgttggactggatagttctgtgttgtggggaccaccttgtacatcgtagactgttcagtagcatccctagcctccactactataactgccagtagcacgcactatgacatccaaaaccatctccagacattgccaaatagccactgggggctgaaatcacccacagttagaaccactcctttaagcctctgtcttcccagctgtaaaatggggttattaacatggagctcataaaattagcatgaagactcaatgcattaatcacaggtatacagtgtctgccacgtgcctggggaagggattctaacaaactccttaacatatggagctgaagaggaaattgggtgtgatcttgatgccccggtgttttaattaagctgcattttgaccttcagccatgatattccattcatttagcacatgtctattcttattcctgtctctgggactatacggcacgttccttgaagttagtggtcacgtttttttggttgtatgtgtgtatgttttttaagagatggggtcttgctctgtcacccaggctggagtgcagtggtgtgatcatagctcactacagccttgacatcctgtgctcatgcgatcctcctgcctcagcctcctgattacctggggctacaggtgcacaacaccatatccagctcatttttattttatttctttgtagagatgtggcccagactggtctcagactcctgggctcaagcaatcttcccaccttggcctccaaaagtgctgggattacagacatgacccaccgcacagagcctatgatcaagttttacacatttacattcttccatattatgtacttgtacatatcgtggactaataaaaggttgctgattgattgctttaatacaaaacagctagtgccatttctacctcaggatcactttgctgggaatgttctccttcctctatgccccacccagtccattcttttccactcataaaactcctactcacccccaaaacccatctcttatgcctttaagaagtttgccacgatcatctcctcctcctaccccaagatttaatcattatgctgcccttctacttataaatgtttctcttgttgaacttattactatgttacctttttttttttttcttctgagacaggatctcgctctgtcacccaggctggagtggggtggcacgatcagagctcaccgcacctccacatccggggctcaagcaatcctcccaccttagtcccctgagtagctaggactacaggcatgtgtcaccacgcctggctaatttttgtattttttgtagagatgggattttgccccagccggtcttaaacttctggcctcaagtgatccatcgcctcggtctcccaaagtgctgggattacaggcatgatccactgcgcctggcccgtattttttttttttttttttttttttgagatagagtctctgtcacccaggctagaatgcagtggcgcaatttcagttcactgcaacctctgcctccccacttcatgcaattctcctgtctcagcctcccaaggagtagctgggactacaggcactggccaccatgcccggctaattttttatatttttagtagagacaggttttcaccgtgttacccaggatggtctcgatctcctgacctcgtgatccgcctgcctcagcctcccaaagtgctgggcttacaggcgtgagccaccacgcctggccaattttttaatttttagtagagatggggtttcaatatgttggtcgggctggtctcaaactcttgacctcaggtgatccacctgccgtggccttccaaagtgctgagattacaggcatgagccactgtgccccgctggcctgtatcattttttaaaatatttttcttcttttggagactgtgagtcactcaagggtaaagattctatcttaattttttttgtttgtttgtttccttacaatatctagcatgatgaccagcattagtaagagctcgatgtttatggtgagggagggagggagtacataagtgaatggaaatgggaggagaacagcaggagggtggaacatgatactggaggtttacagtggaaaaactcctcccgtaaatacctgtcaggtaggtcagagcatcaaagggcacctccttgtagtcattgagaaacatctggatctgccacatactaatcctcaggtcagattcgttgaattcatagggaatattccaccctgcgtgtgggagagcagagagaggcttcagtgctgagagctcttaatttccactcaaagaccaagccgagggagttaagcatcattatggatcaaaagcctctttcaggctcatgaatatcaagcaccgaggccaactattagcctggacgtttaccaccaacatgggagccattctgcctgagaaaacatccattctaaaatcaatttccttatatacctccccatttgttaaggaagatgttaatgtcctgggatttgtggaatgagaattattcagcctggcaggaatatggcggtaatgcacggagctccaaaaataacaccgcggcatggctagacagcaggagctacgactgggcaacagagccacgttggttctgagaattcccctcctcgagctcacgggaaaaactgaatggccagccttaaagaaatgaccactcgtatttccaagggtgtaatgataaatgcccattgggggctgaacaagtgacatacatgtgtaaaccaggcatggtgcaggatacaagaaagagtatggggaaacctgtgctcaatagggaagttttttgtttgttttgcttttgtttgttttgtttttttgtttgttgttttttttttttggagacagagtctcgctctgtcccacaagctggaatgcagtgtcgtgatctcggctgactgcaacctccacctcctgggttcaagagattctcctgtctcagcctcctgagtggctgggattacaggcacgtgccaccacgcccagctagtttacgtagttttagtagagacggggattcgccatgttggccaggctggtcttgaactcctgatcgcaagtgatccgcctgcctcggcctcccaaagtgctgggattacaggtgtgaaccatcgcgcccaggttcaatagagaagtttaatttcctcccaaacactcgctttcaaattataacaaaataataaaattcgtgtgccagcaaacgaagcatgactggcagttagttgcaagccaaacatttgcatggctttttttttttgagagactggatctcgttcttttgcccagtctagagtggtatgatctcccttcactgcagcctcgaactcccaggctcaagtgatcctcccacctcagcctcccaagtagctgggactacaggcttgtgctactatgtcaggctattttatttattttaattttttttttgagacaatgtcttactttgtcatccagtttggagtgcagtggcacaatcttggctcactgcagcctccaccttctcgcctcaagcgatcctcccacctcagcctcccaaagtactgggattacaggcttgcaccattgtgcctggcatgactggtttatttcacttagcgtaatgtcctctaatgtcctcaggttcatccacgttgtagtgtatgtcagaattttcttcctctttaaggttgattaatattcaggagttctagaccagcctggccaacacggtgaaaccccatctctactaaaaatacaaaaattaaccgggtgtggtggcatgcttgtagttccagctactggggaggctgaagtgggaggatcgcttgaacctgagaggtggaggttgcaatgagccaagatcacaacaccacactccagcgtgggtgacagagtgagaccctatctcaaaaaaaaaaaaaaaaattcgttgtatgaatatataacattttgcttatgtattaatctacctatagactttttttttttttttttgagacagggtctcactctgtcacccaggctggagtgtggtggtgtgatatgggctcactacaaactccacctcccggttgaagccattctcatgcctcagcttcccaaatagctgggattataggcgggcaccaccacacccggctaatttttgtgtttttagtagagatggggttttaccatgttacccaggctggtctcgaactcctggcctcaaggattctgcctcccttggcctccctaagtgctgggattaaaggcacaagtcaccacgcccagccaggttgtcagatttagcaaataaaaatacagtgagagtttaatattagttaaataataaatcatttagtataagtatgttccaaatattgcctggaaaatatttataccgtatcttactggcaaccctatctgagcgcaagcttaaacacgcacctggaaacacacctatatgtgtctgatatcctttccctcaggccactcaggtgcactgtcatcgcttacctagggggccgaagtttcttctctcttgaacaacggcgtggaagaaacaaaggccaaataacatcttttgccacatcaccgcctttgcacagctttggaagaacacaggatctgagatggggtcattgaggtaggagcgcaacaggttggcccggagccctttggggggctcattggtcattttgattccattctggagaatgctgactggaaacttctctgatggatagctggttagccagagtctggaagaacaatggacccaacgttttagagcaatacaataagttatagtgaaaagcaacaacaaaaacaaaacaataacaataacaaaacagaccagcctgggtaacatggtaaaaccccatctctatgaaaaacattattttattgataaattaaaaaaaaataacaaaaaagaatagctatgattaaatactaccagagccaaaactatgctaagcatttaacatatgtccttttatttcccttaagcctcacagccacctgatgaggagggacttactacctcttttaccagtgaggaagcggaggcatggcaaggtcaggtgggtttttcaaggacacaccacttggcagtagttgaaccaagatgtgaactcaggactctctgactccaaagctcctactctttttttttttttaatgtagagatggagtccctctatgttgcccaggctggtctcgaactccagggctcaagtgatcctcccacctcaccatcccacagtgctgggattacaggtgtgagtccccgtgcctggccctaaggctgctttctccctacaaccagagttgaatagttgcaacagagacaatatggccacaaaccctgaaatatttactattggccctttacagaaaaagtttgctgatgcctgtcatataagaaatggcatttgaaatgtgccttgaaaaatagggagaaattcttttttaaatgcaagtgtatctatgcccacaaaaaatggaaacatatgtaaaagtgtttagaagaaactagaattgataattttaccacctataggttaacatcttggcacattgcatctgaggctcttttttttcatttttattatttttatcttattttatttttattttcatttttttgagacaaggtctcactctgtcacccaggctgcagtacaggggtgcatctcggctcactgcaacctccacctcccaggttcaagtgattctcctgcctcagcctcccgagtagctgggactacaggtgcccgccactatgcccggctaatttttgtatttttagtagagacagggtttcaccatgatagccaggctggctttgaactcctgacctcaggtgatccacccacctcggccccccaaagtgctaggatttacaggtgtgagccactgcgcccggccagagttgctaacgtttaaaaacctaaggctttcttttacagttctagattcccatcttccctttaaaattgttagaaagtctgatcctacatggcaacagttagctagtattaaacagtgaccgctctccttgccagagcatgtgcccagttcactgcaagccccaccattccctattgtgtctgacactgaggctgactacccatgaggattgttgctgtactgtggaacgtggactatttcttgtatccagccctcttcactcatttatgttacatgcctggcccctataggcacttgagaacttgagttcatgatttttgggtcaggatcatattacagtagaacttaaaatgtcaacataaataactttttcttctttgagtgtgtcattaatggccaatgaattcactcactatcccaaaccaaacaacattcttttcttttttttaaagattaaggcacaacgcttttaggtttttttgttgtttgttttttaatttatttatgtttgggacagagtctcactctgtcacccaggctggagtgcagtggtgcaatctcagttcactgcaacttccacctcctgggttcaaggaattcttgtggctcagcctcccaagtagctgggattacagacatgcaccaccgcacctggctaatttttgtatttttagtagagacagggtttcaccatgttgccaggctggtcttgaactcctggcctcatgtgatccgcctgccttgacctcccaaagtgctgggattacaggtgtgagccacctcactcggccccaaacagcattcttgaaactaatggacttctcttaaactctctctcttttggaagttttatatgaagacaaatcaactgtggcctaatccgactttgtaaataagcaccaaacactttccctcttttctggcagacgactgagatgaaaataaccagctagttttgttggatagagcaggggttgacaaatttttttctgtaaaggaccaaatagtacatattttagactttgtgagcccacatgatctctgctgcaactacttgtcatacaaaagtagccatagacaatatatgaataagcatgatgtttttcaataaaactttatttatggacactaaaatttgaatttcatagaagtttcatgtattatgaaacatgattctttagtttcttccccacactgtttagttagcttgcaagctatacaaaaaaaactggcagcagggtgcatttggctatcgggccataggttgctgctctctgccctggtataagagaatcccttggctgggtgtggtggctcacgcctgtaatcccagcactttgggaggctgaggtgggcggatcacctaaggttgggagttcaagaccagcctgaccaacatggagaaaccccatctctactaaaaattcaaaattagccatgcatggtggtgcatgcctgtagtagcctcaggaggccgaggcaggagaatcgcttgaacccgggaggcagaggtcacagtgagtggagatcgcgtcattgcactccagcctgggcaataagagcgaaactccatctccaaaaaaaaaaaaaaaaaaaaaaaaaaaaaaaaaaaaaaaaagagaatccctgaacatttgagttaaaatggactttaaagtctgtttggttcaactcattattttatgaatgcaaaaactgaggtttagctttgttgggctttaaaattcccaaaaaacaaatagctgtttccaatgttgattaaaattccgaagaaccccagaaatgtaggatagaggcaggaggcgggaggcaggacaaatgatacctggaaaacagtagaattttttttttttttttttgagacagggtctcactctgtcgcccaggctggagtgcagtggtgtgatcactgctcactgcaggctcgacttctcaggctcaggtgattctcccagttcagcctcccaagttgctgggactacaaatgtgcgccaccatgcccagctcattttttgtatttttagtagagatggggttttgccatgttgcccaaactggccttgaactcctgggttcaagcaatccacctgtctcagcctttcaaaatgctgagattacaggcgtgagccaccatgcctggacagaattttttttagacaaataataatttttaaaaatcagacttgctcacattgaatctacctttccagctacgtctcctattaccttctccaacaacttttcatggcatataccagagctgtaagataacttctcaggatttccttaatacctctctttgcttttccaatacctctctttgcttttccaaatgctgtctcttctgcctagaacatccttcctggcaaactcctattcatttttcaaaatcctgggccattgtcaggcctccaagacttccccaaccttcccatcccttctctgtattccatggttcttgttcaaatagtgagtaaatcaggtatgacatggtatcaacattattcatctatggcctgccttctgctatactgaagagcttctttcttttttagagaggaagtctcactctgtcgcccaggctggagtgcagtgatacgatccctgctcgctacaacctctgcctcctgggttcaagcaattctcccacctcagcctcctgagtagctgggattacaggtgtgcgccactatgcctggctaatttttgtatttttagtagagacagtgttttgcaatgttggccaggctagtttcgaactcctgacctcaggtgatccacccacctcagctttccaaagtgctgggattacagacatgagccaccctgcctggcctagactgaaagtttctaaggggcaggactgtgtcttggtcatcttcccagccaccatcctgatgtctggaggttgggtcccagagaaggcagtggtgggacagcatctcacctgaatctggcattggtgctctcaggaacaatcacctcctcacaaatcttctccagggtaggcatccagcttgcggccaggtggcagttctgtaagaccacccaggtcccgtctttgatggcattgttgatcattttggcagcaatagggccttggccttggccaagggagatggtctgtgttctggtacctcccataccaagatcatcagcaaacttcagcaggcctgagaccaggaagaaaggaggcttttgaaagacgacaggccagctaacagtaacagaacagctatatcaacaataacaacatggctgggtgtggtggctcacacctgtaatcccaacactttgggaggccgaggtgggaggatcacttgagctcaggagttggagaccagcctgggcaacacagtgagaccttgtctctatttaaacacacacacacacacacacacacacacacacacacacacacacaccccaacacaaaaggtggggttcacattaaattttggactcagaaaaaaactcattggcttctgttaattacaaaataaacatctctctggggaaactttagacatcagatcagatggcagatgaagctaccatcaacttctcttttgctttaaacacatagacattcttgataaaaaaagaaattatctgaactgaaaagaaacaaaaaaaatcaaggtttgaaagaaaaggatattcccaggtgcccaaaacggggaactcaaaaataaagaggtgagcacatcaaataactaggaaactgatttttgccaatttattttaacaagaaatataagcatttgtaaagtgaaataagtctctcacttctctcttctcagtggtagccaatgtgattagatttgtgaatccttcaagaaatattttgtgtatttaaataaatgcatatatactattaaatttatatgaattgtagaatactgcatttttttcccacttaacaatgtacatatcttataggtctcttccacactagtacatgtataaaggcttttttctttcatggatacatagtatatcaccattggaaaatactacactttatttcattactctagatgttaaagttttaatgtccatgggagatatagctttgcactcataagaggtggggagctggaaccgagacacttgcataaagttagaattctcaaagtgccgtaccttcatgttatgaaggccagacctttggccagatgtggtggctcacgcctgcaatcccagcactttgggaggccgagacgagcggatcacttgaggtcaggaattcgagaccagcatggccaacatggtgaaaccccatctctactaaaaatacaaaaattagctgggctaattaactaattagctgggtggcacatgcctgtagtccgagctactcgggaggctgaggcaggaaaattgtttgaacctgggaagaggcggaggttgcagtgagccgagatcacgccactgcactctggcctgggttacacagcaagactccatctcaaacaaacaaacaaacaaacaaaaggcggccaaggccatttgactactgacccaaggaaaagacatggaagctcataactggtctggagcctggatggaaaaaataactctccagtttaaaaatcaaaacactaagtttatgccacatgaatttgaggagtgtgagttcacggtactctctggtgtgggattcctaagctgagaaatttcccataaaatttgatccagaatggcgacccccacctcaccctctggggtaccactgtttgcacatgcaaagttgttctgtaaggacactccttaaacccaaagtatatgagactcctgctaaacaacacaaatttgctgatggtgaactcacactaaaaaaaaacctacacgaggaagtacatcactatgaggggcaggcagcacataaaaagatcagggttaatattctaaggattacatatggtctctgttacgaactgcatcgtgtccctagcaaaattcatatgttgaagtcctaattccaggtacctcagaatgtaactgttcagtagttggagatagggtctttgcggaggcaaagttaaaatgagttcattcaatgagaacacttggacacaggaaggggaacatcacacaccagggcctgtcgtggggtgcggggagggagaaaggatagcattaggagatacacctaatgtaaatgatgagttaatggttgcagcacaccaacatggcacatatatacatatgtaacaaacttgcacgttgtgcacatgtaccctagaacgtaaagtataataataaaaaataaatgaataaaaaaataaaataaaataaaataaaataaaataaaatgcgttcattagagtgggccttaatccaatatgactgatatccttatgagaagaggagatgaggacagacacagagagaaggccctgtgcagacatagggagaagatgaccatcagcaagccaatcagagaggcctcgaaagaaaccatccccgccaacagcttgatttcaaactttctttaagaattgtgagaaaataaatttctggttttttttttttttttttttttgagatggagttttgctcttgttgcccaggctggagtgcaatggcatgatcttggctcaccacaacctccgcctcccaagttcaagcaattctcctgcctcagcctcccgagtagctcacaccagtaatcccagcactttgggaggccgaggtgggtggatcacttgaggtcaggagttcaagaccagcctggccaacatggtgaaactccatctctactaaaaatacaaaaattagccagacgtggcagcacgtgcctgtaatcccagctactcaggaggctgaggcatgagaattgcttgaacccgagaggtggaggttgcagtgagccaatatcacgccactgcagtccagcctgggcgatagagcaagactccatctcaaaataaataaataaaataaaataataattaaaaaaaataatcattgtgcacctgctactgaaatagtggatcttggtgatgattttcaaaggccactaaaactattaaagtcagtggttcccatccctggctgcacactggaattactggaaaggcttcataaaacacaattcgtgggtctcaccccaaagattttaatttaattggccaaagctgtggcccgtgcattgtgaggcttctttaaactccccaggtgattccaatgtgcagccaagattgagaactgtcacatcaggtgaaaagctggtgggaaactgtataagggagggagtgggggaatggagagccagctcatgctgacaatgcctgagtccccagatctgtctttatcagaaaagacagccagacagtatggatctcatgacatgcggcactagaagggacacagtgtgaagtttcctgtggaatcatccgagctgaatctcaccaagctt

SEQ ID NO: 20 - DNA, 4712 bp, Homo sapiens
cccggcggtggcggcgtctctggccggccttggtgcggcgagccgagcgaggcagctctgagccgcgcggaaatctggcattttttaaagtttgcgccccacaaagaggaaatattccaaaggtactcaggatgtaaaaggggagatcttcacagatgcctccgtggatggcatggcaatccatccatcaatgagaagaccatgatttcttttaattttctgtgtgtttccacattccccagtgagaattcttccacctttttttgtgccatgggaaaaacctgaagggcaggcagagctgctcccgaacttgtgaccttctctgaggttgcagcggctcttgtagaacatgactctgggacatcacttccttttgttttctttcggagctgaaccaaagaatgtgcaccctctttctctagtgctgtggtgtctgcttatttttgtatttgtgctttccatccatcttctgtgatcacaaggcattcttaaggttttctagcacgacttgcggacatccagactcgtggggggcccacccatggctcggtaagccagcagcccagggcactggcactaccatgaggcactgcattaattgctgcatacagctgttacccgacggcgcacacaagcagcaggtcaactgccaagggggcccccatcacggtcaccaggcgtgccccacgtgcaaaggagaaaacaaaattctgtttcgtgtggacagtaagcagatgaacttgcttgctgttctcgaagtgaggactgaagggaacgaaaactggggtgggtttttgcgcttcaaaaaggggaagcgatgtagcctcgtttttggactgataataatgaccttggtaatggcttcttacatcctttctggggcccaccaagagcttctgatctcatcacctttccattacggaggcttccccagcaaccccagcttgatggacagcgaaaacccaagtgacacaaaggagcatcaccaccaatcctctgtaaataatatttcatacatgaaggactatccaagcattaaattaattatcaacagcatcacaactaggattgagttcacgaccagacagctcccagacttagaagaccttaagaagcaggagttgcatatgttttcagtcatccccaacaaattccttccaaacagtaagagcccctgttggtacgaggagttctcggggcagaacaccaccgacccctacctcaccaactcctacgtgctctactccaagcgcttccgctccaccttcgacgccctgcgcaaggccttctggggccacctggcgcacgcgcacgggaagcacttccgcctgcgctgcctgccgcacttctacatcatagggcagcccaagtgcgggaccacagacctctatgaccgcctgcggctgcaccctgaggtcaagttctccgccatcaaggagccacactggtggacccggaagcgctttggaatcgtccgcctaagagatgggctgcgagaccgctatcccgtggaagattatctggacctctttgacctggccgcacaccagatccatcaaggactgcaggccagctctgcaaaggagcagagcaagatgaatacaatcattatcggggaggccagtgcctccacgatgtgggataataatgcctggacgttcttctacgacaacagcacggatggcgagccaccgtttctgacgcaggacttcatccacgcctttcagccaaatgccagactgattgtcatgctcagggaccctgtggagaggttgtactcagactatctctactttgcaagttcgaataaatccgcggacgacttccatgagaaagtgacagaagcactgcagctgtttgaaaattgcatgcttgattattcactgcgcgcctgcgtctacaacaacaccctcaacaacgccatgcctgtgaggctccaggttgggctctatgctgtgtaccttctggactggctcagcgtttttgacaagcaacagtttctcattcttcgcctggaagatcatgcatccaacgtcaagtacaccatgcacaaggtcttccagtttctgaacctagggcccttaagtgagaagcaggaggctttgatgaccaagagccccgcatccaatgcacggcgtcccgaggaccggaacctggggcccatgtggcccatcacacagaagattctgcgggatttctacaggcccttcaacgctaggctggcgcaggtcctcgcggatgaggcgtttgcgtggaagacgacgtgagagctgaattgttgctgcacgtgctgggcccgccaatgccgtcatcatcaggattttacaaatctctttgcggggaactgtttcactcatggtatggaaaaccccaggactctgccactctaggcacacatgaattataaccattttggaatttccttcgtgatgttcgagagctcagcaatggacccctcacagagctcctctatccgaggccattggagaccccagtttctcaagaattcagctctgctctgagcgtcctggagcttggggatgcagccagctggcctgcactgggtgtggagagaacacctagggaaggcagcctggccctgcccgcctccgccttctggagagcctctgggttctgagtcagcaagccagaggtcatgccacaggcctggctggaacttacacttcacgttccctttttttccccctagagatggggtctcgccgtgttgcacagactgtctgtattcaatggctatcttcacaggtgtgatcataccacattcacttctgaaacactcttgttgcgatcgctaacctcactgggacagagaaccgcagtctttcgagaatggaggctcttcattttttttttctcctttactccaaactcagccctccagtttcttcagatgtaaaccctgttaacgtcactgtttccaaaaggaaaaaaataagtcagtttttggcagcaccttcatctttctgacctcctcctattctgtccttgtggacttatgtttaacatagaaaatgaatgcgtttaaaacaaaaccactttctgcatttaaccagtcctggctctctctctgctgcctcttcatacgttttctcaagaacttcagtttataattggaagagaaatttttgctgttaatgccagaatgagcaacctcaaggaattgaacacttcttggaaaatctaggtaattcaagccctcatcaggtttacaagatcatcagagaaacagaggattttaatttttagttctggccggctacaggctccatttctctgccttcccattggaaatagtttatttccacattctccactgcgtgtggtcaaagttcctcacccagcaagggactatagatactcgtgtcccaattccaaaacacaatgcacaagctgaacttgggctgaacgtggcgtgttgagatttggaatgaggtttctaagagccgtgttcttcatggaattttccaggccacttggcagcttggtttaccgatggatgggctagagatcttgtcgtttcttggaagtcacagggaagattgaagagaacgcttgagcatccttggcaacagcccaggtgggacctggatgaagctttgcactcaagtattgtcaagggaagcttcctgtgaaccaaagttctcaggccaaggtctcgcccaccaaagccagaaagtgcaagcacccgtctacccagctctaacttgtatgtgtgagacagaccaggcttcgggggtaggaggatctgcagttgttcagccgtctttctgctggtgttgtctttctgccatcagagaagggacacacagcccgttcgaaggtgtgcagagggctctgagcgccaggatggccagggctgtttttgctactgaaggagcgtgtgtcctgaactcccacttgcagggacagtccccaccttctctatagccggcactgggagcagccgccagcagggaaatctggcctgagcacaaggatgctttagggagagatcacttcagtgtgtgtgtatatttatttgcagtacagtgcgcgcgtgtgtgtgtgtgtacgcgcacgtgtgggtgagtgcgtcttctgagtgggttctgttcagttgctaatgaggctcctccgctctggacacaacccttttatagattaatttctctgccaattaacttgtcattttcagtacatattttactattccacaccaaccataattacaacaagggatttttcttatgcactcctatgcatgtgaataacatgtggtgtaattctgcttcttacagaagtattactgaaggtattatttccaatattatttggtttattatgcggatcttttttatatatgcagtcccatcccttctgtgccactcaatgccatccagacatggtttttccctccaggggcctttctctccagagggcacttcggctgcctctgcttcctctcattcgaggcccggctcttgctgacagaataggttccgttctgggcggtggttctcgagcctgccattcaaaaccaaagcaaattggagcatttctcacaacatggtattgaagttcctttttgttctcaaaagttgtgaccgtgttaaattgtactcccttagtcctgtaaggtatgttaagtgaatcgcagttacgctgtacttttattaatatttaacataattaaagatggacccataagagtg

SEQ ID NO: 21 - DNA, 147223 bp, Homo sapiens
gcttggcatgcaggaggaggctccaggcttagcagggagccaggttgtaaatcaggaagccagggtgtaaatcatgagaggggatcatctcaacagaagtccacctgctctggtggacatatattccttgaacagtttttgactacttaatgattagaaaagtcaccatttgcagagtgtttgctcagtgccagacagtcttctaagtacttcccatagattagctcatcgaatcctcatgataacccaaaaagtaggtgttattatccccattttacagatgggaaaactaaggcacaggaaggttaagcaatgggaaggctgggctttcaagccagtcagtctggctccagcatctgtgtgtttgacccctgtgctgcccctcactaccatgtgcccagcatagagaccagttcatctacacttacgtggctcctaggttgcctctgttcaccagtagacacaagaatacctctttttcccccctcgacaatcttccataccctctcctttcaccacaagtactcattcacatctgtggccctgttctcttaaccaacctagaacttgcaatgtccaacataatacctaccaactcctctacgaagccttccccagctaaacacagctcacagtgaagttttctctccttcagtttccatagtagcttgacctagctttttaataccttgtatcattcttcagctgtttaactagggcaatgattatttccctagttacaatcacatggaaacaaaatcaaggaaagggaaggtgattttcccaaggccacccagaagttcagtggtggagatggagttggagccaagttctgtcttcacagcaagatgctgagtgtctcatcacctggccctagtcatattaataaccgaaaggttctactgacataattaaggacatacatggaatttagtcctcaatgtccccaggggctccgggccttctgggagttcaaggctctaagttggtgggagtctgtgcctatagatacgagcaatcacaggctggtctccagttggtttcagcaggaccctcccaacacagaccgccagagttcctgctggcaatagctctagattctggtgatgtctctctggccctgttcctcgcatccctcccacatctacaaaatactgatagtgcagacaacaaaagctcctgacaatggaagaatgtgtggaaaggcacaaagaaagtgaacagtctgttgattaagtaaatatcattacttacgcagatgtatctttcatctcttgtttatttttggatgtggctttgggaaaattagaatgaagtgatgagtcaagatataacttaacggcaatcccaggaaagcttagtattctttttttaaattttttatttatcatgtttaatgatgaggtttgttgcacaatggacctgcagcaaccttacgcgtaatataagatgtgcatggtcttagacccttgaacatcagcatatagatgtgcatgtatacaagttatggttctatttttattttttatttatttttgtaattatactttaagttttagggtacatgtgcacaacgtgcaggtttgttacatatgtatacaggtgccatgttcttaacaatgaggaaatctaactatattcagggtagttaaaggatttttctaggagcctacccccaagtagtggaaggttttttttttttttttttttaattttttttttttttaatttttttttttttttattatactctaagttttagtgtacatgtgcacattgtgcaggttagttacataaggctttccatctccagtcaattgcatcagaaggtctcctgactatttttctttcctaggaaacgcagcatcacatgcaggagtccctttagtgaagtatcatagggcttatgttggaaggactaaggcaaaacaactggttcctctgacagtgaatgaatgctggtttccgggatgccagatgcttccttcctaggaatatccctttgcaaagtgcatgcatgcaaaacagatcttctttcacatggttactaagaattttgcattttgttttaggttgtcaccactgggatggaacaactagattttgaaacaggaccaaacatatttgatttgcagatttatgtgaaggatgaggttggtgtcacagacctgcaagtcctgactgtccaggtaacagatgtgaacgagccacctcagtttcaaggcaacttggcagaaggtaggatacaccaggatgtgcactgcagcccagacagtggcatcagggagggccctgggggacagagagaaacagaaaaagtaaataaacaagcagctgtttccctggaaaaggcagctgcttaatgagcagggaataaatgaaatgtcctccagctcaacactcccaataataatgtccaacagtttgcaaagcccttcacaggcagggtttctcctggtcccctcccagtcccagggaggaaactgaagctcagagagagacctcgagtggatcattgtggaggaacctggctgagctgcccctaggctcatccctgtgtaccctggtcattgactggcttgttcattctccccatggactctgacttcttgagggcagcgtgtttctgctacaatagggacaatgtaagggaccagagcacacagtaactaatgtcttacaggatctcccccaagctcatggctttgagcatcatccctattctgacaactttcaagtctgtcatttcagttcaggttctgccctgagctgtggcggtcgtaacacaaacatccacctttctcacccagcatctccacttggatgtttgacaggtcaaacttaatgtgcttctgaaccaaactcctggcttcctctccaccctccacccccacccaaatctgcttctcctatatctttcccattttggttagcagtaactccatccttcctgttgcttggaccaagccttgagtcatccttgactcctctctctttcacacttgacatgaaatcctttaggaaatcttgccagcttctaaatatacccagaacctggccccaccctagtgtctgcatcactaccaccatggtccaagccactcatcccatctcacctggattgttgcaatggctggcagctggcctcccagcccccctgcagtctgttttccatactgcagtcagagggatcctattaaaacgtcagttaaatcaaggcactcctctgcttaaaaccctacaagaaattcccgtctcactcaaagggagtctccttaagaaccaattaaaggccgggcgcggtggctcacgcctgtaatctcagcactttgggaggccgaggcaggtggatcacgaggtcaggagattgagaccatcctggctaacatggtgaaaccccatctctactaaaaaatacaaaaaattagctggatgtagtggcgggtgcctgtagtcccagctactcaggaggctgaggcaggagaatggcatgaacccgggaggtggagcttgcagtgagctgagattgctccactgcactccagcctgggtgatagagcgagactctgtctcaaaaaaaaaaaagaaaaaaaaaaaaaagaaccaattaaatctggcaagctgcctacattccttaccctcctacccctcctcctttccccttctccccctcagtccctgtgacccagcctctggcccccttactgatctgcaaatgcctcaaacatgaccctacctcagcattttgcatttgctgattcctctgcctcccctcctatctcctggctcttcctcatttctttagggacaggtgcagtggctcatacctgtaatcacagcactttgggaggctgaggtgggagtatagcttaaggtcaggagttcaagaccagcctgggcaacagggcaaaaccctatctctacaaaaaataccaatattagccagatgtggtggcaggtacctgtagttccagctactcaggaggctgaggtgggaggatcacttgaacctgggaggtcgaggctgcagtgagctatgtttgtgccactgcactccaacctgggttacaaagcaagaccctatctcaaaaaaaaaaaaaaaaaaaaatcttgacaagtgtcatgtccttccccgctacagttaaccttccatagccactttattaaaattgtaacccaactcacacttccttccccaatttttctcataatgtttctcactaatatacacacattttcctcaattattttgctatccatatcttcccatggaaacggaagttgcatgagagtaaggttctgttttgtgagctgctgtattcccagtgtgtagatcactgtttggacagagcgctcagtagatatttttttgaacgaagcatgagagtgataaaaagtgaatgaaagctcaagctcagatgtaaggcatctggattttaatttcgattctatcatttactagctaggacaacttcataacttccctgagtctcagtgttctcatttgaaaagcactaattacgctaaaagaataaatacaatacctgctttatattaatagaactgttatgaagatgaaaatagaaaatgtatgttaagtcctcagcacggtgccccccaatagagtgagttacttttcatattgtccatcatcactgggaaggaaaaaatgcccgagtgagagctctgtggccccttggtcagtgctggtaccgcctgctcctccctcctcccccatcactgtgaaaaactctgaaacagatgaaatcagtttttggttcctcccttgagcctctgtagccctcccctacttattctatttatctctgttccactgtaagatccctcatttcaacggctcatttctgcggagttgccaagtgtccttcaaggggtaacagcacagttgaggagagatttgcacattaaaatggattcagcacatggggatcctcacaccggaggttcctacctgggtttacttcccaactctctgccctatcacctccttcttcccccacctcaaacagcatcaccctggggcacctctcaacagaggacatgaatgaagacttggtaccagcttggccaaccctagcactttatgaattaccctaaatggatccatgcaggaaagttggccagtggtcttgctcatggatttttttattgcattcttggtcccacgatgccaacacccttggttcccttggttgtgtacagctgccttgattttggaattccccatttttgctttaataagatgtttcttattccactttggacactggtctaggtctacacctctacatagtagaaagagcaaaccctggattcatttaccaggttgaggccttcgatccagaagacacaagccgaaacattcccctcagtgtaagtgtccttatatggaagaggtggtgtttgtccgtgttgggttagacacaggagcctgctgtcctgagtcttggcggggtgagtttgggcagtggcagtcaggggaatgtgcgtccacttccaaacacagtgtatgcaggatggttggaatgaataaaggggctctggggccagacactctggagtggatttgtggctctgtgtgatctaggcccatttgttacctctctaagtttcaatttcttcatctgtaaacaaagaagagtaccagcagctactgcagtagagaagctgtgagtattacatagacaatgcatgtaaaaccacttagtgcagtgccgggtgtatcaaaactgctcaatattttaaaaatctaagctcataaaaaccagctctattttaaaagcataaaatgtacaccccaaatccaagcatttacctacctttcccaagagatgaagccaagctgcttagagccaagtttaaaaaattaaaaaagaggccagatgcagcggctcatgcctgtaatcccaagataggaggatggcttgaacccaggagtttgagaccagcctaggcaacatagtgagacctcgtctctacaaaaaataaaaaaattagctgggcatgatggtgcgtgcttgtaattccagctactcgggaggctgaggtggaaggatcgcttgagcctaggagtttgagactacagtgagctatgatcacgtcactacactccagcctgggcaatagagcaagaccctgtctcaaaaaaaaaaaaaaaaaattaaggagtccccagaattctaggttgtagagcaggagattgggtcctgggaattgcctcatgattcagtctgagacagcggatgtctcttctctcccttcttaatcagttttcttaatgtagctgctagtggggcaagtataaccaccaatcctcaggtgaagcctcttagttgttccctgggagtggacgcctcagctcctggctctgcccactaatgtggcctgtgcacacactgcagctgagcagtccaggttggagagaaaaaagaaaaaacaaagcgaatcccaccccactaaccttggagcaggaaacactcctgcagaccctgccttacagagaagagaatacttgaaatatgacactcggggaattggtaacaccaggaggctgtttctactgtttgctgcatgatttgcagcttcaattggactactttttctaacaggaagaaatgagccttgggaataccaggacgaatatatatagtctacagactctgaaacaaagctgttataaaattattggatacaacttaaagtaagggaatagtctgtttttattagaagatgatccttctgtgtaaaaaaaaaaaatcacccattcattcattaactcattcattcatgttaatatttgcatgaataaatgaatatgcaaacatttaatgggtgtctatgtgttaagagcaatactaggtgcttgaaatgcatacttcttaataacatacttctcatactagttaggaatgtgtttgtctgcaaataacaaaacttaaccatgggcgtgtacatgggaactttttttcttctctaataagtctagaggcaggcaggcagttcagcactggtgcatctgctaccatcaggagcctgggctcttcctatgcttctatttttctaaccagagcttgtttgttggcactgtcctctttttctcacctcatgattgccagatggctgctgcacctcccggatttacctcagagttccatgcaagaaaaagaaagaagcaaccagggagggatacaggatagagcaggcaggcccaatctgtccctttttttatcaggaaaacaaaaactctcttggaagccctacccagaggacttctgctatatctcactggccagaactgtgccctatggccacttttgcttactgatgaccagggattcttaatggagataaggtcagaaacccaaagtatagcacctcacttacatatttagttcatttcaacatttacaaagaactctctatgtgccaggcatcctattagatactttggaaacagagatgagtaggacacattgacctcaggaagcgtaaactgaatggcagacattcatgcgtaggggagaaggaacagcttttcctcacttgtcaaaaggtttacagctgacactcctataacaaagaagagattaacaagaagagtaaattaacaaatttatttaaccaaagttttacatgacgtgggagggcttcagaaatgaagacccaaagacccccagggaaaactgtatttttatgctgaagttcaatgaagaatgggcagtcgtgtagaatcgtaactggacaaaaaggggtatgacataaaggtaataaactggggaaacttagcaaggccctgtttgttcagattcttcttggtctctggttgtagggtctggaatcctctagaatcaggttcttatgacctacttttaggggtggtaggtcagagaattcctttatgatcatgcttcaggggagaaagttgggagaaagagtgggcttcctgcttctgagaaggttttcttcaattgccaagatgtcatattttggggtatcgtgttctgatttctgatacatgcatacactaattataatccaatatgacaattactataacgtttgtataagaaccagtgggggaaaagtggaaagaatttcagttgtgaagacaaacatatatttgtttttaaatctccactttaaatgtatctctccaaattatgcagacagaataaggtcatggcccctttaaaaacacctcctagatcaggtagctaccctttcagaggaaggaaagctgcccaggtaggaaacaactgcagcaggtgttgctcccttcagaaaaaaaaatgtagtgccatcaaaagcattctgagagcagctgcgggggcttgtggcttctgcagtgagttgaggagttgtttggggagggggtactcagagttgcagcagaaattgttaatgaaatatttaacacctgtgctggaactaacagctgtacagaaagtcaacagccagcctgcaggagcggtggacataatctggaagaaaactttctcagattaggaaaaggtaataacagtttaggacataacatattatggcctttgtacttagacgttttattctgggtgcttgggggtactaagtagaagcaaatgacatcgttaggttcgtaaaagtagaagggaggtgggttaatttgctactgaccaacctgtgcttctcaaccttggctgtaaattgaaaccactgggggagctttaaagaacacggatgtctgtgtcccaccctgtgaaagtctgatgtgattggacttggatatggcctgggcattaggactataaagcccccagggaatctaatgtatggccaggggtgagaactgctggtttgccacatcatctcccaaaatttccaagtcccactcctggagttttcgagtctgagtctgcatttctgcattgtctgagaacaattttgcatatttggcaaatatcttaggcaattattctggacgaaaaggctgggaacactggtttgtttatttttgagacagggtcttacctctatcacccaggctagagtacactggtgcaatcacagctcactgcagcctcaactttcctggctcaggtgatccttccacctcagccttccaagtagctgggactacaggtgcccgccatcacacccagctaatttttgtattttttatagatagggtttcgctatgttgcccaggctggtctcaaactcttggggtcaagccatccacctgccttggcctcccaaagtgctaggattacagacatgagccaccacacccagtggaaacaccggtttataagtgttttgcaggctttagaagtgtgttcaggcattagaacatacttaggctgattttaaaaatgcagattcctggacattgcctgagaatgctgagtttgaatacaaacctccccggtgattctgatgtaccatgtacttcaagaaccactggactgaacaaacaaggacagagtttaacaaaacactaaagcacatgcctgaagcgacctaggcttggtttgtgtctgtcatcttaacctggtggggtccacgagtcaccctgctggtggcagcaactagagaatgaataatggatttttaaaaatagctataggatgcattttgaaacctcaacccctttaaaatgacaaatcttacaactcttctccagcttaataaagtgaaactgtatcacagttaatgaaaaacaggtactaatctggaagccacttgtatttgctcccttctttttagtgaaacttaaaaagcatgtgctggtacattgtttggaccaacactgatcaatattggaccggctctgtccaataaagctatactgtgagccagaaatgagtcctgcacatgtaattttaaatgttctagtagccacattgaaagtaaaacaaaataaatgaaattaattttaatagcttatttaactcagtatactcaaaatatttcagcatagtcaacataaaatgattaatgagatattttgccttctttttccatactcggtgtccaaactcagtgtgcattttacacttacagatcatctccgtgcagaccagccacatttcaatgctcatagtcacacgtacgtgagggtagtggctactgcattggccaggcacaggcttagatctagcattggttcccccttcctgggcaccttctgtgttgtggtgggcatgcaggtagagccggggcttggcttggaggtatgcattaataatgggctcagaacatagagaaggatgatctgcatgtgaataattatttttactggcatttcttctttgggtacccacccccccacctcttctccactttctgaaggaggctctttgagaccaccctcctcccattcaactcccacactctctgcttccccctctgcttggaaatggccaccgtgactgcagaagagcctccttggagactcccaggatgttaatcaatctctcagctggaggcaaaatgatctagtacagcaatttctccattaaggggctttcttttggcctttccattgaggaagggcttttgcataaaatgaaatgtgctttgtcttcaccaaggcagacaaaggattaaattaagagagcaataacctagctactacctggacttttgggagcgcagcaggggccatccttctctttctgtctttatcttgctcatagctctaggaagtggcagccagttgtgagttttggttttcctgtgtataaagtggtcatcatatgccagacctggccctatcaagggtcccagctggatgggatctttcaggtccattgggcagtccttgatttctggatgagggagggaactgaggggtcaggtaactccagtgagaacccaggtctcctgacccacctcccttctactctgttctggcaagttctgccactggcttcctaccccttgcttttctgagtgacagcatccctgtccccaccatacacccccacctgccccagtcattcagctcccctggtgtctgcctgccaactcaggagtcaggagtcaccacctgaagtcttagcaaaaggcattcttcattctactccaggttcttgttcaaaggctcataaaaggaaaaagcaaaggtactggacaattcccactccaaatatgtggtcactgctggctgtttgcatgtggggtgggacactctcaaatagatggggatcattgttattaagattagcaaagcctgaatcttgcagcacagaacccaggccaattatggaaaaagaatgacagaatgtgagggcataggatctgcagctttatcggtgaaggattacattaataatagcattttgcatttgtcatcgtgtctcttcttaaaaacattcaagtacttgcctgtaacccacttagctcatcctcagaacaatgaaccacgagcaggagccacgttaaggacttgcagtgggtagttttttaacgatagttttttttcttctaggcactcttcctccttcctcctccacgtcccacctctgagctgagacgagggtggaataggggaaaacaaagagaggaattgaggcttttacaaaatattcagcttccattgaaaaatataggaatgtggcaacatatttgtaacttgccacagtcctgagtgctctggccctctggggtgggtttggggccatgtactcagtggcttgtggagccattgacactccctggatgtgggccgaataagggtctttccttctggaaactcagcctgcggtggcctggtagttgactgctctattctataaaagacaagaagctgaattcttgttgtttgtttctactgaaagcaactgatagctgcaaagtggcacaggttgaatcattggtcggtgactcctactgcagtggggaagcaagcctggaggtggcgttcccctcgtaccccagggagctgacatttctggaaactgggccagctccctctcaccttcctttctccctacaccaaggcacaatcaagggtgaatggggcaggaaggatgggcttcttgtcttccaaactaaagcttttgtgtctgagagcaaacctagctgcaaaggggcggcaaatagagaaacctggggtggtggtaaagaaatattcccagcaggaaaaccagagagcttgtctgacaagcatttgttaactgaattgatctgattactcaggacttttcttagccaggactgggggcagagaggggctgcagttgcttttcattctatttaatttctgttttccaagaatgaatatcaagggagcagctttgattaaacaagcctttaaaaagggggagaaaatgccaggttttacagagagccttgctgagtcgctggcaaatggccacatgacacaatatttttagtctttggatattatctcctctctaagtacaaaactgctattcccattaacacagctcttaggttcagagaaaaaagaaattagcctggtgttaaaaagaaaaaaaaaatcaagattccaggaaatcatcctcttcatagaaattaaaaagaaaattctcatgtgcctagttctacagttctccacatcctttttatctgctgctgtttttcttttttcctttctttcctttctgcataagttgttgagactgtgggcccaactggagaagattttaaagccaagtctagcattattacattcaaatatttttaaaaaatgttttacaggatggttttttgttgttgcttttttgttttaagattctctaaggtgggaatgttggtcttactaagatgggaaatgaacaagaagaaaaccccaatatttaacatcgaacaaatatttattgagcatctattatgtgctagtcactaaggatatagcagtgaataaaatgaagccctttccctcatggatcccttctaatgggacagcagtagttaacatttattgagggcttgccatgtaccaggcattgttctagcactttatatgataacccgtggggcatgccctagtattattactctttgcaggcactcacatggctacaaagtgatgaaccagggttcacatccaggtattctggctccagagtcaccaaacttaatttattaccctaatttgtgactcttgtattccagatgagtctaagagtccttcttctcagttcccgtcatatcctgtatgtatcccctttggagcacctccccaaacctttgttccctcggttgaccataagattttggagtgtagggcctgtctgcattctctgtatcccaaggccttacagtgcttgggaccaaccagaattggagatccagctcctagagcatttcaaaacacatgtggaaggacgccctgattcaggtacatacagtaaatctcctccccaacccatgagtctctaaaaccctgtcattctatcatatgtagcttaaggtgctgatttatggatatgcgaggattctctgcagggaaggctctgctcaaagacagaggactgctctgtgtgtgggcaacttcaggcctaggcaattgctgtcaggccgtgagctggagtgttaatggggggcttgggatttaaaccccacacctgggagtactgccaaggtgcttgcacaatctgtggggctgggagaagggtgctctgtggcatcacccaaatatttccccttaaaaatgagcagaaaacacctaaatgatcagcaagaaagatttagtaaaataaacccctgtggtaggatgctgtgccatcgttaactaaccaggctataaaataagacttaagaataggggtaaatgctcaagatataaacacaatgaacagatattataattttgatgataacatcattgctatttttggagggtatacgtttgcatagaaaagaacagaaggctaatcaccaaaatgagatttaataggtggcatatttcatttcttttttatacttttctgtcttcctcagttttgtataaaatatggtcaatacaactagaaaaacattattaaataataaacaaaaggaaactttaaaaatggcttaaaaacgttatattggcctcaaaggagacctttaatctattttctgtgcacactgtcttcttgtgctgggagctcagcagcgatcataacacagcaaatcgctgggttggaaaccttggcaggtgtttcctttgattctagacttcaggggctgtggctgtggttgcaaaacctccactgatgatctgatccagagatctaaggccttgaggatagaacatccctcatcctagcaggaaataatgaaaccttctaaccttaaagccctttggaagaaatgaatataaacatgtgagtctctagcgttgctgcgatccttcatattttacggcacgcattctcatttaatcctcaataacatgaaggagcaattggtcacatcagccctaagttataggcaagaaaggcacttgtcccagatcttgtggtgaggaccagagcttaagctagacgcagtggctcatgcctgtaatcccagcactcagggaggcagaggcaggtggatcacttgagctcaggagttcaagcccagcctgggcaacatggtgaaaccctgtctctacaaaaaaaaatataaaaaaaattagccaggtgtggtggcacacacctgtagtcccagccactcgtgaggatgagatgcaagtatcacttgagcccgggaggcggaggctgcagtgagccatgatagcaccactgcactgcagcctgggtgacagagccagactctgtctcacaaaaaaaaaaaaaaaaaaaaaaaaaaaagaagaagaagaacttggaccttgaaccaagctcttctgatccaggctcttcccctgttttcttgactccattgtggaagaaacagagcaatcctgatgggctgccatgggtggcacgggcatggtcttcctatgggctcaccctcagcgggctgtacacataaacctgtctcttcctatcagatcaaggagatctgggcagggtgtcatcaagagagctgggctggaagcctatgatgacaaagactctcaactacccaaagatgtaggaaggactttccttatgccacgtgccagggattagatttcaaaacagctcttctgaatccctaaactggcttccaacctggactgtaagccctgttatgtttcattctcagctcacccttgtcccttgttccttcaggcatttcaataactgatgctcatgcattttgcgccctgctatattgtaagttgtttttaagggtagtgaccagatcctactcactttggtatagtcctattacctagtgggtagtagctgtattaaataggtaataggtatagtcctattacctagtgggtagtagctgtattaaataggtatagtagctgtattaaataggtaataggtatagtcctattacctagtgggtagtagctgtattaaatacactgtatttaaatacagtgttggttaaagccaaggcatagaatcaaagccagaagttgtccaggagtgagaacacagtgatagggataagaagattggactcagaagcagagcctgccttgacaggggccttttatatgctttctgtagttagaacaagatccactcaccagcttttcagggtgtggtcaaccagggctcagaccaacagagccagaagtttctgtattcaagagcgattaaattggataactgctctttgaaccgcatcctgatgcatcgagaacgttccatgggctaagaacataaaataggaaatgagcacacacatcttctggggaagggtgggcaggtgggctgatttcatcaatttttttcccttgttttttagtatttcctgatttctcccccaaagagcttcagaatgtctgctaatggcaccctcttctccacaacagaattggactttgaagcaggacacagaaggtagtcttgctattgaccttgcatgaagtactgtttatctgagggtcaaggaaaacatgagggataggtcacagtgcaacctgagggcagctggggggagccccttgagcagtctacagcgtcattgtaagttcagatggtagtgaaccccagagagggatggggaataaggcaattgtctgggaggcctcttttggtctccagagaacaagaatgacagtatgggagagggtgcccaagtacaagagtgtcatgagcagtgcaaggtcagacataaccaggtccatgcacatttgtgtctttccataaggtcaggttttcactgatgctacttcaatcctaaaagccatgagctacatggaattcccaaggaggcaactctccttagacctcttgctaactcagtagtcagagcacataggctcaagccactccacaggtcagtcagtattgtaaaccatacatagtatacttcatcagcacataaatgttataaattaaacattccacatcaaacaaagtaacatttaacatcatgagaaaagaggttaataaaccagaccaaggacggtgatgtggacacggagagtgtcttggccacatccagatggtcatcaatgtcttgcaaggaagagtctttgatttgggcagatgctgggtgctgattacaagtgacagcaagacagggtctgtcaagatggccttgtcgagccggtgaagtcctgctcgttttatggcccttgagtccactggcgaagactggtagtaaaggattatgcccttatctggttgagtgttgtctttattgattaggtgaccatctggaccctgttggcttgatgccttttgaaatggaagatggcattttttttctaagatgtagtcattaatgtcaagggtgatctatacaagatttctcagaccccatcttgtttgggaaaggcagccatccaagcaaaggggctgatgaggggaagtggatgacaacacattggccttggggtgaagcaggtgaggctcctggctctgcgtcgggtgtgggaacaagagctagccatgtgagccatgggggcctcactccctccagtgggagtgatatgcactttccagagatcttgtgaaaaacaccgggatagatgtgcagcatggcgcttgagcagatgctggcctggtgggacaatggtggtgaatagcccctgcagaatgagaagcagccagcgggtttggagacggggggagaaaggtcaccctgcaggccctgagactgtgggggcattacggagaggctcaccaccaaaggggcagggtctgctctcactcctcccaccccatgattttccccatcctattttgaagtagtgccagcaaagcttgattctctcacgtggaatgtttccctggcagtttccatctcatcgtggaggtgagggacagtggaggcctcaaagcctccacagagctccaggtgaacatcgtgaacctcaacgacgaagtccctcgctttaccaggtaggcctgagggcatgcaggactccctgggccgcaggtgcgtccttcttaggcggcctcgtctcctccggcacatttaatacaaggcagagggatgccctttgctgtggcctgcaggaaagattagaggcacgtgctcttcagagtctttatctgggcctctggactgctgttttccacctttgctgcctctgcctcctgtacccacacattcacatgcaccatgggattttggatatggtggggagaaggggtggacacatgccccggggtgtggcctgcactgtgcacatgcagagggtgcttttaaaataaagtgccgcgctttagtaacagcagagtcccagagcatgcatcatcactcacgactccctaacgcccgctcctagtatgttatcctcacaccgaggagagggctattttcacggtgcctgcctgttactggctgctctaaagtttcttcctgccatggtggatccagaaaagtgatccggctgtgtctggcagctcctctgtccagcagaggtgggaagggtaaatgcatcgggtggagggtagtttgtggaaatgtgcctggcactatcccaggcacaaaatgaagatctgagcctattgtagatggggatttaggaggaaaagatgggattctgagctagtagatggcactgcaaacagcctggcatactgcttacagagcctctgcctgccccagtccctgagatgggcatagaagccagccacaaggaaaggcaaaatcacctttaacagcatgaacggttatgaatagattcagcacaggatactccaccaataaaagaccattaggcctcagagctgggtagaggacttgcaaaactactccaagattgcgaggtatttaaggcaacctcactcccagactaacctggtgccacttggcaaacaccacaattgcacaacttctggatgttaacatagtctacagtccagttgcaggtgtcaaagaatgcgtctgctccagccctgcagcctgggctgcagttcctttttcaatccttgaccctcaatttatctgctgctattaaatggctatgtaatgctttccatcagcacctgatgctgggttaggttcagaaggagagctcagtgcctttgggctgacaggtggctcctggagcaaagtctaggcagcttattaacagttatgacatcccagcccggactcaggctcaggtatgggcccacacagctctgcagattcttcaagaacccccagaggaaggtgatggctgcagggctggagcagatgcattctttgacaccttccccacaagtcccatctgggaggaggggaggaaggttaatggggtttcaaaggggaaaataataagtcctccccaggggcagagcttgtaaaccatctggtttggatcacatcttccaaaatacagaaactgacttttagcagagagagagagagaacatgaccctcgctggcgtgggatgcacccagaggtcagcctggaactctctggttctcattttaggtttgaaagaggaacatattgggctccatccccaagcagatagcatgatctgtgtgacggtctttttttttttaagtcagtcgactttatttcaaacagcattccttggatgaaggtgagggtgtgtctgccagagcctcactccaaaagaaggagtgggggcagggtggctgcccaggcttggctcaggcagtcaatgagggtcaacctcatccctcagccatcaaaatttgaaaggatttgcttggtttcaaactacgtgctgacttggagggctttcatggttcccttgagcttctcagcctccttttcctgtaaatcagtgctagcactaacgataacttctttaattcaggattaacaaaattaaatcttcaaacagactcaagtgtactgagtttgagcctgaaatacaaatgtaaaatgtacagacagcctttctatctttactatttgttaaacgcatgcaattaacacaaccaaagcaagtcctatgtctgttcttgaaaatgtctccccattttacccctggtggtgacaaatgtcagaaagctttatagattcaggatgcatgctccaggagtctgccattattgaagttgaacattttattataaaagcacctgacacaccgggtgcagtggctcacgcctgtaatcccagcactttgggaggctgaggcgggtggatcacctgaggtcaggagttcgagaccagcctgaccaacatggtgaaaccctgtttctactaaaagtaccaaagtagccaggcatggtggctgtaatcccagctactcaggaagctgagacaggagaatcgcttgaacccaggaggcagaggttgcagtgagctgagatcatgccattgcactccaacctgggcaacaagaccagaactccatctcaaacaaaaaagaaaaagaaaaagaaaaaaaaaaagcacctgacatatttactgtttccctgtgcacagagcttgctgtgtgtgcacagcactttattttagagttgggtaggtaggtctttctcccctcctgcccatttcttttgtatttactcagtccttttccacctggtgcttggcagtgtcatgcacaccttgggcacttactgaatactcattcatagtggtgaagccatccatggcttcccagcattcacacccttccctgtgagtgtggccactggcccaagctctgggggtcaggtgttacggggaagaaggatgtgggaatacaagtggtagcagagctttactgtgtcagggtagctgcatggcacctagcttcactgtgctttgaatagctcttaactgtggtctccgttgaatgatattttatacatacctgtatcttggattcaaaaatcaaatagactaaagattttatctcctgccaggcttaatgtcaggttagccaaggagagaatatttcgcctgaggagctgcatcgtggccagtagcctgaccagttcccttcgtggggatctgggttcctggagcacccagcatggactagatgagccttcagagcagagtttcttaaacagcggaactgctggcattgagccaggtaccccattgtagaggggttgtcctgtgcattggaggatgtgtagcagcatctccagcttctatcccctaaacatcaatagtagctgtctcccctagttgtgaaaatcaaacatgttcagacaccacccccggccccccagctgagaaccactgcctgagaaggaaggagggatgatgggaagaaggggcttttcctccccaggtgtcctctctctgtcccgtggggaggctgggagcctgtggttgccacctctggcatcaccttataatcatccttccgaaacattaaagtctatgcagattagctgggcatcttgtgaaaaagccagtcctggttcagagggctggggtgggtgggcctgaggtctgcatgtctaaccagctccctggtgatgcttttactaggagcatgcttggagcagtagctcatggctgtgtgattagcacaggcatcttagtggcctcttttttggaagttaacagaacccgctcatgatgaccaaagcaaaaacatactacattagcaacaggggcattcacagaagggaccgaggggcttggcccagcctgggggcgctggggccatatccttccctcctggctctggttttggctcctgccatcccacctctttggccccattccactttgtctattcctagatccatcaggggcagcattacagattgcctgagaaggggatatgtcaagtaagggaaaggatgaatgggcctgtttcagtgggacactggggtgaccttaggctgaacatgattactctcctccagcaatggagtatacccacagaagtccaccttgtgaatagatgtggggggaccctggatccagggaggagctctggtagggagggttggggtgaagccctggttcctgcctttctctgactgcccctgacttagctattgattccctgccatttctccttcctctggccctacctaccttatagggatggtgagatagcacagcagaaatattctgagctcacgaaaggaatgccgtcacttagatctgagaggtactatacccctttcaaagaagatcccacatgggaagacctccacttgggtaactgggaaattagaggtgactacttgccccactgaaatgattttccctcagcaaaaggacttcctgcagagttgttttaaacaataagcctcccttagagcattcaaaattactcaatgtatagttagttaaaactcccaacctatcagtctcattactggcctgttccaaaggcattggtgaaggtctgaggaagatgggtaagttggtgatttggggttatcttgcaagaaggacagtgatggggcctggtcttcttcaggggacctatttctcagttcagagagctgacctcatgattaatgcaacttggaaaggtgcacgagttctgtgcataaattctatatcctcaggcaaaaaaaaaaaaaaaaaagacaaggaagaaaaaaaagtgagcaaacacatgagaatagagaagctttacaatttttctggcttctggtggcagccatgggatgggagtcaggaacaagggagggaacccgcagctctggacatgaccctggcatgtaactctggacacagtgatatctaaaagaatccagggacatctgcacaaaacgtgggaaaatgagaaaagatagctggataggccacctgtccttatttcaaaagacgttaatgccaaggctgatctgaaatgacatcaggcagaggtgcatagagtcagagactgtggcccatgtaaattgttgcaatgacagcgtggtactttcttcacatccacagggatgtggtctttggggatacaaaagccagccacccctcctttccactgctgtgctctccctctgagcatgttgatgcaacttgaacagctctgcactatatttagcactaaccaaaataccaatcgcctagatgctaccttcccgtgcccctggaaattagctgtgtctgctgtatctctgttccagcccgacacgagtgtacacagtcctggaggaactgagtccaggaaccatcgtggccaatatcacagcggaggatcctgatgatgaaggttttcccagccacctcctctacagcattaccactgttagcaaatatttcatgataaatcagtgtaagccactcacttccatccttaagtgcatcctctaattcagccatgtggattgtcttacaatgtagttgtccctcgttacccatgagaattggttctaggatgcaccgtggataccaaaatccacgtatgctcaagtttcttctataaaatggcttagtatttgcatataacctatgcatgtccccctgtatattttatattatctctagattccttataataccaaatgctatgtagatagttgttgtattgtttagggaataatgacaagaaaaaaatgtctgtatatgtttagtgcaaatgcagccagccatttatttttcctgaatattttaaatcctcagttggttgaatctgaggatgcagaacccatggatacaaagggccaattgtatttttcttatcttctggtattgggcatgtctttctgtctggggtcatcattggttaccaaggtaatagatgtattataagcagctggcatgggggttgggcaaactaaacagggttgacagctatgtcacccttcacctttgtgggggatgggtggggggcagtgaagagatttattttcttacccattgttaggcttgtgactgagacctctataaaaaaagacagattaacaagagaaaagcatacgaattcatttaatgttaagtttatgtcacaccagagccttcagaaatgaagactcaaagaaacagggaaacccatgtgtttttatgctcagtttgatgaagtgagtaattatggagaagtatgattggaggacaaaagggtgtgataaacctgggagaatttagcaaggtccgtttgttcagattcttcctggcatctctgtcttccagaataggatgttcctttcctccagttataggtaggttacctctggaatgaagctcttatgactgcttcaaaactgctgttttctcaaatgccaaggtgccatattttggggtaatatgtcctgaatcccatcacctttttctcaaaggcaggtgtgtaaggatggatgggttacttatcctgagggttccctgaagtcttctgaagagaggggctatattagcactgtccaataggaatagaatgaagccacttacgtaatttcaaagtctctagtagtcacatttttaacaagtaaaaagaaataggagaaattaattttaattaggtatttttaacatgtataaaatattgtttcaacatgttatcaatacttaaaggtcattcatggccaggcatggtggctcatgtctgtaatcccaacactttgggaggctgaggccaaaggattgcttgagcccaggagtttgagaccagcctgggcaacgtagtgaaaccctgtctctactaaaagtttaaaaattagctgagtgtcatgatacacacctatagtcccagctactcaggaagttgaggcaggaggatcccttgagcccaggagtttaaggctgcagtgagctatgatcattccactctactccagcctgggtgacagagcaaaaacctgtctcaaaaaaaaaaaaaaaaaaagtgattcatgagatatttcatatcattttctttggtaccgagtcttggaagactgttgtatgttttgtacttacagtacatctcaatttggattagcaccatttaattgctcaataactctcatgtgactagtggtaactgtatgggacagtgtcatcttggtcaatctgccagactgatgggagttatttttccatctgaatatctctgaaggggacttctctgctcttctataaccatctttttctggggccttagtacacaccaggcattatgctgagtgattattcacatacatctcatctcaagtactcaagatagcaactcaatgaactatcatcattcacattttacagatgaggaaactgaggcctagggagagcctcaggcaggtcaaacaatttgttcaaggtcttacagcttgtaggtcatgaagcagaagtaccaacctaagctgcctgattcctcgggcctgtcctcttaaccactaccggactgtcccacctttataagtcctgattgcatcaccaaaaaggacgtccagccttagacaatgccagaaaaacaatgtcctgttggctccttaggctttcgggcaaaagacacctattcccaggagagccaggcaaaggcaataattgtgcactgcctctgaaaacatcctgatgccctgtcagctgatagtgtagggacaaccatggttgagaattctgttcactctagtgttgcgaaattcaacttttaacaagtagagtgaggtttttggtttttttctgagcatatttattaagattttttggttgcaggtaacagaaactaaggtaaaccaacctaaccaaaaaaaaaaaaaaaaaaaaaagaaagaaaaaaaaggcaggcacatctatcaacaggattctgtgcatctcttaagaaaatgtaaaaagatggggacatagaaaggatgtgacccagtgctgctccagggaccttggttctgtagctccactattagcctgactgatcctccaatgtgtgcctttcagttataaattctccaataagagagccctctgggtcaagctggagtcagttattcaccagtccagtccactctgggcaagggccgccaccagggacccaactctgaagtacagtgtgaaaaatcctagaagggtcaggccagataccccaatgaatgtctaacacaggaacttaatgggttttcaaaaatgtatttgtatagagattatgctctgcataagctcttcctcatgttcgaatggtcttttccagttttctccaagtttctgtattccttttcatttctcttcaaagggtcacgttctaacctttgctttctcagtgactggtacaatccaagtggcccaaaggatagaccgagatgcaggtgaattgagacaaaatcccaccatttccctggaagttctagtgaaggacagaccatatgggggtcaggagaatcgcatccagataaccttcattgtggaagacgtcaacgacaatcctgccacatgccaaaagttcaccttcaggtatgcacactttgaaagttgggctggacattctatctctttggtggccctctgcccttctgcttctctggtatattctcaggagaattataagcatttggagaaacagctcagtagaataaatcgatgtgaactgttcactgttgtccacaggtttccttgttatcgtccttttttcttccctctctttcattttccttcttcattatctcccttgttcactttcttactcttaagaattattttttattttgctcccttctatatctggctcatctctgttggtgaaaaggaccacagggacttgttaggccctccctggactgtgcctgttctttgtttattgccacgggtggcaagatggggctgttagttagcagttataatagacgtttgagacttaggatcagtgaataggaactcccaggaaaacataccaccagccagatgaataaatcaaaccaagtacttaggtaaaaccaaacaaagcatcgaattcaccttacacaacttaattgaatataaacaaaagacatccgaaagggaaaaaatgcagatacaagtgggatacaagtgatcttgtatattttgactcattctttgtcctacaatctatttgctattattttacaataaagtcccttgtgattctgggttaataagctttttgaaaacaatattgtctttctactattttgtcaaaaagccacatgattagtacttgcccatattagcctcgtctctgaggttttgttccagccagtctctggtctcctgagaggctgaagagggctctttgggaggaattggggttgtggggagcaactccacagcagcccttgctaagagacagccctgtatctggagcaaggctgaagatcagggtgagtctcagctccagatgtccccatggggagagtctcctgagtttatctttgagtggttttgtaagttttctccaggcgactctggacatagacccaatacatgcagaggacaaaggaccctagaccaggattgcctaggagaagcaggagaaatagaaattcctttattatactcatgaatgtctccctgttgtcccaaatggcatgcccagtataatgttaaaggatccatgtgacctcgagtctgatatcaaaacggttaaactctgttctggatgcacccctgacttatccctttagatccagtctccaccctgctctgtgctccaagacgctgacctggatggataccgtattagactgttttcatgctgctgataaagatatacctgtgactgggcgatttacaaaagaaagaggtttaattggacttacagttccacatggctggggaagcctcacaatcatggcagaaggcaaggaggagcaagtcacatcttacatggatggcagcaggcaaagagatagagcttgtgtagggaaactcctccttataaagccatcagatctcatgagacttagtcactatcacgagaacaactcaggaaagacttgcccccatgattccatttcctcctaccaggtccctcccacaacatgtaggaattcaaggtgagactttggtggagacacagccaaaccatatcatcctgccccagcccttcccaaatctcacgttctcacatttcaaaaccaatcatgccttcccaacagtcatccaaagtctttactcatttcagcattaactcaaaagtccacagtccaaagtctcatccgagacaaggcaaatcccttctgcctatgagcctgtaaaatcaaaagcaagttagttacttcctagatacaatgggggtataggcattgggtaaatacagctgttccaatgggataaattggccaaaatgcaggtgctacaggccccatgcaagtctgaaatccagcagggtagtcaaatcttaaaactccaaaatgatctcctttgactccatgtctcacatccaggtcacgctcatgcaagaggtgggttcccatgatcttgggcagctccattcctgtggctttgcagggtacagcttccatcctggatgctttcatgggctggcattgagtgcctgtggcttttccaggtgcatggtgctagctgtcagtggatttaccattctggggtctggaggacagtggccctcttctcacagctccactaggcagtgccctactagggacttcgtgtggggactccaatctcacatttcccttctgcactgccctagcagaggttctccatgaggggccacccctgcaacaaacttctgcctgggcatccaggcatttccatacatcctctcaaatctaagcggaggttctcaaacctcaattcttgacttctgtgcagccgcaggctcaacaccacatgaaagctggcaaggcttggggcttccactctctgaagcaatagcccgagctgtaccttggccccttttaatcaaagctagagcggctgggatgcagggcaccaagtccctaggctgcacacaagagagggacccagggcctggcccatgaagccgtttcttcctcctaaacctctgggcctgtgatgggagtggcttccacagaggtctctgacatgccctggtgacatttaccccattgtcttggtgattaacattcagctccttgttacttatgtaaatttctgcagctgtcttgaatttctcctcagaaaatgggattttcctttctatcgcattgtcaggctgcaaaatttccaaacttttaagctctgcttccctcataaaactgaatgcctttaacagcacccaagtcacatcttgaatgctttgctgcttaaaaatttcttctaccagatactctaaatcatctctctcaagttcaaagttctacaagtctctagggcaggggcaaaatgccaccagtctctttgctaaaacataacaagagtcacctttgctccagttcccaacaagttcctcatctccatctgagaccacctcagcctggatttaattgtccatatcatgaacagcattttggtcaaagccattcaacaagtctctagggagttccaaactttcccacattttcctgtcttcttttaagcccaccaaactgttccaacccctgcctgttacccagttccaaagttgcttccacattttcaggtatctacagcagagccccactctattggtaccaatttactggattagtccattttcatactgctaataaagacatacccgagactgggcaatttacaacagaaagaggtttaatgggcttacagttccacgtggctggggaagcctcacaatcatggcagaaggcaaggaggagcaagtcatgtcttacgtggatggcagcaggcaaagagagagcttgtgcagggaaactcccccttataaagccatcagatctcatgggacttagtcactatcacaagaacagcacaggaaagacttgccaccatgattcaatttcctcctactgggtccctctcacaacatgtgggagttcaagatgagatttgggtggggacacagccaaaccatatcagataccaaccaactcccttgccttccagcttctagttggccaatggggagtcctggaaagagaaggagaggagggtcaggctctctctttgtgagctgggtgcatcccttccctgcctgaagatctccattcccaaaagcagctctctgtcgcaggacctgcttcctccactggcttccctgggcctagtggtggtaagggtgcttcactctcacgagccctgagatattgcaccatctgatgagatttccatatactctgtgagcaccttcttcatagtccctttactgacccctcctagaatgatcctaattcaccagctgcttcctgctgacaccccaataacgtcagtcacaatcttaagcatgtagtaggttcctatcccaacctaagccctacaagtccattagatgggtggggacagctgcatgggtagttaggattgtgacttccacacctttacgtgcataaattgagagatgtctgggcccaggggatggagtggagacaatttgcagcatcacacttacactttctttgacattttaaatctgtgctagaactcttgggtggttccagtacatcctgggaagctcctgccctcttctgccctcctgctcttccttgttcctctgccctaagaggtagggggtgaaggttaagaagtgagaatgcctggagagggctgtgctgtctcaaatcttccttgtccattttctctcttcagtgcatatctgttaattgtatatttggcttcctgcagtccagagtcccctggagtatgggaggacagtttgcagactgtgttccatattagctggtgaaactgcaattcgaatatcctagactgtccaggcaagaccaaacagagtcctgcacttgataatcttccctccagattagccctgaaggccaatgtgaaatccgtagctggactaactgcatttattactgaagataatctaaccaaggctcaagttccctctttgggctcttctagcgggaggaactctcagccaccctatgaacgccaagatgtgaggaagggcaacgaaagggacccctcctctgcagttccaggggcggaggtcttcagcctaaagcccagcctcgcgtcccaaggctgcataagggcgggtgcggagagggctgagaagccctgacctgcagcacccgccatcctcccagccttataccttctccagtccaactatgtcaaagccaagcacgcaagcaggtcaaaacagaacaaagtgacaatggcatggttctgccacagtctctgacacttgctcttgaatgtttgttccttccttggaggctgtgggcgcggtctctgctgtggagttcttgagagcaggtggcagagcgggtgaggtcagcgcggctgctggaggcggtgtgctgtgctcccgcagggaggagggcggcgtggaggaggcgggcgccccctgctgcccgcgcgggctcctgcaggctcccagcctttcgtaccgtggcccctgaggctttcccaggctgatgatgaatgagcccagggcccgacggaggcatccgaggcacgtgacaacccccgctctggttgtaaattgtcaggcgattcagtgaaagcgctttgcaagctgtttgtgagcaagaggcggagcagtttggctgattcagaatgggctggacacagtcaactttgcatggggagagaaacatggtctgatggctgggagcgagggcagctcgcttttgaggcagggattgctgaatgaggggagtggctttccaagttaggcgtttaggggaagaataccaactgtcagggacgaatgagagaacaggccaagcagccctggagggccaagtgaggaggcctctgttggagtgcctgaaatgtctggcttcgggaccttggattctttaaatgatgcaatctcctggcttctgcagagttgaaatcaaggcttagatccccaaaccatctgtgagcctggatacttatgcatggaagttaaagtttacagtgactctaacactgcagaggatcaagtctggatacatccactttcctggacaggccttgaaaatgctcggaaccactctttcttcccctgtgcagtggggacaagaatacaaacctctctgagatgaggaaattagagatagtgtttttaaagtgcttggtatgatacagcatgcagttggtgtttaataagtggtgtctcttctaagtccctatgaatgaaaccatgacattgtgcaatcaaggcaggaatgttcagactccaatcctgctgaaatacagaggtgatctttgccaatgaggcatcgtggagactccattacacgctccagcaagcaaacctgttatcctcagtggcccatgaccattcttgctgtcagactttgctccgtatgcactgagcccagagctgattttatctgccatgaaaagaggatgtggaacaaagaagggaacagagtttggttgcagagagaagtgtatgctccaagaaccagatgctaagatgggattaaatgtgcaaggctattattaggggagatgcctgtggcagaaaatggggagagagatggacaaggctgggcaagtcatcagatcatgatgcaaggctgatctgagtgaaggaaagagggagaaaaggtagttggacatattctaggctgccatgcagttaaggagtgttcagctagggcattgggggtcctggagccagtgtcaactgacataggacaggaatgagccttagtatctttgccatgaccagttgttggtacgtggcctcaccacaaacacagtgatggatttcagagcccagcagctgaggccgatggtcagttatgctctcatggttaaaggtcttccaggcacattctcatgacagccacgatatatttttgtaagaaattctaccaaggcaaaatatgattaagataggtagccaaaacaaacaaaaaagaaagaaaagccgcaaattcctccctgcttgctctttatgcatgctcctttgcaatgtgattttgctattagctccatcaagagatgggtctccttgaatctgagcttgaccacgtgaattgctttgaccactggagcattcacaaacatggcacaacggaggcttgaaaaatgcatgtgccttgggacttgccctctcttgttacttttggaaccagagacctccatgcaatgagcctagactagcctcctagaagatgaggacaagaagaagcagaaatcaagcaccttcccaccaccaggcatgtgagtgaggccatcctagactgtccagccccagccaagctgtcagtgaccacagagaccagctaagccaaactaaaaccgaaaggactgtgggaaaacctatagtactgtgagaaaccataaatgcttgttgttttaattcactcagttttgggacagtgtgttatgtagtaaaaactaattgatatcatttatgtccattttatagatggaggaactgaaacctggagacatgagaaagcccctcaatgaatggaagtctcaaggtgttcattggtcttcctcagagcctcctacagcaagctgggcttgatcggaaggctctgagtttgggggtagctttactcatttgtgttatttgcctaaaccctggagtctactgagatcaagacccccgaatttgatcattaataaatctcttttggatgaataatataaaggtgttaggaggcccttctaggccattgaagccactagaacagaagtcaaggaattctcaatcttcaaagcatgggaaatgaggggtacagggattctccctagcccagttagaaactccttcaggcaggacgtaaaatttatatttctcttctattcttcttcactactgtgctagtcttataagtctattgttcattcattcaacaaatacttattgagtgtgccaagaaaaaagcaaagatctttgccctcatagagtttactttctaggagggaaatagaaaataagcagaataaataagagaaatatatggtgtaccagataatgatgtgtgctaggaattaaaaataaagaggggaataggagaggaagtaccgggcagggaacattgccattctagatagggtagcctcactgataaggtgacatttgattagatagatgaaagaaagtgaaagtgggagtcacgtgagtatttgtggggagaggattccacagctagtgcagggaagctgaggccagagcctcatgaagagctcagggagcaccagaaggccagagtggcaggaggagagtgaacaaggagaagagctagtgggagacgagttcagagaggaaaaggagggcacgtcatgaagcgtcctgcagatcaaaggtgggactttgagtgaaatgaggagccatttgggacttaggagcagaggagtgacgtgatctgacaacatgttagcaggatccctctggccgctgtgtttaaaatagcccaaaaggtagcaagggcagaatcagggagaccagttaggaggtgactgcaatgaccatggacttactttgaattgcagttaaagtagaggtgtctagcccagggcccatgtgagaaggaacagtcgattaccatttattgggggaaatactggattgtgtcttttcaccagcattatggtgccggaaagaacagccaaggggacgttgcttcttgacctaaacaagttctgctttgatgatgacagtgaggcaccaaacaacagattcaacttcaccatgccatctggagtggggagcggcagcagatttttacaggatccagctggctctgggaagattgtggtcagttaatggtcattgcatcattaaaagggcatcgggaattggtccaacatgcatcatgcttttgctgccccatagagagaaatttccaaggtaaccccctctcagagcgactgtaactgacaggcttaatagtgagtctgtgttccccattcgctctttattttaccctggttccaggaatcatttgttacacatagttgtgcctgggctgctgaggactggattcttccttgcatagcatgcagtttgtgtgcctgcttagcgtgccttcacagacacgtcagtgccctctgtgctcaggcacttttgtttatttgaatgctcattcccggcccatagagctgtgaggtgagagaaagcagggccaggaccttgagtatgtctgggtaaattccacaccgtagaaccactggagaccagaggagagtgagacagtgaggatgtgtaggaagccccctccctggcaacttcaagggacaaaagctgcattggaagaaggatgggcatgaaaagtgggtcccaatgatttgagttagacctttccttacagagctactgctggaaggtggtggggaaggagaagagaaaaatgaaagggctgggaaagcagcagcctcagggagggaagccagcaacccgctacccttcccctcacccagctttcttctccacctcccatcccaagcccttcttcaatccccaagaacatctcacccagtttattcatagtaccatcttaaaaataatttctatttttttctgtttaggaaattaatacatgttctctgtagaaaatatagaaagcacagaaaagcatcaccattcactgataaccagtgttagtagtttggtacatgtccttcttttcttttttctatagatatattttatgtgtattttatacatatatgcataggtattttttatttttattatttttttaagagaccatgtctcgctctgtcacccaggctggagtgcagtggttcaatcatagctcaccacagccttgaactcctaggcccaagtgatcctcacatttcagcctccctagcagctgggactacaggagtgcgccactgtgcctggcttattttttagctttttctagagcttttctcaagctcctggtctcaggcaatcctcccacctccacctccccaagtgctgggattataggcatgagctactgtgcctagcctgcatatgaattttagatacagtagtgctcccttatccaccggggatatgttccaagacccctagtgaatgctcgaaaccacagatagtaccagaccctacatatgttatgttttttccttctatacatagatacctatggtaagtttaatttataaattaggtacggtaagtattgacaataatagtgaataataaaatagaaaaagtataacaaaatactataacaaaagttatgtgacactgggcatggtggtgcacacccatagtcccaactacttgaggctgagatgggaggatcatttgaggccacgagtttgaggctgcagtgagctatgattacacctgtgaatagccactgcacaccagcctgggcaacaaaggggacccctatctctaaaaaacaataaagaaaaccagttatgtgaatatggcttctctctctcaaaatatattatagtactgtactcactattttcagactgtggttgactccaagtaactgaaactgtcaaaagcaaaaccacagataataaggggggactactataatgaaacagccctgcatataagattcaattttgtgcttttcttcaacgaatctgaagttgtgatcctgtgctgttgagcaatagtgcttaatgaacatctttgtacatagattctgtctcctggtaaattatttccataagttcactagcagtgagcaaaggtatggtcataactttttaaagctcctaatttttatgggcaaagtgtttgccaaaagcgttttgccaatttatatatccactagcagtatatgaaaatgtctctcgcagcccaataaataggattgtttaatctgtataatctactatctctgttttaatctagctgattggtgatctagactacgaaaatccaagtaacctagcagccggcaataaatatacggtgataatccaggtgcaggatgtggcccccccttactataaaagcaagtatcattttgttttatttcatgattgtctttcttgagtatcaatgaccaaactctgctgggcaatactaggtattgtgctaggtcccccttctcactagtactgccctcatgcggggaccccctctttctcggctgaattacaacacttaagagtctttgaagggaaatgcaaatgccatcatatgacttccttggttaaagccttcgagcatctcctgtagctgtcaagttcaagttccaactctttgacttggcatacaagatttttcaccattcggttgctgcttaattctccagcttcacctcctgtcacttgcttccaagcccccatttttttccaactgggcaaacagcttgaagttttccagagtgaattatgtggttttataccttggcatttttgcatatgcctacaacaccccccaatctcctccctgccccatttgtctaattctatccttataaggctcagcttgttcattctcctggaagctgttcctactctgggttctgtagtgctctgtgtgctcatgcgcttatcaaagggtgaacaccctcggcatctaaaaggcaggagctcccatgtcttagccacctggtatcccctatgcgcaaagcctgtacacaggagattctttaaagatgttgaataaacaaatggatgagtatggatttgtgattaaatgtgtttctatttccatttttagataacgtctacgtttatatcctaacaagcccagaaaatgagtttcctctcatttttgataggccatcctatgtatttgatgtgtcagaaagaaggcccggtaagtaacagataagacacagaccagagtgctgtcaatggactccatccaaacgtgtgttctgtggagtggaaaactcccttctggaggcctcgcatgctgttttgcacagtgattcacagctgattagtatttattgcacctcttatttcttttaaattttcctcgctgctgaggagcccttcaggtgaaacttggacttttgaaaactgttggttaaactgcatttctcagaagcctctgattgcttccttgcctgtttgcctgattccgctaatcctcccttttccaggtttaagttttctcttggtctccactgtgagttttatccagctcactcagagaattaaaatttaaaaacagaaaaggtttcccatttctatatttccttcatttacaaacaaaataaaggcattttctctctcccctactaagattccctgaaggccttcttttctgccctttacaacaccctgctttttgcaggctcctccccctttaaggaaaagactcactccccacttccagcttcactttctgcctccctctcgctctctcagtttgaaggtaatactataaatgctctagtgtaatagactccccacagccgttcatctttagatcatggatactttttccatattaaaaacaacaacaacaaatgaaaccaaaaccaaaacgctccctctaaaatgatccattctctttaggatggtctccatttcctgacattaagttttcaagcaaaatgcaaaatgcaagtccaaagaaaatgcttttaatttcttataccttatccagtgaataacaaattcgaaaggaataggctttctgggaattcacagatcttactgcagttctttttgatcacctactttgggttacaaacttagtgctgggatacagaattgaaaaagagaaggttctgcccttgaggagtgtaatttatgagaaggaactcctacaaaacaagccagaatgctagcagacccaccaacaatatttgtaaaaattgcaaaatggaagaggatttaaaaatctataatctgtaatcatcaattactaaattctttaacaattatttatttttaaaagagcaattcatgctcattatagaaaattgaaaaacacgggacttttagacaatactgctgcaaagagatgtatgtgtgaggttgtatgttctttgtactattgtttctgatagcaaaatgattagtgtccctggagcctatataaaggcataaattgctgggcatggtggctgacgactataatcctagcactttgggaggccgagctgggcggatcacttgaggtcaggagatcgaaaccagcctggccgacatggtgaaaccccatctcttctaaaaatacaaaaagattagccaggtgtggtcgtgggcacctgtaatcccagctacttgggaggctgaggcaggagaattgcttgaacccaggaagtggaggttgcaatgagccgagatcgcaccactgcactccagcctgggcgacagagtgagactccgtcacacacagacacacacacacacacacacacacacacacacacacacacacacaaagatataaattgtctattacacctcacaggactgcttggatcatagggtcagttacctagcgggtgttggttagcattatttcaatttagtagaattgaagctataaaacagagtttggacagcaaggaggcctccagaagtccttcttaccatggcagttaggacatctgttcctgaatcatccttctctaccccttaaaagcaggacttattgcaggtactttattcctccagccagaacccgagtgggacaggtgcgagccactgataaagacctcccccagagcagcctcctgtactccatctccactggaggggccagcctccagtatccaaatgtattttggattaatcccaagacaggagaactccagctggtaactaaagtggactgtgaaacaacccccatctatattctcagaatccaggccaccaacaacgaagacacaagctctgtcactgtgagtggtgctgcttggtatagtgccggtaacccaactggttgacttagggtctctctggcacccccagagtgtggatgtggcaatgaggaaacttcccagggtacatcctgcggatgtggtgagaaacaagtaaaggtgccctgggaaataaagatccacatttttcttttttcgtttttgaggcagggtctcgctctgttgcccaggatggagtacagtggtgtaaccttggctcactgcaacttccacctcctgggcttaagcgattctcgtgcctcagcctctcaagtagctgggattgcaagtgtgcaccaccgtgcgcagctaatttttgtatttttagtagagacgggtttctccatgttggccaggctggtctcgaactcctgacctcaagtaatccactcgcctcagcctctcaaagtgctaggattataggcgtgagccactgcacccagccccatatttttttgaggcccaagtttgcgggtgactgacaaaagcactaaagttgttggccagatattagaatgtctggtggacccacaaagccactttgtgggacaaggttcctcttgtggccctgtaaatcttgctttgccttcactgaaggctgttggtgaaatgcacacttcctagaagttgagtgtggttttggagttatgcatttcctccccaggagcagttatgccgtgttcctaccctgcctctatgcataccagatggggtagatcttaaaacgatgctgtgctgctatcttgcttcccaacctttgaggctgagaatgttgttacaggcagattctgagtcagagggtctggggcctgagattctgcatttctgacgtgcttccaagtggggcggcgctgctggtcccctgccacacctcgagttgcagggacctaataggtccatgttgtcagtggtttggattatccaagggcaacatgatagccacaaagaccaaactattccctggtccttcccattagtaaagtaaaaaagcgtgaaggcaaaatgaactctcagttagcagcaggcagccatagacaaagattggttcagagtcaggagaccgagttcatttttcaactttgatcccaattttccgagggagtctgagcaatgcttatctccgtgtccatatttctctatctcttaaacggagagtcacctgataaccccaatgcctgaatagtccgcttcctccgataacttgctttgaattaatgggatgatgtttttaatgatgtgcaaggtttggcattgctacccaaggaaagttggagataattgcagtgtttgttaggctgtttttttttttttttaaagaaaatgaatggactccactctgggggctaactagagtgaacatttcaatttattcccgggctcagaaatagctgaaatcccaaatttcaaaggtagtatgaatatgactcaaaattcataagctttttaaaaggggtgatgaactaaacgatcacacaagtccctttcagggctgacattctatgattctgtgctggcaggcatcccaggctatattccaatttaccaggcataaaagacagcgatgaaagagaataggctggcccctgcttatggcaggttagctctagggcttagtacagtgctaatagcccaggttacagatgagatcccagcttaaccaggcctgcttgttctgtcccagtgagtcttagccctggctgcatattagaatcagctagggaacatcaatgagggccctgacccccaccctccaatctattggttctgaagtgggcccaagaaagcagagccagggctgagaaccatttctgcatatgccagagttaaagaagttccatttacaaggggcagcaggcaaggtggcacatggagacaccgtaaatccacaccttcctggaaaaacaactcggtgtcatctgcaggtgagcctatgtgtccaggtgcatgtgtgtgtgtgtggggggggggcaaggtatacatacactaaatgtgcacacacacatgcatatggtgtagaagttaatagcataggatttggagtaggacagacctgaattcaaatcccaactctgccattcactagctgaatgatcttagatcaattacctagtctctctaaacttccattttctcaccataaaatgggaataatcatgttagctatctcatgtgagtttaaatgagctaatttatgaaaagtgcttagcctgaaaactgcctacacacagtaagcactcaatgagttttagctattgagaatgaccaccttcttgctactctaggttactgtgaacatccttgaagaaaatgatgaaaagccaatttgtactccaaactcttatttcctggccctcccagtggatctgaaagttggcacaaatattcagaatttcaagctgacatgtaccgaccttgattccagccccagatctttccgttattccattggcccaggtatagtacttggtgtcgacaatcctggccctgtctctgaggaccctgaagttgtctagggtaggggtctgtgctcacacactgatctgggcaaagtgggatgggagttgggagggcattatttttttgagatagggtcttgctatgctgcctaggctagttttgaacccctgggctcaagtaatcctcctgctcagcctcccaagtagctgagactacaggcatgcctcattgcacccagcttgctggggaagtatttgaatgaggaaagcagagacacaaaatctagcagcccctatgcttcctggcactcctctcagtttccccttcttgtcttactcctcccagaccccatacgtgactgcccaaaggcccaagaaaagggtgaaccccccaattcctgactacagtatgagtcataaagcatattagtgttgttagaaaaaatgcagtccaacttttcgaccacctcttttcctgaaagctggtagtgggggcagggaatcccagtcctctctctggataataatagattaaatagattaagtgcgttttgaaacgtgtcctcaggaattctcttctgctccattcatcttctgtctttaaaaatataccatcgtagggaaaaaagagcacccctcaatggaaattagaccaaaatagctcatctaatgaagtgctggggccagagatttaaacccaaacaagcagaacaattccacgtgagagagtaaaaatccatccctgctgcctgctgtgcccttggccgagcaggaacttgaacagtaggaagcctctcgagctggctgtgtcacaaaacccaggggcagaaactgcctcgagactgcagttgccgaagatggaaacaatccatactgagagccctaaggcctttatggagcattttgctgttaagggagcaaaaattgcatcatctcctgctccatttactggtgttcagtcggtaatgagtctggagccagtggaggaatgagcgggcatgtgcttgggctggcagcctctctgccccaggctccctgagctgagccatgagccccagcagagctgtgtgtgtgtttgggggtgtgatggggtgggttcaggaggacctgggactgcaattcccgcaaagccaggaggcaccttcctttggaggactccagggacagccataaccagtgtgacccactgggtcctgtgaaaagcatgcagtgaacttggcctatggctagggatgtgacctattctaccctcttgaaacccactcatttgtttgagtgtgaattacacgtgttgttaccaaataattgccggatgagaaatcagaaggggctgcaccagggttacaaagtctctgcttaatactcagcaagatggcacctaggctaagggtgttgtactattgtccttttctactcagccttgtttgcagccacactggttgtgagcaagagtttctttgtactaatgccatctctggtgcagttaaagcctgtagcatataactaatccagctctggtgtatcagagacacagtctacacttgaggtgtggacatttgagaaaaagattgaatgcagttttcttctaaacctttatttcttactctcttttcttccttttaccaacacccctgcatcaaatctcatttaggtaacgtcaacaatcatttcaccttctctcccaatgctggttccaatgtcacacgcctgctgcttacatctcgctttgactatgctggtgggtttgataagatctgggactacaagctacttgtctacgtaactgatgacaacttgatgtctgacaggaagaaagcggaggctcttgttgagacaggaacagtgacactgagtattaaagtcattccccacccaaccactatcatcaccacgacccccagggtaagggctttaggacctggaatccccaggcacattcccttgtgagttatgttgatggacttctttccccggcctggaggtatgtggggtggactgaagagttgaggtattaggatgttgccaaaaatggcaaccatgggctggactggagtagctgcagggtggcaaaaatctggtgagacctcagactcataaccgctaactcaaccactaacatttcctgttctggtagagaagagtgtgttgtttgtgcagagacttgtgagagatcagacctcaaccatctgtgtggcttgtggcacaggagctgatttccatgggcatgctgccagttgctaccttcacaacccctctctgcttgttcagaagagtctttgcaagtcaatatccatgaaattaggttgcttgcttactgctgggtgctctttcccacatcttttgaagaatcaccaggtaccaatctgtaccctacaccccacctccgctccaaaaaaattcatccaatctacaaatatcgatttaatgcctatagtgtgccagtcactttagcaaacaagccaaaaatgatccctgctctcagaaagcttattgtataggcgagtgattctctaagtgcggtccctagaccatcagaatcagcaccacctggaaactggttggaaatgcaaattctcaggcccagcctagattattaaagttataggttacccaaccatgatcatcaccatgacctccagggaaggatgctggaacctggaatccccaactctatcccctaacctaatgaatccgaagctctggaggtggggtccagtgagctgtgttttcaatcagcctttcagggaattctaatgtgcattaaagtctgagagccactgatctagagggggagatagattacaaacaagtattcaaattgacaaagtaaatacagactgtgggaaagggtaggaagaaaatgaccaggtgctatcacagaattggcctggagaaggaagggagagccttgaatctgacaacaggattatcttccctgccccttggaggaactggcttgcatctatgctgactcatctgtcccctttcttcctcctcctcttcctcctcctcctcctcctcctagtagaagctgcacccctggtcagcagcctgatacctgcagcatgccagaaggaagataatcagaaccttagagaacccactatggaggtggccagcttcttctcagagtcttgccaggagctggttcatgcttctctctcccatgctcgagtcaatatgaccccagtgaatggaggcatatggcaaccctaggactttccttgtgggaggagctggtaggctctcctgagtgaggagttcccacctttcttgggctcagagcatgacctgattgtgacatctccaatcctgaaacctccgtaacttgtttgttatctgtctccagctctaggaagcagatgctgaacttgaggctttgctgtgatatcagcccactgctctggcagtggcagcttgtagttgagaaaacactgaaaagcctacaaggcatttaaaaaaacaactttcgtggcttatgctgtctcggtgagagacaatggctatattcgtccctgggttatgcccagatatggcagaaaaaaagccaatggagttttttttagctttggggaaggggaagacagagaataaaataaggcctagagttgtttttcagttccctaaaatttctgggttttgatctaatggatgtctgcaaagactataaataaggtgatgggttgaagcagcaagaactgtgagcacacagatgtccaacttatagagcaataacaataacaaagagtggaataaacactcaacacgagagagtgctgaatgtcaaaatcactaccaccctctactcaccctccctgctctctgttgttcaagcccagggtcacctatcaggtcctgaggaaaaacgtttactctccatctgcatggtacgtgccgtttgtcatcactttgggctccatattgcttctgggtctcctcgtgtacctggtcgtcctattggccaaagccatccacagacactgcccctgcaagactgggaagaacaaggaacctctgtaagttgccagtgggctgggccctcttccccacctcctttaggacactgtttctggtgacatcaggagaaggaaaaatggagaatcaggatttctctacaaggcaggttgcctggagtgaaggcaggaaaaggagatacgggggaaggaatcccagctcccctcggtcctggtgcactttctttgtcacctgctaggccaggaaaccatccttttggctttccctggcaacctactctgtccttgaggctcttaataagactggggcatcaaccttctgatgaccttgccctggataaaatcttcagcaaagccctgttgtaaatagcgatagaatatgccgtgctcttatttgtagaatatttaaaggatagtatggaattaaggcaagcacacaaaaccaataagggaattaagcttttgtctccagtgactcagccgggtttttgtgtgaccaaataattcttggtgttttgcttgtggtctcagtctctcactcttaagggttgtaaacgcaggcctgttttctctttttccagttttcagctgcccactaatatgcctcttattgtgccaatctgtgatgtgtcttttactggctaaagtgaggtagtagagtgacgtgaagagagcaccaaagaatcacaaacttctcccagagccaagctccttgattctcagtagctcttacaacttacagcttagatggttctgagcctgagttttggagttagatgggcctgagctcaagtcttagctctaccattttcttggaatatggctttgagcaagtgaccacctctgtgaacttgaattttcttatttgtaaaattaatcaactaaatgaacaaatgtaaacaaggcacttaactgtattcctgatatagagtaaatgcttagtacactacccagccagtttttacaaatcttgtttcattattcttcacagatgagtcccaatgagttcaggattctagattccaagtttagctctatgcccaagtatcttgaggtgttggaacctctgagttctaggatctctcaatggcaaaaagagggggtgataagacatgtgtgccttttacgggtattttaaatattaaatattaactgtcaaataagaaaatctatggatgaaagactgtataaaagtacaaggcattagaataaagatgtgcgttgcattttgccatatttattgcggaagtttgttgctattggcaaccttgacttcaaggtaagaaatcctcgagcatctgctgaaattaaaaaaggcatttttgtttgaactctattcacaaattgatttttttaaaaaaaaacagctctaaaagagtaattgcttgtaaggatggtggtgtactgtactgggatttggatagaagttcttgaagaaacaaatccaatagacactgcaactctcatgtaatttatggctaaacgttaaatatgcaccttgaacctggttcttttaacttatgttgtaaatattaattgttttcaacatggttgacttaaaaaagaaaaactagctagaaaaccagactcagactcaacctctctggaaattagttataccatatgacagccaactttgtcaaatagcaaagaagaaaattagggttacagagctatagaatccaaggtgatcatgggaaatctcgtagggtctgagtccagctcttcatgtgacaggaaaccaaaatgtaactgccagctctcaaacctccctgttgtgagccaagccttctgctctgctggctcttggggagaaagggatagggcaagaagactcgctggacagtctgactagggcaggcatgtcctcaccaggttttctcatcagaaacaatgtattccctgaagtttataaggtgatacttttcaactcatcaaattcccagaacctccctagtccaaagccaatagtgatgaagctgctttgttcgaagcaggcgtggtgatctagttttctttctggcccctatccctggcacctctttcagtcaacccctgtatctcaaagggcatagttgcccaaagaaccccatggtgtcatgtgtgtgccagtgcagcatactttcaagtgaattaatagccattctttttccccccataggacaaagaaaggaggtatgtacagtacctgtttcccttgtctgttgttttttgcttgctctgttgtgctacgtaaaaaggttcctactcggcaaagaatcaggccgcgatcacatcttggagcattttcagctgcatcttctgtggctggaaggaagcggaggtcggttgcagctggagaatgggaagggtggggggacagtgccttggcctgcctggatatctcaatttggtcctgcctatgccctacctagagccctcgccaatcagctcagctgaacacctaggtctgtcccttgctgcatggcacaggaagaaagaactctccgtgtgttaaatgtagacaggacctgcttactgcagcccatggagggtgtcctgaggacagctaatgctttgtgctggacacaggcctcttttgaaagaacagataaggctgggcgcagtgactcacgcctgtaatcccagcactttgagaggacgaggtgggtggatcacaaggtcaggagtttgagaccagcctggccagcatggtgaaacccccgtctctactaaaaatacaaaaaattagccgggcatggtggcacgcacctgtagtcccagctactcgggaggctgaggcaggagaattgcttgaacccagcaggtggaggttgctgtcagccaagatcacgccactgcactccagactgggcgacatagtgagactctgtctcaaaaaaaaaaaaaagaacagataatatttgattcccagattctaatggatttgatcatttccacaaattatttaggttagactagtgagaagggggagatgagggtggtgagatgggctgagagctgactgacttcagagaagtgggtaaattgggaaggtccatctgagcagctccaggtctgaggaggtgtcctggcttggcctcaagtagactccagagtgtgggggagacaggacaaagaattggacagtgttttaattaaaaaaaaaaaaagtttgctttaatcactccatctacaggcatgtgtctgacatgcttaaggcatgtctcaacagggttagaaatttgattatagtggttattgatcatattgacagagatgattttaataaatgagattttcacaaactgtctctaatcccactttttaaaaaggggatgggggctgggcatggtggctcacacttataatcccagcactctgggaggccaaggctagaggatcacttgagcccagaagttcgagaccagcttgggcaagatagtgaaaccctgtctgtagaaaaaaaatttttaaattagctgggtgtggtagtgtacgcctgtagtcttagctactggggagatagctgagaggatcacttgagctcaagaggtcaaggctgcagcgagttgtgaccgcactctagcctggacgacaagagtgagaccctgtcttaaaataaaataaaataaaataaaataaaataaaataaaataaaataaaataaaataaaataaaagggcttgggaattaatgcacaaaacccacaccttatgaacagaggtatccaatcccatctttctttcttatcttaaaagccatgtaaaagccagttttctaggtccactgataataagctagaaaaagaataaaaaacaactaaattgttcgtatgttattgtgtgtgtgtgtatacatatgtgtacgtatttttttctgagaagatggaaagttgtcaagaaacatatctatagacagaacaattctttgctgtgtctgcaagactgagatcgaagcctatttaggggaaataccgttgtggaggtggaattttaaggtcaatttaccacccaagaagcttaacttctgcctgttctgttctctgcagaaacgaagactgcagagagagacgtcgtggtggtgagtatgggcagtgtggggcaccaggcatagacgctgggggataggggctcccgtctcccccgaaggcaggcctgccacagccttgtgggcatgtttatcattcagggaggtgcttgtgtttggctactggaacagattgctgtgtgacgagctcctgatagaatttgttccctccactgaacatgcctgctgatatatttgcagaagaacaggatttcataaatattgagtagtggtgtttattatctataccagctctccacgagagtgagttgagggagtgaagcttaaagaccaaaactagtgcttcagcctccagtgagatttaaattttctttctttctttctttctttctttctttctttctttctttctttctttctttctttctttctttctttctttctttttaagacacagtttcactctgttgctcaggctggagtggagtagcacaatctcggctcactgcaacctctgcctcctagactcaagcgattctcatgcctcggcctcccaagtagctgggattacagacacgtgccaccacgcctggctaattttttgtattattagtagagatggggtttcaccatgttggccaggctggtcttgaactcctgacctcaagtgatccacccactgtggcctcccaaagtgctgggattataggcatgagccactgcgcccagctgatttaaactttctttgctcttccactaccttgcagaaaagtgacagagaaagggccctccctggtccggggttggctctacccacttagccttatcacctcggggacttccttggcctctctgagctttaggttcctcacctgtaaaatgggggtgaggatatctgccctgagataacagatggagaaatagtttgaaaattgttaagtgtcacacaaatgcaaagtgttacaggatagctggaaagttccctctcctccacctctgtctctctctctctctctctctctctctctctttgacagaaccttatctaccccctgggaagtgaagtgaaggaacttgaaggtggctccctccagctcttccctacccccacgaataaggctttgtcatggtccaagcttcatgaatttgttgcataattcaatggctcctccaatgaggaagtcagtgcagggcactggaattttggcttcaggcacatccatcccctaagtcttctatgttctggccagtgtacaaacaggaaaagaggcagtctcaggtctcctgggtcttattgtctaaggcgagtacccttggggatgccacttagcgattgctctagaactatgtaatattaaattagtctattaaataaatacctatgaccacaaacagtggggctgcttagctggtcaaattgatgaaggccatataatccccatttcctctctcttcagagttggggagttgtggggaactaggtaggggatcctttaagtgataaaaactggagattggaaagcttgctaaactccaaacacaatccttgttactgtgctagtgaccctgactttggcacctctagagggcagcatgtgagggaagggggtgtttctatggggacaagggacaggtgcattaggcagaagtcaggtcctggagggtggcaccaaggacagatcagggaagagaaaagacctggagcacagggcttaggtgaggcccagatgcgacactgcattggcctaggcaaggggaggccgcaggggagggccagagtgccagggccagaggtacggacacctgggagctcacctgtgtccaccttgacaatgcctgacagcaattcactgacacaacgtaggtcttagccatgctgtgtggcatttccactcttccttctacgctcagattttatttactcaggatgcttccttaacccccaagtgtggtttaaatgtcccctctacccctacctgtgccccataacaccctatatctccccatcatagccttattactctgcattgcagcacctgtttgtaattggcaagctttgtacaggcagtgactatgcctgccttgttcatcactgtgtcccctgcatctatcacagtgcctaattaaagacttagaagtcaagaaggctttggttaaggaacttgggttgtgaggatgtgtagctttgcctgggggaaggaatgtaggattgtgtttgatgctgtctctgtcttctccttaggaaactatccagatgaacactatctttgatggagaagccatagatccaggtaattaagtggcaataccactgtaagaatgctttttatattccagactggtagaagcatggaggatcttatccaatttcctgcttttagctcattttgtcaatccgtttggctatgttgcctatatagtgctgactcttctaggctaaatacaacgtgagatcagctgtgaacccagctggctagcagatgctcaagtacagggtcacacttacgtgaggcctcagtgggtctccacctaaaggctcacgttcaagggccatgcctctttcttgcctcccttcctaaattacaaaccagttgagggaactggtgaatccaggaatccacattttttttcctgctgtttggtactgattgccccccccagcccatccacattcttcctggatgcttctaatagcacttattagtagtggaagatacagagaaatggcaagtgtagtttcttttttccctagatcagggccaagaatttcctcttggtcggcaagatgaacataaggtagagctggcctccagagctctcatcacccccgtgaaatcagctccaaatttagctcctttacactcatccctctgcttacaaaggctcaattatagacgtgaataaagggaaggaaaccaaattcaggaggcaagtgtgttggcttcctgccaccctcatatgcaaacggcaccggtcctcctcctaaggaggatggctcctctccagtgagaggctgccgccgccgctgctgctgctgctggaattaaatttccctctattattaggtgcttgttaccataatgtgcccacattagcataagtgctggtgggatcctgagctgagaggccactcatgctgtatggaaaagacaaggagcaagggcttgccttaaacctgatcttccagagcaaaaggctcttccagagcaaaaggggggatttttgtgtttttgtgtagttgagagaaaaaaaaaaaaagaaagacatgagccaactggcctaagtcaattagtgtctgctggctcggacacaataaaaatggcttccttgtatcatctcaagcgggaccagatttttgtatctgtgtctacaaattgctgctaacctaacataaataaaaatcagccttttccttctcacttggtgaattcctttttatagcaggaattcaggggtcttttaaaacaaacaaaatgaatcagaaagtaacgggtaatcccattagagattgaacctaatttatccaaagcttgcatggagttcaagagttacatggccttctcatcctgcaattgagatgtccttgagacgctcctaagcctttctatccagagaggtttgctgtttgctacctgtgtggtccgagcagcacggcttgtggcaagggcaggctggtggagattgtggggctattcacacacctactgtctgtgtcagtgattcacaccttctagtgtgcttcatcttcccttgggagtcagaacagagcagggtagaagtgggggaagagacagtcattggaattttctggcttatgtgattgttgtatttttttttcactagtgaccggggaaacatatgaattcaactcaaaaactggagccagaaagtggaaagatccactaacccaaatgccaaaatggaaagagtccagccaccagggagctgccccacgcagagtcactgctggggaagggatggggtcactgagaagtgccaactgggaagaagatgagctgagtggcaaagcgtgggctgaggatgctggtctgggttccagaaatgagggtggcaagctgggcaacccaaagaacagaaatccagccttcatgaacagggcttaccccaaaccacacccaggaaagtaaacggggtctaaggaggggcctgtcaatcactgagatgctgcctcaccctaaattctatggggatggtgtgggcatggtgtaggggggaaaatgtgggctgaggggattcagacatccagggtcaaacatgggatgtttgacaaatttttaaacaaatagaaaggggtttgatcacatagttgcgtgttctgaaatgatacaggaacattttctatcagatttcagaactacctgtgcttctgataagcaagactgttaactttggggtgtggaattgttgtgtttcttctttgcattgactgctaggaagctctattctgttcaccatagaaagtttgtaggaattcctgacataaatagtgaagactatccttacatctggtttccaccttattttcctgccctcgttttaacatcacccagatttcttcagttataaatatgccatacacctttgtaagtcacctcaaatcttcttcaaaagaagcagaacagtgaaaaaaacagatgagtaagttaagagttggtcatctggaaagaagaaaactcagtaggcaccttcttttgttttttcttgtggtgtccggatcagcatcctgcatgtgagattcatccacgttgtcctgtctagcagtagttcagttctcttcatggttatgtctggtttcattctatgattatatcacaatttatctattctacacttgggtggcagctgcttcagattttttacttttaaaaaatatacttaaaagtgaactacaggcagggcatgatggctcatgcctgtaatgccagcactttgccaaggtgggcagatcacctaaggtcaggagttcaagatcagcctggcctagatggcaaaaccctgtctctactaaaaaatacaaaaattagcttggtgtggtggtgggcacatgtaatcccagctacttgggaggctgaggtagggagaactgcttaaacctgagaggtggaggttacagtgagttgagattgtgccactgcactctagcctgggtgacaaagcaagactccatctcagaaaaaaaaaataaaagtgaattacaacactatgaactttcttgtacatgtcttttggtgaacataaacactcacttttttgctcatatatctaagagtgggattgctggagcaattgctggatctgccaaagagttccaaagtggtggctctgattcacattccagcagcaaacactgagagttgcaattgctctctatccttgccaacacttgggattgtcaatccttttaactttagccattctggttaaaattactattgaagtgaaatcactttttcctcaaagctgaaacaccatcagccttacaacctacctgccttgctccttcccacttcctatgattggaaggaactgcaggactctgagtggggacatactggaagccccatctagacataaaactcagacttccacctgtaggcatgagcaatgaactgggaataaatggtattatgatggaataggaaatgtaactttccaatgtgtgcctagcagagcctgagcaagcttcactcgagctctatgccctgctgcccagctgctgcgaccctagtccagtaaccctaagaaaggtccaggtgagtgttcattagggaagcactcccttcccaactggggagtcaggtgagagcctaccaggtccacaaggtcctgtgggagacagactggatccagcaaatgtagagcttcagagagagcagcagcttgtttactgtgtgcctagtgccagtgtcacttctcaagcaaaagaagcatttgcaaaatgcctgtcctggcctagattgagcgtgatttattaataagggttggttgccagggaactcccttgaatggatttaaactttgcaaaagaaggcagaactgttcatttatgcaggttaaagtgagtgaagtggctgattgcccatttaaggcattgcaaatctgtggggcccggagtcaaatgctttccttggaagctctcagcttcaatgcaagtaaaatgaggttctgagaaggctgaagggggacttaataactgcttataagcccattaagaatgattaaaagggccgggtgaggtggctcatgcctgtaatcccagcactctgggaggctgaggcaggtggatcacctgaggtcaggagtttgagaccagcctggccaacatggtgaaaccctgtctctactaaaaaatagaaaaattagctggacgtgttagcaggcacctgtaatcccagctactcaggaggctgaggcaagagaatcgcttgaacccaggaggcagaagttgcagtgggctgagattgcgccactgcactccagcctgggtgacaagggcaaaactctgtgtcaagaaaaaaaaaaaaaaaagaataattaaaaggagagagtggtgagcagctggtctttcttctccagtgatgacagggcaagagggaattgtgcttaatggccagagaagagatttaagtcaggcaccaagagggacttcctgaagcctggggcctctctgaagagctcagtgtcttctctggtgataggcaggaagagctgagtgtcttcctagtcgcaaggcaagcctcgagaaactcaagaaataggggcaagagtgcgccaggaggagagaacacctgctgccccgtttcttttgtatatccggctatttggttcggggaaatccagaagtcaaagtgtcaccggtggagggtcttgactgcaagttgtccaagttcttggagttttgaacaaagaatggaacaaaatgcccagcaaagcagagaaagaatgaggcaacgaaagaatgaaagcagggatttattgaaaaccaaagtacactccacagtgtgggaacgggcctgagcaagtgactcaagggcccagatacagtcttctcagtccaaataccccttggaggtttccccttggccacttcatgctcacctcatggaaatgaagtagtggaccacaattggtctgattggttgcaggaagcaaccaatcagagactgaagtggagttacaaaggtcacgctcctgtgcaaacatctgattggttgcaaaaagcaaccaatcagaggctaaggtgaagttacaacgttgcaacgaagactcggctggcaatcagtctgattggttacagacagccaatttcccagcgttgaccaggttttggggggaacaaaattatctgaataaaatgaagacagcaaccgtcgtggatttggtgaaagttttctcccatctccctctcaaggccttaaacaggtatgagttgattatagccaatgtttacttttctcattctgattcattataaaactggggtaaatacgttcaggaattagaccacgtaacaattataattgtcgaagactttgaaactgcatagtagattgtgacattggagctttttgttgtgctcattagaaagcagggtctgaaactcagcctgtgtagcaagcacgggtggctcacaagcagaactgggaaatgacacttctgctccccagagccccctttcacatctggggttctcattgtttgcctttttacttaatgtattttgtaatggctgtgaaaattaagctacaaaatgagtgaacattgaagacaatgattgctattgaaacttaggatttctcatttcaaacttagcgtgtgtttatccttcgtattcattcaataaatatctgtggagcaactaccatgtgccaagcgttgactcattaggaaacacagcagctcccatccctgcccttgagcagcctccattctgtttctacagctgaatgtggcctgctgataagctattccacagagttctagttccagctgcatcctggcctatttgctccttggatccttgagtgttcgacttgaaagataaattagccaggaataaaatccctggaatgtttccccagaggaacagataattcagaaccttaaaaaaaaaaaaaagcagaaagcccttgtcagaaaatagttgagatgtccaagtagggctcccagttttgcgctatcaggacagtagactgttaatgcacctccacatggcagctctgaggcagtgtgacctctgtgtgcagaatatgaaagaaacctgacatcagtgagatatttgatttggagttcagggcaaaggtccaaaatggggagtgggggagattcccatcacccctggaccctcctatgtgtcacctgcactgggggcaaggtgtggctctggctctcagggaataacccaactgagaagataatcagctcattcaaaaaacaaccggttgccacacaggccctttctgagaggagctaaatgagctccacatgcagtgagtgctggagaaactagacatgggcccacacagcctctgaaagaataatgggcctggaacctgcagtggtgttataggtggagttgaatttaaagtcgaagagaaatttggaggaaaggcaaaagcatttagaatcctggttgtcaatccattttcagctaatactcgtcttgtgtaacctggagtggcctaacacagaacctcctggatatgtagcaagcactcaacaaacatttatagaactggattgaatgaagcaggcttgtggttggccttttttccacatcatgtagcaaaatcacaacttttctaactagagctagataaacatgatcataatcaacaacagatagtttctgagtacctgctaggtaactggcactattctaggctctggggatacaacagtaaataaaacagtattcttagtgtttatattctaatgaggtataaaagactgaacatacaacagaaccacagagagatggctggactctatataaaaacagaacactgccccacagcctgcagcagggaacctgcccaggaaacccactcccttatctatagttattatagataattaattataatgaacaacgcacgaagccagcctgctatcagacttgcaggaggccagactgctatctctagtgacaatctaggaagctaaacaacccatgtaccaatgggccccaaatggccagaacttggttaataactgatagcttccctatttttgtccccgagtcctaattaggacccatcacagaaagccaaatatgcaccctaaccaatcacataggctgccctgcctctagcccacctccagcttcctcctgccaacagcctgtaagcagggctcacctgaagccttccccggtttccaccatgaagctctccctctcctctgcctgcctttgggcctctcgccaaaggcaagtgccagttgctgactcccttaatatagcaagctcggaataaatggccctcgctttatcatagggttggtctttgtttattcccactgagatgatagacaaacaggttagatatatacatatatgatatcctagatataagtgtgtgtgtgtgtgtatatatatatatatatatatatatatatatatatatatatatatatatatgatatgtgaatggtgttaagtgccattaagaaaaataaacagggtcaggggttatggaggatggccactttaaacaggtggccaaggaaggcccctgtggtaaggggagattcaagcggtggatgtgtgggcaggggctgtgcagataactgggaagaaccttccaggcagtgagtgcaaggcaacgtgaagtggaggaacagcaggaggaacagagtgatgagcatgaggctggaggacaggacttcagagaggggtcggtggggaggcaggggcggatgagtgtgtgtgtgtggtggtgagtgggggtgtgtgggctgggggatatgtgtggagaggagtttgcatatcacatagggccttgtaggccactgtaaggacttcggcttttactctgagtatgatgggagccattgcatggtgttgagcagaggagtgacataacttacttatgttttgaaagcatctgtctgctgatttgagaagagacttaaggaagggagagaacaagggtagaagtagaaagaccagctctgtagctgttggattcatccagatatgagatggtgggggctgggtccaggggggcagaggtggaggacagtagaaaccttgtggtacctttgtgaaggagtgtcccggatatgaatgaagtcctgagttctcttgagccctgttcctgtatgagatcaaggctccccagcaggcatgagcccctccctcagtggaagctaccagacaaagtcattttagataatactgagcggctctcccgagtgtgactgccccatgcttggtctgcagcgggggaatggtagtcatgtgtgcacacataggtgtgtggggagagtgaagagaccggtcagtgttccggccacatcacacttcccggcaagattccagtcgatgacccaaggaaacaggaaacaggcctgcagggtgatttcgaggtctggactctatgccccgctgtgaaggtggttgtaggcagccctcaagctgaacggtgcattcgattggctctcagtctgaaaaagtacagttctgattaaacgtcaggagacctgaattgtaggaaactctaacttctgtctaggactccccagagagttgaagttcttagaaaacttgtctgtttgggggaacagaaggagatgaatgtgttctggaaaaccggagccttatgcccaaatttttggagacggatatcacttaaaatggtgcatcccactgtccccatgggtacaaaccatacaatcagttctgatgcctggtttggaaaacgtgatccccgtcagtgttgaaaccgaagcagagcatgctcgtaaactctgattttccccatgtgactgcgagctgggctatccgggtgaggctggcctagggcctggagtgagcattgtggatgcttacgctctaggccacagcgccctcagcagccttttcattagggtggtgttcagagacagactgtggctgctgcagccccttcagaacccggggcagctgagggagagaagccgcttaatctgatttataggcaaggctcacaagagttgcactccctgcatggcccacctcatttgctggtccatggtcaaagcacactccagctggcaggctaagggtcctttttaaaataacagttttattgtgatttaactcacatgccatagaattcagtggtttttagatattcacggagttgtgcaaccaccactgctatgtaattccaaaacattttcatcatccccaaaataaacttcacgcacattaacagtcattccccatccccaggcactggcaccgctgaactgctttctctctctatggatttgcctatactggacatttcatagaaatggaatcatacaatgtttgtccttttgtgtctggcttatttcagttagcataatcttttcaagattcatccacatggtaggtccatacattcatttttatggctgaataatggcccactgcatggatataccacattttatttatccattcatcagttgatgatatttgggttgtttccatcttctggctgctataaataatgctgccatgagcatttgcatacaagttcttctgtggacatttgttcttatttcctaggtatatacctaggaatggagttactgggtgatgtggtaactctatatttaccttgttgaccaactgccaggctgctttccaccatggctgcaccattttaaatttccaccagcaatgctcaagggtttcatgagcttttcaaacagacaagtgaggcaccctttgctcaggttgcagtgtcgggctttcagcccttcccagcttctgtctgctttggtttgaggagtctgatctggcgtgctggcacacctcgctgaggttagcagcaacagctcctgctgcaccttagcagcctgcagagaagtctctggaaacctcatgattgcagtgcgtgcctaccacaagcgggccctccacctgcaccatctataatcctcatggcacgcctctgagaatggtctgcatcttgaagatcatatccactttacagatgagaaagctgaaggttggagagattaggagacttgtccagaggtcacagagccaggatggcaactgagtgtgtctcctctgagcctaggcaggaagggcttagtgatggcctttgatttgtgttctgatgggaaaaggggtcaggtgactggacccccagatggatcctcttgctgaacagctctctaccctgaaagtccaaggctgctcatggctgcagaaatcttcacaggttcagagtcaacaccagcctctgcaggagcaatgtgttctgagcatatcctgtcttttgaggcttgagttaggggtctgaaaccacccctggcctcctgcaaccctgccaagcccagcgcactgctttgggcaatgcaggaggcaatgtttattcttttctctgttcttcacacacccactacctatctgctgctccacagaagcagcctcatcctggctatgagtactgaagtgccttccaagcagagatcctaatcactcaggaacagcctctacccaaaggctgaggggctgcagtgatctatgttggccagcaggggcgtggcctctctatttgccatttagcgtccagtgaatggtccaggaacacctctggtaaaagactactctcccttctctccaccttctcccgagcctttcagggtatgtgtcctcaatgcctgcagagagcagccacagggcatcctgggccaagattccaccctgtggccaccgcaaaaaaccacagcagcaatgtggtagcttgaaaccagggaatgtggcggcaccaagccttctggaggaaggagtgagtggctgctccacccacaagtggccttttcccaaagggtccaggacagctatcctggcattttgccaagcaaactatggccactgaccaagacagcacccagttgggttcagaacaggtcgatcactgctgacatatgtagagagggttagaatccatgggggttcttggcatctcggaatacacacccctgaattttgtttccttgacataccatcttgctacatgctcaggagagtaaagttcccaaattctgtctttggttgagtgtgtgtatatgtgtctgtgtaagtgtccctgtagtcataaggaaaatcactttgcatttatggaatgccggctacatgccagatcacgtgaggtcttcacatttataattctacttaatgtagaatttatatgtgtaaatttagtttacatatgaagaattgaggctcagaaagggtgtgtgacctgccaaaggtcacacagctagtaagtggcagagggaggtaggatctgaaagcagatctgacttttaagcccctgtgtgccaggagtagattctgacaagcctagtaagataggtgacccttggccaggtgcgctggctcaagcctgtaatcccagcactttgggaggctgaggcaggcagatcacttgagtccaggagtttgagaccagcctggccaacatggcgaaaccccagctctaccaacatacacaaattggctgcacatggtggctcaggcctgtagtcccagctactagggagtctgcagtgggaggattgcttgagcccaggaggtcaaggctgcatgaagccgtcagcgtgtcattgcactccagcctgggcaacagagtaaaaccctgtgtcaaaaaaaaaaaaaaaaaggaaactaaaaagatagttgagcctcttgttgctcccaccccaacactgcctcaatcttgcggttgctttgaaagaaaggggcaaggctgggagcagagtcagaaggggaggataaggacagaatttgcaagctagtttatttaggaactggtgaaattcagaagggttgaaggaggcctctaggatggcgacctttccctaagcagcacatcggtgttaccgggcaccgagagagaaaggtaaaaaggagaatgaagaggaataatgggaggtggggagatagagagaggctggtggcctgaagacgcttgcaaggggactcccctgcctggggggctggcaggagcaagcacaaccttcattctctctagcagggccaacaaagggcagctgaatcacagtatttctcaagaaataaaaattcctagcacacccctggggcctcggggagaaaaactgacaaggtgttgattgaaaacataccgcgctgtgtgcgcccacagggtgaggccgcgcttgcacaggttcacagcgacacctagtggtctcctggggcacctgccgcctctgcagaaatggcaaggttggtgggccacagggtgactgggttcctggaggagatttggggtccaaatcagacatttcctcttttcccttgctgtcagcacgcatattttgcacaactgtccaccctccaactgtgtgaaacatgtcggtattctgaggagagtcaggggtggggccgggggccattggtaaaagactggacttcctggttggacacggtagctcactcctgtaatctcagcaatttgggaggccgaggcgggcggatcacttgagtccaggagtttgagaccagcctggccaacatggtgaaaccccgtctctactaaaaatacaaaaattagtcgggcgtggtggcacgtgcctgtaatcccagctactcgggaggctgagccaggagaatcgcttgaacccaggaggtggaggttgcagtgaaccaagatcgcgccactgcactccagcctgggcaacagagcgagactctgtctcaaaaaaaaaaaaaaagaaaaaaagaaagactggactttctaatgttcaccccaagactaacaaggtatgcatatccaactggctctgcaccatctagattttctgaagtggtcactatttcctctaattttattctcttcatttattcaatataactaaaagtatttaatggtgaaatcctcagatggcttttacacaaatgaattctccagtcacagaaatttctttgttgtcgacctgctcagaaaatagaacaactatacttctatattaggtcaaagaccttgatgtccatagtgaacctgatcaataaatctgcttagaaatgaaaacaatgcatctctttctggataatagcacttgaacatttttgttccctccctggcctcctctcatgccatttaagccttggctaatttccttgtctgaaggccccctggagacagagcatatccagtgtgagcacaatgcctgagacatcgttgatactcaaaaatgatttcttactgaatggcttcagctcctgatggagcagcagatgccacaggaggaaggtcagagagttcagtcctccgtgaagcgctgccagaggattccagactctgaagggaaatgatcagactagcaagacccttgctagggtgtccctacctgcaatccagcttcttgttaatagctggggatgacttgtggttaagtggtagcccagtgtggcatttgcagagttctggaacaaggctattaaatgtctgtgggctggcactcctgagagggctccatgtggccatgctttccagaccccctcaaaagccccactggagcctttccttgtaaagaagccatgagcttctgtgaaccaatcctgctgggatgaaaaccattgtctccaagctaaattttatccaaattacattggccaaattgtgttgcattaactgggtttctttctggttgcaaagaacagagaatcataggtttattgggatataacatgtgaaaataaagagttggctccattgctcagtctgtccagaacccagaagaagcagaagacctcacttctcaggggtggtgtagtataatagatattagtcatattggtgccaccccaacatcatttgaagaaacttcttaaatttggaaaatacgccatgtgaggggtgctacctcaccagggtggagatcagaactcagttactcagactcctctgcagctaggacacaggcatgtgacataggctctgtggattggatgcagtatgatgagatttcagtctggaagagtgaaaagccagggagaagctgctgcatggaattgttcttggtgatggggcggaacatggtggagggacatggaaccccagaggcagcagagacagagatgataatagtaacatgcaccaaaggcagtgggatcaagcctgtgaccagacaggtgaggatttgggtattgtttgtggctgcagagtgccaacccctatttctccgaccttgctggagagtctgtgagccactaatatgcgtccataagttcttttctgtttaaacaaatcagaggggattttgttgtttgtaggtaagaatcctgattgataaaagcctagtgaggactcagggagactgtgatcagaaagtcatttagcatgcaaggcatctgtaagaggttaatgtcaggagttcaaggatctttgctccggagaggttgtgctcaactattttgtttggggctgaggctgttgttactgcctgtttaacatcccttaagcaataaccattttctactattaggtcctgtattctggtggggctgacatcatgccctagctccagaactgggcatatgacccaggccaggccaatcagatcacagcttctccttggctctgttaattggttcagggatggatacgtgttccaaggtggaccattgagaactacccctgggacttgtgctgtagatctagggaattattccttatctgctgatgctgctaagctggaaggaggtcagtaggaagcatgaagccaatattggttaccttgttgagtgtgggaagagcctgccaaccaaagaataatgccaactgaaggaaagaaaaataagaagagagagagaaacaataattcctgatgatgttgggtatttgtatgcagccatcattgaagtctgttctatccctagatttttcagtgacatgaaccatcagattcctttgtaagttaattttgagttgagtttctgttacttgaaaccaaaaggtcctgactaatacaatggcacatgttcaaatatcagaatttttggcaagcctttagaagaattaaataacatccttggttattatagcgttaacttggttactctgcaagcccatgtctttgagaataactgttatggccccaactgtgctctcttctgtcctcacaagacagttttcacacattctgggaaacttggttgtgttggcacacacttatcattatactctacctcttccctccgatgtgcgtgtttgggattctcccattctacaaggagtattcctctcaacattctgtccaacaagcactgttgtaacaatacatatcctcagttgcaacaaaaggtgcattttctaccttgagcacaatgtgttagccacctgtgcaaggtatgccgccagctgctgtgggtgtgcagagatatttgggttcagaaccactggtcctagggctctggcatcaatatgactctctgccttcgctcttcactcacctcttctaagtgtttcttcaggacttttgttctgctaccagttggctcattttctctttatctctaaaatcagtttcctggccaggcatggtggctcatgcctgcaatcccagcactttgggaggccaaggcaggaggatcagttgaggccaggagcttgtgaacagcctggccaacacagcgagatcatgtttctataaaaaaaattctctttagaccctaaaattagttttctcagaaggaaagataattcaatggatctaattgccaatttgaattctcatttgggcagagttggttgagctgggccatatcagacaatcccactagtccctggataggaggtcttgggcaaggcatctgcccctgtccaatcacagctggccaagaggaggtgtgggtcacatggctaagaacaaggcaaatgctgaatgagggacagcttggggacacttccctccttgggggctgtgactgggcagtttttcttaggcgagaatggtgtgtacgacagctaccatgatcgatgtgtctggtacattctcccatcctataaataataagagaaaagcaagatgatggcaggggacggaatgataataattatcgaggactggcttcaccttcagcacctcacttcttcctatgtcccactcgtcagctgtctctgggaaagtgatcagcttccaggagccagagggctctttgaagggctgtgaggaaagaggagctgctcagcatgcatttcaatatcctcagcacggagcacatcaccctcgctgtgggcccaatggcctttagagatggtgagagttgagctgtgggcacagagttgagagttcagtattctcaactccttctctgaagccagacaaggacacatttcccctatagcctccccctgtagctgagggcagggctgtggatccacatgctggctctgtcttgttcttctgagtttatcctgtggtttgcaccagtgttctacggcaactccagaaccctcagcttcaagccaaagtgttttccaaataaccagaagagtccacctgggaggcctggctcaggccagccccacgtacgagggttggcagctctgacattaattaaccgtgtggccttttagtgaactgaaagacactggaacactgcttttcttaataaaataaaatctttaaccaccagggttgacagtaggaggaaatctgataggggtggggctgtactagaagtctcccttgcctggtttgaatgttctggccttgtccctggttgggacagcgtattaagctggggcagctacatcttcccctgggctgacttctgccaaagcctagaacgttgtcactaaagtttaattcctttttgtatttaaaggctcctggagtcctagagatgcaactctgcaaaccttagcagtttgtttctcctaagttgtagggtctttgcttagggttgatttatttaatccatcaggttctggtgatttatttgattttctgtgccaaatgagtgtctcgagacaaaaaagtggtctctagactaagtgaacaacaccaaggtgacctgttcccactttggagaagacacagcttaatggttaagagtgtagactttgatacttgatgccctcgggctcaaattttggctctgcaattacgaacagcgtgaccttgagtaaattattgaataggttggagctgtgtttcctactgtgtaaaatggggttgatgatgccataagtctgccccatagcggcatgtgtacattaagtgagatcacgtgcacagtaagcactcaggaaagactcactgttttttccagctaggtggaatttctctggggagctatcagatttttttcctagagacctgctgggtggcccacactttggagcccttccaggtgggggtagcagaaacatcataggggggcatcatgggttttccctcccagctctattccttctgcctctcggtgcttcaggccaactgttactagttgcagagagacggccaaggcaacagcaggcttggaaggtgcaagcctggactggtcgttcactgagtggaaggtgtttggaatgcagaggggcatgaatgagccaccactctttagttggggttttcattaaggacatgttgctgtttgatgccactgggcacaggactttcagagcaggggatgggcataggggaggagtccccacttctggccattcaccctggtctttgaacataacctggctctgagaaagtggctcgacagtacaggcccccaagcccaggatttgggagacctaatctgggctcagccaggcttctgttaagtcattgatctaaggagctggcaaatcccttaggagagtatctggaattgatggcccaggcaaatccaggctctgcctctcagttttgcatataccttatcgaatttaatccttgtaactattctgagttgcacagtttagagaggaggaaagtccccatggagttttaaatctggaagaactttgaggtcttctgctttaccctcttgttatgcagatgaaaaaaggaaagcccagcaagggtgaggtcactcagctaattaggagcagagctagagccagatctggaaccttgttcttttagccgtgcacactgtagctaatgcaggcggaccctgtgctctcttgaaaggcaactgcactgcaggccccatgtgtagatttaggctgctttgtgcctcaacccacatccccatcaccagtgcagcttcaggaatggtccttggtggggcagaggggataaaaccagcctgactgacagctccagctttcagctacccgaaggagtctcttcgagtccttgccaagacccaaactgggaatctcagacttcggacaagaattctccaactgtggggatgagtgcacctaggctaagccaagcactccttggcctgtcttgcgttacccagaattcctgaaagtgctgggacttggctaggtggaatttgaaagtctgacctctggttctaacctgttaaaatagttgagcacagactgttttcccagcactgggctgcctgtgtaccacctgaagtcgggggtagaggcctttgcacagtgtctggcaggtgctccataggaagggaggggaaactcgaagcaggggcaggtcccaaggaagacggggtggcattttcacaagaaaatcccccagaaagggcggccgccccatgctctcccccatggcattgtgccaggctggctatgctgtggcttccctttgggttcccctgggtggaagggtgctcactgaggtgccttttgggtgacgttgcccatgcaaacacatttccccagaaacacatctgctcaactgcactaaaaatggcatcttgattgacttatttagcgtccattaagttcatactcaaattaacatgcagaatgggagacaggaggggttacaacacccgtaaggggttagagaggcatttaaaatggatgaagatctgtgtaccagatgtttgtttcacctaaataaaacaaaataataaaacagaacaaaacactgcaccaaaaacgttctttctgggagcagggagagaaagttccatgtctctcatccctttttcgggcttcaccccaaggtcacaggtccctgctggtgtagtggtggcctgtagataggcagggagccccatttcattgttggagttacacaggagtgactgtggcaatcagcacacaacagactcttcaaaatcgtgaacaactggggggaccttgcacatggagggcccactgttgaaagagctgtgctgcggctggcctcaatgctggggagcatgtggctctccttgggtcagcagagcaaaggtaggggcatccaagagggaccctgggagctccttgcattgcttggaccatgagccagctggggcctggctgcttcccagcaagagggcgcccacgttcccttttctgtggggctggaggattcctcttcaccctccccatccctcttccatgcaggaagcattgcaacatctagacaatgtctgtattaactcctctgcctggagccaagtagcctgtgtggtcctgcagcagaatacaggcccgtgctgtcggcccagctcacccccacccaggaatgattatggaatgggggatgcacacttgcttcacccttcttgctctcctttagctccgtgagtgccctacccccaaagcatattgctttaccggtgctgtgtgagattatagaattctcaaacctggttcatgacagggggaagcccagaatgggcctgcctggcaggacaccgggatgaggtgtctggttcctccctgggagctgcccatgtgacgtggatcagaggcccttctggaaccaccacctctaggacagtaaactgtcggtgactgtaagtagcacccgtaatgccaccatcagccccagaggcacaaagccgagacagagcaggagtcttgaaggggagaacattcatggaggaggacttctgcgggaaaaggggctagatctgcctttgccactgctcccaagacagtccttctcatttttccctggtaatagctgctcccagcccagccctcccccacatggcacctcagctctcagtccggcactgcctgctttactgctttccaagtcccatggaaatgaatcattctgctggcttgctggagtgcactttcctatctttcagaagccagtggccttcgagaataactggcatttctcagtctgtgatagagatgtccctctgttcacgccaaggtgagctcttccaagcatgtgcacgcagctcatgtgcctggggaaataagcactttgctacctggcaaagcagtggggaggagaatactttgcctggaaacctgaccagacccttaatgaatgttatgtgtaagcttaggctgggcagtgtagttgggagaacagggaatgagtttcagttccacaattgtgctctgctccctcacatctcagggcctttttacctacaaccctgctgtctaggattcagccattcattccttcaacacacgcttgttgagtacctcttatactgcaggcttacactctcatctgcaaggtgctgagtgaacaagacacaggcaatgggggtgcagacaatgaaggtgaggtgtggcttgtcccttcttcatcttttactggtgtcctgtctgtggcggtcactatgagggcatctgaacagtggtcttgaggcaggaatttttacgccttagctcagcgagatctgggttcttgtctcacgaccaggaaaaattaggcacatggacatcaaagagtgagtggaatagaatttatgaagcaaaaagggaagctctcagcaaaaagaggggtcctgaaagcaggttactggctggcccccttcatagttgaatacaaggggcttctataatccactgatggggctggtttccctatttgtatgtggcgtgaattcctggcacccccatccttctagtgcacatgcgggcccttagtctgagccactccacattgatttatttcccttattgcgcgtgtgttaagggacagaagttttcactgcgagcatgtttaggcaagccacctgtgcacaatgaccttggccggtgggaagttctctgggggccctcccctatctgcctaggagagtgctctgtctcctgcctctgtcagtctcagggttgatcagcagagaatcccataggggtataggggtagagagagaaaggggagactcggggcaattcaggagggctggaagtgcaaactctctctttcctgatattaatcagaccagggcttcacaaacttttgaccatgatctattacaataaatatgttttacattacaacacaatataacatagctatatgaacatatacacaggaaaatacacacctggcaaaatgttatgagacattaccaacctttattgtgtgtgaggaactgtgatatctttttattctattctatttgttctattctatccaaaatgatgttcatgaattttgcagcccactagtggatggcaaatgtcattttgaaaaacactgaagggccaggcgtggtggctcacacttgtaatcccagcactttgggagaccgagataggtggatcacttgaggccaggagttcaagaccagcctggccaacatggcaaaatctcgtctctactaaaaatacaaaaattaggtgggcattgcacacctgtaaccccaactactcgggaggctgaagcaggagaatcgcttgaacccgagaggtggagtttgcagtgagctgagatcgtgccactatcctccagcctgagtgacaaaagtgcatctccatctcaaaaaaaaaagaaaagaaaaacactgaaagtaaaaaagggaagacagctaacactgcaggaaaaagttacaatcaaatcttattttgaatgcattcagggaaccctctatttagatcaccaaggtaaattcttctgtaaatcaaatcaatctattcttaatttgtatttaagaagaccaagccttctactttggggcttgtttaaagcaaaatccaccttacttgccaagtcaggtctgtagccatttttgcatggtccgtgaactaagaatgattttaaatgaaaaaaaaatcaaaagaataatttcacaatacatgaaaattatataaattcagatttcagtgtgtctattcattggatcacagacattcgtttgcatattttctatggctgtttttgcattagaggagagttgagtctctgttttagaggctaaatggtctgcaaaacctaaaatgtttactgtccagcctttacagagtttgccaacctctgggttaaagtgtggtatttcttatgctgaggttggagtgacccccaaataaatggttttgctggtgaggagccttcaaagggctggctgaatgagaatgcctggccttccagagccttctttggccagcaggagcatctgtgtgatgccactgtgcagtgaactcatcttaaccgcatgaatgggcgagcagctgtccagcagctgcccagagacccagaccggctctcaggtactgtgtggcctggctgagggcatctgggggcggggcaggggctcagtgggtgcagcccttgaaaaattcaccagaattagactctgatgtctccatttgatcttttcttccctccttgtcttgccttttcaaaaggcgactcttttctgtggccttttcttctttcttttggcttatatgatccctgcatcattatttcccaaaaaagaatgtggcaaagtaactttttgaaatattaatgaaccccctttttccttttttcccctccctccctctctctctcccttgtttccttccttccttccctccctccctccttccctccctccctccttcccttctttctggcaaggtcttgctctgtcacccaggcaggagtacagtggtgcaatcacaactcattgcagtctcgatctcccaggctcaagtgatcttcctgcctcattttaaatttttctgtagagacaaggtctcaatatgttgcccaggctggtctcaaactcctgggctcaagtgatcctcccaccttggcctcccaaaatgctgagattacaggtgtgagccactgtgcctggcccgtcttttttttattttacctctcctttcctcaaactctctgcctcctcagtgaagcagctaggctgttctgtcctcctgtttcaggggagtaaggggttgggcagggagtttttctgtcttaacttcagggaggcctgagaattctcagcagaaattgtttcagcgaacatcaaaatagagcaagacttctcccacctccttgaggtgggtagggaagcagagagggatgctcagtgcagaggaatcagtgagtgaggggaaaagacatagcatctgaagacacagaggccagcactcaggacctccatcagaggaccacgtgaaaggcaggttcaagtccaccttgaccactcagcctccattgcagtcggtggcatctagtgccactggctggccttccttcactgtggtggggatttctttctgcagcagccagtacttccttggtgactccatacagagcatgacaccgtcccagcctccagctttggttctttccccatctgacatgccctaggaattcactgcctttgcagtttcactggatctgagttaatccaagagatagacaaaggggtattgagtgaacaagatgaccagcacatcctaggttcccagagttcccaaagctgggttgagacctcacaggccgggctggtggtaatgcccagggtgtgtgtgtgtgtgtgtgtgtgttcgttccttggcactcacatatgtttgtgtgtctgtgaggctgtgtgatgggatctgggaactggtggaggatgagaataaaggatggagcgctaaggagtcaggcaggcaaaaacaacccccacacaccatgcgggtgtatgcctcccgggtcccatgcacctgggtatgtgaaccctgccaccctcctgcacaagagcccagtctactgtgcctgaagaggctggacctgacgccggccttccctttgcttcatttgtgagatgccggctagtccagtctgacttcaggagagcatctctggcttttctgctccattcctagttttggttcttccttaggaggccccgcaatggagggaggaatagagcagagaagaggcggcatttcctcatctccccacactctggcctaggaccttgtgatgactttctctaatttcagaggtggagacagacttcttccagccccctcctgtgaagggacagtggggccaacttcctttcctctcctgtgccaggtcttaaaagcctgacctgcattttgcagaagtcaggaccggcttgagttcaattacagtagattgcttgatctcatttattttctcctgtatgcttgaagttaggacagctttaatttgaaatggaaatttatgcaaatactatgtaaattaggtcattcccagattaactgggggaaaaaatctggtcgccttagcaggcaccatctgttccctcctcattctttccatatctgaaccccaccccccctttcccaatcaactttgaaacttgttttcctgtggctgagaagagagatcgttcaagggaaggaaactaatcccccatcagttttccaggtgggtcgttccaatgtctgttttgcggtgagaagaggctcaggtgagaggctgggaagacttcagggttggctccgggttaatggttgccacactccacacatgtgccgcctcctccttgttcctctcttttctcttggcctccgcttctcttaggattcttttcctccttctctttgcctgaagtcttctaatggcacccagaagccttcttcctccctcttgtggcagtcggagtagaagggctttggggttttgcaatacccccagagttcttgggaacttttgggtccatgtgggtattggttgggaggctcagggcccaagcaggaggctctgtcccaccccatggctgcagctcacgcctatggagcagggacagcttcagtcctgctctgtgaaggcaagaaagccaggagcctcagaaaagctatggatgtgagggaagcagggggccccagcttcgtcattccgcatcgttttctcctttaaggggacaaaagtgagaagacttcccagcgattcattcgctcctccatcctgcaaggaagcagagccacagttgccccaccaggaagaagcaacttgaggccgggtgcggtggcacacacctgtaggtcaggagtttgagaccagcctggccaacataatgaaaccctgtctctactaaaaatacaaaaattagctgggcgtggtggcggccacctgtaatcccaactactcgggaggctgaggcaggagaatcacttgaacccaggagacggaggttgcagtgagctgagattgcaccactgtactccagcctgggtgacagagcaagactccatctcaaaaaaataataaataaaaataaagaagcaatttgagggatacttttgttgctgttagccactgagtttttttttttttttttttttttaacagtctcatactgttgcccaggctggagtgcagtggcatgatctcagcaacctccacctcccaggttcaagtgattctccttgcctcagcctcccaagtagttgggattacagctgcctgccaccacacccggctaatttatttagtatttttagtagagatagggtttcactatgttggccaggctggtcttgaacttctgacctcaggtgatccatccatcccagcctcccaaagtgctgggattacaggcatgagacaccacgcccggcctagccactgagatttttgaggctatttgttattgcagcaaaacttaatgagagcttactactacaccctctcatcttcctcaatctctcctcaaagctgcctcaaaatttaaaaaattcttttatatactcatgtgatactttctcgctttaggccaagtgaaaataaaggcatcttcataaacatttgctttttttcttggttcatgatatgactgtacaaactgcacttgtgtatacggctttaaacccagacttcaggcagggggaacagtcagtgcaaaggcccccaaggcagggacgtcaggagtccatgtggcttggtcagagtaagaaggtgggagagtggtagggagtgaggctcatggagtgagaggtgggcagtgtggacctgagcatgggccccagagaaggtgcagtttcaggacagaagcacaaggtggcaccgtgacactcccctcagtcactgtggaccgcatgtgcggtggtagagaagacacatcttcttatcctccaaaatggctctgccagggaatgaaagtccagccgactccagcaaattagaaactgtactcttaggactggaaaagctttcgagacctctcaatcagggaggtttccatgtggggtccatgatgcctatgcatggactccaggacccaggggatcccctgaattgcagtgtgcttttcaggagaaacctccaacattttcactccaaggggtctatgacccaaaaaaggtgaagaacctctgactaccactggtgctcccaccaaggccagacttgacaagaacttcctcagcaacaggcagccccggccaattccacattattaccaggtgcctggagacctgtgagtcctttgctatctcagtggaggcacccagtaatgcttggaaccgctgggcctgaggacactcgggctctccttccagaaactagagcttttgtgaggggccagcaaatttgcatacgtgcacccgtgcacacacgcacacacccctctctccactgtctttagattgaagaaatcacatcttctgcacatgaacgtcctgttggttctcaaaggtgcctggatgtttctgtgataagtaaaatatgattgcacaatgtggttactgaatttgcagtcactttgatcattatatagtttctcacccactggatgttttatagaagtctaatatagaattgatctaattgaagtttaatatatattcgactctatgtgtccaatataatgaatggggcagggagtctgtcagatattttgagctaaatgagaaacttcataatcaaaatggtgggagccacagtctggtgaaagggaggggtcgtgagtgatgtctgatggccaacaggtgagctgggacggcgcagggggcgcggtgggggcaggacaggaagctgcgtgggcagcaggtggagggtgtgagcagaagtgagactggagcctgtggggttgctcaagtggaactgcagaaggagatcaagaatgagggaagatgcaaatttttaattcagcatcttctaaaaaaaagtcccagaaatgactgtatttgctattggtgttttaaaatatccattaaataccacatttgccagcatcacttctcttatcccggctgctctagcagcctgaattctgcctttttcttccctgagagctgggctcagggaacccgcgtatcgacctcagggggtcaggcctgcaggtgggtggctcccctgggactctttaaaaccaaaccccgagcagaaaggagaggctgaggtttggggctcctttaaaggcctcctctcagcttgtctccagttcactgcctaagaatgtcctccagacacaggctctgaggccagagctattgaatatttatcaaggcctcctggcagacgtgggagactgagaacaggaaaatcaggcccaggcgggcatctgtggagcctgcctgggtgctagccagatgctgcaagattcaagttgcccgttgactctgcagagcctgccccgccctgtcctccctcctcggggaggcgtgcatgggcctggctgctgtcagggtgtttgcttcttgtcaccatcctccatactgacttccattgcaagccctgccccactgtggctccattgtctgcagtggcctgggctgaccagctcagcctggagccctgccctgggacgatgcgggctaacacagtgacacaaagccctgctttgtggccctgacaggaggatttatcattagctgtgagatggtccctggcagatcctggcatgtggtgagcagacagatctgtgctgatcacagtattttgagtacccccagttgaatacagcatctggggccctcaaatctgccacatggatcttatggcttcaggctcactggcaccttttgtgttggccgaagtacgggtagggggtagattaggagcactagcttgtacccagtgacgtctgggggctggtttacaggaaaggcaccctaaggttgtgcaggccctgacatgtggtcctcctggcatctggggacagcatgtcaggtttggggtctgcccatccttgccttgggcacaggtccccaaacaacagcagcatccctgtgggtgggatatctgaccagcagaaaatggaagtgaatatctctttgatcttggagtgaggaagaatttcttaaaaataacacaccaaaaaatcacaaatcataaaaaagaaagattcatgatttcaaccacgttaaatttaagaaccttggttcatcacaggtattttaaagaaactcagaagataagccacaagctgggaaaagatatgtgtagcacttaagtgacaaaggattagcttcaagaatatatcgagtcctgaatgcctggtggggtggagggagtgggaaatagacagatagttcagaagaaaaatgggaaaaaaatatgaataggcatttgacagaagaggcaacacatagggccagtcaacatagggatgtgctaacctagtcagtgtccaggaaattgcaaaacaggcagtgagatccatttcctccagtctgtttcctccagtctctctccggggcctggagatgctccttggatggttctcagtggccctggtcctctccctgggaagcctggcctgtcaggctctgcagagccctctgttttgtccttcccccaatatcctcccactcagagcctgagtctgcccctgccccttcccttcctgtcctcaccaatggcgagtgtggcagatcctccagtttctagaaacacctcctcactccatcttcatcctttcctttgatgtttccccaggtcttatccggccaggtgggctttagggaacatttttcttccccctttgaagccagggtctcgctctgttgcccaggctggagtgcagtggcacaatctcggctcactgcagcctccgcctcccaggttccagcaattcttctgcctcagcctcccaagtagctgggattacaggcatgcgccaccacgcctgggtaatttttgtatttttagtagagacggggttttgccatgttggccaggctggtcttggactcctgacctcaggtgatccacccacctcggcctcccaaagtgctaggattacaggcatgagccactgcacccggcctagagagcatattttcaatcagaaaagtagttcgctgcacctcacaagcccaacactgagttccaggaggacctcaggacaggctattgatggtacggtaaacatggctgacaactagcacgttctagaccaagttcaggtagaaagggactccctcagctggccacaaagctaccctctccctagtgtgcagccttatcaggctattgtccaaggcaaaagctgtgtgtaacaagcagcccacgcagcctgcagccaggtctgccaaggcacctttcctaaggggctgcccatgtggcccgctcacgcaggatcttgctggcactcttccttgggagcttaccttgtttggaaacctttcctggttagcctttaagagcctcaacaggcagctgaaagcatgtcctgaaatgcctgaactcatacttggaatgagaactagctacagcttagtatgccatgaacgtttgcatcacttgttgtccaataaatctgcggtccccaacctttctggcaccagggaccagtttcatggaagacaatttttccatgaacaaggaggatggggtggttttgggatgaaactgttccacctcagatcatcaggcattagattctcataaggagtgcacaacctagatccctcgcatgcaccgttcgcagtagggtttgtgctcctatgagaatctaatgctgccatgatctgacaggaggtggagctcaggcagcaacgcgcactcacccactgctcacctcctgctgtgtgtcccagttcctaacaggccctgggggtgagggatccctgcaatacataacacgtgctaagcagtggggtttgggtgctacttcccaactggccgctcttaggaactggtgaaaccttaagtcaggtgtgactgagcgagcccctgggtcatggctattctccttgctgctctgctctcctaagtctggtttgaggctcctctccctccctggcgtcccaccctgtatgtctcctaagccagtccagcttccaagggtcgctgttgtttctcatggccttcatgaaaacagcgggcagggcatgtctctggcctgtgatggctccccgctatagtccttgtcatctgtatatcaaggagattttatttctttctttctcagttcctctttctttctctcttttttttttttttcctgtttttccttcactcaacaaatcaagcttccattaggcacaaagagtcttgtagacacttgaggacataccagtgaacaaaatagtcttaaatccttgccctcatggagattctattccgaatgggagacaggaaataagcaaaataaaatgtgaaacctatgacagggtgaaagcgatatgcagtcctgagaataacttttatttgcatggcaccacagctgcaaaaaacagtgcatttcactaaccccttatggtatcaaccatggatggggcaatcactacaggccaagcattgcatttacatcacttcagaacccctgtgggaggtgctgtcctatcccagtatacagatgaggacactggcacacagggagactcaatgacttcccatgatcatccatctgctaagaagtggagtctggattcgaacctgaagccgtgggactccaacgtctttgttctttgtcactgtacaatatgcctcccagcttctgtcctggctgcctccacaatcactcagcagcctctgtactgcatacaccacagcgggaggtagtgcgtggctgctgaacatatgggtgacgaaaggggttttctggtgggactgaagtgccactgtccctcttacgtgcagaaggccctgcctgccctgcatgccaccatctaacctagtcctgccagcagctgcctggtggtggctttgcagccctgttacagcccctgctgggtgcatgattcacaggggtgcagtgttgccttgcccaggctcaggccctggcctgcaccagcctgagacagagcactgggtcagaggtgccttctgtggctccactgcccagggcatcaatggagcagggcctacggcgagcctctgtgtgtgtcgagacagctagaactgttactggtggagggtcttgactgcaagttgtccaggttcttggtgttctgaacgaagaattggacaaaatgcacagcaaagaaaggaaagaatgaagcaactaaagcagagatttattgaaaatgaaagtacactccacagggtgggagcaggcctgagcagcggttcaagggtgctggttacaggatcttcaggggtccaaataccccctagaggtttcccataggccacttggtgtacacttcatgcaaatgaagtagtggcctgcaatcagtctgattggttgcagaaatcaaccaaatcggacaggtgggggtgtttacaaagggagtagcctctggtccttttgttacttaggtgtggaaagttggggtttcccttttgatttagttctaattagtcagtgtgaatcagccttaggttccctgcctccagaccctattctcctgcctcagaacttgcctgggcaagactaaaggtggtctcacagtccagagaagccacagtaggggccaagggaaaaacttctttgccctctgtatgttcatggaaaaatcatctcacaaaatgcagattaataaaagaaaaggcagacaaatttgttaatgtgcacatgggggagaaccacagagtgattacctccaccctccaccctccaccctcctccaccctcctgtctaaataagctcttcttctaggcaaactggtggggggaattgattcactatcctcagaaattaggaagcatgaaattatgctggctctgctactggggaacaaagagcaggggcgtggtgtgcagcggccagtgcaggaagtataagtatatataccatcctgaggttacagaaagaatgggggcttggatcggggcaaaataggttatgggaggagaagatgaggaggcctggtgagccaagatgatcttgttacgtagacgaaacctcacagggagcagccccgagagaactgatgggaaatgttactttcagacctttaaaggtgtcccattttcagttaatttttcctagattggacaaaggacgacctctgagaaaacctgagaaaacctggctgcatcaatgcagattctctgcagatgcaaatctcccccagaaagacagctttgcagggctccttctgtttgcaggccctctgaacaaccatctcaaattatgtcaaagaagtgtatttggggatgaaacatgtggatttctttcaccccccacccccctgcatcgcttgtgtactcttttcccaaagtggagtctacagcatggagtagggggagttgatctccagatatccatgtctcttccctgcgcatagtgacaggaaactgaacccaggaatcaaaactcaatatatgaggccagacaatggtgcttgttcctccctcttgttgtgagaagacatgaagtgaactctggggtcatgagttactgtgcttcgaaaaataagctgtgtgactttgggcaattgcccaacctctctgggactcaatgccattgtctgtaaaatagggctaagaactcctttcctgcctgcctcctagatttgtggtgaggatcacaggaaataatgtatgtgagtgtgccctgtaaaccataaagtgccctagtgacatgcacccatgcacctccatcattcctgcagtgactgaaacttggaaatctcaccagaatgcatcactgtgagacttgttgagaattaagtcaagcaggggttaaatttgccaatcaccagagcacactatgtatatttaaaatcctccactcttttagtaattgggggcaaaaaagaaaaaaaaaaacatccactctgtcccagaatcattattctgtaaagttaatgagttccatgaagggtctttgtggtgactcatcccatcacttcttccactcctgccaccaggtgagacctggggagagcatcagggagcaggtgtcttaaggatctgaggtgcagggtgggggctcccgcagcgctgtgtttaaacagggccctgctgacgcctcaccacggccggctgggaaacagctgcagcataaggcctctcctcaggctagtgtggagcccagcagatgtgccatttgcctccacagcaacagacgtgaccctaaaaccagtgaggtccccaccctgaaaggctccactggcttctgagcctgtgtctagagggagtgggcaaggattccaggtgcatggagaggtgaacgctattactgactcctctgctggccatatgcttacttcctttatcctcccatcagctctgtgaagcacccaccactttagtgcggaggaagccgagccttagagaggtcaaggcctttatttcagcctcccagccagcaggcagcagggctccaaatcggaacccagatttattggaccccaaatcataggctgtgacagggctcgttattaaccaggccataaatacttcctgagtccctatcccgtccctggaactgctggggacatgaaaggcacaggaggcaggggcccgacctcacggggttggagcagacctaaagtgggatgagagcagaggaaccctgcggctggggctctccactcttccatcacgctctgtccagcagggcaactggagggagccatgagcatgcgatgacctggcggctgctcaggatgggagggaccactgtcagccaggactggcaggactgtgtgagtcatcctagtgggtgagggagtcttcctgggctctgggagctatgagtccatgattcctgggcatgtgaggaagctggttaggagctcagccaaaacttaaactctcaatccagcactctttacactcccaccacatctgagctgagacttgaaggggtggggcatgggtgattctggtcccagggactagagcctgggggctcccaccttttcctctggttctgcactgacctgccctctggttctgccctgacctgcccttgccaagcccactgggccggcgaacagttgtttccattttccctgcagcctctgttctgggaaccaggccagcattcatagcctttcccctccttttctttttgtaatagaaactgctcagggctgccaggagccagcagtgtgctccgcggctcaccgtttggctggactggaggtgaagcttcttggtggctccttcccagccttctatggaagctggaatccactctcccgaggccatttctcctcccggggttccctctctgcagcctcaaccccccagtgccctttgtcccctaaagcgagcagtttgttttcagtccaatacctccaggggatgggggggggcgcctggaggagtgtcccaggagagggtcccaccagccacgctgccctgaacccccttaaaatgggggtggtgtgacagtaacttagagaccacttagatgacctcaggcattctgagaaatctaaaggctgatctgaagccagaggaggaaagttcattcacctttgtcccagcccctccccgactccaggactctagcgttggctgtttttatttgcagtccagcgtccggaatgagcggagttccttttgggaaggatgtgcggcaggtgtgctcactctgcccgggagcgtctccccgccgaggagcgcccatgctgactgcgaattgttccacactgcacgcagagcattcctttagcagcctcttgttttcttaagtgactctctacaactgtttccttggaggcgtttgtctaaataagctcttcttctaggcaaactggtggggggaattgattcactatcctcagaaattaggaagcatgaaattatactggctctgctaccggggaacaaagagcaggggcgtggtgtgcagcggccagtgcagggcccaggacagggtgtgggggctaatcacagcccgcggggtgggtgggaagtgccccagccccaagctgggactgtgcttctcggcaccttccacaccttatgtagctcccctttggtctccacgtttctggaagtcacagctgcaccctgggtcaccttaagctttttcacagtggaccacatgtgattctgagttacattactttaacctcaagagcttgactattttctatatcgtgaagttataaaaggatagtggaatctcacagtcatttgagagacaatactttttttcgaccatatgaatgttttgtaccatggagacagtgtgagccaggctaggaggtctggtcagagacacttattttatttttagttttagtttttgtagaaatgagagtctcactatgttgcctaggcaagtcttgaacttctggcctcaagcaatcctcctacctcggcctcccaaagttttaagattacaggtgtgagccactgcacctggccagacacacttagtttaaggagcaatgtgctataggcaagaaagccaaatatatctcaggtcaaatctggctctgctgtgtgatttggggcaaattaatgaacctctctgcacttctgtttcctcatccatcaaaggggaataataaaacctatctcactgtgctgtaaagattaaataatgaaatggatgcaaactacctcacatagtacctggcccacagcaagttcttaactaaagagaactctctttctcttctaaaacctaggatgcctgaggagtctaggattaggaatctctgaatatttactagtagcattgctggggtggatcagaaatatttgggaaaaaagttaggaggaaaatggcacctatgaggatgtcatagtcatcagcaatgaaggatttgagaagttctttagcagaaatcaggagattacctctttcattcaaaccctagcgaaggatgctttacactatgactatgattacagagaaatgagaatattttccatttgtgatatagaaaaaccattcccttaactgggggccacatgctgtagggagttcaataccattctccaagtacatgaggcccaacctacatcctggttctgtctctttccccagccctggtcctttgcaagaggtaaaagtctttataagtgcatgagaataactgctcaaaatcacttttaggtttcccccaaattctcctgatctctaataaaaacaaataattgaggggatgtgacattacccttggtcactagtgatttagagcttctgtccattgctccttggagctgctcatcctcaaaggtaccccaggcagaggccagcagcgagttcaaggccttgtcaagaaggttttcctttaataatacgcatccacatacacaaaacacaggccttcctggaattgccaaaagacagcagctgcaaaaaggacttggacaagaaagtttattgcagctttattccaaacaacccagatgcccatcaacaggagaatggtaaacaaattatggcatatttatacgatggaatattacacagttataaaaacagcaaatttttgaaatgtgaacctcacagtcatgatgttgaaagaaacaagacacagataaaaaagtacatattgtgtaattctatttataatggagttcaagaatcagcaatgttaatcctagatgacggaagtcagatagcagttacctttgggtaagcatgcttactttggacttggaaggggcacagatagctttctggggctgtggaaatgttgcgaatcttggtttgggtagttacatgggtgtatgcgtagataaacattcacagtgatgtgcgctcaaaattgtgcattttatgggacataaattaaaaacgtaaaaatattgaaaaacagaaattggagaagtgttaaagggtcaggttgaatgaggactgtctaacctggagctggcatcagaaacaactaccagaaatccctgtaacctgcttctcctttggggtctgtgaaccgcaggactaagacactcccacattctgaccctggcaccagcaacagactacttgccatcggattgatgtcgagaaatgatcacaggataacagctcttctcacggttcagcagataatagtaagtcaaacttttgccccagttgaacatcctatctctaagtataccccccatttcctctgaacccccctaaaccatttgccagtcacccaaatcaccatctgtgaccactactcccctgcattctacatccaatcaatcaccaagccctgtcaattctccttacttgatagctttaacactcctccactcctctccagcccagtgtcttaaatccacactaacatcctccttctagatgatgcgcccacctcccacctgctctcccagactcctgtggtcttgccctcccttcaatgaacttgccagctgctgaagggatcatggccctaaaatgcaaatcatagaatacttaaaagaatttctaaacctcccaggattcacccaggctcctggcatggcttacaggctgtaacccatgatgcaaaccaggcttgcctgtcctgacagcctcatctctctatgcggggcactgtcctaagtggtagaattaattacagcagtgaatgaaacaaagttccttcgccgatgggatttgccattttgtagggaagtacagacaacaaacaaacaaatatatgagatgatgtggtatacatgtgaaagacagaaaagcaagataggagacagggagtgatgtgggattctgtgtcagctgggatggttaaggaaggccattctaatgagatcacatttgggcagaagcctgaaggaagaggctgcttgccaccccacacagcaagggtgtgccacagtcatctgctctcctggcagttccgagagcaggctgggctcccctaggcctctgggcctgtgcacgcacacttcctctccctgcagcattccataccatcaagaactgagatcttatctcatgtgcaggtaataatcacacatgccaaaatttcacggatgttggtagaagacatgaggctcctgggtcagagaagaaggacagtttcttcacttccagtaatagtaacagccagagtggcagcatttttgcactggttttctgaccccaggtgacccaacaccaccattcagtgagatagatgaagtctaaataagagagtaaaccattgtggaaggcattgaaaccataaaaagtaagatgagaacagttgagaaaaagacacttagaattgactgcaacatttacagagttttggtgtcagcagaggccttagtattaggtgatggaagcccgccactgtaaggttcccgcccttgagaatctgctcaggaccagctggtgagatggacgtgtcagcagataaattgcaaggctgtgctctcaagctctagtgcacaaaggactatgggagcccatagaatgggtaggaggaggccattcaagctaaatcttgacagatgggcaggaattcatcagaaagacttaaatattggtcttgaaaatagcactgcatacaagaaaaaaacacatgcatttatgaggcaagagtccctgaagtttcacatttacacaaaatgatgtgtgtcttttggtgggggaagcggatgtgaaattccctacagataagcccaggctagctgaccagatgaggtgagatttctttcaggtactgcctaagcaatcaatggccagagagggctgcggggctgggctgctgggctgcgaggctgctgggtgctgagggagcagggggaatgttccctggggtgtggctggccatggtgctcgccatcctggaacaaatcaactgaggcgcaaatctgcagcacctttgccacagccagaatccacggtggttcctccgtgagcacatgccctgaattccacctggcctgtgcgtcatgctcagttggcaggatatcagaaccaatgctgccaacaccagactctccacgtgcggagcaatttatgaaaccctggggccagcaatggccacctttgcatcctggagttaggatgaccctgacacatcccagccccagcatacaccaccgcgctgccctgaggctgggctctaccttttgagagctactgagctctgcagagatgtgggtgaagggagccacagacatatcagtctggcaggggcttagagtcactgctctaactgcctatctggcaggtgaagaaacagaggccagggcaggcaagccctgaccagggcagtgtacctgcttggtagacgagttctctccttcccccagtgcagtgcctactgtctctctttagctgtgcctagctgggttggggtcttttctctgggcttccctaaccactcctgctgacccctatctgagctccaacttctccctggaaaccacgcattaacctattacctcctcgctacactgtgagttcctgagaggggcttgcgtctttctcatctggcagttggccagagccccataagtacactcaagttgaatgagcgattaaatgggtgactgcaacaagcctgggcaggaatgggtagtgctctttttggtcatggcttcttaaacacaaacaaggtgggcttcattgggccttatttcagaaaaaaatattcgtcttattataaaaagtaatgtttggccaggcacagtggctcaaacctatagtttcagcactttgggcggccaaggtgggaagattgcttgggcccaggagtttgagaccagcctgggcaacatagtgagaccctgtctcttaaaaaaaaaaaaaagttagctatggtgttgcatgcttgtggtcccagctacttgggaggctaaagcaggaggatcactggagcccaggagttggaggctgtagtgaaccatgactgtgccactgcactccagcctgggcgacagagaagaccctgtctcaaaaaacaagtaagtaaagcaaaataaaaagtaatgtttgacttgaacttacaagttaaagaactgatgagtcgattgtgctgttttgattctgtggctcctgtcatccgtctcactctacctcccagcgacacagtcctgtcctcctagatacatgtaccctagcttgagaagtgggactgcgggaagctgggccaaccaggtggcttattcactgtctgctggggcaggaggcagggcaggggcaggagggaggcaaccccagcctgtgcccggcttccccgaggcgtgtgccttgtgcggctgctgaaggagtgactcctgaggaaaccagcttttccagggaggcaagggatgggagaagagggtggagaaggaagtggtcacaccacttgccttctgccaatactgtccctttcttacgcgttaaccttccactctgagctatgacactttcagtactagtgtggtaagttctacaggaaacaggaaacatggtttaacagacatccctttaagctttaagtgtagcccaggccctgttctagctagaatgaagttttgcataatgaatagataccagattcccctgaagggctcttgccccagagactctcagtggcccacgttcacaggtacttgcaggcatgcatatatgcttctcacctcttaggaaatggcctttgcaggcatgaaaaaacaaatacctcaagttcccttcctgagcctcttaggcaacatgaaaaaactacataccaatcccgagaatggaagctggtttggagtttcacctcacaaaaagctggccccaccatgctcacccaaatggcagatttatgaaggttctgtttgacaagagcaaaggatccactttgagcagctctgggcctatggaaggcaaggtgttcatgtttaagcacaaaggtaaacagagcatagcagcaggttacagagatcatttattttcccgctgatgacagacatgagctctggcccagggcccaaacttcttatccttgaaaaacacattttacagattgccggcagagacagccaacccagattaagctgccagacctaactattttagatcttcctcctactcctctggaaaaaaaaaatataagataacgatttttgtccctgaaaaacaatgagaggaactaaaggaaagcccgggctctattcttaggggtctgctgccctccagaaagcccagcgtacaacttcaggcaggcccatgacacgccaagtgtttgcattttggaagaatcctaatagaattccttcaagtggcagattcctgaggacatttcaggatttatttacagatcgttaacttacttgtcacagaaaccgaagggcagggaaattttgagctgacattttggaatgccaccctcaaagggtgatcaaccagaaataaagataaagtgcctttgaaatgataaatatgaagtaatggggacaaggatttgtttcataggcaccgtttcagaaaaacatctctaatgtaaagtgaagcccagaagtatattttacctgctcttcactgactatgtaattaatgtttcagtgactgacaattctcacttatcaccataaatttttttctagaaattgccacataaattggagcatcataaaacaggtttctgcaaactggtttgtatgttttttatcataataatgaggttatagccgggtgcattggctcacgcctgtaatcccagcactttgggaagctgaggtgggtggatcacctgatgttaggagtttgagaccagcctggctaacatggtgaaaccctgtctctactgaaaatacaaaaattagccaggcgtggtggcttgcgcctgtaatcccagctacttaggaggcggaggcaggagaattgcttgaatccaggaggcagaggttgcagtgagctaagatcttgccattgcactccagcctaggcaacaagactgaaacttcctctcaaaacaaacaaacaaacaaacaaacaaataatgaagttataaatttggacttacattctgggttagggacttgacatcaagcacatcagatatgatttgataatttctgtcaggaatgcaataataaaatagctctaaactccgtggtcattataaatagtaaactcatgctccaagcactataaaatgggcatgggcgcactgtctgcatcccactggtttcctgttaccccacctgctgcctcttgcttgaccatgggctgttgatggaaactgaggactaaacttataaggcccaccaagcttatcttgccttgcttgcttttagccgcttgcttctagctgattttaaaatccatatagctaaataatatatatctgccagtagcttccttatagttaacaactctaaggcattgctcaccatggtaacagttgtttttcaggaagtgggggtcagtccttgtccacttcaaaccagctgagaccaccagcccttcaactggacctgtgtgaatgtccagttgatatggacaggagacagggaaatactgggtagaagagggtggttccctggcaaaggccccaccctaaagcctggaaacctgcagcctggaatgagaacaagcattcctgttttcatgcccaaatgttgccttttggtctggaacgccccctatcctgtagtcatataaaccctaagccccaggctctacaagcagatgagcagacaaacagaagagcagaagagctgcagaacggcgtggcagagaaggagagtaaagaaggagcatctgaacatcaagaggagtttggctggggcagtcagggaggagagataggccattggacagccaaactccagggaaaggtcattttcccactccatccgctttccggctccctgctgacagccacctccaccactcaataaaacccccacattcaccatccttcaagtctgtgtgtgatctgattctccctggacactggacaagaatccaggtaccaagacggcactgagctgtttaacatttaagccatctgcggatggcagagctaaaagaggactgtagctcatccactggggcttcaggagttgcaggctcctacccctagacaccactggtgggccggtgcccaaaagcgctcaccctgattcctgcacctgcctgcgtgctccctctcccgtaaagggtttgagcacacacagtggctgaacagacgagccacacccttgttgcatgtcctgcaaggaggttcagggaaacctcccgtttcacagtgggtgaccttttgatgttggagggccaaaaactccaccctcagatcacgctaatgatctcattttgttaacgtgcatcctgttaagagccatgaagcttgactacacttgtgcaggtcactcattgccttgttttcccttactccagtcacctttccccatgcctcggaccgccttgctactctaccccataaatatccataaagcctcttctacggggaggcagacctgagaggcattctctagctgctcacttagctgcctcaagaataaaatcttttctccactgccaaactcatcatctcagtgattggtttactgtgtaatgggcagaatgtgcctggccactaacatgctcacatctactttctcaatacactaactctgaggtaaggaaggcatatcttagttcccgagttcaacagatggggaaactgaagttcaggaatacttcagctttggaagcacggcagagacttagcaaacaggttttctttcagtgcttaagtcctcactttccaatctctgtagccctgctcgtgacacagtggacattgtgcatttgcttgtctcacatctaagggaacactgatttacttatttattttgagacaggatctcagtctgtcacccaggctggagtgcagtggcacaatcatggcttgctgcagcatcaacctcctggactcaagtgatcctcctgcctcagtctcccgagtagctgggactataggtacatgccactatacctggctaatttttttttttttttttttttttgagacggagtctcactctgtcgcccaggctggagtgcagtggcaccacgttggctcactgcaacctccgtctcctgggttcaagcaattctccggcctcagcctcctgagtagctgggattgcaggtgcccaccaccacacctggctaatttttatatttttagtagagatggggtttcaccatgttggccaggttggtcttgaactcctgacctcaggtgagccgcccacctcggcctccaaagtgctaggattacaggcgttagccaccacgcccggactacctgcttaattttttgattttttttttgtaaagacagtgtcttactttgttgcccaggctcaagtaatgcccactccttggcctccagaagtgatgggattataggcgtgagccaccgtacccggcctgggatgctactctaaatgcacattcattctagctcccaaactacttttttttcgctatttctaaatcaaaatgcttttcgacattgctatgtggaaactgtgggttttataaagttataaagaatagtttaataagaaattacacccaagaaaagtataaaacacattacaatataaatgtgacctggcacttagaataaacatttgctttgcaatactctcatttgtttttttcctagaatttaaatgagacttttttggaaccagatttttaaaataaacaaatgaacaactgtccctaagaaaccttagctgacaccttttttgtttctgtcttaaagttcccagccaaggttttcaaaatctttcccctgacctcagaactgctggaagtggtgcagtgctgactgacagtttgttgacaagagaggcaacacttcacacttcactggaaagcataaaagcgtgctccaggtcattaactgagacttttaagaggaactgcttgctgcattatgatagtgggattcaggaacatttctttgcaattcgtacagttttgttgttttttcacaaaatggaattcaaatgcacagaatgcaattaataaaaattcttgattcatggcacactatcatcattggcccgtgaatggccttattttactttatatcacatttagtaatgaacacctggtaaaaccaaggcccaaccaagaactagaatatcaccaccattttaccttgacctaagggaaagggaagggcacccactctatctctgccctctggctctctcacataggttactcttctaaatctgttgtttgtcattcctttgctttttaaagatgagttttaccaaatatgcttgaacatctaaatcatatgtaattgggtcttctcaggtgataaaagtagtatcaccctgtatatagtcttctctagcctgttcttttcactcaacagtgtttctgagacattcatgtggttggtaaagctgtagttccttaattttcacctctgtgttatagtcccttgtgcgactctactaaaatttatattttttcctgccagtagatatccgagttgtttctatttctttctgtaagacaaacttttttgcttagaacaatcttctgtttcatattaggtgctaatgtttctcttgggtatataactagatgaggagttactgggtcttcaggcatgaacaaccttataaggtaatgacaaattattttccaaagtggttatattaatttacatttctaccaggaatgtgatcacattgattcacattcccttcaaactcaatattgtcacacaaaatttttatcaataggtgtaaaatggtatctctgtggttttgacttccatttccctgataatgaggttcaacagtgcttcatgatttttagctgtatgtattttttcttctgtgaaatgtctgtttgaatcttttgcagttttgctagcttttccctctttttgtttgtaggaacccttatctattctgcatgctaatcctttgtgctataataacttcagttggaatttttcttctatttctttaaaatattttttgatgacatgttttggtgactaattttaacatatctgaatttgtgaatattgtttcttacggtgagcatatttttgtgtgttatttaggaaatccctccctgttctaagatgagaacaatattagcttatttttctctaaaagtgaaagtgtgcttttaacacgtaaactcttaatccttctaggtttgatttttgtatatggtgtgaagtaagatctgatttcatttttccacatggataaccaatttttcagctccatttattattcaatcttgcctttctccagttctgtacttccagcctgtcttaaaaattcaaatatgcatgagtctgattcctggccctctatttctatctatcagtcagttcatttattcctgcaccaagaccacactatcttaattagtataactttataaaaaatcataatgtctgctagaataattctccccttttaatttttcttcagaaataccttggctatccttgacatctgctccttaatatatattagaattaacttctcatgttctatgaaaaatcttttggggattttgactgtaattcattacatctgtagattaacttggagaaaattcatgtgtttatcataagaacttatgattcataaaaatgggatctttgtccatttaggtattctttaatgctttttgctaaaattttgtaatttttttgtatagattttacacatctttgttagtttttttttaccctagaacttatatagtttggtgatattctacgtcaataatattgatatttgtttttattttttattttattttattttttttgagatggagttttgatctttttacccaggctggagtgcaatggcgctatctcagctcactgcaaccttcacttcccgggttcaagagattctcctacctcagcctcccaagtagctgggattacaggcacctgccaccatgcccagctaatttttgtttttttgtatttttagtagagacggggtttcaccatgttggccaagatggtcttgatctcttgaccttgtgatccatccgcctcagcctcccaaagtgctgggattacaggcatgagccactatgcccggcaatatttgtttttaaaaataaattgtgcttttagattgtgtctggtatagagaaatgaaactgaatttttatattgatcttatcaaaatcatctattatgtctaagaatttatttttagattctttggggatttctactgagaactaagctctgattttttttttatcttgccccaattcctatctaaggggtctgtggagtcatgtcctacaaaccacaaattctcatcagaagggttttatttaaccctgtatattgtggcttactttccaatctgactctggcataacaaggaagaaaagcaaaatattttacctcaaaacatgtttctctgccgtatcttgaaatggccctgcaaagctgtcccttgtgggaaaaaatccacattctatagagaatccctttcccctcctttttttttccttccttcctttccagatccaggagataatcaactaagagccaggcacccttttaggtcctataagaaacattttacaacctgctgtctctgaagtctgctatctagagcttactctgcacaataaaacttggtctccacaatcctttatattaacctgaacatttcccttctgttgatcccaggtcttcagataaactcaaactactgtcaaccagtaaatgtttaaatttacctattgcctggaagctccccctgcttcgagttgtcctgcctttctgaaccaaaccaatgtatttcctaaatgtatttgactgatgtctcatgcctccctaaaacatataaaacaaagctgtgccccgaccaccttgggcacatgttctcaggacctcctgagggctgtgtcacggtccatggtcactcatatttggctcagaataaacctcttcaaatattttacagagtttgactcttttggtcaacagtactgtagacaatcatatcatccacaaaaaatgatagttttatttcctttatttcaattcttatgtgtttattttccttatggtgctgcaaaacatctccctaaaacgctgacttgaaaaatgagggcaggcctctttactttggtcctgatttccaaagaaaaactttccatgttttcctactgagtatgatttttgttgtaggcgttttatttaagattggatctaaagaagactcaaagtcccgcacaacattgctttaattccattggccagaacttagccacacagctatacaaagctgcaagggaggctgggaaatgtggtgctttagctgggtgggcaaatggagttctgttaatttgatatagaagggaagaatggctatttacttggtaatgagtaggcagactctaccatatcttttggatgttgcctagaaaccaaggtgggcatttaggctagtgtcatatggatatcttgcaagatataaaaatgtcttaggccttttcatgtaattataaaaacaaacaataacattacaaaaaaaagttgcaaaggaactttcttagccagccagtccaccctgtctacttcctgatctcagaactccgtttgtgccaaaactaagactccctacttgtcagggagagaagagtagaaaccatatcatgaagattttcatggtaaaatgaaaaattgaagtttaagccagttttaattaccagtgctctttgttacctcaccacccctacttccttgaactttgaaggcatgagggaggcatgagacagcaatcaaatacatttgaaggcatttcctcaccctaggaagccaaggcaccatacatggtagggttgtttccagacaaattgtacagggaatcaaataagtgaatgcccaggtagcgtattttcaaaatatacgtctgcagtcctcctcccttgctatatactttcccccacactcactgcaatctggccacactggccccttttctgttcctcattgtgattttaaagtgtggtaacttagttaagctataactacatttcccaaaattcccatctcccgccattggcagtgggctgcagagaaaagacttggaaagtagcagaggggaggcagccagtaggctgtgaaggtcagcgagggctgccaggcatggctgctgctcctccagctgctgtcggatagcctttgtcctgtctgagtcctgagccagaaacacacagctctgcagtgaagggcacaggctgcttctgtggctcccctgtatgatcaaggtagaaaacggtgcattccagtttgtccttttgagttcctatttgttctcatgggttccaacttgccctcacagattctagtttgttctctcatttcatgttcagctttgcttcctgactcctggtcttgctggtctactgtgacttcagatccatctccaaatgcagaggcaaccaccttccatgggcgtcctccccagttcctgcaactatgtgaggcccaatccatggaaccccttcacaacattgtacaatagcttcatagtaagtatcacgatttagtaaggcagatccctctatcaccttctctaggagtgccttggctatttggggagctatttttgctcttccataacaattttagaatcagcttattaagatttcccaaaaactgtagaaatttgattggaattcaattgaatctgtagatcagacaagagagtttcacagttttcttagtaataattttgcacattttatttttatctctagcttcctaatcctttttttttacttcagatgatatatattttttaagttatattttataactgttgttcttgtataaaaacagtttttatatattgatcttgtattcaggaatctttcctttttttttttttttttttttttgacacagagtctgacactgttgcccaggctggagtgcagtggtgcgatctcggctcactgcaacctccacttcccaggttcaagtgattctccttgcctcagcctcccaagtagctgggattatgggcacccgccaccaggccctgttaatttttttgtatttttagtagagacggagtttcactttgttgcccgggctggtctcgagctcctgacctcatcatctgcccaactcagcctcccaaagtgttgggattacagatgtgagccacctcacccggcctattcgggtacagatgtgagccacctcacccggcctattcgggtatctttctaaactaattctagtggttagtggtagattattttgggttttctatctggacacatagtatgtgctgataacagtttagtttctaatattagctttctaatatttactttttttcttgttctgttgtgttggctaggatcgtcagtacaatgttatttcatttttacacattctatgaatatggcctccccttcaatcaaatgtctgcactgcgtcgctactcattcttaagtgatgaacttgcttatttcactgagaaaacaagtgtagagagaacttccttagtctaatcaccatacaatctacaaacaaatcttcctttaaacttttgtgtttccctcccaatacaatgaatggattgtgtgtgctctcgccaagatcaacctttcctcttgggcaccttcttaaggagttggctctgcaatcaccctgcctctccttcttgtatcagcattttttttttctattttaaaatgaatcaatcttctcaggttaaaaacacactgtcatagcttaagtcttaagtacacaaaaatgcgtccctcgatctcacatcttctttcagctattccaattctctgctcccctttatagcagaacacctcaaaagaatcatccatacctgctagttttcactctctcacctacaaattactctgttggactactgtaatgaagtactgttgttcccagaattccgctgaaatagcccttgtcaaggacaataacctctacaatgtcaaaggcgatggttgattctcactccttatcttacttaatctctccgaagtgtttgacagtgtgtgtagtataaatacatggggtttgcttactcattaattttttcgaaggggtgaagcatttggctgtgataaaataaaaacttcagccgaattaaatttaaaggagtttaatgactaatgaacgatttgcgaatcgggcagcccccagaatcacagcagattcacggagactcgagcgcagccacgtggtggaagatttatagacaaaaaaagggaggtgaggtacagaaaagctggtttggttgcaggttggcatttgctttatttgaacacagtttgaacactcagcagtatgtgagtggttgaagtatggccgccgggattggccaagactcagtgactgttacaggcgcatactcctaagttaggtttctgatcttgtctgcctattaagctaggttacagttcgtccacaaggactcaaatataggagtcttctcaggccatatttagttcactaaaatagctgtatgatacagataaacctctgtttaaaccaaatttttctgttatttgcaaccaaatgcattcctcactgctttataagtttatagaacctgttttaataatcccaaccaaatcccagcactttgggaggctgaggtgggcagatcatgaggtcaggagatcaagaccatcctggctaacacggtgaaaccccatctctactaaaaatacaaaaaattagccgggcatgatggcatgtgcctgtaatcccagctactcaggaggctgaggcaggagaatcgcttgaacccgggaggtggaggttgcagtgagctgagattgcaccactgcactcaagcttgggcaacaaagtgagactgtctcaaaaaaaaaaaaaaaaaacaaccgaaccaaaaaacatctattataagaagcaacatggtacagtgaggggggaaactgaatttagagtccagatgtacttctcctttgggactagcgtggattttactcccactctcaaacttactacacttcagatcctacagctactacacttcggatccattgtgctaagaaggaagaaaacaatggctgagattgaggtaacagtgcattttctctactaagtcttccctccacctggctgactaaaaatgtagtttggcaattgaaaaaataaaagggagcttcaacttcagcttcccaaaggttggattagatgcactttccttatttttcctattaagtgcaagtaaaaacttaatagaaaacaaacctaagatgtctctgaaaggcggagatgaagggagactggctagggaccttggaacccaagaaacaacatagtggtgagttgtctggattttccttttgccttataaatcccagacttggagctgaagaaactggcaacatgtgaacagcaataatgcagacagaaaaaaaaaaataaagtcccaacaaaagttggctcttcctagctaaaggacaaggaaaaaggcaacctagcaagacagaaaacttttaggaaataacgactctaccctagcccagcaccacaggaaaaaactatggttccacccacacccacaccagcaaaggccaaatgaacacctccacccatggaggctctaatgaggtggccctccctctttctctctgctggagtgatgtcagaaaaagcctgcaaaacagaaggcatagaaagacccagagtctcaaaatatagtacccgaaatgctcaggttcctatcgaaaatcactcttcataccaagaaccagttagatctccaacaaaggaaaaaagacagtggataacaacactgagatgacagagatattagaatcatctgataaagcttctgaagcagtcatataaaagtgcttcaacaatgggctcacgcctgtaatcccagcactttgggaggccgaggcaggtggatcacaaggtcaagagatcgagaccatcctggccaacgtggtgaaaccccgtctctactaaaaatacaaaaattagctgggcatggtggcatgcgcctgtagtcccagctactcgggaggctgaggcaggagaattgcttgaacctgggaggtggaggttgcagtgggccaagattgtgccactgcactccagcctggagacagagtgagactccatctcaaaacaaaacaaaacaaaacaaaaatgctccaacaagcaatcataaacaggcttgaagcaaacgaaaaagtagtctcagcgaataaaaagtctcagtaaataaaaggagaaccaaattttagaaatgaaaaatacaaaaacccaaaattcaaaggatagtctcaacagcagaacagaagacacagacgacagctcagtaaattggaagagagagaagaaaaattatccaattctggccaggcacgctggctcacacctgtaatcccaacactttgggaggctgaggtgggcaggtcacttgaggccaggagttcgaaaccagcctggccaacccggcgaaacccctctctactaaaaatacaaaaattagctgggcatggtggtgcgtccctgtagtccctagagctacttgggaggctgagacataagaactgtttgaacctgggaggtggaggttgcagtgagccaagactgcaccactgcactgcagcactccagcttgggtaacagagtgagactctgtttcaaaaaaaaaaaaagaaaaaaaaatcttagctttggcctgtgggggaaaaaataaattacccaatttctagagataaaatggactgttaaacctgtattactataacaaaaacaacaaaaaaatctaactttcacatcatttgagtctgagagaggagaaatagggtagggtggggccaaaaaagtactggaagaaataatggctgaaaactccttaaatttggcaaaagacataaacctacagattcaagaactgagcaaatcccaaacaggtaaacctgttttgcttaatgtatcttttttttttttttcattttcaatatactgtttccttattttacatgtgctttggttaacatataaatttaaaggatagaataagctgatatacaaggcaaacagtacatcacactcaacagatacatatttttaagcacatgaaaaagttaaaacttttgaccatcaactaggtcagaaagcaagtttcagcaaatttcaagggtctgattattgcagaaaccacaatgtgattacctcagtagtcaataaaaaaaaaagaaaattccatatgtttggaaacatattactaaataactagtacatcaaagaattatgggaaatttgaatgtatttagaactatgatcaaaatactgcatatcaaaaacttgtgggataaagctaaagtagtagtttgtagaaaatttaaaatctcacatgtgtgtattagaggaaaagaggcttgaagccaatgaaaaaactaatgagctaagtaccatcttgagttaggaaaaaaagcagcaaaacagacccaaagaaagcagaagaaaagagctaatgatgacaagagtagaaattaagagaaataaaacaaacataaaagagcaaggatcaataaagacagacttgatcatttgaaaagagatcaaactgacaaacctctgacaatatggatggaaaaaaggaaggcacaaaaataataggaatgaaagaaggaacgtaaatgcagttggtgtagacattaggcatataatcaacaggctatgatcaacttcatattaataaatttggaaattcagatgaaatggaaaaattcctggtaaaatacaactgaatgaaggagaataaaaaacttgaatagttctataatcaaaagcaagactgaatcagtaatttcttttttttttttgagacagcgcctcactttgtcacccaggctggagtgcagtgccgagatcatagctcactgcagttttgaccttttgtgttcgagtgatcctcccacctcagtctccttagtagctaggactagagtcatgtgccaccatgcctgactaatttattttattttttgtagagacggagtcttgctttgttactcagactgatcttgaacccctaacctcaagtgatcctcttgcctcaacctcccaaaatgttgggattacaggtgtgagtcatggtacctggctgaatcagtaatttaaaaataatcttcccacagagaattctaggccccaatagtattactggtgagttctatgaaatattcaaggaatgaaaaattccaattatttcagagtattgaataagggaaaacactactccaacttattatatgggcttgggggaagaatatatgttactttgtataagagccgcaaaaactacaagacagatgtgaatcttaaatctttatgttgacaattacaaaactttactgaagggcataaaagatataaatggagagatataccatgttcataaatacaaaatacaaaaggctttgtatttattggtattactggtattacaaatatgaccattctcctcaaattgatcttataaactcaatgcagttcttttcaaatgaaatcctatgaaggtttttaggaacttcacaagctgatccaaaaattcatgagagtatagggcttcaagatagccaagacaattgtgaataacctgaataatgatggtgctctggtgcttatcctatcagagagtaattcttactgtaaagctatatttaataaagagtggggctagatatggtagtggtaaagagcatacagaaagaactacaaataatatggaaatctgacatatgacagaggtgaataaattttttttttgagctctgtcacccaggttggagtgcagtggtgccatcttagctcattgcaacctccgcctcccaggttcaagcgattcttctgccttagcctcctgagtagccgggattacaggtgcctaccaccacacctggctaatttttgtatttttagtagagacggggtttcccatgttggttaggctggtatcaaacccctggcctcaagtgatccacctgtctcagcctcccaaagtgctgggattacagatgagagccactgtgcatggcaagataaacttttaaataaaggtggtactatgaaaattggataggagtattgaaaattataaaaattgaagtagacaccatgaacgtacaaaaatataatcccaaactgcttaacgactaaaaagtgaaaaaccatattcagaagaaaaaaggttaatatctttatgacattgaggatttcttaatacagcaaaatgcaccaacggtgaagaagatacttacattaatattaaaataaagtttgtttttttattttattttttttggagacagagtcttgctctgccaccaggctggagggcagtggcacgatctcggctcactgcaacctctgcctcctggactcaagcgattctcctgcctcagcctcccaagtagctgtgactacaggcacacaccaccatgctcagctaatttttgtatttttagtagagacggagtttcaccatgttggccaggatggtctccatctcttgacctggtggtccgcctgcctcggcctcccaaagtgttgggatcacaggtgtgagccaccgaccccggccataaagaacttttatatgacaaaaatcacaaagtgaaaatgcaagccaggaacagagagaagatatttgcaacctctataaatgtcaagaggttaataccaagaatacataaagagcacgtcaattcagcaggaaaaagcaccaaacagaaaaatttgcaaaggatatgaataggcagtacagggtggtggaaaccaaatggccaataaatacaggaaaggaccaccaacctaaatagcaatcagagtaacataaattttaaagcatcaaagacacaatttcaaacttatcagattggcaatagtccaaaaacatcaagttattggcaatatggagcaagaggaaatcttacttattgctggtgggagactaacttgttacagacattttgctgaacaatttggaatacctaggttacaatggaaaacatgaacatctcacattccaatagttcccatttctagtgataggtcttagagaagccttcacacactgcagaagaatatttgtgtgctatttttaatagtgaaaggtaggaaaaatgtaactttacctcagtaaggaaaaggctttatctgtaatgttttatttcctttaaaaaaaatctgatgcaaagccaggtgcgatggctcatgcctgtaatcccagcacttcgggaggccgaggtgggtggagcgcctgaggtcaagagtttgagaccagcctggcctacatggtgaaaccccatctccactaaaaataaaaaaattagcccggcatggtggcgagcacctgtaatcctagctacttgggaggctgaggcaggagaatcacttgaacccgggaggtgggggttgcagtgagctgaaatcgcgccattgcactccagccagggcaacaagagtgaaactccatctcaaaaaaaaaaaaaaaaaaaaaaatctgatgcaacgctgggtgaggtggctcacacctgtaatcccagcacttgggaggctgacgcaggaggactgcttgcgcccatgagtttgagaccagcctgggtaatatagtgagaactcgtctttacaaaaaatgttttcaattaccaagcatggtgacacgtgcctgtagtcccagatactgagaaggccaaggtgggaggatcactggagcctggcaggtggaggttaacagggagctgagatggcgccactgcattctagcttgggtgacagagtaagaccctgtctcaacaaacaaacatctgatgcaaataaagcatttgttaaatattattttgtatacttacctattaatctgaaatactatatgaaaaaattttaaatgtgaaacataagcaatattgcctttaacatttacagtaggttaaacatctattcaactgacctctgttcactaaaacattagtaatgctcatcttttttataaataattctctacaacctaacacctagtaagtaaagcttttattgcttctctcctggaaattatcctataaatgggttaaccttgtaatgttgattcaaaagcacaaagggaaaaggcaatagaagtccttttaagatctactttaatctcaatacttttaagttttaaattttgatctcattaaccttatgaatgtcaaccaacagaaaaataaaacacaccaaaagatccagaactctttaaggattgtaaagggacaagcttgaaagcctgacgccaatcctctctttgtccaaaaccaccaccctaacggctccagccccatgaattcctagtttaagaatctctatatcagatgctatcaaaagttagtaatcgtagctaacatttatagagtgcctactaaatgcggaacactgttctaagggctttacatttgttaattcacttttaaatcataaacacactgagatcaggaaagtggtttaactattcttagtttcagttccccgtagtacagtacagtaagatattctgagagaccatattcacataacttttactacagtatggttttaattgtgccacttcattattagtccttgttaatctcttactgtgctcaattgataaactttattataggtgcatgtatggataggaaaaaagacagttcacatagggcttggtactacacttggtttcaggcatcccagggggtcttgaaacatatccccagtaaacaggagggaactacttactttatttccgacttccacataagcaaactgaggcacacagagggcaatttgcctacagttaaacagctagtaagtggtgtagacaagattcaaatctaggcagttcggttgcagagcacacactcttaagcaggaatctttgctagttaattagacaattaatgagaaaaggtatatcaggaaaacaatctaagagttgcaaataagtattttctaaatgaggtcggaagaaaaaaggatagaaccatagtctccaaagcatttctgtctgttttattccttgccaaacattaaaactgtgattctatttcctgctttgaaaatcagttctgttttgcactgctcaatgcctttaagatgaaggtttctttgtaatattaacaatcagtgcactctttctttcaactcctttattaaattggttgcaaaaaagatatacattcttatattgacaattcttgtcatgaataaaagcatcaaaaataaggcaacagcaagatgtgcttcacatataaacaatcatgttgtaagaataagaaacctgaatccctgtacaacaaaaagattaggaagcaaaatgtgaataagcttgtattcagaatatacctatatgtgtgtgcaaagacaatacactcatcatatacctcacttaggttcctttatgatgcataattccttaatcattcatttgtgaaacaagaatgaatattaagaaacatgaaatccaaattgcacttattttcacaatatcaatgctaaactcaaaatagcaacttcattgactctcaatggtaaatttcaaacatggaaagcaatcttaatttttttaaccctttgactagggtctgtaaaaaacggtggattattttactgtacttacaaagaggctgggtctcagcctgcacttaaacagcatgagcaacaaaggacaggaaacaaatatcactaagagtaatgcccatacatataaagatatctagttgagccacgttctacttacatagcaagcctattaaaccactagcataacagatcatatctcatgaaacagaattactaaattaactacacatctctcagaaatttccaaatccctgctcccaacacaattttagtacacctattaagtaccacgggtcatttagaaaaacagaaaaaaatatacacctagtctttgcaattaaaaaaaaatcataacataaacaatgttagatataaattttgaactcaatatgttttttcctacatatttatgtaatcaaggctctttaagcaaagacaggtggtaggtatatgatctgtacaaacttacagtagtgtatattccaaataaaggtttttcttcctactatggtatgacaatataactgttttctgaatgaagatacatgttaaggcttaaggtgtaaacactttggaaggcaaacagcttagtgaaaaaaattatggttcatttaaaaatgtgtatcatttcataatagacccctgaactttcaaatttacatgtgagaatacatttacatcttaactttctaggaaaggcacaggctttatgtaaaaaagcagcaaagttttaaacccaccaatatattgacaaagccattacttttattagaaacaaataatgcttctcaaggtgttggcaacatgtcatagtatcaacatatacttcatacagtgtatttctccctttaattatattccggtaggaggtggaatacctccttggctatgaggggcagatgtatttgatggactgtgtaggctggtctccttgtacacaaaccaagcatttcctccccagagtatcatatttagaaagccaaatatctatgaaagagaaaaagaaatatgaaaatcaaatacctacttataaaaattcatgccctacttaaaaatctcactttttctttaaatatttaacatttttaggaagtacgccattatttcacttaaagtttaatactacacacaatgagaaataaggaagactacacttcaatgtacaaaatgtggttatataatgacttattcccaatgaaataaggctaaatctctaacatataaaatcatggctaagagatttactcttccaaatacttttcacttttctcctatttagaatgattatcaactgcttgtgtaacttttcccatttacttatcaccccctcctaccatctcttctactccaatccaacagttgtagccacaaaaaaagaggagtcacacaactttacttcccatcccaatgagttaacctcaaagaaattaatcttcctggctgggtgtggcagctcatgccagtaatcccagcactttgagaggctgaagcaggcagatcacttgaggtcgggagtttgaccagcctggccaatatggtgaaaccctgtctctactgaagatacaaaagaattagctgggagtggtggcacatgcctgtaatcccagctacctgggaggctgaggtaggagaatcacttgaacccaggaggcggaggttgcagtgtgccgagatcatgccactgcactccagtctgagcgacatagcgaaactccatctcaaaaaaaaaaaaaaaaaaagaaattaatcttcccagatataaatctgactagatgaaagaaagtctcagagatgaataaaatcatgatcttggttacaggtaatactttttttagacaaacttttcttcactaaacactatattgttactagaattcaggtagctgagtaaaaataaaaaccatccagagatttactgaaagctattgctttcctgaattactagtactttaaacaaatatatgaaagaaaaaaattataaataatgcatacataccacagatacatttagggatcccatactggtcacagagccaaagtaacacagtactgctttcttcttacaaggcggaagttcatcaataatattgtgaccagtagctattttaatatctgtcagagctttagcccaggctgaagtgctcaccaaccacaaaaaagtggcaacaagtgtaacaacaaagtcctaaagcaaaaatcagtaagagttaataatgaacagttaattttaatactaaatttcaaatccatgatgaagaaactgagattacattcaaccttatggtgctgagaaatggccttcatgatatactttattaaaaaagtcagtcagcatagtaaacattgctgttagtgttacaagcacagtgcctgagttacaacagtaaataagactcagtcatcccctcagaagtctaagattttcacactagaaaccaaagttttatacagccttcaacataacctcacctcagccacttactcccaggaccataccttagaccttgtcatcaccaataactgtatccttccatactctgttttgatcatcccattttcccataacacctctttccagctcactgtctctggcaccccaatcctaaaactcctttgaccccaccaagacctacaatctgatcctactgctttcttactgtatcaccacttcactaatgtcctcacttattttaatcaatttctgttctaagggccttcattatcatctcttgcacatactctcaactcacttatccttcttctgcaaaactctaactttagttaaaccaaattctccatgagatggataataaaatggtgaaaagcacacaccagaatggtatctcttttaaatttcctaaccacaaattttaagaatgctcactatattaagaaaaaggcaacaacaaaaatctcccaagacaccttatcactattaactctgtactaaatcctttgctatttattacaaagaatgggatggttttaatattttagaataaatggttctaatgggtggttttaatattttagatcataagtctaatcttgtttgatcttccttcaaattaatgaccagggtaggaataatataaaatttgtatcttttggatgctatatatgctaaacatatgcgtacactcaaggataggagctcttacatatctgcagcaaaaatctttctaacctcagaatggattttggagcttatcacagaagcattttgttttttaaataaacccaattagtttttaattattttgccagccaccttttagtcatttattaggttggtgcaaaagttattatggtttttgctatttattttaatgataaaaaccacaattatttttgtaccaacctaatatttaggataaataccagtgatctcttaggagatatagaagctatgctatatagcttgcccacttggtcaagacaacactgaatgaatacttaggattagagaaccaaaaataattactaattacatgaacacggaagtacatgcattttgtatctgagctctctgctgctacttgtccttttaaaaaccgtagctcaaagagaaaaggctagaaatatagcttatattttctgcactgtggaagtactcccccctttttactgctgtacatctgctatacattctgctgcaggtagacattttctaaacgcttgctagaaatacagtgttttttggaaaactgatgagtaacatgaggttatatcgcatgttaaataatttctctttacggaaaagttcacaactttgatcaatatatgtcaaatcctcctaattttcaggtattttcttccttccaaagtctttttttttcgtagttatactcttaaatccactttgatggcttgaggccattcttatatttcaaaagcaggaacttttctgaaaatgatgcacaaagtaacctaggttgaaggaacgtggggggaattctggtcccttcagatagtatttgctctactcaggactctagtcacactgcactctaagcgaatggtgccacctggagctctgcaatgcacaacctgcagctgcctagggcagctctactcctcccaacaattcacaatatgagtcatagatttttagaatttgggataccctaattttgtttggattcattttctggtattctcaattttccacattgccttgaaaccttaaactcctgctacttaacaaaaaaaaaagtgctatatttacttcaaaagagaattgaagtagatttaaattttcataactgaaatactcctagaaacaccttagcacagaattgagaatattgctaaaagggcttgtcctcattaatagtacctaaaaattaatgtcatatttggctatatcttaaattttgggtatctcaaaaaaaacctttttttttttttcccctgagatggagtcttgctctgtcacctaggctggaatacagtggtgtgatcttggctcactgtaacctccacctcctgggttcaagcgattctcctgcctcagcctcccagtagctgggattacaggtgcccaccaccatgtccagctaatttttgtatttttagcagagatggggtttcaccatgttggccaggctggtctcgaactcctgacctcctggagtgatccacccacctcggcctcccaaagtgctgggattacaggcatgacccactgcacccagtctctcaaagaaaatcttttaatatttttatggttacattaaaaatagaactgaaaattaaatttagaagctagacttttatagacaagaagcacccattatgtaacaataaaaacctacttaaggaattttggattatctctttatatgaccactaattggtcattctgaggtggaaaattactttttacgtttctgaatgatgcaactaggtcagttttatagttttatcagacaaaaaccacctacaaaaatagattggaatgctgctttaagaagggtagtatttttaaaagtttactagacaaaatatgagaaataaagggcacactgatagatttagtaaaaaaatttgttgggatgacaaaatggcaagaaatagcttctagttataaagaattttaacaaaatataattatctataagattattccagttcccttttaaataagatttgaaaagtctgcagaagacacagattcctaacaagtatgttggataagcactgcaaattaaaacagttgacgtcttatctttttaacaaccgagaagtattttatgaaaacctctagttttcttgtgtctcctatgacataagaaacagaattaaatatgaatgataaaagactgttgtattacttaccatttccattcttatgatccagcagcaaaattaaaaataaatatgtaaataaaacttgtaatgttatttaataatccttcatatttaaatagccttccctttaaagtaacttcacaaataattagcagatgtgttttctcatacatatgaatgaccagtatcacacataaaaaacacctctgttttccctttaagtcactaataactgactttgtagttactcttttatagtggaggtgtagcttaaaaccatgatttctctctggatttgccaccaataatccagggcagattctactaactaaatctcagagaatatttctagctcagtaggctctgaagccaaaagtataggacttcaaatctaagtcctttgttgatacctcaaagattcaaaattagttcatggttgccactaatgctgagtataagaattacctgggtctgattttaaattaaggagtttagggacatagaccaggaatcaacaaacttcttttgaaaagggccaaatagcaactattttttatctctgttacaactactcaactttaccattgcagtgtgaaagcagccataggcaatgtgtaaatgattgtgtatggctgagttccaaaaaaaacctttatttaaaaaaacaaggccaggctcctggccacacctataacccccagcactttgggaggccaaggcaggcagatcacttgagcccaggagtttgagaccagcctgggcaacatggtaaaacttcgtctttacaaaaatacacaaaaagtaactgagtatggtggcttgtgactgtagtcccagctactcaggaggatcatttgagcccaggaggttgaggctgcagcaagccaagatggtgctactgccctcctgcctgggcgacaaagcgagaccttgtctcaaaaagtaaatatataaataaagaagtaaaaataaaaaataagacagtgacctctgggacatagtttgtgaacccatgatataattaaactcaataagttttgtagaagtataaagtgggcctttagagaaagaaaaaaagtaagaagcagaaagagttatgagactatgttgtgataagtaattcttcaaattaaaagaatttcgacttaatttttttgctatttgtaacctgatgtgctttattacatatctgagttttttccaagttaaaatagatttaaaaaagaaataaactttccttatagtgcaaataggctaaaaaaaattgagttaaacttaatgggagaaagctcaacctcgtggcaaacacaggctaaaatatgctgaactggcttacaccaagaatttttatttccagtataagaaaatctatatttagcttatacaaattatttttgtatttaaaaaataaagtgattacttactatcataggaagtttacgactatccagatacagactcgtgtagccaacataaagcagaagggcagcaatgcagtacaggaacacaaagactgcaaaggtaacatagaattgtgcagaagaagagtaatcgcctatgaggacgtaatctttccaatttacatcacatatgtttacacctggaggtggctgaaatgatgcctcattcaacctattaaaataaatgtatgaattattggactttcccaacagagacagaaacatttaagcaaaacaatgagtgacacttcaaaaaatactccccaaatatattaaaaacattcctttggggaaaaaagtaaaattcaaatattatatttaagtaaactgaaattttcataataaatgtatatgttatacctggtattagtttatgatacattgaatatagactgaattaaatactttcatacccagatactatcttcctgcagtaaacaattaggtaggagagattataccaaatggtttatactttgagacatcatatttcattctgtgtggcagagtatgtgtgactagccccaagagagccaatcacaacaatgattcacatttttaaccctggatcaatagttgctaacaataaatattgcctttcatttttcccaaccataaattgtaaaaaacttgtcactaaagatgctgtaacagtcccttatgtgagaagtgtctaggagaaaggatacaagatagagaggctttgatgattaaccacttattatctgacttatctttaatatggggattttatttaatcatcaaaacagccttacaagataatacttccaattactggaccaaaaaattgagtcttgggtgaagtaagtaaaattagtaagtgaaagaagattcccaccctggcttaaacacaggacatattcaataaacttttcaatggatactgatgtcaaacaagacttcacagatgaaatactcattttactttaagaaagtgtggctttatgctaatgaatgaaatatggaatctctttatatacatatgtcttaaaactatataaagacattaatattcagcaattacaaaaaacactgagaatctggatttttctaagttatgtttccttctacattagggcttcttatactaaggtgatagaacaatctctagtttgctttatttttacatttccaatcctctgttagaataaaattatcaaggcaacatcacattgttataaaagtttctaaatgcttactctcactttctgtactattttgtcacagatcaggagatgtttttagacaggcatgggtctgtgtaccacagtttgggaggtaatgatcacttacaaatgagcatacagtctaaaattttctaccccccacaatcaataaattgctggaaatcttaatgactcactgtgaaagtaaaaagagttgtgaaaccattaaaataaatataactcacctgaatggataaccaaaagtagctgtaacagttttattctcagtaactgcaggaggacaattcacttgaatttctgtttggcccttaaaacctccacaggtggcaaaagcaaagatagaagcaatctacacaaagtaagatgaaaaaagacaaaagaaaaaaaagataagcaatactacaaccaaaacaagggtcactaaaactgtaagcacactgattattaaaaattggctaacattctagaaattctttttttgagacagggtttctgtcgcccagactggagtacactggcacgatcagggctcactgcagccttggcctcccaggctcaagtgatcctcccacctcagtcccccaagcagctggatcacaggtgtgcatcaccacacctggctaatttttctttgaattttagtagagatgaggcctcgctatgttgctcagattgggcttgaactcctgaactcaagcaatcctcccatcttggcctcccaaaatgctgggattacaggtgtgagtcactgtgcccagcccccactacccttttttaaagagatgagtctcactctgttgtatagactcaagtgtagtggcacaatcatagcttactgcagccctgaactctcaagtgatcctcccaagtagctgggactaaggagtgtgccaccatgcctggctacattctagaaattcttaaacacaaactaagatggtgaaagacattaaaacattcatttgcaaacctcgacaaatgtgattttattttccccggagtataatatagaaataaatgtaccagcccatatgacaattcatttgctcatactttagtgtatccactaagtattagtatgaaatatagagggagactcatttattagtataaaatcaaaaggggtgaattggaggtatttttatttggaacacaagttaccagtaatttgtaaagccaagaggttgtcagcagagaagagacactatttcatgagcctgttaaacctcccttgtgggtatttccaggtctcaaaaagttgttggaaacttattttcctaatcatgtatatgcttaaaaaaatgaatggtgttctctcaaataccatctaaaacacaaaaaacctagaagcaacctaaatgttgacagggaatcaaactataattcatccattcattcattcatgcaatgaaacattatatagctgttggaaattaacaacatagaatgttggagattaacaacatagaaagtgttcattacatacaaagtagatttaaacaacaaaaactagaaaggttatgcatcaaaattttaacactggtcacctctcaaaggaagataaataattcctttttatttttgtacttgtgaattttctacaaaacaacacaagtaagcaaaaaattccagatgcgctgttaaagtccaggagctcaatctttcagcaagtggtgatggctctattttcaaaatacatttgcaatctgaccacttgtactgcctcctgatctgaactaccatcaccttttgcctgaattttgcactaacagccttctaaatgatctctctgcttctgcccttgccccagcttcagtctgttatcaacacaacagccaagacaatcttttaaaaatgtaaggcagaaaatgttatcctttgctcaaaaccctccaatggcttttgagctctctatgaataaaaaccaaagttcatataaaggcctgcaagatcctttcttcccttatatttctgacctcatgttgctactttttcctttacctaatctgtatacacaaactgctttccatgcgatacctttaatgacacgggataaactcttccttcaggacctttgcactggctatttcctctgcctggaatacatgcttcactccctcacttccatagcttcctgttccagtatgaccttctcagagagaccttcccctcaccacactatatcaaataacagcactcctaccccgcactacctattccctctactctatttctgctctgttctaattaccactgcttgacacagtacttaatttgtctgtctttccctagaatagaaacttgaagaggtcaggggcttcgttttgttcaaggtcacacacactcagcaactggtagtagataatattcaatgcagatttgatatcaaatattcactgtggaacacttgacataatgcttcccatggattattccagggccttgaatcttgtaggccataatccacattatagtaattgtcaagggtttgttttttcccatccgcccccccccccccccccccccccccccccacaaaaaagatacatgaaaagaatctggttacagataggaagagtctgaggtaatgtccagcacatagtttggggtcttaactgttaagaggtgatccccagtttttacaggatttcaaaatatgtaaaagtaactttccttggaaaatgtgtcatgaaatcatttttcattatttgtactaaataatgttttatgttaaaaaagaaggtaaagatggaagaatcaatactctctcagaataaatatgcatgaatacacagagtgaaaaggccagaaaatgagtcctgagcatatacccacgtttaaattaaaaaaaaaaaaaaagaaaagaaatgagatacacaaattgaaccaatggagcagaataaaaaggccaggaatagactagtgtgtataagacaaattgtatctaacagagttgatttgtagatcacggaggaaaggaatgtggtggttttaaagatatgcccacaaactctttgatacaactcccatcaagagatggagcctgatttcccttcccttgagtgtcaactaaatgtagtgacttgcttctacagaatagaatatggtactgtagaagaaatgggatgtcttttctgagactcagttataaaaagattacaacttttttttttttttgagacacagtctcgctctgtcacccaggctggagtgcaatggtgcaatcttggctcactgcaacctccacctcccagattcaaggaattctccttcctcagcctcctgagtagcaggggtaattacaggtgcctgccaccatgcccggctaatttttgtattttcggtagagacggggtttcaccatgttggtaaggccagtctcgagctcctgacctccggtgatccacccgccttggcctcccaaagtgctgggattacaggcttgaaccacaacgcccggccaaagattgcaacttctgtcttcctttctcactctctcgaactttctcattctccgggggaagccagtggccatgttgggaggatactcaggcaacttttataaactcacatggtgtggaattgaggactgccagtaaccacatgactgagcttggaaggggatcctctgaggtttgtcaacagtcatgagaataagctggaggccttgagataacagcaaccccagccaacagcttgactgcaaccttatgggagaccctatgcccaaaccacatagctaagctgctcccagattcctgacccacagaagaatgggtgaggtttattatctcacttaataaaagtcaacagacctttgttttaaactgctaagctcggcgtaatttgttatacagcaatagataactaatacaaggaagagctgttcagtaaatggtccagatgagctgcacacaaaagtaaaaagtctttaaaaaatgtgaagacaatataaaagaaaacctgtgaccacatgaaaagggagaatttaagatttttttttgtaaaaaagaaccataaaagattgttaaattcaactacagaaaaaaaatcttaatcaagtcagctgttgaatgtaaaacaagctaccaattagatgaacatatttataataaacataatgtcacaaaggatttactagtatatagatctaagagaaacccttgctcacacgtactaagagacatataagaatgttcatgaaaaatggggaggggaaaagcaacagggaaatggataaaataccatagtatattcttacactgggaagttatacggcaaaaaagatataagaattacaactgcctacatcaacatagatgaatcatagaaatccaatgctgagttaaaacaaaaacaaaataaaaaccatgttgcatatgactacctagactataaaaccattttttaaaaagctctgtttacctgcctacattacacctgccactatttttgttcaggccctcaccatttttcattgggactaacccagcagactctttctcacatttccaatttcattccaattgatactcatcttctataatgtgggcactatagctgcagtacccagtaatgctacttgtgagtcttgaacactttacatgtcactaatctaaattgatatatactccaactgcaaaatacacactagattttgaagatttactatgaaaaagatgtgaaatacttcattaatttttatattgacgacttgttcaaacaataatctggatagattgggttaagtaaaatatattgttaaaattaatttcacctgtttcctcttattttagtgtggttaatagaacactgaaaattactatgtggtttgcatttttgcttcccattgtatttttttgtactggacagagctagtttagaatgatgccaaactgatctgaaataaaaatctgatcatgtccttcccatttaaaggaatttcctcaattgtttttcaacctaaattaaacaaaaaatgctccaacttcttaatttggcataaaaggcatggctgatcgatcctcaactttatctttctagatagatttatctgcagtctattcactgccaggtactgtatgattctgtcacattatactgcttactgttcctgaaacataccatgtatttatgtcttaaatgtatatgcttcttcttctgggaatgccctgtctctgattagctcatcttttaaggccctacccaattccctgtggtagaactcatgattcttctcttgagctatcatagacattaactctattatatatgaactctactataggcatttttcttgtgtaacttgctttctaaaaaataaaatggggccgggtgcagtggcttatgcctgtaattccaacactttgggaggccgtggcaggaggattgtttgagcccagaagttcaataccagcttgggcaacacagtgagaccctgtcttaaaaataaaataaaataaaaaaattaaatggaaaaatgaatttcctaatataacaagtagcaaataaatggcatactgcactacagcttgttgctttcaagactatcacttctactgctcctttgccagactgtcatgtctttgcacctggttttgtttaggattttcagtgactagcagaaaacctggcacatagcagatgctcactaaataactacttaattaaggaaaaaataatttccaataacttataaataaaaccatattttgaatcttacataattattattttaaagctttttgttataaggatagataaatatcatgacagcaattctggtctttatcttatagaaagaagggacaaaagcacatattttatattaaacaaagtacaaaattatgagggcaaaatatccaactatctcacttctccctatattctactgctattttgatctagactggaagttatatactggcagcctgttggtaaaacccggcctgcaaatatatttgtgtggcctttccagtattacaaaaaaatgtgaatttgttgtcattgttttaatatcagggtattacacataaaaatttggatttcctgcttttcctgagtgtgtatgggaaagctgaagaatggcaacatcagacctacattctcataaagcaacaatcagagagaactgagtgacagatgtcacttatggcagagtatgtgctttccaggttatccgcttctccattgtcttaacagccctcaggatgtgtgttagttgccagtaagtaatcaatgacatactattctttttcttccaaacatcttgcttcactcatttactttagagggtggttcctatgaccatttcagtttccaaccctagtctaaaatgaaggagtactggtgttctgatttatattttctggccacttttgaaacttattttcccatatactcctaccccatgaagaatgactgaaactactgacatggaattctatctgcacagtgactagtaagaatccaggggcggggtgacagcaagcttctgtttagtcagaaaagttacatgttcacatacagccccaagtatccagagaaacagtcccacttacttctctgcccaccagacccatactagatgaccaccatggcagatcttattcagagaattgtaacctcagggtgaatagtacagcctggttttccagagcactagtctccaaagtagactggagtaccagaagaaaatatgtaaacttctatttagatctactttcagacttaaataaggaattgaagctttattgcaattaatataccactgaaacccatgctgggcatgcacatcagaaggtcacatgtcagtacagcatgctgggtatcctgaaggtaaggggaatctcatacatggaaggacagacagtgataacctcatctattctttcacttttagtgttcatgcattacaatgtgagtgggcctggatttatggaataatttgtctagttttaaccaaatcaaccttcacaaaattgacccatggctttaaaatgtcttcaaagaaatagattggtaacacacacactcatgtataaaagagaaaatggaagcattcatactactctatgattacaatcaacagccatattacaaggtaaaaacagactacttaatcagatcacaagacggtggcacaacaataaaaaattatcagaatagtatctgaagcaaggatttaaaaatataaacaaaatttgcactgagtatataatataccttaagatactaactgacatagtaaaacatgcatcttaagttgtagatgcatattgtggctctgtccataaaattttgcactaataggagtgcaaaaaagactctggaggctgggcacagtggctcatgcctgtaatcccagcactttgggaggctgagccgggtggatcacctgaggtcaggtgttcgaaaccagcctggccaacatggtgaaaccccatctctactaaaaatatcaaaaaaaattagctgggtgtggtggtgggcacctgtaatcccagctacttgggaggctgaggcaggagaattgcttgaacctgggaggcggaagttgcagtgagccgagatcatgccactgcactccagcctgggcgacagagtaagactctgtctcaaaaaaaaaaaagactctggaggctgggtgcagtggttcatctcagcattttgggaggccaaggcaggtgatcgtttgagcccaggggttcgagactggcctgggtgacatggtgggactctgtctctataaaaaattatagaagtagctgggggtggtggtgtgtacctgcagtcccagctacccagtagactgaagtgagagaaaagcttgagcctggggaagtcaaggctgcaattagttgtgatcgtgccactgcactccagcctgggtgacaagagtgagaccctgtctcaaaaaataaataaataaaatttaaaaagagtttggagccttaacttctattgctagaccatgctaattctgaggattctactggagaatactagtattcacctggtttatgagtgttgtttacacgtttctagttgcaggatcttcattgctatttaatttcatcattaatctgaaatcatctatttaaatttctttctgtccaaggtttagtttatcaaagtgataactgaaatcttcaaaaatagatataaaagtatattatgtatgagtgtttacatgcaaaagaaatgtatgctggttttaagtcaaatgatcattcagcacttaaaatgaaatattatagcacgtttgcctttacaatcaaaagattagatgcctagagccaaggtatgatttttatgagtcaaagtccaaaatgtttactaaagttattcatttcaaaaaagtattgtttttgatggtggtatttcagtttattcccactgggaaataaagtcagttacaaagtgcttcagtttcactctatctccctttgcttctaatgtacaatagtagaaaattctaaatagcctgccaagataattccataatccttaaaaatttggattatggccggctgcagtggctcacgcctgtaatcccagcactttgggaggccagggcggacggactacctgaggtcaggagtttgagaccagcctggtgaaaccaggtgaaaccccgtctctactaaaaatacaaaaattagccgggcaaggtggcacacgcctgtagtcccagctacttgggagggtgaggcaggagaatcacttgaacctgggagatggaggttgcagtgagctgagatcatgccactgcactccagcctgggtgacagagcaagactccgtctccaaaaaaaaaaaaaaaaaaaattggattatgagaagtaaactctagagttcctactgaaataaacagctagaagttttttgctaactcctaatcattgtatgttgaaaacacatttatgtcaccttaaatctctgaggaacctaaatatatttatttaaaaatcatttatcagccaggcgcggtggctcatgcctataatcccagcacttggggaggccgaggcgggtggatcacttgaggtcaggagttagagtccaggctggccagcatggtgaaaccccgtctctactaaaaatacaaaacttagctggatgtagtggcgagcgcctgtaatcccagctactcgggagactaaggcagaagaatctctggaacctggaaggcgaggttgcattgagccgagaccacactactgcactccagcctggacaagacagagactatatttttaaaaatttaaaatataatttatatttttaaaaatagaaatcattttctaattgctctactattttcatgtcttctggagtgaatcaatatcctgattgttgatctggctggctgtcttgaagtaagcctgtcactctgtggaaaactgacagcatttgttgccactgacataatttgaatttttaagtaaaaattagttttcttcatgtgttttaggatatttgatataggctcaacttgattgtcccctcctgcttctatccctgtctagcggctttatggtcatggtcatttctgcttggccttctgagtcccctggtccacaaacacaccttatgatgggacccccaaaccaccaacataagtgaacatacacgttatcacaaatccagaccttaagcctgcaagtagattggtccaggtcttgagaggctatatatatctctttatttctacacttttaagtactcagctctatttaagtcgtaaatccagatagttggttgagctttcttcagatttattaataattaccaaatttgggaatagtctttctccctgccgtattttctgttctgtttctggtccccagtggtgtttacctcatcaattctcaatgcgtggtctgtggacccctgaaagctcccaaggctctttcaggagttcatgaaggtaaaacattttcctaacgatactaagacattatttgccttttacactgtgctgacatttgtactgatgaagcagataaactggtggggaaaactgccgggtttaataagaatcaggaagaataccaaactctatttcactgccacatacttgcagttaaaaacaaaaaaccaaaaacaaaaaagaacaaaaaacccccaccagttttacttaagaatgtctgatgaagcagtaaaaattttattaaaccttgacccttgagttctcttgtcagtaggataaaatgggaaatgcaaataaagacttttgttgcataccaaatacaatggttgtctccagagaatgcatttaagcaactgagttgtaagctgaactagtggcttttttttgtaaccaccaaatttctcccatcttcacagtcaaacagcggtttatgctgtcttcactttcttaccacacattcattcagcctactaaaatctggctttttgattttactgaaactgctcttgctaactagtccttattttatcaactagtccttattttactttaccattctattgcaccttacgttttggggtactcttttcttgaaattctaatagtgatgccaaggcattatttccctcaattttcctaaccattccttctctcctttgcaggcagatatctgctatatctgcagcccaaactcatattttaaattctagatccatatatatagctgtatcctataggatacctccaaaagatctaaagagaccacaaactcaatacatctgaaacctttgacttcccataaaatctgctcctcctcctcttaatgacattaccttgaatatgctaatggcaacgaagtcagaaagacagcagtcatcttagggtcctccctctttgttaccttccatatatattctaatttgtaacccccttttgtaaaccccttcagtcctactgaaactaattttaggccctcataattcctcaatcaacagatttcccttcctccaattctagcctttccaattcatccttttagaaattttcattttgtcggcagttagagggatggattggaaaggtcagaattggagggagaaatcgattgattgaggaattatgagtgcctaaaattagtcgtatcattgacttgtttaaagcctttaagttcccatcccctatggcagggattctgggcttgaatggaataaacactccaatattccataccctgcacatatgcattttcctaaggaaagggcccagattcccaaagattaaccccagaagcagccgacctctgaaatcttttcagaacaatctcaaaccgtaccctccaacctagcatatattccaactaacccccaattacttttaagttctcatacagggttatgctgcttcaacatttccttccactgaacataagattccttctgcctagaaagccactccccaagtgaaccagtacccatccttcaagtgttctctcagctatgaagtcctccctagttcctccaagcaaatgctctctccctcatttcttctactattctttgcatacacctttatcacagtttattacatggcatttttgtattttgtatgtccttcatccttaatagatcatgagaaaaagaccatgttttattcatgtggtatgctagtgtttagtacagatctggtataaaatagtcaaatatttaccacaccattaacaatgtgtagtcttttcataaaaggctctcctgtgtaataacaagctgttcaaactgaaagtatttctgtaagatgcttaaaaagggatatttttcaaaatacatcaaaacacgaatgaacttatcactagtgcttgaaatattaaggaaaaagctaagtctacagttgtttaaaaacttgacaaaaaatataagcacagatataaacaactgcctcttcatttaagtggaaatctaaattattagttatacatttaattataatcctcaatgagactaaatctagatataagactttcttaacgttcatatttgattagcctcgttaatgagattttcctcttgcaatttttaaatgctttaatcatggttttctttatacttaaatctggacttaggtttaaaaaaatcaagtatatttatttatgcgtctttcaagtagtcatttgtgtgaagtcagcactacttcagttttcagaaaacacacaaaatgttcagtgaatggtgaaattgcctaaccccttgcgcggttacaatggtccaagtaggaaatcacattaggtacccatcagagaaactgagtttctacgctgcttttaaaaacatcctcggtaggttatttagaacaggaaattgaaagttcttattcttcttcaccactctatcactaaggaaaagggcgaaaaagctatggatgtaaatgctgctgtctataaacacaacttgcctgcagaaatatgtagtgggccgcgaagtttgaaggaagcccgcagtgcctggtatattcaccaactcctccaagtaactgatcattgccaaggtcgaattaataagcgttctttgatgttaatgattgtgagtgttctcaggaaaggactaaaagctgactttctaaacaggatgttgtttggaaataccccaaacaaactcgatgtccattcctaacgtgttattaagtgaaccgatctgactcgatgcgttttgttaaaaggactttctttagtttccctggcccacagtttatttttttactatttttaactcggagcccatcttaaaaacaaattaagaacggaatgctcgccaaatcacgtctacaagacaaaatcggcttcccagggagctagacctcgagtgggcaccggcagggacgtaaccgctgagcctctccgcagagcgcgacgccggccgccgggtttcggttagaccgcagcaggaagttttcccttcctctgcgggaggcagtggagccaaggggaaatttgaactcccactccacggggacacccagaggggagctccggtgtgggagggtggctcccctgggagccaggcggccgaggagctcgtgattcgacgcccgccgcggcgtctccgccccgcgcggcccaggccgcggcctccctgccctccctgccgtccactcccagtcccggggcggcggcctcaaagcccgcgcggcagggctgcgtcccggctcgcaggtccccgtctccccgcctagggcgccgcgccgagcggcaggcgggcctggccggcgcgggctgcactcacccactcgaggaccttgatgaagccgagtggctccttgagcgggttgaggttgatctggaagccggacatcctctgaggaaaggagggagagagagtcaggacgacggggcggaggaggggaccgacgagaccagagcagcccggtggcgaggaagggcaggcggggctggcgcgctggccgggctcggaggcgggcccgggcggccgtggggcggggcggggcggagcggcggcggttgagctgctggctgagactctggggcggaaacggagtggggcggctggggaggcgaggggcgggccggggcggagaccgggaggcttctcctcaggccgcacctggccgagtcgactgatccgctggcgaaccaagtagatgttgggcgccatactgcgtgcgccgcgcccccttccctgcggttcagcccctggcactcggtcttcccctgcgcacgcgtgtacgcgtgcgctcgttgggcccgcgccgcgcttccggacccgcgcgactgcgaagagccctgacccgggggcgcccacgcccgctcctgcgcagcttgggggcgctggcctcagagacaccctcacttgaccccgagctcaccacagctgagctcactacaccgaagctgacctctccttcccttaacagatctcaacttttttatgaatttataatgtattggcacagatgaagttgtgtttcaaggcatgtgttaggggcctttgattaaaattgcaaaacaacagacttctggctaccgtgctgtggggtgcctcgaaagtgtgaatcaccaaatattcgtatggaaattaggtttattttcaaagttaccatcgcagccatggttgaaaaatgaagtaagtttatacctaaaaggaaaggcgtggccggacaggccctcggtgacctacactttcacctcttctacgctgtcggtcgacagtcctctttttaaggcatcgttggtatctttcttcaagaagctgacccctttaagattcggcttaggtgatactttcctcttggcacgcagttacgggagccccaaggtagtgtgatctccttcctggcttcttcagtacctggaaagttcctggacagctggaatgtggtcatattcgtgtatatgaaaaaccagcttccaaggacttacctgaatttcaagcacgaatatgatttgcaggctacttgccactgaggttattccgtcagggttgacaactgttattgaacgtccttgtagtaagcgaaccctttctctttcgagacctatctccttgtttgctgtccagagagtgcaaaaaatacatttcattttctatgcagacagagacaatctttatgtttatcttggctcccgttcctcagtccccagcacagtcagtgctcaatgagcacctaatggcatatctcattttgaaataacattaagaactgggcgcggtggctcacgcctgtaatcccagcactttgggaggccgaggccggcggatcgtgaggtcaggagttcaagaccaacctggctaacatggtgaaaccccgtctcttataaagataccaaaaaaattagcctgacgtggtagcacgcgcctgtcatcccagctactcaggaggctgaggcaggagaatcgcttgaaccgggaggtgggggggttgcagcgggttcctaatggatggttgcagatttctcccactaagcaacaaagcatcatagataccccttagggctaggtgagtggaaggtgaccatacactgctacctggtgcgtctgagaccacgatgagcggtgctccaggtcttccagcttcctctctctccttttttttctactttgtttctgtatcttcctctcagtacttctctttttgttctctttagcccgtttttctaagcttttactctcattctgttgcggtcttctgggtaggcacctggggacggagtagtgaatagtaagactatttagcttgagcttcatattcacgaatattcaaattagactcttaatgttattattattattttttttttttgagacagagtcttgccccgtcacccaggctggagtgcaatggcgtgatctcagctcactgcaacctctgcacccccgggttcaagcgattctcctgcctcagcctcccgagtagctgggattacaggcacgtaccaccacgtccggctaatttttttgtatctttattagagacggggtttcaccatgttggccaggttggtcttgaactcctgacctcatgatccgccacctcggcctcccaaagtgctgggattacaggcgtgagccaccgcgcccagctcttaatgttatttcaaaatgagatatgccttgacagattagagatatgttcacatgcagctttattaattaaagatctaaaacataccatgacttagtaaaccaatattggcatctcttcttctttttgtttattgaaggccttagaaattggaattggccaggccctttctcaacttccgcgctaaactttctgttgcttctgtctgcctctcctcactttctctcctgcttcttgttcaagcccaccagtggaaggcatggtggttacatttcctcaggaaaccttcagtgctagagtaactccttgaactttaagaaggttccttccttggccctgtggcactcgattttaaagatggagaccaccgagggtgagcagaaccacatctggtcacttatcagaactcattcgcagaatctctcttgagcagaaggaaacagaagtgagccgccactgctcaccttcagtcacagcctagcactgcttctgccagtcagctgagctcaggggcctaccttcctgagaaggaactggccgtgactggcagagccagtgagatctgattgggcaacaagataattgtgatttttttttaaatcctcctcaaacaaaagtgtttaaacaatagcatctcattgaaggcacaactgttcaaaatcagggaagaatgttcagatgactgtatcacattgactacaacactggtcattttctgatttgttcctcaaatctgaggaaagagccagatgctctgggaacaacatgttccaggtctactctaccagggctatttggaaaagaatccctgtaatataaaatggttctgtctatctgaggtagtattattgagctttatctgtggtggtataattatggctaagttacctacataatttgtcattgttttactttctctctgtggctttgaacacatgtgccagactgtgacacttgggatttaggaatgctcagaaggccagaaaggaaactatatttagtcaaccatatattaactatattagacatctcattggctaactataatattttttgtttttctcaatgggaatacaaagttttggtcatcttattggcaagatgagactttgtaactcattcccaaccaatatttatctccttttctgaaaagatattgtttaataccaaattcaaaacctgacttttgcttataaacacaaataggtgttttgttttcgctaatgaattcaataatcattttagaaaaattttaagataaccaaatttatttaaattgtacaatagatggatttaataggctcagtaaattaatctcaaagtaatctgaggcctcttaaacttttcattttaaaacatattttgatttatgaattgcaaagtacaaagagttctgtatacacttcacccagtttcccctaatgttaacatcttctataaccatcatacatttgtcaaaacaaaaaaaattagtattgatgtgttactactgactaaactaaagaatttttcaaacttcatcagttgtccactaatgtcttttttactcccccaggatccaatccaggaaaccacatttaatgtaatgagtgtcacaggtgatcagaaactatctggggccagtggtacaggcagtaagaagaatttaccaagacagtcgtaggtaaagaaaggcagatttatttgagaacgtaggaaaatgtattgcaagggtgcaacaggcaggtcagcgaaagaggagctgactgcaaagagtcaaaagcttgctagggattttataggatggtgcttgtgctctgcgcttgaagaagactttgtgcagtattggtaatgccgaggttgcagtgagctaacttgcatttttctgtcagccaagagtcaggtggtagctcggcacaggaagattgtgagtgatttacacatgagggctatgtgtcctggaccatgaagaaaggcagacttatagcttatctatctgctttctcgttttgctttcccctggtcctgccagcctgactccttctcctgaattaggactctacctttcttcacaccctgacagcaacaatgactaatctttggcatgtggttaaaggtctcatcttccaactgcttcttgctgaccaggggtgtatagttggccctacctaggattgttagtcggtcaggaggttatgtacacctaaatccctgagttgggacttaaattggtcagggttgctatgagactatgggagaacagcatttgtagcctaaaattttgttctgctgcattcaaaggaaagttatgtagctgatacctttgctgtagtactgttttggtttgaaattgttgtatcctagaaaacacaaaatcagatgtagaattaacaatacagtatgcaaataaacaaactaatatgagctttattataggcagaagaagttgagcaacccatggccaaatttaactggagaagctttgaaatagttgtgctgaaaaggaatcttgaggaactctgttttgaaggccctttaatatttttatgttgtctgttatcttttctaaactttcttctacctgacctgagttactgatgtaaaagcaacaagttttatttaacagcatgcaggtgcctcctgcttcagcaggaagcacctcctaagtgagttggttctgcaaaacataccctgccagcgagttcagggcctgccattggccttcaatggccgtgattgtagcttcccaagattgctggactaggatggtgagattatgaatactgcacttaagcatgggtatatctgcaaaccaaaagattgcactggctacagaatgtcctaggtcatttttctctatgacaggattattattggcgaggatgctaaatgatgggagactaagtactgcttctgatgtcctttggagggaccaacataagaaggattttaaatttggagcttggctagaggttacgaagtctgaggagttatatatgtgcactccagatattgctgcaactgtagtgtaagtgcctcttcacttaatagacaaggctagaaatatgttagatctgtataaaaagaagaacccagttccttttaatgaaactcctgaagaggaacctcacaaccaggcataggtgtgattagtttagattcccgtatggtttgcataaatagagggatcccatggtcccctgggattaaatgtggatgggcagtgacccaaaaagtagttatccacgcataagggggtaaaagtttgacttgtagtgttatgtgaatgtggggcctgacagatatgatttttgaatattaatgggataagagaaaattgaggaaaagatgtagatgtattagtgaagttgagaagtcgtccagttttgactgctatttctatatgttccatcctggctgctgaactatttataggcataaaggaattgttataaatctttctggcatgaactttgttgtttcctcaccatagagaaaaactgtggaggtacacagtgaacttgttaagagtcattgcatggcttccattctggtttgtttgatcatagctgacagtgtaattgcaatggacttgtgtgttaaagcccctgggaaagggccagactccttggaatttctagcattataagccatctctggtgccctccctatttgctcggtcaccgtgggtgattggcatgagggatcgattggcctaggtttacctcataaacctgtatttttggtgtgcgtgtacctggcgtagttgaatccagagtatttggcttgtgtgttagcaatttcttctatagatagtggaactgctaggagtgtaatgtcattctcgagtgactgcccacgtgagcatatccagcggttagtgctgtgtgttgtgttagcaacctgagatattactggttatagtgggtgcttggtgtagccatggaagcaatagttagccatgacagacagaataaacacagaagaatatttaaggaaaatgacaatatacagtaaacttagggagacaggaaagaagaaaggctgtaaagagtatgaaaaaaaccaaacaattagtacctcagcatatcaatgttgtggcatgggggtaaataacattgctaggacaaagataaagaaatttcccctgggctgtagttttggaggtcggcctgcaaatagcaattgtgtactatctcccttataaaagcattaatatcaacagggtgaagctgctcaagagaggcagttggatagttactgagaacttgcagtagaattgaataaaaagagtcagctttaagaataacgtttaagggccagtcacggtgactcactttgggagtcccagcactttgggaggccaaagtgggcagatcacctgaggtcaggagtttgaaaccagcctggtcaaaacggtgaaaccccttctctcttttttttttttattattatactttaagttctagggtacatgtgcacaatgtgcaggtttgttacatatgtatacatgtgccatgatggtgtgctgcacccattaactcgtcatttacattaggtgtatctcctaatgctatccctccccactccccctacctcatgacaggccccggtgtgtgatgttccccttcctgtgtccaagtgttctcattgttcaattcccacctatgagtgagaacatgaggtgtttggttttctatccttgtgatagtttgctgagaatgatgaggtgaaaccccttctctactaaaaaaactacaaaaattagctgggcgtggtgacacgcacctgtagtcccagctacttgggaggctgaggcaggaaaatcacctgaacctgggaggtggaggttgcagtgagccaagatcaggccactgcactccagcctgggcgacagagtgagtctctgtctcaaaaaaaaaaaaaaaaaaaaaaaaaagaataaggtttaaaggaggtgctggatttatttccattaactttaagggagatttaaaaattctaggttgtttggtttaacaaaacctcttttaccttttttaaaaatttaaatgagtttccaatgtttaccttctagttagaacgtaaataatgagtatcatctcagcactagcagctgagtaacagcagatttaaagcaggcagaaaaaaagagaggaagatagagagctttagaagactctacttaactctatagtgcaggttaaccatttgagctatgaatttttttgttgtagtttttccatcagtttaaaatgtgcacaaaattataatagtgaaagagatccgatctagcccacctgcccctcttgcctttagcttgtaagctgccttaatcattccagggcttttgggctgagttaattttagaagacatctgggttatagtttaatgataatagcccttcccccaaactcaaacacctttttaaagctaatgagtggccatcaggctagggggtggagaggagcctgatttctgctaaggcgtagccagccattcctgtagataacaccactattgtaggttggctttttgaggtatcttttcaggttttttgaatgtctgacacccatggctctacctgtacccaccaatcccactcctgtgacctcacccaaaagcgattcagtgtgcaggaggacagcttccactccctatgatttcatctctaccccaaacaatcagcagcaaccccagccacccccacccctctcctaaactgcctttgaaaaacccctaaactacgatctttggacgaggcacgtggcatggctggcctcatgtctattaaactttttctgtactgtaatgctgtactctttctttgtacagcaggcaggaaaaactcctcgggtggttacacaaccaacccaaaactcaggactcaaacccctgtatggctgttgttctactggatgggcctggggctcagatgttcctctcatacaaggaatgaacctctggtttggctactcctgtattccctcactgggaacacacagtcaggtgcgtctgtcccacagggccattctaagggtatgttcaagttattcctctcaggggcatttaccctacactttgacaagaggtttaaccttcctaagtttccattttctcattcccattttgcagacaggaaatgagagttgtagtgggatttaaattttataatcataagagatcatttagaagagtgcctggtacagactaagaactgaggaaatgttacccgttcttgccactgtgttccagaaacagtggagtgggtgcatcagtcttctgattgggtgggtaggaagcagctaagacttagtgctagaacaaaagtcatttaaggaaatcagactttggttagagcgaattagagttgtaaggaagaatgttccattgataaaatgaaagaaatatgaaatgagaatataattcttgaaagcaaataaaatgcagtttttcattactgaaaactatgtggggcagaggtcatgctaatcctccctgtgtgggtctacttttagtctatttgtgtcatcaccatttcaagcttagctcacatttaagcagtgaatagacagggaaagtcctctaatttgtagcagttaattttatttttatttttatatttttgagactgagtctcactctgtcacccaggctggagtgcagtggcccaatcttggctcactacaacctccgcctcctgggttcaagcgattctcgtgcctcagcctcaaaagtagctgggattacaggcatgcgccactgcacccaactaacttttgtatttttagtagagatggggtttcaccatgttgaccaggctagtctcaaactcctggcctcaagtgatccacctgcctcatcctcccaaagtgctgggattaccggcatgagccactgtgctggccgaggttatttttataataatcattacaagtactgtaattaagtttctaaaaaaaggcttattgtgtaataactattttataataacataacttggcctttgaatagtgctttgcctttttcagagaactttcagggtcatttttttatgtgatctttgagttacagtatggtgtaggaattataatccacattttgctaatgcagaaactgaagttcagagggaagaaagtgtatcagaaaaggcttcctaggggaagtgacacagcactgtagcttgagagatgtgtaggtgattcctcaagtagatgggggctggggagttttcagcagaggtgctgcagagggtagggcatagtgatagaggagggggagttctatagtgggaccaaatactttgatatatctgatgctttgggttaggggagcagtgtagagtcagggctttgtatatcaggctaggagtttggactatattctctgctagggaggtgcttttaggcaaaggagagtaatatgatcagatttcagtttaggaagatcactatgtcagtagtgtagaagctgaacaggcaaggtgtttaggtggtaggttcaagctagctgatattttctaaacctattggtcatgaggtctcagttcccgggtatggtgacaatgagcaagtgtagacagccaggttggcactagcagcataaactgcttgtgaaaaaagcacagcatttagacacagaaaccactggctcctgtcctggatttgtgagatctacaaattttcctggagcatttgccatttaatttcctttggcttacctcatctgtgtaatgagggtatttatatggcatcagctttgcatatgttaacattgatgaaatacttcagataaaacaaatcggaacttgggaatgaaaacagatatgaagaagccacaggcttgtcccaaaatcatagccaaggatggatggagggcttagcaggttacctatgctatatgagcagggttgataagaggttttaagatccagttttgagcagcctctctcataaataattattcaaaggacttgcatgttttgttgtctccctgagaagcagagtgcccacaaagatttatacagagttttcaagtttaacattgtattatagccaccactctctcttgaaatcaggtggaaagcaaaacaaaatgtccactagttctgaatgaatggtttatttatcctatttgcaattgcacagagaactgacttcctacgaagaagaaaacagttgatagatcttctgagacaataaactgggtgaacgaggggctttgttttaagtgtgctagacagaatttttccaggatctgaacttcctgtacctagggtgggaaatccagaaatatacagtagcccttccctcctaattctaaccctgcagaatttgtgtcagaaccaccaagatcagattctgagtggcatcatagcatttattaggagggaacagatcactgaaggtgaccactttcaatgttagctagtcacatacccaagatgtctgtgatcttatcaacaacagaaatcgatcttctaacatgatgcaaagaggggaaagaaagaaatgcctgagtggaggctggccaggaaaattctaatgctgatgaattgatggcaatggaagtttgtatatcatttctctagcaggcataggaaggtactttacacagtaggtgggtttctagaaagttaactatttttatttatttatttatttttgagtctcactctgtcacccaggctggagtgcagtggcacgatctcagctcactgcaacctctgcctcccaggttcaagcgattctcctgcctcagcctcccaagtagctgggactacaggcatgcgccactgcacccaactaacttttgtatttttagtagagatggggtttcgccattttggccaggccagtctcgaactcctgacctcaggtgatccagccacctcagcctccctaagtgctggtagaaacttaactgtaattttttcaaatggaattttcttttaaatacactttacgagttggtcatttaaaggaatattttggagaatctgcttgtgaacattcttttttttttttttttttttttgagagagagtctcactctgttgcccaaactggagtgcaatggcgtgatcttggctcactgcaacctccacctcccaggttcaagcgattttcctgcctcagcctcctgagtaggtgggattacaggtgtgtgccaccacacctggctaatttttgtatttttagtagagatggggtttcactatgttggtcaggctggtcttgaattcatgacctcaggtgatccatccacctcagcctcccaaagtgttgggattacaggcgtgagccaccacactcggcctgcttgtgaatgttgtttatgtttcatgggcttgtatttttttatactttccacccattcgaattttttaaagtgataaacatttgtcattaattgtcttacaagctcaataaattggtctttgctttctgacgcaatttgttattgttgctattttccttgagggaaaagcaaggtttctgtgtttgtatttaaacccctctgctttcttatttttctttgttgattttttcctctcctagtatgaccaatggtgagaagcctgagtttattgattttgactaggaatttactgactttgactttgtaatcaaggcaggtgaccacctttttgatgaggcctgagagaataagaaaagtcccaatcaccccaccacccacctacggaaatatatatacaccccatgccactgtcacactgaccctgaaatgccatcataatacattctctatcttaggctaacggcttcatgttctaaaatacaaataccctggagaattactggattaaatggtctattacagcataatgcttcaatgagaaattatctgaatatttttctcctggcagtaaaaaataaaataatgggagttttaatgggagtagagcaagaaagagatagtcttggaatctgggcaccatcccaggaagacagacttaactaaagggaaaagttctaggctgccaaagagctgtaaaagggatagtgaatgcctgggaagtatgatggagaagctgctcagtattgaaaaaaaggaaaatgcaaagcagagctaaggcaacttggatttatgatacaagttagcttggggaagactgaactcttagtatctttcatttcattatttgccaatcatttgagaagaaaaacctgaacatttcatacattccttctagcatttactgatcactcatatgtactggacactttgttaagtgctgatcatacaaagtagacctcaaagagtttattttaaagggagagatagggctgggcgcagtggctcatgcctgtaatcccaacactttggaaggccaaggcaggtggattgcttgagctctgtagtttgagtccagcctgggcaacatggtgaaaccccatctctacaaaaaatacaaaaattagctgggtgtggtggcctgagcttgtagtcctagctacttgggaggctgaagtgggaggatggcttgagcccaggaggtggaggttgcagtgagccaagatcacaccactgcactccagcctgcgtgacagacccaggccctgtctcaatagaatagaataaaataaaataaaataaaataaaataaagggaaagataggacaaaaactatatatattttcaagttgtgataagtgcagtgaagaacacaaaacgtgctttttatatatatttttttgttttctgctttacaattagattgccctgcaaaatctatggcaaaacagagaaaaattggtaagggctgcagtcttcataatctacataaaaactatgattgactcaggtcctgtaggaggaaatttctggggataatcctgtgacactctcagtactctttgaaattctatagagcaaagagcttgtggagtctggcaggaagagcaacgaaggtgaaggtgaagacattgagctggaatccggacaactatgtccgcaaaaccaagttggacttacagattattccaagaaactgtgatcctaccttacatccttttgaggtcctgcaagaatgtgtaagagttttaaatgctaccaaactggaaggagtatttgcaaaaccatgcctggcttggctggatggtcacgagatggagtgagttgcttggcaaagcatccaaagatcctggctactctcctttctaggggatgtgatggagcagttagaatttggaacctgactcagctgaaatgtatccgtataatacaagcacatgaaggttttgtacagggaatacgtgctcacttttgtgggacttcttttttcactgttggtgatgacaaaactgtgaagcagtggaaaatggatgggccaggctacggagaggaggaagggccattacatacaatattaggaaagacagtgtatactgggattgatcatcactggaaagaagctgtttttgccacatgtggacagcaagtagacatttgggatgaacaaataactaatcctataagttcaatgacctggagatttgacagtataagtagtggtaaatttaatgcaattgagacatttatcttgggaagttgtgcttccgacaggactacagtactgtatgatatgaggcaagctactcctctgaaaaaggttatcttagatatgagaacaaatacagtctgttgaaaccctatgga

SEQ ID NO: 22 - DNA, 151882 bp, Homo sapiens
gcttattgtataggcgagtgattctctaagtgcggtccctagaccatcagaatcagcaccacctggaaactggttggaaatgcaaattctcaggcccagcctagattattaaagttataggttacccaaccatgatcatcaccatgacctccagggaaggatgctggaacctggaatccccaactctatcccctaacctaatgaatccgaagctctggaggtggggtccagtgagctgtgttttcaatcagcctttcagggaattctaatgtgcattaaagtctgagagccactgatctagagggggagatagattacaaacaagtattcaaattgacaaagtaaatacagactgtgggaaagggtaggaagaaaatgaccaggtgctatcacagaattggcctggagaaggaagggagagccttgaatctgacaacaggattatcttccctgccccttggaggaactggcttgcatctatgctgactcatctgtcccctttcttcctcctcctcttcctcctcctcctcctcctcctagtagaagctgcacccctggtcagcagcctgatacctgcagcatgccagaaggaagataatcagaaccttagagaacccactatggaggtggccagcttcttctcagagtcttgccaggagctggttcatgcttctctctcccatgctcgagtcaatatgaccccagtgaatggaggcatatggcaaccctaggactttccttgtgggaggagctggtaggctctcctgagtgaggagttcccacctttcttgggctcagagcatgacctgattgtgacatctccaatcctgaaacctccgtaacttgtttgttatctgtctccagctctaggaagcagatgctgaacttgaggctttgctgtgatatcagcccactgctctggcagtggcagcttgtagttgagaaaacactgaaaagcctacaaggcatttaaaaaaacaactttcgtggcttatgctgtctcggtgagagacaatggctatattcgtccctgggttatgcccagatatggcagaaaaaaagccaatggagttttttttagctttggggaaggggaagacagagaataaaataaggcctagagttgtttttcagttccctaaaatttctgggttttgatctaatggatgtctgcaaagactataaataaggtgatgggttgaagcagcaagaactgtgagcacacagatgtccaacttatagagcaataacaataacaaagagtggaataaacactcaacacgagagagtgctgaatgtcaaaatcactaccaccctctactcaccctccctgctctctgttgttcaagcccagggtcacctatcaggtcctgaggaaaaacgtttactctccatctgcatggtacgtgccgtttgtcatcactttgggctccatattgcttctgggtctcctcgtgtacctggtcgtcctattggccaaagccatccacagacactgcccctgcaagactgggaagaacaaggaacctctgtaagttgccagtgggctgggccctcttccccacctcctttaggacactgtttctggtgacatcaggagaaggaaaaatggagaatcaggatttctctacaaggcaggttgcctggagtgaaggcaggaaaaggagatacgggggaaggaatcccagctcccctcggtcctggtgcactttctttgtcacctgctaggccaggaaaccatccttttggctttccctggcaacctactctgtccttgaggctcttaataagactggggcatcaaccttctgatgaccttgccctggataaaatcttcagcaaagccctgttgtaaatagcgatagaatatgccgtgctcttatttgtagaatatttaaaggatagtatggaattaaggcaagcacacaaaaccaataagggaattaagcttttgtctccagtgactcagccgggtttttgtgtgaccaaataattcttggtgttttgcttgtggtctcagtctctcactcttaagggttgtaaacgcaggcctgttttctctttttccagttttcagctgcccactaatatgcctcttattgtgccaatctgtgatgtgtcttttactggctaaagtgaggtagtagagtgacgtgaagagagcaccaaagaatcacaaacttctcccagagccaagctccttgattctcagtagctcttacaacttacagcttagatggttctgagcctgagttttggagttagatgggcctgagctcaagtcttagctctaccattttcttggaatatggctttgagcaagtgaccacctctgtgaacttgaattttcttatttgtaaaattaatcaactaaatgaacaaatgtaaacaaggcacttaactgtattcctgatatagagtaaatgcttagtacactacccagccagtttttacaaatcttgtttcattattcttcacagatgagtcccaatgagttcaggattctagattccaagtttagctctatgcccaagtatcttgaggtgttggaacctctgagttctaggatctctcaatggcaaaaagagggggtgataagacatgtgtgccttttacgggtattttaaatattaaatattaactgtcaaataagaaaatctatggatgaaagactgtataaaagtacaaggcattagaataaagatgtgcgttgcattttgccatatttattgcggaagtttgttgctattggcaaccttgacttcaaggtaagaaatcctcgagcatctgctgaaattaaaaaaggcatttttgtttgaactctattcacaaattgatttttttaaaaaaaaacagctctaaaagagtaattgcttgtaaggatggtggtgtactgtactgggatttggatagaagttcttgaagaaacaaatccaatagacactgcaactctcatgtaatttatggctaaacgttaaatatgcaccttgaacctggttcttttaacttatgttgtaaatattaattgttttcaacatggttgacttaaaaaagaaaaactagctagaaaaccagactcagactcaacctctctggaaattagttataccatatgacagccaactttgtcaaatagcaaagaagaaaattagggttacagagctatagaatccaaggtgatcatgggaaatctcgtagggtctgagtccagctcttcatgtgacaggaaaccaaaatgtaactgccagctctcaaacctccctgttgtgagccaagccttctgctctgctggctcttggggagaaagggatagggcaagaagactcgctggacagtctgactagggcaggcatgtcctcaccaggttttctcatcagaaacaatgtattccctgaagtttataaggtgatacttttcaactcatcaaattcccagaacctccctagtccaaagccaatagtgatgaagctgctttgttcgaagcaggcgtggtgatctagttttctttctggcccctatccctggcacctctttcagtcaacccctgtatctcaaagggcatagttgcccaaagaaccccatggtgtcatgtgtgtgccagtgcagcatactttcaagtgaattaatagccattctttttccccccataggacaaagaaaggaggtatgtacagtacctgtttcccttgtctgttgttttttgcttgctctgttgtgctacgtaaaaaggttcctactcggcaaagaatcaggccgcgatcacatcttggagcattttcagctgcatcttctgtggctggaaggaagcggaggtcggttgcagctggagaatgggaagggtggggggacagtgccttggcctgcctggatatctcaatttggtcctgcctatgccctacctagagccctcgccaatcagctcagctgaacacctaggtctgtcccttgctgcatggcacaggaagaaagaactctccgtgtgttaaatgtagacaggacctgcttactgcagcccatggagggtgtcctgaggacagctaatgctttgtgctggacacaggcctcttttgaaagaacagataaggctgggcgcagtgactcacgcctgtaatcccagcactttgagaggacgaggtgggtggatcacaaggtcaggagtttgagaccagcctggccagcatggtgaaacccccgtctctactaaaaatacaaaaaattagccgggcatggtggcacgcacctgtagtcccagctactcgggaggctgaggcaggagaattgcttgaacccagcaggtggaggttgctgtcagccaagatcacgccactgcactccagactgggcgacatagtgagactctgtctcaaaaaaaaaaaaaagaacagataatatttgattcccagattctaatggatttgatcatttccacaaattatttaggttagactagtgagaagggggagatgagggtggtgagatgggctgagagctgactgacttcagagaagtgggtaaattgggaaggtccatctgagcagctccaggtctgaggaggtgtcctggcttggcctcaagtagactccagagtgtgggggagacaggacaaagaattggacagtgttttaattaaaaaaaaaaaaagtttgctttaatcactccatctacaggcatgtgtctgacatgcttaaggcatgtctcaacagggttagaaatttgattatagtggttattgatcatattgacagagatgattttaataaatgagattttcacaaactgtctctaatcccactttttaaaaaggggatgggggctgggcatggtggctcacacttataatcccagcactctgggaggccaaggctagaggatcacttgagcccagaagttcgagaccagcttgggcaagatagtgaaaccctgtctgtagaaaaaaaatttttaaattagctgggtgtggtagtgtacgcctgtagtcttagctactggggagatagctgagaggatcacttgagctcaagaggtcaaggctgcagcgagttgtgaccgcactctagcctggacgacaagagtgagaccctgtcttaaaataaaataaaataaaataaaataaaataaaataaaataaaataaaataaaataaaataaaagggcttgggaattaatgcacaaaacccacaccttatgaacagaggtatccaatcccatctttctttcttatcttaaaagccatgtaaaagccagttttctaggtccactgataataagctagaaaaagaataaaaaacaactaaattgttcgtatgttattgtgtgtgtgtgtatacatatgtgtacgtatttttttctgagaagatggaaagttgtcaagaaacatatctatagacagaacaattctttgctgtgtctgcaagactgagatcgaagcctatttaggggaaataccgttgtggaggtggaattttaaggtcaatttaccacccaagaagcttaacttctgcctgttctgttctctgcagaaacgaagactgcagagagagacgtcgtggtggtgagtatgggcagtgtggggcaccaggcatagacgctgggggataggggctcccgtctcccccgaaggcaggcctgccacagccttgtgggcatgtttatcattcagggaggtgcttgtgtttggctactggaacagattgctgtgtgacgagctcctgatagaatttgttccctccactgaacatgcctgctgatatatttgcagaagaacaggatttcataaatattgagtagtggtgtttattatctataccagctctccacgagagtgagttgagggagtgaagcttaaagaccaaaactagtgcttcagcctccagtgagatttaaattttctttctttctttctttctttctttctttctttctttctttctttctttctttctttctttctttctttctttctttttaagacacagtttcactctgttgctcaggctggagtggagtagcacaatctcggctcactgcaacctctgcctcctagactcaagcgattctcatgcctcggcctcccaagtagctgggattacagacacgtgccaccacgcctggctaattttttgtattattagtagagatggggtttcaccatgttggccaggctggtcttgaactcctgacctcaagtgatccacccactgtggcctcccaaagtgctgggattataggcatgagccactgcgcccagctgatttaaactttctttgctcttccactaccttgcagaaaagtgacagagaaagggccctccctggtccggggttggctctacccacttagccttatcacctcggggacttccttggcctctctgagctttaggttcctcacctgtaaaatgggggtgaggatatctgccctgagataacagatggagaaatagtttgaaaattgttaagtgtcacacaaatgcaaagtgttacaggatagctggaaagttccctctcctccacctctgtctctctctctctctctctctctctctctctttgacagaaccttatctaccccctgggaagtgaagtgaaggaacttgaaggtggctccctccagctcttccctacccccacgaataaggctttgtcatggtccaagcttcatgaatttgttgcataattcaatggctcctccaatgaggaagtcagtgcagggcactggaattttggcttcaggcacatccatcccctaagtcttctatgttctggccagtgtacaaacaggaaaagaggcagtctcaggtctcctgggtcttattgtctaaggcgagtacccttggggatgccacttagcgattgctctagaactatgtaatattaaattagtctattaaataaatacctatgaccacaaacagtggggctgcttagctggtcaaattgatgaaggccatataatccccatttcctctctcttcagagttggggagttgtggggaactaggtaggggatcctttaagtgataaaaactggagattggaaagcttgctaaactccaaacacaatccttgttactgtgctagtgaccctgactttggcacctctagagggcagcatgtgagggaagggggtgtttctatggggacaagggacaggtgcattaggcagaagtcaggtcctggagggtggcaccaaggacagatcagggaagagaaaagacctggagcacagggcttaggtgaggcccagatgcgacactgcattggcctaggcaaggggaggccgcaggggagggccagagtgccagggccagaggtacggacacctgggagctcacctgtgtccaccttgacaatgcctgacagcaattcactgacacaacgtaggtcttagccatgctgtgtggcatttccactcttccttctacgctcagattttatttactcaggatgcttccttaacccccaagtgtggtttaaatgtcccctctacccctacctgtgccccataacaccctatatctccccatcatagccttattactctgcattgcagcacctgtttgtaattggcaagctttgtacaggcagtgactatgcctgccttgttcatcactgtgtcccctgcatctatcacagtgcctaattaaagacttagaagtcaagaaggctttggttaaggaacttgggttgtgaggatgtgtagctttgcctgggggaaggaatgtaggattgtgtttgatgctgtctctgtcttctccttaggaaactatccagatgaacactatctttgatggagaagccatagatccaggtaattaagtggcaataccactgtaagaatgctttttatattccagactggtagaagcatggaggatcttatccaatttcctgcttttagctcattttgtcaatccgtttggctatgttgcctatatagtgctgactcttctaggctaaatacaacgtgagatcagctgtgaacccagctggctagcagatgctcaagtacagggtcacacttacgtgaggcctcagtgggtctccacctaaaggctcacgttcaagggccatgcctctttcttgcctcccttcctaaattacaaaccagttgagggaactggtgaatccaggaatccacattttttttcctgctgtttggtactgattgccccccccagcccatccacattcttcctggatgcttctaatagcacttattagtagtggaagatacagagaaatggcaagtgtagtttcttttttccctagatcagggccaagaatttcctcttggtcggcaagatgaacataaggtagagctggcctccagagctctcatcacccccgtgaaatcagctccaaatttagctcctttacactcatccctctgcttacaaaggctcaattatagacgtgaataaagggaaggaaaccaaattcaggaggcaagtgtgttggcttcctgccaccctcatatgcaaacggcaccggtcctcctcctaaggaggatggctcctctccagtgagaggctgccgccgccgctgctgctgctgctggaattaaatttccctctattattaggtgcttgttaccataatgtgcccacattagcataagtgctggtgggatcctgagctgagaggccactcatgctgtatggaaaagacaaggagcaagggcttgccttaaacctgatcttccagagcaaaaggctcttccagagcaaaaggggggatttttgtgtttttgtgtagttgagagaaaaaaaaaaaaagaaagacatgagccaactggcctaagtcaattagtgtctgctggctcggacacaataaaaatggcttccttgtatcatctcaagcgggaccagatttttgtatctgtgtctacaaattgctgctaacctaacataaataaaaatcagccttttccttctcacttggtgaattcctttttatagcaggaattcaggggtcttttaaaacaaacaaaatgaatcagaaagtaacgggtaatcccattagagattgaacctaatttatccaaagcttgcatggagttcaagagttacatggccttctcatcctgcaattgagatgtccttgagacgctcctaagcctttctatccagagaggtttgctgtttgctacctgtgtggtccgagcagcacggcttgtggcaagggcaggctggtggagattgtggggctattcacacacctactgtctgtgtcagtgattcacaccttctagtgtgcttcatcttcccttgggagtcagaacagagcagggtagaagtgggggaagagacagtcattggaattttctggcttatgtgattgttgtatttttttttcactagtgaccggggaaacatatgaattcaactcaaaaactggagccagaaagtggaaagatccactaacccaaatgccaaaatggaaagagtccagccaccagggagctgccccacgcagagtcactgctggggaagggatggggtcactgagaagtgccaactgggaagaagatgagctgagtggcaaagcgtgggctgaggatgctggtctgggttccagaaatgagggtggcaagctgggcaacccaaagaacagaaatccagccttcatgaacagggcttaccccaaaccacacccaggaaagtaaacggggtctaaggaggggcctgtcaatcactgagatgctgcctcaccctaaattctatggggatggtgtgggcatggtgtaggggggaaaatgtgggctgaggggattcagacatccagggtcaaacatgggatgtttgacaaatttttaaacaaatagaaaggggtttgatcacatagttgcgtgttctgaaatgatacaggaacattttctatcagatttcagaactacctgtgcttctgataagcaagactgttaactttggggtgtggaattgttgtgtttcttctttgcattgactgctaggaagctctattctgttcaccatagaaagtttgtaggaattcctgacataaatagtgaagactatccttacatctggtttccaccttattttcctgccctcgttttaacatcacccagatttcttcagttataaatatgccatacacctttgtaagtcacctcaaatcttcttcaaaagaagcagaacagtgaaaaaaacagatgagtaagttaagagttggtcatctggaaagaagaaaactcagtaggcaccttcttttgttttttcttgtggtgtccggatcagcatcctgcatgtgagattcatccacgttgtcctgtctagcagtagttcagttctcttcatggttatgtctggtttcattctatgattatatcacaatttatctattctacacttgggtggcagctgcttcagattttttacttttaaaaaatatacttaaaagtgaactacaggcagggcatgatggctcatgcctgtaatgccagcactttgccaaggtgggcagatcacctaaggtcaggagttcaagatcagcctggcctagatggcaaaaccctgtctctactaaaaaatacaaaaattagcttggtgtggtggtgggcacatgtaatcccagctacttgggaggctgaggtagggagaactgcttaaacctgagaggtggaggttacagtgagttgagattgtgccactgcactctagcctgggtgacaaagcaagactccatctcagaaaaaaaaaataaaagtgaattacaacactatgaactttcttgtacatgtcttttggtgaacataaacactcacttttttgctcatatatctaagagtgggattgctggagcaattgctggatctgccaaagagttccaaagtggtggctctgattcacattccagcagcaaacactgagagttgcaattgctctctatccttgccaacacttgggattgtcaatccttttaactttagccattctggttaaaattactattgaagtgaaatcactttttcctcaaagctgaaacaccatcagccttacaacctacctgccttgctccttcccacttcctatgattggaaggaactgcaggactctgagtggggacatactggaagccccatctagacataaaactcagacttccacctgtaggcatgagcaatgaactgggaataaatggtattatgatggaataggaaatgtaactttccaatgtgtgcctagcagagcctgagcaagcttcactcgagctctatgccctgctgcccagctgctgcgaccctagtccagtaaccctaagaaaggtccaggtgagtgttcattagggaagcactcccttcccaactggggagtcaggtgagagcctaccaggtccacaaggtcctgtgggagacagactggatccagcaaatgtagagcttcagagagagcagcagcttgtttactgtgtgcctagtgccagtgtcacttctcaagcaaaagaagcatttgcaaaatgcctgtcctggcctagattgagcgtgatttattaataagggttggttgccagggaactcccttgaatggatttaaactttgcaaaagaaggcagaactgttcatttatgcaggttaaagtgagtgaagtggctgattgcccatttaaggcattgcaaatctgtggggcccggagtcaaatgctttccttggaagctctcagcttcaatgcaagtaaaatgaggttctgagaaggctgaagggggacttaataactgcttataagcccattaagaatgattaaaagggccgggtgaggtggctcatgcctgtaatcccagcactctgggaggctgaggcaggtggatcacctgaggtcaggagtttgagaccagcctggccaacatggtgaaaccctgtctctactaaaaaatagaaaaattagctggacgtgttagcaggcacctgtaatcccagctactcaggaggctgaggcaagagaatcgcttgaacccaggaggcagaagttgcagtgggctgagattgcgccactgcactccagcctgggtgacaagggcaaaactctgtgtcaagaaaaaaaaaaaaaaaagaataattaaaaggagagagtggtgagcagctggtctttcttctccagtgatgacagggcaagagggaattgtgcttaatggccagagaagagatttaagtcaggcaccaagagggacttcctgaagcctggggcctctctgaagagctcagtgtcttctctggtgataggcaggaagagctgagtgtcttcctagtcgcaaggcaagcctcgagaaactcaagaaataggggcaagagtgcgccaggaggagagaacacctgctgccccgtttcttttgtatatccggctatttggttcggggaaatccagaagtcaaagtgtcaccggtggagggtcttgactgcaagttgtccaagttcttggagttttgaacaaagaatggaacaaaatgcccagcaaagcagagaaagaatgaggcaacgaaagaatgaaagcagggatttattgaaaaccaaagtacactccacagtgtgggaacgggcctgagcaagtgactcaagggcccagatacagtcttctcagtccaaataccccttggaggtttccccttggccacttcatgctcacctcatggaaatgaagtagtggaccacaattggtctgattggttgcaggaagcaaccaatcagagactgaagtggagttacaaaggtcacgctcctgtgcaaacatctgattggttgcaaaaagcaaccaatcagaggctaaggtgaagttacaacgttgcaacgaagactcggctggcaatcagtctgattggttacagacagccaatttcccagcgttgaccaggttttggggggaacaaaattatctgaataaaatgaagacagcaaccgtcgtggatttggtgaaagttttctcccatctccctctcaaggccttaaacaggtatgagttgattatagccaatgtttacttttctcattctgattcattataaaactggggtaaatacgttcaggaattagaccacgtaacaattataattgtcgaagactttgaaactgcatagtagattgtgacattggagctttttgttgtgctcattagaaagcagggtctgaaactcagcctgtgtagcaagcacgggtggctcacaagcagaactgggaaatgacacttctgctccccagagccccctttcacatctggggttctcattgtttgcctttttacttaatgtattttgtaatggctgtgaaaattaagctacaaaatgagtgaacattgaagacaatgattgctattgaaacttaggatttctcatttcaaacttagcgtgtgtttatccttcgtattcattcaataaatatctgtggagcaactaccatgtgccaagcgttgactcattaggaaacacagcagctcccatccctgcccttgagcagcctccattctgtttctacagctgaatgtggcctgctgataagctattccacagagttctagttccagctgcatcctggcctatttgctccttggatccttgagtgttcgacttgaaagataaattagccaggaataaaatccctggaatgtttccccagaggaacagataattcagaaccttaaaaaaaaaaaaaagcagaaagcccttgtcagaaaatagttgagatgtccaagtagggctcccagttttgcgctatcaggacagtagactgttaatgcacctccacatggcagctctgaggcagtgtgacctctgtgtgcagaatatgaaagaaacctgacatcagtgagatatttgatttggagttcagggcaaaggtccaaaatggggagtgggggagattcccatcacccctggaccctcctatgtgtcacctgcactgggggcaaggtgtggctctggctctcagggaataacccaactgagaagataatcagctcattcaaaaaacaaccggttgccacacaggccctttctgagaggagctaaatgagctccacatgcagtgagtgctggagaaactagacatgggcccacacagcctctgaaagaataatgggcctggaacctgcagtggtgttataggtggagttgaatttaaagtcgaagagaaatttggaggaaaggcaaaagcatttagaatcctggttgtcaatccattttcagctaatactcgtcttgtgtaacctggagtggcctaacacagaacctcctggatatgtagcaagcactcaacaaacatttatagaactggattgaatgaagcaggcttgtggttggccttttttccacatcatgtagcaaaatcacaacttttctaactagagctagataaacatgatcataatcaacaacagatagtttctgagtacctgctaggtaactggcactattctaggctctggggatacaacagtaaataaaacagtattcttagtgtttatattctaatgaggtataaaagactgaacatacaacagaaccacagagagatggctggactctatataaaaacagaacactgccccacagcctgcagcagggaacctgcccaggaaacccactcccttatctatagttattatagataattaattataatgaacaacgcacgaagccagcctgctatcagacttgcaggaggccagactgctatctctagtgacaatctaggaagctaaacaacccatgtaccaatgggccccaaatggccagaacttggttaataactgatagcttccctatttttgtccccgagtcctaattaggacccatcacagaaagccaaatatgcaccctaaccaatcacataggctgccctgcctctagcccacctccagcttcctcctgccaacagcctgtaagcagggctcacctgaagccttccccggtttccaccatgaagctctccctctcctctgcctgcctttgggcctctcgccaaaggcaagtgccagttgctgactcccttaatatagcaagctcggaataaatggccctcgctttatcatagggttggtctttgtttattcccactgagatgatagacaaacaggttagatatatacatatatgatatcctagatataagtgtgtgtgtgtgtgtatatatatatatatatatatatatatatatatatatatatatatatatatgatatgtgaatggtgttaagtgccattaagaaaaataaacagggtcaggggttatggaggatggccactttaaacaggtggccaaggaaggcccctgtggtaaggggagattcaagcggtggatgtgtgggcaggggctgtgcagataactgggaagaaccttccaggcagtgagtgcaaggcaacgtgaagtggaggaacagcaggaggaacagagtgatgagcatgaggctggaggacaggacttcagagaggggtcggtggggaggcaggggcggatgagtgtgtgtgtgtggtggtgagtgggggtgtgtgggctgggggatatgtgtggagaggagtttgcatatcacatagggccttgtaggccactgtaaggacttcggcttttactctgagtatgatgggagccattgcatggtgttgagcagaggagtgacataacttacttatgttttgaaagcatctgtctgctgatttgagaagagacttaaggaagggagagaacaagggtagaagtagaaagaccagctctgtagctgttggattcatccagatatgagatggtgggggctgggtccaggggggcagaggtggaggacagtagaaaccttgtggtacctttgtgaaggagtgtcccggatatgaatgaagtcctgagttctcttgagccctgttcctgtatgagatcaaggctccccagcaggcatgagcccctccctcagtggaagctaccagacaaagtcattttagataatactgagcggctctcccgagtgtgactgccccatgcttggtctgcagcgggggaatggtagtcatgtgtgcacacataggtgtgtggggagagtgaagagaccggtcagtgttccggccacatcacacttcccggcaagattccagtcgatgacccaaggaaacaggaaacaggcctgcagggtgatttcgaggtctggactctatgccccgctgtgaaggtggttgtaggcagccctcaagctgaacggtgcattcgattggctctcagtctgaaaaagtacagttctgattaaacgtcaggagacctgaattgtaggaaactctaacttctgtctaggactccccagagagttgaagttcttagaaaacttgtctgtttgggggaacagaaggagatgaatgtgttctggaaaaccggagccttatgcccaaatttttggagacggatatcacttaaaatggtgcatcccactgtccccatgggtacaaaccatacaatcagttctgatgcctggtttggaaaacgtgatccccgtcagtgttgaaaccgaagcagagcatgctcgtaaactctgattttccccatgtgactgcgagctgggctatccgggtgaggctggcctagggcctggagtgagcattgtggatgcttacgctctaggccacagcgccctcagcagccttttcattagggtggtgttcagagacagactgtggctgctgcagccccttcagaacccggggcagctgagggagagaagccgcttaatctgatttataggcaaggctcacaagagttgcactccctgcatggcccacctcatttgctggtccatggtcaaagcacactccagctggcaggctaagggtcctttttaaaataacagttttattgtgatttaactcacatgccatagaattcagtggtttttagatattcacggagttgtgcaaccaccactgctatgtaattccaaaacattttcatcatccccaaaataaacttcacgcacattaacagtcattccccatccccaggcactggcaccgctgaactgctttctctctctatggatttgcctatactggacatttcatagaaatggaatcatacaatgtttgtccttttgtgtctggcttatttcagttagcataatcttttcaagattcatccacatggtaggtccatacattcatttttatggctgaataatggcccactgcatggatataccacattttatttatccattcatcagttgatgatatttgggttgtttccatcttctggctgctataaataatgctgccatgagcatttgcatacaagttcttctgtggacatttgttcttatttcctaggtatatacctaggaatggagttactgggtgatgtggtaactctatatttaccttgttgaccaactgccaggctgctttccaccatggctgcaccattttaaatttccaccagcaatgctcaagggtttcatgagcttttcaaacagacaagtgaggcaccctttgctcaggttgcagtgtcgggctttcagcccttcccagcttctgtctgctttggtttgaggagtctgatctggcgtgctggcacacctcgctgaggttagcagcaacagctcctgctgcaccttagcagcctgcagagaagtctctggaaacctcatgattgcagtgcgtgcctaccacaagcgggccctccacctgcaccatctataatcctcatggcacgcctctgagaatggtctgcatcttgaagatcatatccactttacagatgagaaagctgaaggttggagagattaggagacttgtccagaggtcacagagccaggatggcaactgagtgtgtctcctctgagcctaggcaggaagggcttagtgatggcctttgatttgtgttctgatgggaaaaggggtcaggtgactggacccccagatggatcctcttgctgaacagctctctaccctgaaagtccaaggctgctcatggctgcagaaatcttcacaggttcagagtcaacaccagcctctgcaggagcaatgtgttctgagcatatcctgtcttttgaggcttgagttaggggtctgaaaccacccctggcctcctgcaaccctgccaagcccagcgcactgctttgggcaatgcaggaggcaatgtttattcttttctctgttcttcacacacccactacctatctgctgctccacagaagcagcctcatcctggctatgagtactgaagtgccttccaagcagagatcctaatcactcaggaacagcctctacccaaaggctgaggggctgcagtgatctatgttggccagcaggggcgtggcctctctatttgccatttagcgtccagtgaatggtccaggaacacctctggtaaaagactactctcccttctctccaccttctcccgagcctttcagggtatgtgtcctcaatgcctgcagagagcagccacagggcatcctgggccaagattccaccctgtggccaccgcaaaaaaccacagcagcaatgtggtagcttgaaaccagggaatgtggcggcaccaagccttctggaggaaggagtgagtggctgctccacccacaagtggccttttcccaaagggtccaggacagctatcctggcattttgccaagcaaactatggccactgaccaagacagcacccagttgggttcagaacaggtcgatcactgctgacatatgtagagagggttagaatccatgggggttcttggcatctcggaatacacacccctgaattttgtttccttgacataccatcttgctacatgctcaggagagtaaagttcccaaattctgtctttggttgagtgtgtgtatatgtgtctgtgtaagtgtccctgtagtcataaggaaaatcactttgcatttatggaatgccggctacatgccagatcacgtgaggtcttcacatttataattctacttaatgtagaatttatatgtgtaaatttagtttacatatgaagaattgaggctcagaaagggtgtgtgacctgccaaaggtcacacagctagtaagtggcagagggaggtaggatctgaaagcagatctgacttttaagcccctgtgtgccaggagtagattctgacaagcctagtaagataggtgacccttggccaggtgcgctggctcaagcctgtaatcccagcactttgggaggctgaggcaggcagatcacttgagtccaggagtttgagaccagcctggccaacatggcgaaaccccagctctaccaacatacacaaattggctgcacatggtggctcaggcctgtagtcccagctactagggagtctgcagtgggaggattgcttgagcccaggaggtcaaggctgcatgaagccgtcagcgtgtcattgcactccagcctgggcaacagagtaaaaccctgtgtcaaaaaaaaaaaaaaaaaggaaactaaaaagatagttgagcctcttgttgctcccaccccaacactgcctcaatcttgcggttgctttgaaagaaaggggcaaggctgggagcagagtcagaaggggaggataaggacagaatttgcaagctagtttatttaggaactggtgaaattcagaagggttgaaggaggcctctaggatggcgacctttccctaagcagcacatcggtgttaccgggcaccgagagagaaaggtaaaaaggagaatgaagaggaataatgggaggtggggagatagagagaggctggtggcctgaagacgcttgcaaggggactcccctgcctggggggctggcaggagcaagcacaaccttcattctctctagcagggccaacaaagggcagctgaatcacagtatttctcaagaaataaaaattcctagcacacccctggggcctcggggagaaaaactgacaaggtgttgattgaaaacataccgcgctgtgtgcgcccacagggtgaggccgcgcttgcacaggttcacagcgacacctagtggtctcctggggcacctgccgcctctgcagaaatggcaaggttggtgggccacagggtgactgggttcctggaggagatttggggtccaaatcagacatttcctcttttcccttgctgtcagcacgcatattttgcacaactgtccaccctccaactgtgtgaaacatgtcggtattctgaggagagtcaggggtggggccgggggccattggtaaaagactggacttcctggttggacacggtagctcactcctgtaatctcagcaatttgggaggccgaggcgggcggatcacttgagtccaggagtttgagaccagcctggccaacatggtgaaaccccgtctctactaaaaatacaaaaattagtcgggcgtggtggcacgtgcctgtaatcccagctactcgggaggctgagccaggagaatcgcttgaacccaggaggtggaggttgcagtgaaccaagatcgcgccactgcactccagcctgggcaacagagcgagactctgtctcaaaaaaaaaaaaaaagaaaaaaagaaagactggactttctaatgttcaccccaagactaacaaggtatgcatatccaactggctctgcaccatctagattttctgaagtggtcactatttcctctaattttattctcttcatttattcaatataactaaaagtatttaatggtgaaatcctcagatggcttttacacaaatgaattctccagtcacagaaatttctttgttgtcgacctgctcagaaaatagaacaactatacttctatattaggtcaaagaccttgatgtccatagtgaacctgatcaataaatctgcttagaaatgaaaacaatgcatctctttctggataatagcacttgaacatttttgttccctccctggcctcctctcatgccatttaagccttggctaatttccttgtctgaaggccccctggagacagagcatatccagtgtgagcacaatgcctgagacatcgttgatactcaaaaatgatttcttactgaatggcttcagctcctgatggagcagcagatgccacaggaggaaggtcagagagttcagtcctccgtgaagcgctgccagaggattccagactctgaagggaaatgatcagactagcaagacccttgctagggtgtccctacctgcaatccagcttcttgttaatagctggggatgacttgtggttaagtggtagcccagtgtggcatttgcagagttctggaacaaggctattaaatgtctgtgggctggcactcctgagagggctccatgtggccatgctttccagaccccctcaaaagccccactggagcctttccttgtaaagaagccatgagcttctgtgaaccaatcctgctgggatgaaaaccattgtctccaagctaaattttatccaaattacattggccaaattgtgttgcattaactgggtttctttctggttgcaaagaacagagaatcataggtttattgggatataacatgtgaaaataaagagttggctccattgctcagtctgtccagaacccagaagaagcagaagacctcacttctcaggggtggtgtagtataatagatattagtcatattggtgccaccccaacatcatttgaagaaacttcttaaatttggaaaatacgccatgtgaggggtgctacctcaccagggtggagatcagaactcagttactcagactcctctgcagctaggacacaggcatgtgacataggctctgtggattggatgcagtatgatgagatttcagtctggaagagtgaaaagccagggagaagctgctgcatggaattgttcttggtgatggggcggaacatggtggagggacatggaaccccagaggcagcagagacagagatgataatagtaacatgcaccaaaggcagtgggatcaagcctgtgaccagacaggtgaggatttgggtattgtttgtggctgcagagtgccaacccctatttctccgaccttgctggagagtctgtgagccactaatatgcgtccataagttcttttctgtttaaacaaatcagaggggattttgttgtttgtaggtaagaatcctgattgataaaagcctagtgaggactcagggagactgtgatcagaaagtcatttagcatgcaaggcatctgtaagaggttaatgtcaggagttcaaggatctttgctccggagaggttgtgctcaactattttgtttggggctgaggctgttgttactgcctgtttaacatcccttaagcaataaccattttctactattaggtcctgtattctggtggggctgacatcatgccctagctccagaactgggcatatgacccaggccaggccaatcagatcacagcttctccttggctctgttaattggttcagggatggatacgtgttccaaggtggaccattgagaactacccctgggacttgtgctgtagatctagggaattattccttatctgctgatgctgctaagctggaaggaggtcagtaggaagcatgaagccaatattggttaccttgttgagtgtgggaagagcctgccaaccaaagaataatgccaactgaaggaaagaaaaataagaagagagagagaaacaataattcctgatgatgttgggtatttgtatgcagccatcattgaagtctgttctatccctagatttttcagtgacatgaaccatcagattcctttgtaagttaattttgagttgagtttctgttacttgaaaccaaaaggtcctgactaatacaatggcacatgttcaaatatcagaatttttggcaagcctttagaagaattaaataacatccttggttattatagcgttaacttggttactctgcaagcccatgtctttgagaataactgttatggccccaactgtgctctcttctgtcctcacaagacagttttcacacattctgggaaacttggttgtgttggcacacacttatcattatactctacctcttccctccgatgtgcgtgtttgggattctcccattctacaaggagtattcctctcaacattctgtccaacaagcactgttgtaacaatacatatcctcagttgcaacaaaaggtgcattttctaccttgagcacaatgtgttagccacctgtgcaaggtatgccgccagctgctgtgggtgtgcagagatatttgggttcagaaccactggtcctagggctctggcatcaatatgactctctgccttcgctcttcactcacctcttctaagtgtttcttcaggacttttgttctgctaccagttggctcattttctctttatctctaaaatcagtttcctggccaggcatggtggctcatgcctgcaatcccagcactttgggaggccaaggcaggaggatcagttgaggccaggagcttgtgaacagcctggccaacacagcgagatcatgtttctataaaaaaaattctctttagaccctaaaattagttttctcagaaggaaagataattcaatggatctaattgccaatttgaattctcatttgggcagagttggttgagctgggccatatcagacaatcccactagtccctggataggaggtcttgggcaaggcatctgcccctgtccaatcacagctggccaagaggaggtgtgggtcacatggctaagaacaaggcaaatgctgaatgagggacagcttggggacacttccctccttgggggctgtgactgggcagtttttcttaggcgagaatggtgtgtacgacagctaccatgatcgatgtgtctggtacattctcccatcctataaataataagagaaaagcaagatgatggcaggggacggaatgataataattatcgaggactggcttcaccttcagcacctcacttcttcctatgtcccactcgtcagctgtctctgggaaagtgatcagcttccaggagccagagggctctttgaagggctgtgaggaaagaggagctgctcagcatgcatttcaatatcctcagcacggagcacatcaccctcgctgtgggcccaatggcctttagagatggtgagagttgagctgtgggcacagagttgagagttcagtattctcaactccttctctgaagccagacaaggacacatttcccctatagcctccccctgtagctgagggcagggctgtggatccacatgctggctctgtcttgttcttctgagtttatcctgtggtttgcaccagtgttctacggcaactccagaaccctcagcttcaagccaaagtgttttccaaataaccagaagagtccacctgggaggcctggctcaggccagccccacgtacgagggttggcagctctgacattaattaaccgtgtggccttttagtgaactgaaagacactggaacactgcttttcttaataaaataaaatctttaaccaccagggttgacagtaggaggaaatctgataggggtggggctgtactagaagtctcccttgcctggtttgaatgttctggccttgtccctggttgggacagcgtattaagctggggcagctacatcttcccctgggctgacttctgccaaagcctagaacgttgtcactaaagtttaattcctttttgtatttaaaggctcctggagtcctagagatgcaactctgcaaaccttagcagtttgtttctcctaagttgtagggtctttgcttagggttgatttatttaatccatcaggttctggtgatttatttgattttctgtgccaaatgagtgtctcgagacaaaaaagtggtctctagactaagtgaacaacaccaaggtgacctgttcccactttggagaagacacagcttaatggttaagagtgtagactttgatacttgatgccctcgggctcaaattttggctctgcaattacgaacagcgtgaccttgagtaaattattgaataggttggagctgtgtttcctactgtgtaaaatggggttgatgatgccataagtctgccccatagcggcatgtgtacattaagtgagatcacgtgcacagtaagcactcaggaaagactcactgttttttccagctaggtggaatttctctggggagctatcagatttttttcctagagacctgctgggtggcccacactttggagcccttccaggtgggggtagcagaaacatcataggggggcatcatgggttttccctcccagctctattccttctgcctctcggtgcttcaggccaactgttactagttgcagagagacggccaaggcaacagcaggcttggaaggtgcaagcctggactggtcgttcactgagtggaaggtgtttggaatgcagaggggcatgaatgagccaccactctttagttggggttttcattaaggacatgttgctgtttgatgccactgggcacaggactttcagagcaggggatgggcataggggaggagtccccacttctggccattcaccctggtctttgaacataacctggctctgagaaagtggctcgacagtacaggcccccaagcccaggatttgggagacctaatctgggctcagccaggcttctgttaagtcattgatctaaggagctggcaaatcccttaggagagtatctggaattgatggcccaggcaaatccaggctctgcctctcagttttgcatataccttatcgaatttaatccttgtaactattctgagttgcacagtttagagaggaggaaagtccccatggagttttaaatctggaagaactttgaggtcttctgctttaccctcttgttatgcagatgaaaaaaggaaagcccagcaagggtgaggtcactcagctaattaggagcagagctagagccagatctggaaccttgttcttttagccgtgcacactgtagctaatgcaggcggaccctgtgctctcttgaaaggcaactgcactgcaggccccatgtgtagatttaggctgctttgtgcctcaacccacatccccatcaccagtgcagcttcaggaatggtccttggtggggcagaggggataaaaccagcctgactgacagctccagctttcagctacccgaaggagtctcttcgagtccttgccaagacccaaactgggaatctcagacttcggacaagaattctccaactgtggggatgagtgcacctaggctaagccaagcactccttggcctgtcttgcgttacccagaattcctgaaagtgctgggacttggctaggtggaatttgaaagtctgacctctggttctaacctgttaaaatagttgagcacagactgttttcccagcactgggctgcctgtgtaccacctgaagtcgggggtagaggcctttgcacagtgtctggcaggtgctccataggaagggaggggaaactcgaagcaggggcaggtcccaaggaagacggggtggcattttcacaagaaaatcccccagaaagggcggccgccccatgctctcccccatggcattgtgccaggctggctatgctgtggcttccctttgggttcccctgggtggaagggtgctcactgaggtgccttttgggtgacgttgcccatgcaaacacatttccccagaaacacatctgctcaactgcactaaaaatggcatcttgattgacttatttagcgtccattaagttcatactcaaattaacatgcagaatgggagacaggaggggttacaacacccgtaaggggttagagaggcatttaaaatggatgaagatctgtgtaccagatgtttgtttcacctaaataaaacaaaataataaaacagaacaaaacactgcaccaaaaacgttctttctgggagcagggagagaaagttccatgtctctcatccctttttcgggcttcaccccaaggtcacaggtccctgctggtgtagtggtggcctgtagataggcagggagccccatttcattgttggagttacacaggagtgactgtggcaatcagcacacaacagactcttcaaaatcgtgaacaactggggggaccttgcacatggagggcccactgttgaaagagctgtgctgcggctggcctcaatgctggggagcatgtggctctccttgggtcagcagagcaaaggtaggggcatccaagagggaccctgggagctccttgcattgcttggaccatgagccagctggggcctggctgcttcccagcaagagggcgcccacgttcccttttctgtggggctggaggattcctcttcaccctccccatccctcttccatgcaggaagcattgcaacatctagacaatgtctgtattaactcctctgcctggagccaagtagcctgtgtggtcctgcagcagaatacaggcccgtgctgtcggcccagctcacccccacccaggaatgattatggaatgggggatgcacacttgcttcacccttcttgctctcctttagctccgtgagtgccctacccccaaagcatattgctttaccggtgctgtgtgagattatagaattctcaaacctggttcatgacagggggaagcccagaatgggcctgcctggcaggacaccgggatgaggtgtctggttcctccctgggagctgcccatgtgacgtggatcagaggcccttctggaaccaccacctctaggacagtaaactgtcggtgactgtaagtagcacccgtaatgccaccatcagccccagaggcacaaagccgagacagagcaggagtcttgaaggggagaacattcatggaggaggacttctgcgggaaaaggggctagatctgcctttgccactgctcccaagacagtccttctcatttttccctggtaatagctgctcccagcccagccctcccccacatggcacctcagctctcagtccggcactgcctgctttactgctttccaagtcccatggaaatgaatcattctgctggcttgctggagtgcactttcctatctttcagaagccagtggccttcgagaataactggcatttctcagtctgtgatagagatgtccctctgttcacgccaaggtgagctcttccaagcatgtgcacgcagctcatgtgcctggggaaataagcactttgctacctggcaaagcagtggggaggagaatactttgcctggaaacctgaccagacccttaatgaatgttatgtgtaagcttaggctgggcagtgtagttgggagaacagggaatgagtttcagttccacaattgtgctctgctccctcacatctcagggcctttttacctacaaccctgctgtctaggattcagccattcattccttcaacacacgcttgttgagtacctcttatactgcaggcttacactctcatctgcaaggtgctgagtgaacaagacacaggcaatgggggtgcagacaatgaaggtgaggtgtggcttgtcccttcttcatcttttactggtgtcctgtctgtggcggtcactatgagggcatctgaacagtggtcttgaggcaggaatttttacgccttagctcagcgagatctgggttcttgtctcacgaccaggaaaaattaggcacatggacatcaaagagtgagtggaatagaatttatgaagcaaaaagggaagctctcagcaaaaagaggggtcctgaaagcaggttactggctggcccccttcatagttgaatacaaggggcttctataatccactgatggggctggtttccctatttgtatgtggcgtgaattcctggcacccccatccttctagtgcacatgcgggcccttagtctgagccactccacattgatttatttcccttattgcgcgtgtgttaagggacagaagttttcactgcgagcatgtttaggcaagccacctgtgcacaatgaccttggccggtgggaagttctctgggggccctcccctatctgcctaggagagtgctctgtctcctgcctctgtcagtctcagggttgatcagcagagaatcccataggggtataggggtagagagagaaaggggagactcggggcaattcaggagggctggaagtgcaaactctctctttcctgatattaatcagaccagggcttcacaaacttttgaccatgatctattacaataaatatgttttacattacaacacaatataacatagctatatgaacatatacacaggaaaatacacacctggcaaaatgttatgagacattaccaacctttattgtgtgtgaggaactgtgatatctttttattctattctatttgttctattctatccaaaatgatgttcatgaattttgcagcccactagtggatggcaaatgtcattttgaaaaacactgaagggccaggcgtggtggctcacacttgtaatcccagcactttgggagaccgagataggtggatcacttgaggccaggagttcaagaccagcctggccaacatggcaaaatctcgtctctactaaaaatacaaaaattaggtgggcattgcacacctgtaaccccaactactcgggaggctgaagcaggagaatcgcttgaacccgagaggtggagtttgcagtgagctgagatcgtgccactatcctccagcctgagtgacaaaagtgcatctccatctcaaaaaaaaaagaaaagaaaaacactgaaagtaaaaaagggaagacagctaacactgcaggaaaaagttacaatcaaatcttattttgaatgcattcagggaaccctctatttagatcaccaaggtaaattcttctgtaaatcaaatcaatctattcttaatttgtatttaagaagaccaagccttctactttggggcttgtttaaagcaaaatccaccttacttgccaagtcaggtctgtagccatttttgcatggtccgtgaactaagaatgattttaaatgaaaaaaaaatcaaaagaataatttcacaatacatgaaaattatataaattcagatttcagtgtgtctattcattggatcacagacattcgtttgcatattttctatggctgtttttgcattagaggagagttgagtctctgttttagaggctaaatggtctgcaaaacctaaaatgtttactgtccagcctttacagagtttgccaacctctgggttaaagtgtggtatttcttatgctgaggttggagtgacccccaaataaatggttttgctggtgaggagccttcaaagggctggctgaatgagaatgcctggccttccagagccttctttggccagcaggagcatctgtgtgatgccactgtgcagtgaactcatcttaaccgcatgaatgggcgagcagctgtccagcagctgcccagagacccagaccggctctcaggtactgtgtggcctggctgagggcatctgggggcggggcaggggctcagtgggtgcagcccttgaaaaattcaccagaattagactctgatgtctccatttgatcttttcttccctccttgtcttgccttttcaaaaggcgactcttttctgtggccttttcttctttcttttggcttatatgatccctgcatcattatttcccaaaaaagaatgtggcaaagtaactttttgaaatattaatgaaccccctttttccttttttcccctccctccctctctctctcccttgtttccttccttccttccctccctccctccttccctccctccctccttcccttctttctggcaaggtcttgctctgtcacccaggcaggagtacagtggtgcaatcacaactcattgcagtctcgatctcccaggctcaagtgatcttcctgcctcattttaaatttttctgtagagacaaggtctcaatatgttgcccaggctggtctcaaactcctgggctcaagtgatcctcccaccttggcctcccaaaatgctgagattacaggtgtgagccactgtgcctggcccgtcttttttttattttacctctcctttcctcaaactctctgcctcctcagtgaagcagctaggctgttctgtcctcctgtttcaggggagtaaggggttgggcagggagtttttctgtcttaacttcagggaggcctgagaattctcagcagaaattgtttcagcgaacatcaaaatagagcaagacttctcccacctccttgaggtgggtagggaagcagagagggatgctcagtgcagaggaatcagtgagtgaggggaaaagacatagcatctgaagacacagaggccagcactcaggacctccatcagaggaccacgtgaaaggcaggttcaagtccaccttgaccactcagcctccattgcagtcggtggcatctagtgccactggctggccttccttcactgtggtggggatttctttctgcagcagccagtacttccttggtgactccatacagagcatgacaccgtcccagcctccagctttggttctttccccatctgacatgccctaggaattcactgcctttgcagtttcactggatctgagttaatccaagagatagacaaaggggtattgagtgaacaagatgaccagcacatcctaggttcccagagttcccaaagctgggttgagacctcacaggccgggctggtggtaatgcccagggtgtgtgtgtgtgtgtgtgtgtgttcgttccttggcactcacatatgtttgtgtgtctgtgaggctgtgtgatgggatctgggaactggtggaggatgagaataaaggatggagcgctaaggagtcaggcaggcaaaaacaacccccacacaccatgcgggtgtatgcctcccgggtcccatgcacctgggtatgtgaaccctgccaccctcctgcacaagagcccagtctactgtgcctgaagaggctggacctgacgccggccttccctttgcttcatttgtgagatgccggctagtccagtctgacttcaggagagcatctctggcttttctgctccattcctagttttggttcttccttaggaggccccgcaatggagggaggaatagagcagagaagaggcggcatttcctcatctccccacactctggcctaggaccttgtgatgactttctctaatttcagaggtggagacagacttcttccagccccctcctgtgaagggacagtggggccaacttcctttcctctcctgtgccaggtcttaaaagcctgacctgcattttgcagaagtcaggaccggcttgagttcaattacagtagattgcttgatctcatttattttctcctgtatgcttgaagttaggacagctttaatttgaaatggaaatttatgcaaatactatgtaaattaggtcattcccagattaactgggggaaaaaatctggtcgccttagcaggcaccatctgttccctcctcattctttccatatctgaaccccaccccccctttcccaatcaactttgaaacttgttttcctgtggctgagaagagagatcgttcaagggaaggaaactaatcccccatcagttttccaggtgggtcgttccaatgtctgttttgcggtgagaagaggctcaggtgagaggctgggaagacttcagggttggctccgggttaatggttgccacactccacacatgtgccgcctcctccttgttcctctcttttctcttggcctccgcttctcttaggattcttttcctccttctctttgcctgaagtcttctaatggcacccagaagccttcttcctccctcttgtggcagtcggagtagaagggctttggggttttgcaatacccccagagttcttgggaacttttgggtccatgtgggtattggttgggaggctcagggcccaagcaggaggctctgtcccaccccatggctgcagctcacgcctatggagcagggacagcttcagtcctgctctgtgaaggcaagaaagccaggagcctcagaaaagctatggatgtgagggaagcagggggccccagcttcgtcattccgcatcgttttctcctttaaggggacaaaagtgagaagacttcccagcgattcattcgctcctccatcctgcaaggaagcagagccacagttgccccaccaggaagaagcaacttgaggccgggtgcggtggcacacacctgtaggtcaggagtttgagaccagcctggccaacataatgaaaccctgtctctactaaaaatacaaaaattagctgggcgtggtggcggccacctgtaatcccaactactcgggaggctgaggcaggagaatcacttgaacccaggagacggaggttgcagtgagctgagattgcaccactgtactccagcctgggtgacagagcaagactccatctcaaaaaaataataaataaaaataaagaagcaatttgagggatacttttgttgctgttagccactgagtttttttttttttttttttttttaacagtctcatactgttgcccaggctggagtgcagtggcatgatctcagcaacctccacctcccaggttcaagtgattctccttgcctcagcctcccaagtagttgggattacagctgcctgccaccacacccggctaatttatttagtatttttagtagagatagggtttcactatgttggccaggctggtcttgaacttctgacctcaggtgatccatccatcccagcctcccaaagtgctgggattacaggcatgagacaccacgcccggcctagccactgagatttttgaggctatttgttattgcagcaaaacttaatgagagcttactactacaccctctcatcttcctcaatctctcctcaaagctgcctcaaaatttaaaaaattcttttatatactcatgtgatactttctcgctttaggccaagtgaaaataaaggcatcttcataaacatttgctttttttcttggttcatgatatgactgtacaaactgcacttgtgtatacggctttaaacccagacttcaggcagggggaacagtcagtgcaaaggcccccaaggcagggacgtcaggagtccatgtggcttggtcagagtaagaaggtgggagagtggtagggagtgaggctcatggagtgagaggtgggcagtgtggacctgagcatgggccccagagaaggtgcagtttcaggacagaagcacaaggtggcaccgtgacactcccctcagtcactgtggaccgcatgtgcggtggtagagaagacacatcttcttatcctccaaaatggctctgccagggaatgaaagtccagccgactccagcaaattagaaactgtactcttaggactggaaaagctttcgagacctctcaatcagggaggtttccatgtggggtccatgatgcctatgcatggactccaggacccaggggatcccctgaattgcagtgtgcttttcaggagaaacctccaacattttcactccaaggggtctatgacccaaaaaaggtgaagaacctctgactaccactggtgctcccaccaaggccagacttgacaagaacttcctcagcaacaggcagccccggccaattccacattattaccaggtgcctggagacctgtgagtcctttgctatctcagtggaggcacccagtaatgcttggaaccgctgggcctgaggacactcgggctctccttccagaaactagagcttttgtgaggggccagcaaatttgcatacgtgcacccgtgcacacacgcacacacccctctctccactgtctttagattgaagaaatcacatcttctgcacatgaacgtcctgttggttctcaaaggtgcctggatgtttctgtgataagtaaaatatgattgcacaatgtggttactgaatttgcagtcactttgatcattatatagtttctcacccactggatgttttatagaagtctaatatagaattgatctaattgaagtttaatatatattcgactctatgtgtccaatataatgaatggggcagggagtctgtcagatattttgagctaaatgagaaacttcataatcaaaatggtgggagccacagtctggtgaaagggaggggtcgtgagtgatgtctgatggccaacaggtgagctgggacggcgcagggggcgcggtgggggcaggacaggaagctgcgtgggcagcaggtggagggtgtgagcagaagtgagactggagcctgtggggttgctcaagtggaactgcagaaggagatcaagaatgagggaagatgcaaatttttaattcagcatcttctaaaaaaaagtcccagaaatgactgtatttgctattggtgttttaaaatatccattaaataccacatttgccagcatcacttctcttatcccggctgctctagcagcctgaattctgcctttttcttccctgagagctgggctcagggaacccgcgtatcgacctcagggggtcaggcctgcaggtgggtggctcccctgggactctttaaaaccaaaccccgagcagaaaggagaggctgaggtttggggctcctttaaaggcctcctctcagcttgtctccagttcactgcctaagaatgtcctccagacacaggctctgaggccagagctattgaatatttatcaaggcctcctggcagacgtgggagactgagaacaggaaaatcaggcccaggcgggcatctgtggagcctgcctgggtgctagccagatgctgcaagattcaagttgcccgttgactctgcagagcctgccccgccctgtcctccctcctcggggaggcgtgcatgggcctggctgctgtcagggtgtttgcttcttgtcaccatcctccatactgacttccattgcaagccctgccccactgtggctccattgtctgcagtggcctgggctgaccagctcagcctggagccctgccctgggacgatgcgggctaacacagtgacacaaagccctgctttgtggccctgacaggaggatttatcattagctgtgagatggtccctggcagatcctggcatgtggtgagcagacagatctgtgctgatcacagtattttgagtacccccagttgaatacagcatctggggccctcaaatctgccacatggatcttatggcttcaggctcactggcaccttttgtgttggccgaagtacgggtagggggtagattaggagcactagcttgtacccagtgacgtctgggggctggtttacaggaaaggcaccctaaggttgtgcaggccctgacatgtggtcctcctggcatctggggacagcatgtcaggtttggggtctgcccatccttgccttgggcacaggtccccaaacaacagcagcatccctgtgggtgggatatctgaccagcagaaaatggaagtgaatatctctttgatcttggagtgaggaagaatttcttaaaaataacacaccaaaaaatcacaaatcataaaaaagaaagattcatgatttcaaccacgttaaatttaagaaccttggttcatcacaggtattttaaagaaactcagaagataagccacaagctgggaaaagatatgtgtagcacttaagtgacaaaggattagcttcaagaatatatcgagtcctgaatgcctggtggggtggagggagtgggaaatagacagatagttcagaagaaaaatgggaaaaaaatatgaataggcatttgacagaagaggcaacacatagggccagtcaacatagggatgtgctaacctagtcagtgtccaggaaattgcaaaacaggcagtgagatccatttcctccagtctgtttcctccagtctctctccggggcctggagatgctccttggatggttctcagtggccctggtcctctccctgggaagcctggcctgtcaggctctgcagagccctctgttttgtccttcccccaatatcctcccactcagagcctgagtctgcccctgccccttcccttcctgtcctcaccaatggcgagtgtggcagatcctccagtttctagaaacacctcctcactccatcttcatcctttcctttgatgtttccccaggtcttatccggccaggtgggctttagggaacatttttcttccccctttgaagccagggtctcgctctgttgcccaggctggagtgcagtggcacaatctcggctcactgcagcctccgcctcccaggttccagcaattcttctgcctcagcctcccaagtagctgggattacaggcatgcgccaccacgcctgggtaatttttgtatttttagtagagacggggttttgccatgttggccaggctggtcttggactcctgacctcaggtgatccacccacctcggcctcccaaagtgctaggattacaggcatgagccactgcacccggcctagagagcatattttcaatcagaaaagtagttcgctgcacctcacaagcccaacactgagttccaggaggacctcaggacaggctattgatggtacggtaaacatggctgacaactagcacgttctagaccaagttcaggtagaaagggactccctcagctggccacaaagctaccctctccctagtgtgcagccttatcaggctattgtccaaggcaaaagctgtgtgtaacaagcagcccacgcagcctgcagccaggtctgccaaggcacctttcctaaggggctgcccatgtggcccgctcacgcaggatcttgctggcactcttccttgggagcttaccttgtttggaaacctttcctggttagcctttaagagcctcaacaggcagctgaaagcatgtcctgaaatgcctgaactcatacttggaatgagaactagctacagcttagtatgccatgaacgtttgcatcacttgttgtccaataaatctgcggtccccaacctttctggcaccagggaccagtttcatggaagacaatttttccatgaacaaggaggatggggtggttttgggatgaaactgttccacctcagatcatcaggcattagattctcataaggagtgcacaacctagatccctcgcatgcaccgttcgcagtagggtttgtgctcctatgagaatctaatgctgccatgatctgacaggaggtggagctcaggcagcaacgcgcactcacccactgctcacctcctgctgtgtgtcccagttcctaacaggccctgggggtgagggatccctgcaatacataacacgtgctaagcagtggggtttgggtgctacttcccaactggccgctcttaggaactggtgaaaccttaagtcaggtgtgactgagcgagcccctgggtcatggctattctccttgctgctctgctctcctaagtctggtttgaggctcctctccctccctggcgtcccaccctgtatgtctcctaagccagtccagcttccaagggtcgctgttgtttctcatggccttcatgaaaacagcgggcagggcatgtctctggcctgtgatggctccccgctatagtccttgtcatctgtatatcaaggagattttatttctttctttctcagttcctctttctttctctcttttttttttttttcctgtttttccttcactcaacaaatcaagcttccattaggcacaaagagtcttgtagacacttgaggacataccagtgaacaaaatagtcttaaatccttgccctcatggagattctattccgaatgggagacaggaaataagcaaaataaaatgtgaaacctatgacagggtgaaagcgatatgcagtcctgagaataacttttatttgcatggcaccacagctgcaaaaaacagtgcatttcactaaccccttatggtatcaaccatggatggggcaatcactacaggccaagcattgcatttacatcacttcagaacccctgtgggaggtgctgtcctatcccagtatacagatgaggacactggcacacagggagactcaatgacttcccatgatcatccatctgctaagaagtggagtctggattcgaacctgaagccgtgggactccaacgtctttgttctttgtcactgtacaatatgcctcccagcttctgtcctggctgcctccacaatcactcagcagcctctgtactgcatacaccacagcgggaggtagtgcgtggctgctgaacatatgggtgacgaaaggggttttctggtgggactgaagtgccactgtccctcttacgtgcagaaggccctgcctgccctgcatgccaccatctaacctagtcctgccagcagctgcctggtggtggctttgcagccctgttacagcccctgctgggtgcatgattcacaggggtgcagtgttgccttgcccaggctcaggccctggcctgcaccagcctgagacagagcactgggtcagaggtgccttctgtggctccactgcccagggcatcaatggagcagggcctacggcgagcctctgtgtgtgtcgagacagctagaactgttactggtggagggtcttgactgcaagttgtccaggttcttggtgttctgaacgaagaattggacaaaatgcacagcaaagaaaggaaagaatgaagcaactaaagcagagatttattgaaaatgaaagtacactccacagggtgggagcaggcctgagcagcggttcaagggtgctggttacaggatcttcaggggtccaaataccccctagaggtttcccataggccacttggtgtacacttcatgcaaatgaagtagtggcctgcaatcagtctgattggttgcagaaatcaaccaaatcggacaggtgggggtgtttacaaagggagtagcctctggtccttttgttacttaggtgtggaaagttggggtttcccttttgatttagttctaattagtcagtgtgaatcagccttaggttccctgcctccagaccctattctcctgcctcagaacttgcctgggcaagactaaaggtggtctcacagtccagagaagccacagtaggggccaagggaaaaacttctttgccctctgtatgttcatggaaaaatcatctcacaaaatgcagattaataaaagaaaaggcagacaaatttgttaatgtgcacatgggggagaaccacagagtgattacctccaccctccaccctccaccctcctccaccctcctgtctaaataagctcttcttctaggcaaactggtggggggaattgattcactatcctcagaaattaggaagcatgaaattatgctggctctgctactggggaacaaagagcaggggcgtggtgtgcagcggccagtgcaggaagtataagtatatataccatcctgaggttacagaaagaatgggggcttggatcggggcaaaataggttatgggaggagaagatgaggaggcctggtgagccaagatgatcttgttacgtagacgaaacctcacagggagcagccccgagagaactgatgggaaatgttactttcagacctttaaaggtgtcccattttcagttaatttttcctagattggacaaaggacgacctctgagaaaacctgagaaaacctggctgcatcaatgcagattctctgcagatgcaaatctcccccagaaagacagctttgcagggctccttctgtttgcaggccctctgaacaaccatctcaaattatgtcaaagaagtgtatttggggatgaaacatgtggatttctttcaccccccacccccctgcatcgcttgtgtactcttttcccaaagtggagtctacagcatggagtagggggagttgatctccagatatccatgtctcttccctgcgcatagtgacaggaaactgaacccaggaatcaaaactcaatatatgaggccagacaatggtgcttgttcctccctcttgttgtgagaagacatgaagtgaactctggggtcatgagttactgtgcttcgaaaaataagctgtgtgactttgggcaattgcccaacctctctgggactcaatgccattgtctgtaaaatagggctaagaactcctttcctgcctgcctcctagatttgtggtgaggatcacaggaaataatgtatgtgagtgtgccctgtaaaccataaagtgccctagtgacatgcacccatgcacctccatcattcctgcagtgactgaaacttggaaatctcaccagaatgcatcactgtgagacttgttgagaattaagtcaagcaggggttaaatttgccaatcaccagagcacactatgtatatttaaaatcctccactcttttagtaattgggggcaaaaaagaaaaaaaaaaacatccactctgtcccagaatcattattctgtaaagttaatgagttccatgaagggtctttgtggtgactcatcccatcacttcttccactcctgccaccaggtgagacctggggagagcatcagggagcaggtgtcttaaggatctgaggtgcagggtgggggctcccgcagcgctgtgtttaaacagggccctgctgacgcctcaccacggccggctgggaaacagctgcagcataaggcctctcctcaggctagtgtggagcccagcagatgtgccatttgcctccacagcaacagacgtgaccctaaaaccagtgaggtccccaccctgaaaggctccactggcttctgagcctgtgtctagagggagtgggcaaggattccaggtgcatggagaggtgaacgctattactgactcctctgctggccatatgcttacttcctttatcctcccatcagctctgtgaagcacccaccactttagtgcggaggaagccgagccttagagaggtcaaggcctttatttcagcctcccagccagcaggcagcagggctccaaatcggaacccagatttattggaccccaaatcataggctgtgacagggctcgttattaaccaggccataaatacttcctgagtccctatcccgtccctggaactgctggggacatgaaaggcacaggaggcaggggcccgacctcacggggttggagcagacctaaagtgggatgagagcagaggaaccctgcggctggggctctccactcttccatcacgctctgtccagcagggcaactggagggagccatgagcatgcgatgacctggcggctgctcaggatgggagggaccactgtcagccaggactggcaggactgtgtgagtcatcctagtgggtgagggagtcttcctgggctctgggagctatgagtccatgattcctgggcatgtgaggaagctggttaggagctcagccaaaacttaaactctcaatccagcactctttacactcccaccacatctgagctgagacttgaaggggtggggcatgggtgattctggtcccagggactagagcctgggggctcccaccttttcctctggttctgcactgacctgccctctggttctgccctgacctgcccttgccaagcccactgggccggcgaacagttgtttccattttccctgcagcctctgttctgggaaccaggccagcattcatagcctttcccctccttttctttttgtaatagaaactgctcagggctgccaggagccagcagtgtgctccgcggctcaccgtttggctggactggaggtgaagcttcttggtggctccttcccagccttctatggaagctggaatccactctcccgaggccatttctcctcccggggttccctctctgcagcctcaaccccccagtgccctttgtcccctaaagcgagcagtttgttttcagtccaatacctccaggggatgggggggggcgcctggaggagtgtcccaggagagggtcccaccagccacgctgccctgaacccccttaaaatgggggtggtgtgacagtaacttagagaccacttagatgacctcaggcattctgagaaatctaaaggctgatctgaagccagaggaggaaagttcattcacctttgtcccagcccctccccgactccaggactctagcgttggctgtttttatttgcagtccagcgtccggaatgagcggagttccttttgggaaggatgtgcggcaggtgtgctcactctgcccgggagcgtctccccgccgaggagcgcccatgctgactgcgaattgttccacactgcacgcagagcattcctttagcagcctcttgttttcttaagtgactctctacaactgtttccttggaggcgtttgtctaaataagctcttcttctaggcaaactggtggggggaattgattcactatcctcagaaattaggaagcatgaaattatactggctctgctaccggggaacaaagagcaggggcgtggtgtgcagcggccagtgcagggcccaggacagggtgtgggggctaatcacagcccgcggggtgggtgggaagtgccccagccccaagctgggactgtgcttctcggcaccttccacaccttatgtagctcccctttggtctccacgtttctggaagtcacagctgcaccctgggtcaccttaagctttttcacagtggaccacatgtgattctgagttacattactttaacctcaagagcttgactattttctatatcgtgaagttataaaaggatagtggaatctcacagtcatttgagagacaatactttttttcgaccatatgaatgttttgtaccatggagacagtgtgagccaggctaggaggtctggtcagagacacttattttatttttagttttagtttttgtagaaatgagagtctcactatgttgcctaggcaagtcttgaacttctggcctcaagcaatcctcctacctcggcctcccaaagttttaagattacaggtgtgagccactgcacctggccagacacacttagtttaaggagcaatgtgctataggcaagaaagccaaatatatctcaggtcaaatctggctctgctgtgtgatttggggcaaattaatgaacctctctgcacttctgtttcctcatccatcaaaggggaataataaaacctatctcactgtgctgtaaagattaaataatgaaatggatgcaaactacctcacatagtacctggcccacagcaagttcttaactaaagagaactctctttctcttctaaaacctaggatgcctgaggagtctaggattaggaatctctgaatatttactagtagcattgctggggtggatcagaaatatttgggaaaaaagttaggaggaaaatggcacctatgaggatgtcatagtcatcagcaatgaaggatttgagaagttctttagcagaaatcaggagattacctctttcattcaaaccctagcgaaggatgctttacactatgactatgattacagagaaatgagaatattttccatttgtgatatagaaaaaccattcccttaactgggggccacatgctgtagggagttcaataccattctccaagtacatgaggcccaacctacatcctggttctgtctctttccccagccctggtcctttgcaagaggtaaaagtctttataagtgcatgagaataactgctcaaaatcacttttaggtttcccccaaattctcctgatctctaataaaaacaaataattgaggggatgtgacattacccttggtcactagtgatttagagcttctgtccattgctccttggagctgctcatcctcaaaggtaccccaggcagaggccagcagcgagttcaaggccttgtcaagaaggttttcctttaataatacgcatccacatacacaaaacacaggccttcctggaattgccaaaagacagcagctgcaaaaaggacttggacaagaaagtttattgcagctttattccaaacaacccagatgcccatcaacaggagaatggtaaacaaattatggcatatttatacgatggaatattacacagttataaaaacagcaaatttttgaaatgtgaacctcacagtcatgatgttgaaagaaacaagacacagataaaaaagtacatattgtgtaattctatttataatggagttcaagaatcagcaatgttaatcctagatgacggaagtcagatagcagttacctttgggtaagcatgcttactttggacttggaaggggcacagatagctttctggggctgtggaaatgttgcgaatcttggtttgggtagttacatgggtgtatgcgtagataaacattcacagtgatgtgcgctcaaaattgtgcattttatgggacataaattaaaaacgtaaaaatattgaaaaacagaaattggagaagtgttaaagggtcaggttgaatgaggactgtctaacctggagctggcatcagaaacaactaccagaaatccctgtaacctgcttctcctttggggtctgtgaaccgcaggactaagacactcccacattctgaccctggcaccagcaacagactacttgccatcggattgatgtcgagaaatgatcacaggataacagctcttctcacggttcagcagataatagtaagtcaaacttttgccccagttgaacatcctatctctaagtataccccccatttcctctgaacccccctaaaccatttgccagtcacccaaatcaccatctgtgaccactactcccctgcattctacatccaatcaatcaccaagccctgtcaattctccttacttgatagctttaacactcctccactcctctccagcccagtgtcttaaatccacactaacatcctccttctagatgatgcgcccacctcccacctgctctcccagactcctgtggtcttgccctcccttcaatgaacttgccagctgctgaagggatcatggccctaaaatgcaaatcatagaatacttaaaagaatttctaaacctcccaggattcacccaggctcctggcatggcttacaggctgtaacccatgatgcaaaccaggcttgcctgtcctgacagcctcatctctctatgcggggcactgtcctaagtggtagaattaattacagcagtgaatgaaacaaagttccttcgccgatgggatttgccattttgtagggaagtacagacaacaaacaaacaaatatatgagatgatgtggtatacatgtgaaagacagaaaagcaagataggagacagggagtgatgtgggattctgtgtcagctgggatggttaaggaaggccattctaatgagatcacatttgggcagaagcctgaaggaagaggctgcttgccaccccacacagcaagggtgtgccacagtcatctgctctcctggcagttccgagagcaggctgggctcccctaggcctctgggcctgtgcacgcacacttcctctccctgcagcattccataccatcaagaactgagatcttatctcatgtgcaggtaataatcacacatgccaaaatttcacggatgttggtagaagacatgaggctcctgggtcagagaagaaggacagtttcttcacttccagtaatagtaacagccagagtggcagcatttttgcactggttttctgaccccaggtgacccaacaccaccattcagtgagatagatgaagtctaaataagagagtaaaccattgtggaaggcattgaaaccataaaaagtaagatgagaacagttgagaaaaagacacttagaattgactgcaacatttacagagttttggtgtcagcagaggccttagtattaggtgatggaagcccgccactgtaaggttcccgcccttgagaatctgctcaggaccagctggtgagatggacgtgtcagcagataaattgcaaggctgtgctctcaagctctagtgcacaaaggactatgggagcccatagaatgggtaggaggaggccattcaagctaaatcttgacagatgggcaggaattcatcagaaagacttaaatattggtcttgaaaatagcactgcatacaagaaaaaaacacatgcatttatgaggcaagagtccctgaagtttcacatttacacaaaatgatgtgtgtcttttggtgggggaagcggatgtgaaattccctacagataagcccaggctagctgaccagatgaggtgagatttctttcaggtactgcctaagcaatcaatggccagagagggctgcggggctgggctgctgggctgcgaggctgctgggtgctgagggagcagggggaatgttccctggggtgtggctggccatggtgctcgccatcctggaacaaatcaactgaggcgcaaatctgcagcacctttgccacagccagaatccacggtggttcctccgtgagcacatgccctgaattccacctggcctgtgcgtcatgctcagttggcaggatatcagaaccaatgctgccaacaccagactctccacgtgcggagcaatttatgaaaccctggggccagcaatggccacctttgcatcctggagttaggatgaccctgacacatcccagccccagcatacaccaccgcgctgccctgaggctgggctctaccttttgagagctactgagctctgcagagatgtgggtgaagggagccacagacatatcagtctggcaggggcttagagtcactgctctaactgcctatctggcaggtgaagaaacagaggccagggcaggcaagccctgaccagggcagtgtacctgcttggtagacgagttctctccttcccccagtgcagtgcctactgtctctctttagctgtgcctagctgggttggggtcttttctctgggcttccctaaccactcctgctgacccctatctgagctccaacttctccctggaaaccacgcattaacctattacctcctcgctacactgtgagttcctgagaggggcttgcgtctttctcatctggcagttggccagagccccataagtacactcaagttgaatgagcgattaaatgggtgactgcaacaagcctgggcaggaatgggtagtgctctttttggtcatggcttcttaaacacaaacaaggtgggcttcattgggccttatttcagaaaaaaatattcgtcttattataaaaagtaatgtttggccaggcacagtggctcaaacctatagtttcagcactttgggcggccaaggtgggaagattgcttgggcccaggagtttgagaccagcctgggcaacatagtgagaccctgtctcttaaaaaaaaaaaaaagttagctatggtgttgcatgcttgtggtcccagctacttgggaggctaaagcaggaggatcactggagcccaggagttggaggctgtagtgaaccatgactgtgccactgcactccagcctgggcgacagagaagaccctgtctcaaaaaacaagtaagtaaagcaaaataaaaagtaatgtttgacttgaacttacaagttaaagaactgatgagtcgattgtgctgttttgattctgtggctcctgtcatccgtctcactctacctcccagcgacacagtcctgtcctcctagatacatgtaccctagcttgagaagtgggactgcgggaagctgggccaaccaggtggcttattcactgtctgctggggcaggaggcagggcaggggcaggagggaggcaaccccagcctgtgcccggcttccccgaggcgtgtgccttgtgcggctgctgaaggagtgactcctgaggaaaccagcttttccagggaggcaagggatgggagaagagggtggagaaggaagtggtcacaccacttgccttctgccaatactgtccctttcttacgcgttaaccttccactctgagctatgacactttcagtactagtgtggtaagttctacaggaaacaggaaacatggtttaacagacatccctttaagctttaagtgtagcccaggccctgttctagctagaatgaagttttgcataatgaatagataccagattcccctgaagggctcttgccccagagactctcagtggcccacgttcacaggtacttgcaggcatgcatatatgcttctcacctcttaggaaatggcctttgcaggcatgaaaaaacaaatacctcaagttcccttcctgagcctcttaggcaacatgaaaaaactacataccaatcccgagaatggaagctggtttggagtttcacctcacaaaaagctggccccaccatgctcacccaaatggcagatttatgaaggttctgtttgacaagagcaaaggatccactttgagcagctctgggcctatggaaggcaaggtgttcatgtttaagcacaaaggtaaacagagcatagcagcaggttacagagatcatttattttcccgctgatgacagacatgagctctggcccagggcccaaacttcttatccttgaaaaacacattttacagattgccggcagagacagccaacccagattaagctgccagacctaactattttagatcttcctcctactcctctggaaaaaaaaaatataagataacgatttttgtccctgaaaaacaatgagaggaactaaaggaaagcccgggctctattcttaggggtctgctgccctccagaaagcccagcgtacaacttcaggcaggcccatgacacgccaagtgtttgcattttggaagaatcctaatagaattccttcaagtggcagattcctgaggacatttcaggatttatttacagatcgttaacttacttgtcacagaaaccgaagggcagggaaattttgagctgacattttggaatgccaccctcaaagggtgatcaaccagaaataaagataaagtgcctttgaaatgataaatatgaagtaatggggacaaggatttgtttcataggcaccgtttcagaaaaacatctctaatgtaaagtgaagcccagaagtatattttacctgctcttcactgactatgtaattaatgtttcagtgactgacaattctcacttatcaccataaatttttttctagaaattgccacataaattggagcatcataaaacaggtttctgcaaactggtttgtatgttttttatcataataatgaggttatagccgggtgcattggctcacgcctgtaatcccagcactttgggaagctgaggtgggtggatcacctgatgttaggagtttgagaccagcctggctaacatggtgaaaccctgtctctactgaaaatacaaaaattagccaggcgtggtggcttgcgcctgtaatcccagctacttaggaggcggaggcaggagaattgcttgaatccaggaggcagaggttgcagtgagctaagatcttgccattgcactccagcctaggcaacaagactgaaacttcctctcaaaacaaacaaacaaacaaacaaacaaataatgaagttataaatttggacttacattctgggttagggacttgacatcaagcacatcagatatgatttgataatttctgtcaggaatgcaataataaaatagctctaaactccgtggtcattataaatagtaaactcatgctccaagcactataaaatgggcatgggcgcactgtctgcatcccactggtttcctgttaccccacctgctgcctcttgcttgaccatgggctgttgatggaaactgaggactaaacttataaggcccaccaagcttatcttgccttgcttgcttttagccgcttgcttctagctgattttaaaatccatatagctaaataatatatatctgccagtagcttccttatagttaacaactctaaggcattgctcaccatggtaacagttgtttttcaggaagtgggggtcagtccttgtccacttcaaaccagctgagaccaccagcccttcaactggacctgtgtgaatgtccagttgatatggacaggagacagggaaatactgggtagaagagggtggttccctggcaaaggccccaccctaaagcctggaaacctgcagcctggaatgagaacaagcattcctgttttcatgcccaaatgttgccttttggtctggaacgccccctatcctgtagtcatataaaccctaagccccaggctctacaagcagatgagcagacaaacagaagagcagaagagctgcagaacggcgtggcagagaaggagagtaaagaaggagcatctgaacatcaagaggagtttggctggggcagtcagggaggagagataggccattggacagccaaactccagggaaaggtcattttcccactccatccgctttccggctccctgctgacagccacctccaccactcaataaaacccccacattcaccatccttcaagtctgtgtgtgatctgattctccctggacactggacaagaatccaggtaccaagacggcactgagctgtttaacatttaagccatctgcggatggcagagctaaaagaggactgtagctcatccactggggcttcaggagttgcaggctcctacccctagacaccactggtgggccggtgcccaaaagcgctcaccctgattcctgcacctgcctgcgtgctccctctcccgtaaagggtttgagcacacacagtggctgaacagacgagccacacccttgttgcatgtcctgcaaggaggttcagggaaacctcccgtttcacagtgggtgaccttttgatgttggagggccaaaaactccaccctcagatcacgctaatgatctcattttgttaacgtgcatcctgttaagagccatgaagcttgactacacttgtgcaggtcactcattgccttgttttcccttactccagtcacctttccccatgcctcggaccgccttgctactctaccccataaatatccataaagcctcttctacggggaggcagacctgagaggcattctctagctgctcacttagctgcctcaagaataaaatcttttctccactgccaaactcatcatctcagtgattggtttactgtgtaatgggcagaatgtgcctggccactaacatgctcacatctactttctcaatacactaactctgaggtaaggaaggcatatcttagttcccgagttcaacagatggggaaactgaagttcaggaatacttcagctttggaagcacggcagagacttagcaaacaggttttctttcagtgcttaagtcctcactttccaatctctgtagccctgctcgtgacacagtggacattgtgcatttgcttgtctcacatctaagggaacactgatttacttatttattttgagacaggatctcagtctgtcacccaggctggagtgcagtggcacaatcatggcttgctgcagcatcaacctcctggactcaagtgatcctcctgcctcagtctcccgagtagctgggactataggtacatgccactatacctggctaatttttttttttttttttttttttgagacggagtctcactctgtcgcccaggctggagtgcagtggcaccacgttggctcactgcaacctccgtctcctgggttcaagcaattctccggcctcagcctcctgagtagctgggattgcaggtgcccaccaccacacctggctaatttttatatttttagtagagatggggtttcaccatgttggccaggttggtcttgaactcctgacctcaggtgagccgcccacctcggcctccaaagtgctaggattacaggcgttagccaccacgcccggactacctgcttaattttttgattttttttttgtaaagacagtgtcttactttgttgcccaggctcaagtaatgcccactccttggcctccagaagtgatgggattataggcgtgagccaccgtacccggcctgggatgctactctaaatgcacattcattctagctcccaaactacttttttttcgctatttctaaatcaaaatgcttttcgacattgctatgtggaaactgtgggttttataaagttataaagaatagtttaataagaaattacacccaagaaaagtataaaacacattacaatataaatgtgacctggcacttagaataaacatttgctttgcaatactctcatttgtttttttcctagaatttaaatgagacttttttggaaccagatttttaaaataaacaaatgaacaactgtccctaagaaaccttagctgacaccttttttgtttctgtcttaaagttcccagccaaggttttcaaaatctttcccctgacctcagaactgctggaagtggtgcagtgctgactgacagtttgttgacaagagaggcaacacttcacacttcactggaaagcataaaagcgtgctccaggtcattaactgagacttttaagaggaactgcttgctgcattatgatagtgggattcaggaacatttctttgcaattcgtacagttttgttgttttttcacaaaatggaattcaaatgcacagaatgcaattaataaaaattcttgattcatggcacactatcatcattggcccgtgaatggccttattttactttatatcacatttagtaatgaacacctggtaaaaccaaggcccaaccaagaactagaatatcaccaccattttaccttgacctaagggaaagggaagggcacccactctatctctgccctctggctctctcacataggttactcttctaaatctgttgtttgtcattcctttgctttttaaagatgagttttaccaaatatgcttgaacatctaaatcatatgtaattgggtcttctcaggtgataaaagtagtatcaccctgtatatagtcttctctagcctgttcttttcactcaacagtgtttctgagacattcatgtggttggtaaagctgtagttccttaattttcacctctgtgttatagtcccttgtgcgactctactaaaatttatattttttcctgccagtagatatccgagttgtttctatttctttctgtaagacaaacttttttgcttagaacaatcttctgtttcatattaggtgctaatgtttctcttgggtatataactagatgaggagttactgggtcttcaggcatgaacaaccttataaggtaatgacaaattattttccaaagtggttatattaatttacatttctaccaggaatgtgatcacattgattcacattcccttcaaactcaatattgtcacacaaaatttttatcaataggtgtaaaatggtatctctgtggttttgacttccatttccctgataatgaggttcaacagtgcttcatgatttttagctgtatgtattttttcttctgtgaaatgtctgtttgaatcttttgcagttttgctagcttttccctctttttgtttgtaggaacccttatctattctgcatgctaatcctttgtgctataataacttcagttggaatttttcttctatttctttaaaatattttttgatgacatgttttggtgactaattttaacatatctgaatttgtgaatattgtttcttacggtgagcatatttttgtgtgttatttaggaaatccctccctgttctaagatgagaacaatattagcttatttttctctaaaagtgaaagtgtgcttttaacacgtaaactcttaatccttctaggtttgatttttgtatatggtgtgaagtaagatctgatttcatttttccacatggataaccaatttttcagctccatttattattcaatcttgcctttctccagttctgtacttccagcctgtcttaaaaattcaaatatgcatgagtctgattcctggccctctatttctatctatcagtcagttcatttattcctgcaccaagaccacactatcttaattagtataactttataaaaaatcataatgtctgctagaataattctccccttttaatttttcttcagaaataccttggctatccttgacatctgctccttaatatatattagaattaacttctcatgttctatgaaaaatcttttggggattttgactgtaattcattacatctgtagattaacttggagaaaattcatgtgtttatcataagaacttatgattcataaaaatgggatctttgtccatttaggtattctttaatgctttttgctaaaattttgtaatttttttgtatagattttacacatctttgttagtttttttttaccctagaacttatatagtttggtgatattctacgtcaataatattgatatttgtttttattttttattttattttattttttttgagatggagttttgatctttttacccaggctggagtgcaatggcgctatctcagctcactgcaaccttcacttcccgggttcaagagattctcctacctcagcctcccaagtagctgggattacaggcacctgccaccatgcccagctaatttttgtttttttgtatttttagtagagacggggtttcaccatgttggccaagatggtcttgatctcttgaccttgtgatccatccgcctcagcctcccaaagtgctgggattacaggcatgagccactatgcccggcaatatttgtttttaaaaataaattgtgcttttagattgtgtctggtatagagaaatgaaactgaatttttatattgatcttatcaaaatcatctattatgtctaagaatttatttttagattctttggggatttctactgagaactaagctctgattttttttttatcttgccccaattcctatctaaggggtctgtggagtcatgtcctacaaaccacaaattctcatcagaagggttttatttaaccctgtatattgtggcttactttccaatctgactctggcataacaaggaagaaaagcaaaatattttacctcaaaacatgtttctctgccgtatcttgaaatggccctgcaaagctgtcccttgtgggaaaaaatccacattctatagagaatccctttcccctcctttttttttccttccttcctttccagatccaggagataatcaactaagagccaggcacccttttaggtcctataagaaacattttacaacctgctgtctctgaagtctgctatctagagcttactctgcacaataaaacttggtctccacaatcctttatattaacctgaacatttcccttctgttgatcccaggtcttcagataaactcaaactactgtcaaccagtaaatgtttaaatttacctattgcctggaagctccccctgcttcgagttgtcctgcctttctgaaccaaaccaatgtatttcctaaatgtatttgactgatgtctcatgcctccctaaaacatataaaacaaagctgtgccccgaccaccttgggcacatgttctcaggacctcctgagggctgtgtcacggtccatggtcactcatatttggctcagaataaacctcttcaaatattttacagagtttgactcttttggtcaacagtactgtagacaatcatatcatccacaaaaaatgatagttttatttcctttatttcaattcttatgtgtttattttccttatggtgctgcaaaacatctccctaaaacgctgacttgaaaaatgagggcaggcctctttactttggtcctgatttccaaagaaaaactttccatgttttcctactgagtatgatttttgttgtaggcgttttatttaagattggatctaaagaagactcaaagtcccgcacaacattgctttaattccattggccagaacttagccacacagctatacaaagctgcaagggaggctgggaaatgtggtgctttagctgggtgggcaaatggagttctgttaatttgatatagaagggaagaatggctatttacttggtaatgagtaggcagactctaccatatcttttggatgttgcctagaaaccaaggtgggcatttaggctagtgtcatatggatatcttgcaagatataaaaatgtcttaggccttttcatgtaattataaaaacaaacaataacattacaaaaaaaagttgcaaaggaactttcttagccagccagtccaccctgtctacttcctgatctcagaactccgtttgtgccaaaactaagactccctacttgtcagggagagaagagtagaaaccatatcatgaagattttcatggtaaaatgaaaaattgaagtttaagccagttttaattaccagtgctctttgttacctcaccacccctacttccttgaactttgaaggcatgagggaggcatgagacagcaatcaaatacatttgaaggcatttcctcaccctaggaagccaaggcaccatacatggtagggttgtttccagacaaattgtacagggaatcaaataagtgaatgcccaggtagcgtattttcaaaatatacgtctgcagtcctcctcccttgctatatactttcccccacactcactgcaatctggccacactggccccttttctgttcctcattgtgattttaaagtgtggtaacttagttaagctataactacatttcccaaaattcccatctcccgccattggcagtgggctgcagagaaaagacttggaaagtagcagaggggaggcagccagtaggctgtgaaggtcagcgagggctgccaggcatggctgctgctcctccagctgctgtcggatagcctttgtcctgtctgagtcctgagccagaaacacacagctctgcagtgaagggcacaggctgcttctgtggctcccctgtatgatcaaggtagaaaacggtgcattccagtttgtccttttgagttcctatttgttctcatgggttccaacttgccctcacagattctagtttgttctctcatttcatgttcagctttgcttcctgactcctggtcttgctggtctactgtgacttcagatccatctccaaatgcagaggcaaccaccttccatgggcgtcctccccagttcctgcaactatgtgaggcccaatccatggaaccccttcacaacattgtacaatagcttcatagtaagtatcacgatttagtaaggcagatccctctatcaccttctctaggagtgccttggctatttggggagctatttttgctcttccataacaattttagaatcagcttattaagatttcccaaaaactgtagaaatttgattggaattcaattgaatctgtagatcagacaagagagtttcacagttttcttagtaataattttgcacattttatttttatctctagcttcctaatcctttttttttacttcagatgatatatattttttaagttatattttataactgttgttcttgtataaaaacagtttttatatattgatcttgtattcaggaatctttcctttttttttttttttttttttttgacacagagtctgacactgttgcccaggctggagtgcagtggtgcgatctcggctcactgcaacctccacttcccaggttcaagtgattctccttgcctcagcctcccaagtagctgggattatgggcacccgccaccaggccctgttaatttttttgtatttttagtagagacggagtttcactttgttgcccgggctggtctcgagctcctgacctcatcatctgcccaactcagcctcccaaagtgttgggattacagatgtgagccacctcacccggcctattcgggtacagatgtgagccacctcacccggcctattcgggtatctttctaaactaattctagtggttagtggtagattattttgggttttctatctggacacatagtatgtgctgataacagtttagtttctaatattagctttctaatatttactttttttcttgttctgttgtgttggctaggatcgtcagtacaatgttatttcatttttacacattctatgaatatggcctccccttcaatcaaatgtctgcactgcgtcgctactcattcttaagtgatgaacttgcttatttcactgagaaaacaagtgtagagagaacttccttagtctaatcaccatacaatctacaaacaaatcttcctttaaacttttgtgtttccctcccaatacaatgaatggattgtgtgtgctctcgccaagatcaacctttcctcttgggcaccttcttaaggagttggctctgcaatcaccctgcctctccttcttgtatcagcattttttttttctattttaaaatgaatcaatcttctcaggttaaaaacacactgtcatagcttaagtcttaagtacacaaaaatgcgtccctcgatctcacatcttctttcagctattccaattctctgctcccctttatagcagaacacctcaaaagaatcatccatacctgctagttttcactctctcacctacaaattactctgttggactactgtaatgaagtactgttgttcccagaattccgctgaaatagcccttgtcaaggacaataacctctacaatgtcaaaggcgatggttgattctcactccttatcttacttaatctctccgaagtgtttgacagtgtgtgtagtataaatacatggggtttgcttactcattaattttttcgaaggggtgaagcatttggctgtgataaaataaaaacttcagccgaattaaatttaaaggagtttaatgactaatgaacgatttgcgaatcgggcagcccccagaatcacagcagattcacggagactcgagcgcagccacgtggtggaagatttatagacaaaaaaagggaggtgaggtacagaaaagctggtttggttgcaggttggcatttgctttatttgaacacagtttgaacactcagcagtatgtgagtggttgaagtatggccgccgggattggccaagactcagtgactgttacaggcgcatactcctaagttaggtttctgatcttgtctgcctattaagctaggttacagttcgtccacaaggactcaaatataggagtcttctcaggccatatttagttcactaaaatagctgtatgatacagataaacctctgtttaaaccaaatttttctgttatttgcaaccaaatgcattcctcactgctttataagtttatagaacctgttttaataatcccaaccaaatcccagcactttgggaggctgaggtgggcagatcatgaggtcaggagatcaagaccatcctggctaacacggtgaaaccccatctctactaaaaatacaaaaaattagccgggcatgatggcatgtgcctgtaatcccagctactcaggaggctgaggcaggagaatcgcttgaacccgggaggtggaggttgcagtgagctgagattgcaccactgcactcaagcttgggcaacaaagtgagactgtctcaaaaaaaaaaaaaaaaaacaaccgaaccaaaaaacatctattataagaagcaacatggtacagtgaggggggaaactgaatttagagtccagatgtacttctcctttgggactagcgtggattttactcccactctcaaacttactacacttcagatcctacagctactacacttcggatccattgtgctaagaaggaagaaaacaatggctgagattgaggtaacagtgcattttctctactaagtcttccctccacctggctgactaaaaatgtagtttggcaattgaaaaaataaaagggagcttcaacttcagcttcccaaaggttggattagatgcactttccttatttttcctattaagtgcaagtaaaaacttaatagaaaacaaacctaagatgtctctgaaaggcggagatgaagggagactggctagggaccttggaacccaagaaacaacatagtggtgagttgtctggattttccttttgccttataaatcccagacttggagctgaagaaactggcaacatgtgaacagcaataatgcagacagaaaaaaaaaaataaagtcccaacaaaagttggctcttcctagctaaaggacaaggaaaaaggcaacctagcaagacagaaaacttttaggaaataacgactctaccctagcccagcaccacaggaaaaaactatggttccacccacacccacaccagcaaaggccaaatgaacacctccacccatggaggctctaatgaggtggccctccctctttctctctgctggagtgatgtcagaaaaagcctgcaaaacagaaggcatagaaagacccagagtctcaaaatatagtacccgaaatgctcaggttcctatcgaaaatcactcttcataccaagaaccagttagatctccaacaaaggaaaaaagacagtggataacaacactgagatgacagagatattagaatcatctgataaagcttctgaagcagtcatataaaagtgcttcaacaatgggctcacgcctgtaatcccagcactttgggaggccgaggcaggtggatcacaaggtcaagagatcgagaccatcctggccaacgtggtgaaaccccgtctctactaaaaatacaaaaattagctgggcatggtggcatgcgcctgtagtcccagctactcgggaggctgaggcaggagaattgcttgaacctgggaggtggaggttgcagtgggccaagattgtgccactgcactccagcctggagacagagtgagactccatctcaaaacaaaacaaaacaaaacaaaaatgctccaacaagcaatcataaacaggcttgaagcaaacgaaaaagtagtctcagcgaataaaaagtctcagtaaataaaaggagaaccaaattttagaaatgaaaaatacaaaaacccaaaattcaaaggatagtctcaacagcagaacagaagacacagacgacagctcagtaaattggaagagagagaagaaaaattatccaattctggccaggcacgctggctcacacctgtaatcccaacactttgggaggctgaggtgggcaggtcacttgaggccaggagttcgaaaccagcctggccaacccggcgaaacccctctctactaaaaatacaaaaattagctgggcatggtggtgcgtccctgtagtccctagagctacttgggaggctgagacataagaactgtttgaacctgggaggtggaggttgcagtgagccaagactgcaccactgcactgcagcactccagcttgggtaacagagtgagactctgtttcaaaaaaaaaaaaagaaaaaaaaatcttagctttggcctgtgggggaaaaaataaattacccaatttctagagataaaatggactgttaaacctgtattactataacaaaaacaacaaaaaaatctaactttcacatcatttgagtctgagagaggagaaatagggtagggtggggccaaaaaagtactggaagaaataatggctgaaaactccttaaatttggcaaaagacataaacctacagattcaagaactgagcaaatcccaaacaggtaaacctgttttgcttaatgtatcttttttttttttttcattttcaatatactgtttccttattttacatgtgctttggttaacatataaatttaaaggatagaataagctgatatacaaggcaaacagtacatcacactcaacagatacatatttttaagcacatgaaaaagttaaaacttttgaccatcaactaggtcagaaagcaagtttcagcaaatttcaagggtctgattattgcagaaaccacaatgtgattacctcagtagtcaataaaaaaaaaagaaaattccatatgtttggaaacatattactaaataactagtacatcaaagaattatgggaaatttgaatgtatttagaactatgatcaaaatactgcatatcaaaaacttgtgggataaagctaaagtagtagtttgtagaaaatttaaaatctcacatgtgtgtattagaggaaaagaggcttgaagccaatgaaaaaactaatgagctaagtaccatcttgagttaggaaaaaaagcagcaaaacagacccaaagaaagcagaagaaaagagctaatgatgacaagagtagaaattaagagaaataaaacaaacataaaagagcaaggatcaataaagacagacttgatcatttgaaaagagatcaaactgacaaacctctgacaatatggatggaaaaaaggaaggcacaaaaataataggaatgaaagaaggaacgtaaatgcagttggtgtagacattaggcatataatcaacaggctatgatcaacttcatattaataaatttggaaattcagatgaaatggaaaaattcctggtaaaatacaactgaatgaaggagaataaaaaacttgaatagttctataatcaaaagcaagactgaatcagtaatttcttttttttttttgagacagcgcctcactttgtcacccaggctggagtgcagtgccgagatcatagctcactgcagttttgaccttttgtgttcgagtgatcctcccacctcagtctccttagtagctaggactagagtcatgtgccaccatgcctgactaatttattttattttttgtagagacggagtcttgctttgttactcagactgatcttgaacccctaacctcaagtgatcctcttgcctcaacctcccaaaatgttgggattacaggtgtgagtcatggtacctggctgaatcagtaatttaaaaataatcttcccacagagaattctaggccccaatagtattactggtgagttctatgaaatattcaaggaatgaaaaattccaattatttcagagtattgaataagggaaaacactactccaacttattatatgggcttgggggaagaatatatgttactttgtataagagccgcaaaaactacaagacagatgtgaatcttaaatctttatgttgacaattacaaaactttactgaagggcataaaagatataaatggagagatataccatgttcataaatacaaaatacaaaaggctttgtatttattggtattactggtattacaaatatgaccattctcctcaaattgatcttataaactcaatgcagttcttttcaaatgaaatcctatgaaggtttttaggaacttcacaagctgatccaaaaattcatgagagtatagggcttcaagatagccaagacaattgtgaataacctgaataatgatggtgctctggtgcttatcctatcagagagtaattcttactgtaaagctatatttaataaagagtggggctagatatggtagtggtaaagagcatacagaaagaactacaaataatatggaaatctgacatatgacagaggtgaataaattttttttttgagctctgtcacccaggttggagtgcagtggtgccatcttagctcattgcaacctccgcctcccaggttcaagcgattcttctgccttagcctcctgagtagccgggattacaggtgcctaccaccacacctggctaatttttgtatttttagtagagacggggtttcccatgttggttaggctggtatcaaacccctggcctcaagtgatccacctgtctcagcctcccaaagtgctgggattacagatgagagccactgtgcatggcaagataaacttttaaataaaggtggtactatgaaaattggataggagtattgaaaattataaaaattgaagtagacaccatgaacgtacaaaaatataatcccaaactgcttaacgactaaaaagtgaaaaaccatattcagaagaaaaaaggttaatatctttatgacattgaggatttcttaatacagcaaaatgcaccaacggtgaagaagatacttacattaatattaaaataaagtttgtttttttattttattttttttggagacagagtcttgctctgccaccaggctggagggcagtggcacgatctcggctcactgcaacctctgcctcctggactcaagcgattctcctgcctcagcctcccaagtagctgtgactacaggcacacaccaccatgctcagctaatttttgtatttttagtagagacggagtttcaccatgttggccaggatggtctccatctcttgacctggtggtccgcctgcctcggcctcccaaagtgttgggatcacaggtgtgagccaccgaccccggccataaagaacttttatatgacaaaaatcacaaagtgaaaatgcaagccaggaacagagagaagatatttgcaacctctataaatgtcaagaggttaataccaagaatacataaagagcacgtcaattcagcaggaaaaagcaccaaacagaaaaatttgcaaaggatatgaataggcagtacagggtggtggaaaccaaatggccaataaatacaggaaaggaccaccaacctaaatagcaatcagagtaacataaattttaaagcatcaaagacacaatttcaaacttatcagattggcaatagtccaaaaacatcaagttattggcaatatggagcaagaggaaatcttacttattgctggtgggagactaacttgttacagacattttgctgaacaatttggaatacctaggttacaatggaaaacatgaacatctcacattccaatagttcccatttctagtgataggtcttagagaagccttcacacactgcagaagaatatttgtgtgctatttttaatagtgaaaggtaggaaaaatgtaactttacctcagtaaggaaaaggctttatctgtaatgttttatttcctttaaaaaaaatctgatgcaaagccaggtgcgatggctcatgcctgtaatcccagcacttcgggaggccgaggtgggtggagcgcctgaggtcaagagtttgagaccagcctggcctacatggtgaaaccccatctccactaaaaataaaaaaattagcccggcatggtggcgagcacctgtaatcctagctacttgggaggctgaggcaggagaatcacttgaacccgggaggtgggggttgcagtgagctgaaatcgcgccattgcactccagccagggcaacaagagtgaaactccatctcaaaaaaaaaaaaaaaaaaaaaaatctgatgcaacgctgggtgaggtggctcacacctgtaatcccagcacttgggaggctgacgcaggaggactgcttgcgcccatgagtttgagaccagcctgggtaatatagtgagaactcgtctttacaaaaaatgttttcaattaccaagcatggtgacacgtgcctgtagtcccagatactgagaaggccaaggtgggaggatcactggagcctggcaggtggaggttaacagggagctgagatggcgccactgcattctagcttgggtgacagagtaagaccctgtctcaacaaacaaacatctgatgcaaataaagcatttgttaaatattattttgtatacttacctattaatctgaaatactatatgaaaaaattttaaatgtgaaacataagcaatattgcctttaacatttacagtaggttaaacatctattcaactgacctctgttcactaaaacattagtaatgctcatcttttttataaataattctctacaacctaacacctagtaagtaaagcttttattgcttctctcctggaaattatcctataaatgggttaaccttgtaatgttgattcaaaagcacaaagggaaaaggcaatagaagtccttttaagatctactttaatctcaatacttttaagttttaaattttgatctcattaaccttatgaatgtcaaccaacagaaaaataaaacacaccaaaagatccagaactctttaaggattgtaaagggacaagcttgaaagcctgacgccaatcctctctttgtccaaaaccaccaccctaacggctccagccccatgaattcctagtttaagaatctctatatcagatgctatcaaaagttagtaatcgtagctaacatttatagagtgcctactaaatgcggaacactgttctaagggctttacatttgttaattcacttttaaatcataaacacactgagatcaggaaagtggtttaactattcttagtttcagttccccgtagtacagtacagtaagatattctgagagaccatattcacataacttttactacagtatggttttaattgtgccacttcattattagtccttgttaatctcttactgtgctcaattgataaactttattataggtgcatgtatggataggaaaaaagacagttcacatagggcttggtactacacttggtttcaggcatcccagggggtcttgaaacatatccccagtaaacaggagggaactacttactttatttccgacttccacataagcaaactgaggcacacagagggcaatttgcctacagttaaacagctagtaagtggtgtagacaagattcaaatctaggcagttcggttgcagagcacacactcttaagcaggaatctttgctagttaattagacaattaatgagaaaaggtatatcaggaaaacaatctaagagttgcaaataagtattttctaaatgaggtcggaagaaaaaaggatagaaccatagtctccaaagcatttctgtctgttttattccttgccaaacattaaaactgtgattctatttcctgctttgaaaatcagttctgttttgcactgctcaatgcctttaagatgaaggtttctttgtaatattaacaatcagtgcactctttctttcaactcctttattaaattggttgcaaaaaagatatacattcttatattgacaattcttgtcatgaataaaagcatcaaaaataaggcaacagcaagatgtgcttcacatataaacaatcatgttgtaagaataagaaacctgaatccctgtacaacaaaaagattaggaagcaaaatgtgaataagcttgtattcagaatatacctatatgtgtgtgcaaagacaatacactcatcatatacctcacttaggttcctttatgatgcataattccttaatcattcatttgtgaaacaagaatgaatattaagaaacatgaaatccaaattgcacttattttcacaatatcaatgctaaactcaaaatagcaacttcattgactctcaatggtaaatttcaaacatggaaagcaatcttaatttttttaaccctttgactagggtctgtaaaaaacggtggattattttactgtacttacaaagaggctgggtctcagcctgcacttaaacagcatgagcaacaaaggacaggaaacaaatatcactaagagtaatgcccatacatataaagatatctagttgagccacgttctacttacatagcaagcctattaaaccactagcataacagatcatatctcatgaaacagaattactaaattaactacacatctctcagaaatttccaaatccctgctcccaacacaattttagtacacctattaagtaccacgggtcatttagaaaaacagaaaaaaatatacacctagtctttgcaattaaaaaaaaatcataacataaacaatgttagatataaattttgaactcaatatgttttttcctacatatttatgtaatcaaggctctttaagcaaagacaggtggtaggtatatgatctgtacaaacttacagtagtgtatattccaaataaaggtttttcttcctactatggtatgacaatataactgttttctgaatgaagatacatgttaaggcttaaggtgtaaacactttggaaggcaaacagcttagtgaaaaaaattatggttcatttaaaaatgtgtatcatttcataatagacccctgaactttcaaatttacatgtgagaatacatttacatcttaactttctaggaaaggcacaggctttatgtaaaaaagcagcaaagttttaaacccaccaatatattgacaaagccattacttttattagaaacaaataatgcttctcaaggtgttggcaacatgtcatagtatcaacatatacttcatacagtgtatttctccctttaattatattccggtaggaggtggaatacctccttggctatgaggggcagatgtatttgatggactgtgtaggctggtctccttgtacacaaaccaagcatttcctccccagagtatcatatttagaaagccaaatatctatgaaagagaaaaagaaatatgaaaatcaaatacctacttataaaaattcatgccctacttaaaaatctcactttttctttaaatatttaacatttttaggaagtacgccattatttcacttaaagtttaatactacacacaatgagaaataaggaagactacacttcaatgtacaaaatgtggttatataatgacttattcccaatgaaataaggctaaatctctaacatataaaatcatggctaagagatttactcttccaaatacttttcacttttctcctatttagaatgattatcaactgcttgtgtaacttttcccatttacttatcaccccctcctaccatctcttctactccaatccaacagttgtagccacaaaaaaagaggagtcacacaactttacttcccatcccaatgagttaacctcaaagaaattaatcttcctggctgggtgtggcagctcatgccagtaatcccagcactttgagaggctgaagcaggcagatcacttgaggtcgggagtttgaccagcctggccaatatggtgaaaccctgtctctactgaagatacaaaagaattagctgggagtggtggcacatgcctgtaatcccagctacctgggaggctgaggtaggagaatcacttgaacccaggaggcggaggttgcagtgtgccgagatcatgccactgcactccagtctgagcgacatagcgaaactccatctcaaaaaaaaaaaaaaaaaaagaaattaatcttcccagatataaatctgactagatgaaagaaagtctcagagatgaataaaatcatgatcttggttacaggtaatactttttttagacaaacttttcttcactaaacactatattgttactagaattcaggtagctgagtaaaaataaaaaccatccagagatttactgaaagctattgctttcctgaattactagtactttaaacaaatatatgaaagaaaaaaattataaataatgcatacataccacagatacatttagggatcccatactggtcacagagccaaagtaacacagtactgctttcttcttacaaggcggaagttcatcaataatattgtgaccagtagctattttaatatctgtcagagctttagcccaggctgaagtgctcaccaaccacaaaaaagtggcaacaagtgtaacaacaaagtcctaaagcaaaaatcagtaagagttaataatgaacagttaattttaatactaaatttcaaatccatgatgaagaaactgagattacattcaaccttatggtgctgagaaatggccttcatgatatactttattaaaaaagtcagtcagcatagtaaacattgctgttagtgttacaagcacagtgcctgagttacaacagtaaataagactcagtcatcccctcagaagtctaagattttcacactagaaaccaaagttttatacagccttcaacataacctcacctcagccacttactcccaggaccataccttagaccttgtcatcaccaataactgtatccttccatactctgttttgatcatcccattttcccataacacctctttccagctcactgtctctggcaccccaatcctaaaactcctttgaccccaccaagacctacaatctgatcctactgctttcttactgtatcaccacttcactaatgtcctcacttattttaatcaatttctgttctaagggccttcattatcatctcttgcacatactctcaactcacttatccttcttctgcaaaactctaactttagttaaaccaaattctccatgagatggataataaaatggtgaaaagcacacaccagaatggtatctcttttaaatttcctaaccacaaattttaagaatgctcactatattaagaaaaaggcaacaacaaaaatctcccaagacaccttatcactattaactctgtactaaatcctttgctatttattacaaagaatgggatggttttaatattttagaataaatggttctaatgggtggttttaatattttagatcataagtctaatcttgtttgatcttccttcaaattaatgaccagggtaggaataatataaaatttgtatcttttggatgctatatatgctaaacatatgcgtacactcaaggataggagctcttacatatctgcagcaaaaatctttctaacctcagaatggattttggagcttatcacagaagcattttgttttttaaataaacccaattagtttttaattattttgccagccaccttttagtcatttattaggttggtgcaaaagttattatggtttttgctatttattttaatgataaaaaccacaattatttttgtaccaacctaatatttaggataaataccagtgatctcttaggagatatagaagctatgctatatagcttgcccacttggtcaagacaacactgaatgaatacttaggattagagaaccaaaaataattactaattacatgaacacggaagtacatgcattttgtatctgagctctctgctgctacttgtccttttaaaaaccgtagctcaaagagaaaaggctagaaatatagcttatattttctgcactgtggaagtactcccccctttttactgctgtacatctgctatacattctgctgcaggtagacattttctaaacgcttgctagaaatacagtgttttttggaaaactgatgagtaacatgaggttatatcgcatgttaaataatttctctttacggaaaagttcacaactttgatcaatatatgtcaaatcctcctaattttcaggtattttcttccttccaaagtctttttttttcgtagttatactcttaaatccactttgatggcttgaggccattcttatatttcaaaagcaggaacttttctgaaaatgatgcacaaagtaacctaggttgaaggaacgtggggggaattctggtcccttcagatagtatttgctctactcaggactctagtcacactgcactctaagcgaatggtgccacctggagctctgcaatgcacaacctgcagctgcctagggcagctctactcctcccaacaattcacaatatgagtcatagatttttagaatttgggataccctaattttgtttggattcattttctggtattctcaattttccacattgccttgaaaccttaaactcctgctacttaacaaaaaaaaaagtgctatatttacttcaaaagagaattgaagtagatttaaattttcataactgaaatactcctagaaacaccttagcacagaattgagaatattgctaaaagggcttgtcctcattaatagtacctaaaaattaatgtcatatttggctatatcttaaattttgggtatctcaaaaaaaacctttttttttttttcccctgagatggagtcttgctctgtcacctaggctggaatacagtggtgtgatcttggctcactgtaacctccacctcctgggttcaagcgattctcctgcctcagcctcccagtagctgggattacaggtgcccaccaccatgtccagctaatttttgtatttttagcagagatggggtttcaccatgttggccaggctggtctcgaactcctgacctcctggagtgatccacccacctcggcctcccaaagtgctgggattacaggcatgacccactgcacccagtctctcaaagaaaatcttttaatatttttatggttacattaaaaatagaactgaaaattaaatttagaagctagacttttatagacaagaagcacccattatgtaacaataaaaacctacttaaggaattttggattatctctttatatgaccactaattggtcattctgaggtggaaaattactttttacgtttctgaatgatgcaactaggtcagttttatagttttatcagacaaaaaccacctacaaaaatagattggaatgctgctttaagaagggtagtatttttaaaagtttactagacaaaatatgagaaataaagggcacactgatagatttagtaaaaaaatttgttgggatgacaaaatggcaagaaatagcttctagttataaagaattttaacaaaatataattatctataagattattccagttcccttttaaataagatttgaaaagtctgcagaagacacagattcctaacaagtatgttggataagcactgcaaattaaaacagttgacgtcttatctttttaacaaccgagaagtattttatgaaaacctctagttttcttgtgtctcctatgacataagaaacagaattaaatatgaatgataaaagactgttgtattacttaccatttccattcttatgatccagcagcaaaattaaaaataaatatgtaaataaaacttgtaatgttatttaataatccttcatatttaaatagccttccctttaaagtaacttcacaaataattagcagatgtgttttctcatacatatgaatgaccagtatcacacataaaaaacacctctgttttccctttaagtcactaataactgactttgtagttactcttttatagtggaggtgtagcttaaaaccatgatttctctctggatttgccaccaataatccagggcagattctactaactaaatctcagagaatatttctagctcagtaggctctgaagccaaaagtataggacttcaaatctaagtcctttgttgatacctcaaagattcaaaattagttcatggttgccactaatgctgagtataagaattacctgggtctgattttaaattaaggagtttagggacatagaccaggaatcaacaaacttcttttgaaaagggccaaatagcaactattttttatctctgttacaactactcaactttaccattgcagtgtgaaagcagccataggcaatgtgtaaatgattgtgtatggctgagttccaaaaaaaacctttatttaaaaaaacaaggccaggctcctggccacacctataacccccagcactttgggaggccaaggcaggcagatcacttgagcccaggagtttgagaccagcctgggcaacatggtaaaacttcgtctttacaaaaatacacaaaaagtaactgagtatggtggcttgtgactgtagtcccagctactcaggaggatcatttgagcccaggaggttgaggctgcagcaagccaagatggtgctactgccctcctgcctgggcgacaaagcgagaccttgtctcaaaaagtaaatatataaataaagaagtaaaaataaaaaataagacagtgacctctgggacatagtttgtgaacccatgatataattaaactcaataagttttgtagaagtataaagtgggcctttagagaaagaaaaaaagtaagaagcagaaagagttatgagactatgttgtgataagtaattcttcaaattaaaagaatttcgacttaatttttttgctatttgtaacctgatgtgctttattacatatctgagttttttccaagttaaaatagatttaaaaaagaaataaactttccttatagtgcaaataggctaaaaaaaattgagttaaacttaatgggagaaagctcaacctcgtggcaaacacaggctaaaatatgctgaactggcttacaccaagaatttttatttccagtataagaaaatctatatttagcttatacaaattatttttgtatttaaaaaataaagtgattacttactatcataggaagtttacgactatccagatacagactcgtgtagccaacataaagcagaagggcagcaatgcagtacaggaacacaaagactgcaaaggtaacatagaattgtgcagaagaagagtaatcgcctatgaggacgtaatctttccaatttacatcacatatgtttacacctggaggtggctgaaatgatgcctcattcaacctattaaaataaatgtatgaattattggactttcccaacagagacagaaacatttaagcaaaacaatgagtgacacttcaaaaaatactccccaaatatattaaaaacattcctttggggaaaaaagtaaaattcaaatattatatttaagtaaactgaaattttcataataaatgtatatgttatacctggtattagtttatgatacattgaatatagactgaattaaatactttcatacccagatactatcttcctgcagtaaacaattaggtaggagagattataccaaatggtttatactttgagacatcatatttcattctgtgtggcagagtatgtgtgactagccccaagagagccaatcacaacaatgattcacatttttaaccctggatcaatagttgctaacaataaatattgcctttcatttttcccaaccataaattgtaaaaaacttgtcactaaagatgctgtaacagtcccttatgtgagaagtgtctaggagaaaggatacaagatagagaggctttgatgattaaccacttattatctgacttatctttaatatggggattttatttaatcatcaaaacagccttacaagataatacttccaattactggaccaaaaaattgagtcttgggtgaagtaagtaaaattagtaagtgaaagaagattcccaccctggcttaaacacaggacatattcaataaacttttcaatggatactgatgtcaaacaagacttcacagatgaaatactcattttactttaagaaagtgtggctttatgctaatgaatgaaatatggaatctctttatatacatatgtcttaaaactatataaagacattaatattcagcaattacaaaaaacactgagaatctggatttttctaagttatgtttccttctacattagggcttcttatactaaggtgatagaacaatctctagtttgctttatttttacatttccaatcctctgttagaataaaattatcaaggcaacatcacattgttataaaagtttctaaatgcttactctcactttctgtactattttgtcacagatcaggagatgtttttagacaggcatgggtctgtgtaccacagtttgggaggtaatgatcacttacaaatgagcatacagtctaaaattttctaccccccacaatcaataaattgctggaaatcttaatgactcactgtgaaagtaaaaagagttgtgaaaccattaaaataaatataactcacctgaatggataaccaaaagtagctgtaacagttttattctcagtaactgcaggaggacaattcacttgaatttctgtttggcccttaaaacctccacaggtggcaaaagcaaagatagaagcaatctacacaaagtaagatgaaaaaagacaaaagaaaaaaaagataagcaatactacaaccaaaacaagggtcactaaaactgtaagcacactgattattaaaaattggctaacattctagaaattctttttttgagacagggtttctgtcgcccagactggagtacactggcacgatcagggctcactgcagccttggcctcccaggctcaagtgatcctcccacctcagtcccccaagcagctggatcacaggtgtgcatcaccacacctggctaatttttctttgaattttagtagagatgaggcctcgctatgttgctcagattgggcttgaactcctgaactcaagcaatcctcccatcttggcctcccaaaatgctgggattacaggtgtgagtcactgtgcccagcccccactacccttttttaaagagatgagtctcactctgttgtatagactcaagtgtagtggcacaatcatagcttactgcagccctgaactctcaagtgatcctcccaagtagctgggactaaggagtgtgccaccatgcctggctacattctagaaattcttaaacacaaactaagatggtgaaagacattaaaacattcatttgcaaacctcgacaaatgtgattttattttccccggagtataatatagaaataaatgtaccagcccatatgacaattcatttgctcatactttagtgtatccactaagtattagtatgaaatatagagggagactcatttattagtataaaatcaaaaggggtgaattggaggtatttttatttggaacacaagttaccagtaatttgtaaagccaagaggttgtcagcagagaagagacactatttcatgagcctgttaaacctcccttgtgggtatttccaggtctcaaaaagttgttggaaacttattttcctaatcatgtatatgcttaaaaaaatgaatggtgttctctcaaataccatctaaaacacaaaaaacctagaagcaacctaaatgttgacagggaatcaaactataattcatccattcattcattcatgcaatgaaacattatatagctgttggaaattaacaacatagaatgttggagattaacaacatagaaagtgttcattacatacaaagtagatttaaacaacaaaaactagaaaggttatgcatcaaaattttaacactggtcacctctcaaaggaagataaataattcctttttatttttgtacttgtgaattttctacaaaacaacacaagtaagcaaaaaattccagatgcgctgttaaagtccaggagctcaatctttcagcaagtggtgatggctctattttcaaaatacatttgcaatctgaccacttgtactgcctcctgatctgaactaccatcaccttttgcctgaattttgcactaacagccttctaaatgatctctctgcttctgcccttgccccagcttcagtctgttatcaacacaacagccaagacaatcttttaaaaatgtaaggcagaaaatgttatcctttgctcaaaaccctccaatggcttttgagctctctatgaataaaaaccaaagttcatataaaggcctgcaagatcctttcttcccttatatttctgacctcatgttgctactttttcctttacctaatctgtatacacaaactgctttccatgcgatacctttaatgacacgggataaactcttccttcaggacctttgcactggctatttcctctgcctggaatacatgcttcactccctcacttccatagcttcctgttccagtatgaccttctcagagagaccttcccctcaccacactatatcaaataacagcactcctaccccgcactacctattccctctactctatttctgctctgttctaattaccactgcttgacacagtacttaatttgtctgtctttccctagaatagaaacttgaagaggtcaggggcttcgttttgttcaaggtcacacacactcagcaactggtagtagataatattcaatgcagatttgatatcaaatattcactgtggaacacttgacataatgcttcccatggattattccagggccttgaatcttgtaggccataatccacattatagtaattgtcaagggtttgttttttcccatccgcccccccccccccccccccccccccccccacaaaaaagatacatgaaaagaatctggttacagataggaagagtctgaggtaatgtccagcacatagtttggggtcttaactgttaagaggtgatccccagtttttacaggatttcaaaatatgtaaaagtaactttccttggaaaatgtgtcatgaaatcatttttcattatttgtactaaataatgttttatgttaaaaaagaaggtaaagatggaagaatcaatactctctcagaataaatatgcatgaatacacagagtgaaaaggccagaaaatgagtcctgagcatatacccacgtttaaattaaaaaaaaaaaaaaagaaaagaaatgagatacacaaattgaaccaatggagcagaataaaaaggccaggaatagactagtgtgtataagacaaattgtatctaacagagttgatttgtagatcacggaggaaaggaatgtggtggttttaaagatatgcccacaaactctttgatacaactcccatcaagagatggagcctgatttcccttcccttgagtgtcaactaaatgtagtgacttgcttctacagaatagaatatggtactgtagaagaaatgggatgtcttttctgagactcagttataaaaagattacaacttttttttttttttgagacacagtctcgctctgtcacccaggctggagtgcaatggtgcaatcttggctcactgcaacctccacctcccagattcaaggaattctccttcctcagcctcctgagtagcaggggtaattacaggtgcctgccaccatgcccggctaatttttgtattttcggtagagacggggtttcaccatgttggtaaggccagtctcgagctcctgacctccggtgatccacccgccttggcctcccaaagtgctgggattacaggcttgaaccacaacgcccggccaaagattgcaacttctgtcttcctttctcactctctcgaactttctcattctccgggggaagccagtggccatgttgggaggatactcaggcaacttttataaactcacatggtgtggaattgaggactgccagtaaccacatgactgagcttggaaggggatcctctgaggtttgtcaacagtcatgagaataagctggaggccttgagataacagcaaccccagccaacagcttgactgcaaccttatgggagaccctatgcccaaaccacatagctaagctgctcccagattcctgacccacagaagaatgggtgaggtttattatctcacttaataaaagtcaacagacctttgttttaaactgctaagctcggcgtaatttgttatacagcaatagataactaatacaaggaagagctgttcagtaaatggtccagatgagctgcacacaaaagtaaaaagtctttaaaaaatgtgaagacaatataaaagaaaacctgtgaccacatgaaaagggagaatttaagatttttttttgtaaaaaagaaccataaaagattgttaaattcaactacagaaaaaaaatcttaatcaagtcagctgttgaatgtaaaacaagctaccaattagatgaacatatttataataaacataatgtcacaaaggatttactagtatatagatctaagagaaacccttgctcacacgtactaagagacatataagaatgttcatgaaaaatggggaggggaaaagcaacagggaaatggataaaataccatagtatattcttacactgggaagttatacggcaaaaaagatataagaattacaactgcctacatcaacatagatgaatcatagaaatccaatgctgagttaaaacaaaaacaaaataaaaaccatgttgcatatgactacctagactataaaaccattttttaaaaagctctgtttacctgcctacattacacctgccactatttttgttcaggccctcaccatttttcattgggactaacccagcagactctttctcacatttccaatttcattccaattgatactcatcttctataatgtgggcactatagctgcagtacccagtaatgctacttgtgagtcttgaacactttacatgtcactaatctaaattgatatatactccaactgcaaaatacacactagattttgaagatttactatgaaaaagatgtgaaatacttcattaatttttatattgacgacttgttcaaacaataatctggatagattgggttaagtaaaatatattgttaaaattaatttcacctgtttcctcttattttagtgtggttaatagaacactgaaaattactatgtggtttgcatttttgcttcccattgtatttttttgtactggacagagctagtttagaatgatgccaaactgatctgaaataaaaatctgatcatgtccttcccatttaaaggaatttcctcaattgtttttcaacctaaattaaacaaaaaatgctccaacttcttaatttggcataaaaggcatggctgatcgatcctcaactttatctttctagatagatttatctgcagtctattcactgccaggtactgtatgattctgtcacattatactgcttactgttcctgaaacataccatgtatttatgtcttaaatgtatatgcttcttcttctgggaatgccctgtctctgattagctcatcttttaaggccctacccaattccctgtggtagaactcatgattcttctcttgagctatcatagacattaactctattatatatgaactctactataggcatttttcttgtgtaacttgctttctaaaaaataaaatggggccgggtgcagtggcttatgcctgtaattccaacactttgggaggccgtggcaggaggattgtttgagcccagaagttcaataccagcttgggcaacacagtgagaccctgtcttaaaaataaaataaaataaaaaaattaaatggaaaaatgaatttcctaatataacaagtagcaaataaatggcatactgcactacagcttgttgctttcaagactatcacttctactgctcctttgccagactgtcatgtctttgcacctggttttgtttaggattttcagtgactagcagaaaacctggcacatagcagatgctcactaaataactacttaattaaggaaaaaataatttccaataacttataaataaaaccatattttgaatcttacataattattattttaaagctttttgttataaggatagataaatatcatgacagcaattctggtctttatcttatagaaagaagggacaaaagcacatattttatattaaacaaagtacaaaattatgagggcaaaatatccaactatctcacttctccctatattctactgctattttgatctagactggaagttatatactggcagcctgttggtaaaacccggcctgcaaatatatttgtgtggcctttccagtattacaaaaaaatgtgaatttgttgtcattgttttaatatcagggtattacacataaaaatttggatttcctgcttttcctgagtgtgtatgggaaagctgaagaatggcaacatcagacctacattctcataaagcaacaatcagagagaactgagtgacagatgtcacttatggcagagtatgtgctttccaggttatccgcttctccattgtcttaacagccctcaggatgtgtgttagttgccagtaagtaatcaatgacatactattctttttcttccaaacatcttgcttcactcatttactttagagggtggttcctatgaccatttcagtttccaaccctagtctaaaatgaaggagtactggtgttctgatttatattttctggccacttttgaaacttattttcccatatactcctaccccatgaagaatgactgaaactactgacatggaattctatctgcacagtgactagtaagaatccaggggcggggtgacagcaagcttctgtttagtcagaaaagttacatgttcacatacagccccaagtatccagagaaacagtcccacttacttctctgcccaccagacccatactagatgaccaccatggcagatcttattcagagaattgtaacctcagggtgaatagtacagcctggttttccagagcactagtctccaaagtagactggagtaccagaagaaaatatgtaaacttctatttagatctactttcagacttaaataaggaattgaagctttattgcaattaatataccactgaaacccatgctgggcatgcacatcagaaggtcacatgtcagtacagcatgctgggtatcctgaaggtaaggggaatctcatacatggaaggacagacagtgataacctcatctattctttcacttttagtgttcatgcattacaatgtgagtgggcctggatttatggaataatttgtctagttttaaccaaatcaaccttcacaaaattgacccatggctttaaaatgtcttcaaagaaatagattggtaacacacacactcatgtataaaagagaaaatggaagcattcatactactctatgattacaatcaacagccatattacaaggtaaaaacagactacttaatcagatcacaagacggtggcacaacaataaaaaattatcagaatagtatctgaagcaaggatttaaaaatataaacaaaatttgcactgagtatataatataccttaagatactaactgacatagtaaaacatgcatcttaagttgtagatgcatattgtggctctgtccataaaattttgcactaataggagtgcaaaaaagactctggaggctgggcacagtggctcatgcctgtaatcccagcactttgggaggctgagccgggtggatcacctgaggtcaggtgttcgaaaccagcctggccaacatggtgaaaccccatctctactaaaaatatcaaaaaaaattagctgggtgtggtggtgggcacctgtaatcccagctacttgggaggctgaggcaggagaattgcttgaacctgggaggcggaagttgcagtgagccgagatcatgccactgcactccagcctgggcgacagagtaagactctgtctcaaaaaaaaaaaagactctggaggctgggtgcagtggttcatctcagcattttgggaggccaaggcaggtgatcgtttgagcccaggggttcgagactggcctgggtgacatggtgggactctgtctctataaaaaattatagaagtagctgggggtggtggtgtgtacctgcagtcccagctacccagtagactgaagtgagagaaaagcttgagcctggggaagtcaaggctgcaattagttgtgatcgtgccactgcactccagcctgggtgacaagagtgagaccctgtctcaaaaaataaataaataaaatttaaaaagagtttggagccttaacttctattgctagaccatgctaattctgaggattctactggagaatactagtattcacctggtttatgagtgttgtttacacgtttctagttgcaggatcttcattgctatttaatttcatcattaatctgaaatcatctatttaaatttctttctgtccaaggtttagtttatcaaagtgataactgaaatcttcaaaaatagatataaaagtatattatgtatgagtgtttacatgcaaaagaaatgtatgctggttttaagtcaaatgatcattcagcacttaaaatgaaatattatagcacgtttgcctttacaatcaaaagattagatgcctagagccaaggtatgatttttatgagtcaaagtccaaaatgtttactaaagttattcatttcaaaaaagtattgtttttgatggtggtatttcagtttattcccactgggaaataaagtcagttacaaagtgcttcagtttcactctatctccctttgcttctaatgtacaatagtagaaaattctaaatagcctgccaagataattccataatccttaaaaatttggattatggccggctgcagtggctcacgcctgtaatcccagcactttgggaggccagggcggacggactacctgaggtcaggagtttgagaccagcctggtgaaaccaggtgaaaccccgtctctactaaaaatacaaaaattagccgggcaaggtggcacacgcctgtagtcccagctacttgggagggtgaggcaggagaatcacttgaacctgggagatggaggttgcagtgagctgagatcatgccactgcactccagcctgggtgacagagcaagactccgtctccaaaaaaaaaaaaaaaaaaaattggattatgagaagtaaactctagagttcctactgaaataaacagctagaagttttttgctaactcctaatcattgtatgttgaaaacacatttatgtcaccttaaatctctgaggaacctaaatatatttatttaaaaatcatttatcagccaggcgcggtggctcatgcctataatcccagcacttggggaggccgaggcgggtggatcacttgaggtcaggagttagagtccaggctggccagcatggtgaaaccccgtctctactaaaaatacaaaacttagctggatgtagtggcgagcgcctgtaatcccagctactcgggagactaaggcagaagaatctctggaacctggaaggcgaggttgcattgagccgagaccacactactgcactccagcctggacaagacagagactatatttttaaaaatttaaaatataatttatatttttaaaaatagaaatcattttctaattgctctactattttcatgtcttctggagtgaatcaatatcctgattgttgatctggctggctgtcttgaagtaagcctgtcactctgtggaaaactgacagcatttgttgccactgacataatttgaatttttaagtaaaaattagttttcttcatgtgttttaggatatttgatataggctcaacttgattgtcccctcctgcttctatccctgtctagcggctttatggtcatggtcatttctgcttggccttctgagtcccctggtccacaaacacaccttatgatgggacccccaaaccaccaacataagtgaacatacacgttatcacaaatccagaccttaagcctgcaagtagattggtccaggtcttgagaggctatatatatctctttatttctacacttttaagtactcagctctatttaagtcgtaaatccagatagttggttgagctttcttcagatttattaataattaccaaatttgggaatagtctttctccctgccgtattttctgttctgtttctggtccccagtggtgtttacctcatcaattctcaatgcgtggtctgtggacccctgaaagctcccaaggctctttcaggagttcatgaaggtaaaacattttcctaacgatactaagacattatttgccttttacactgtgctgacatttgtactgatgaagcagataaactggtggggaaaactgccgggtttaataagaatcaggaagaataccaaactctatttcactgccacatacttgcagttaaaaacaaaaaaccaaaaacaaaaaagaacaaaaaacccccaccagttttacttaagaatgtctgatgaagcagtaaaaattttattaaaccttgacccttgagttctcttgtcagtaggataaaatgggaaatgcaaataaagacttttgttgcataccaaatacaatggttgtctccagagaatgcatttaagcaactgagttgtaagctgaactagtggcttttttttgtaaccaccaaatttctcccatcttcacagtcaaacagcggtttatgctgtcttcactttcttaccacacattcattcagcctactaaaatctggctttttgattttactgaaactgctcttgctaactagtccttattttatcaactagtccttattttactttaccattctattgcaccttacgttttggggtactcttttcttgaaattctaatagtgatgccaaggcattatttccctcaattttcctaaccattccttctctcctttgcaggcagatatctgctatatctgcagcccaaactcatattttaaattctagatccatatatatagctgtatcctataggatacctccaaaagatctaaagagaccacaaactcaatacatctgaaacctttgacttcccataaaatctgctcctcctcctcttaatgacattaccttgaatatgctaatggcaacgaagtcagaaagacagcagtcatcttagggtcctccctctttgttaccttccatatatattctaatttgtaacccccttttgtaaaccccttcagtcctactgaaactaattttaggccctcataattcctcaatcaacagatttcccttcctccaattctagcctttccaattcatccttttagaaattttcattttgtcggcagttagagggatggattggaaaggtcagaattggagggagaaatcgattgattgaggaattatgagtgcctaaaattagtcgtatcattgacttgtttaaagcctttaagttcccatcccctatggcagggattctgggcttgaatggaataaacactccaatattccataccctgcacatatgcattttcctaaggaaagggcccagattcccaaagattaaccccagaagcagccgacctctgaaatcttttcagaacaatctcaaaccgtaccctccaacctagcatatattccaactaacccccaattacttttaagttctcatacagggttatgctgcttcaacatttccttccactgaacataagattccttctgcctagaaagccactccccaagtgaaccagtacccatccttcaagtgttctctcagctatgaagtcctccctagttcctccaagcaaatgctctctccctcatttcttctactattctttgcatacacctttatcacagtttattacatggcatttttgtattttgtatgtccttcatccttaatagatcatgagaaaaagaccatgttttattcatgtggtatgctagtgtttagtacagatctggtataaaatagtcaaatatttaccacaccattaacaatgtgtagtcttttcataaaaggctctcctgtgtaataacaagctgttcaaactgaaagtatttctgtaagatgcttaaaaagggatatttttcaaaatacatcaaaacacgaatgaacttatcactagtgcttgaaatattaaggaaaaagctaagtctacagttgtttaaaaacttgacaaaaaatataagcacagatataaacaactgcctcttcatttaagtggaaatctaaattattagttatacatttaattataatcctcaatgagactaaatctagatataagactttcttaacgttcatatttgattagcctcgttaatgagattttcctcttgcaatttttaaatgctttaatcatggttttctttatacttaaatctggacttaggtttaaaaaaatcaagtatatttatttatgcgtctttcaagtagtcatttgtgtgaagtcagcactacttcagttttcagaaaacacacaaaatgttcagtgaatggtgaaattgcctaaccccttgcgcggttacaatggtccaagtaggaaatcacattaggtacccatcagagaaactgagtttctacgctgcttttaaaaacatcctcggtaggttatttagaacaggaaattgaaagttcttattcttcttcaccactctatcactaaggaaaagggcgaaaaagctatggatgtaaatgctgctgtctataaacacaacttgcctgcagaaatatgtagtgggccgcgaagtttgaaggaagcccgcagtgcctggtatattcaccaactcctccaagtaactgatcattgccaaggtcgaattaataagcgttctttgatgttaatgattgtgagtgttctcaggaaaggactaaaagctgactttctaaacaggatgttgtttggaaataccccaaacaaactcgatgtccattcctaacgtgttattaagtgaaccgatctgactcgatgcgttttgttaaaaggactttctttagtttccctggcccacagtttatttttttactatttttaactcggagcccatcttaaaaacaaattaagaacggaatgctcgccaaatcacgtctacaagacaaaatcggcttcccagggagctagacctcgagtgggcaccggcagggacgtaaccgctgagcctctccgcagagcgcgacgccggccgccgggtttcggttagaccgcagcaggaagttttcccttcctctgcgggaggcagtggagccaaggggaaatttgaactcccactccacggggacacccagaggggagctccggtgtgggagggtggctcccctgggagccaggcggccgaggagctcgtgattcgacgcccgccgcggcgtctccgccccgcgcggcccaggccgcggcctccctgccctccctgccgtccactcccagtcccggggcggcggcctcaaagcccgcgcggcagggctgcgtcccggctcgcaggtccccgtctccccgcctagggcgccgcgccgagcggcaggcgggcctggccggcgcgggctgcactcacccactcgaggaccttgatgaagccgagtggctccttgagcgggttgaggttgatctggaagccggacatcctctgaggaaaggagggagagagagtcaggacgacggggcggaggaggggaccgacgagaccagagcagcccggtggcgaggaagggcaggcggggctggcgcgctggccgggctcggaggcgggcccgggcggccgtggggcggggcggggcggagcggcggcggttgagctgctggctgagactctggggcggaaacggagtggggcggctggggaggcgaggggcgggccggggcggagaccgggaggcttctcctcaggccgcacctggccgagtcgactgatccgctggcgaaccaagtagatgttgggcgccatactgcgtgcgccgcgcccccttccctgcggttcagcccctggcactcggtcttcccctgcgcacgcgtgtacgcgtgcgctcgttgggcccgcgccgcgcttccggacccgcgcgactgcgaagagccctgacccgggggcgcccacgcccgctcctgcgcagcttgggggcgctggcctcagagacaccctcacttgaccccgagctcaccacagctgagctcactacaccgaagctgacctctccttcccttaacagatctcaacttttttatgaatttataatgtattggcacagatgaagttgtgtttcaaggcatgtgttaggggcctttgattaaaattgcaaaacaacagacttctggctaccgtgctgtggggtgcctcgaaagtgtgaatcaccaaatattcgtatggaaattaggtttattttcaaagttaccatcgcagccatggttgaaaaatgaagtaagtttatacctaaaaggaaaggcgtggccggacaggccctcggtgacctacactttcacctcttctacgctgtcggtcgacagtcctctttttaaggcatcgttggtatctttcttcaagaagctgacccctttaagattcggcttaggtgatactttcctcttggcacgcagttacgggagccccaaggtagtgtgatctccttcctggcttcttcagtacctggaaagttcctggacagctggaatgtggtcatattcgtgtatatgaaaaaccagcttccaaggacttacctgaatttcaagcacgaatatgatttgcaggctacttgccactgaggttattccgtcagggttgacaactgttattgaacgtccttgtagtaagcgaaccctttctctttcgagacctatctccttgtttgctgtccagagagtgcaaaaaatacatttcattttctatgcagacagagacaatctttatgtttatcttggctcccgttcctcagtccccagcacagtcagtgctcaatgagcacctaatggcatatctcattttgaaataacattaagaactgggcgcggtggctcacgcctgtaatcccagcactttgggaggccgaggccggcggatcgtgaggtcaggagttcaagaccaacctggctaacatggtgaaaccccgtctcttataaagataccaaaaaaattagcctgacgtggtagcacgcgcctgtcatcccagctactcaggaggctgaggcaggagaatcgcttgaaccgggaggtgggggggttgcagcgggttcctaatggatggttgcagatttctcccactaagcaacaaagcatcatagataccccttagggctaggtgagtggaaggtgaccatacactgctacctggtgcgtctgagaccacgatgagcggtgctccaggtcttccagcttcctctctctccttttttttctactttgtttctgtatcttcctctcagtacttctctttttgttctctttagcccgtttttctaagcttttactctcattctgttgcggtcttctgggtaggcacctggggacggagtagtgaatagtaagactatttagcttgagcttcatattcacgaatattcaaattagactcttaatgttattattattattttttttttttgagacagagtcttgccccgtcacccaggctggagtgcaatggcgtgatctcagctcactgcaacctctgcacccccgggttcaagcgattctcctgcctcagcctcccgagtagctgggattacaggcacgtaccaccacgtccggctaatttttttgtatctttattagagacggggtttcaccatgttggccaggttggtcttgaactcctgacctcatgatccgccacctcggcctcccaaagtgctgggattacaggcgtgagccaccgcgcccagctcttaatgttatttcaaaatgagatatgccttgacagattagagatatgttcacatgcagctttattaattaaagatctaaaacataccatgacttagtaaaccaatattggcatctcttcttctttttgtttattgaaggccttagaaattggaattggccaggccctttctcaacttccgcgctaaactttctgttgcttctgtctgcctctcctcactttctctcctgcttcttgttcaagcccaccagtggaaggcatggtggttacatttcctcaggaaaccttcagtgctagagtaactccttgaactttaagaaggttccttccttggccctgtggcactcgattttaaagatggagaccaccgagggtgagcagaaccacatctggtcacttatcagaactcattcgcagaatctctcttgagcagaaggaaacagaagtgagccgccactgctcaccttcagtcacagcctagcactgcttctgccagtcagctgagctcaggggcctaccttcctgagaaggaactggccgtgactggcagagccagtgagatctgattgggcaacaagataattgtgatttttttttaaatcctcctcaaacaaaagtgtttaaacaatagcatctcattgaaggcacaactgttcaaaatcagggaagaatgttcagatgactgtatcacattgactacaacactggtcattttctgatttgttcctcaaatctgaggaaagagccagatgctctgggaacaacatgttccaggtctactctaccagggctatttggaaaagaatccctgtaatataaaatggttctgtctatctgaggtagtattattgagctttatctgtggtggtataattatggctaagttacctacataatttgtcattgttttactttctctctgtggctttgaacacatgtgccagactgtgacacttgggatttaggaatgctcagaaggccagaaaggaaactatatttagtcaaccatatattaactatattagacatctcattggctaactataatattttttgtttttctcaatgggaatacaaagttttggtcatcttattggcaagatgagactttgtaactcattcccaaccaatatttatctccttttctgaaaagatattgtttaataccaaattcaaaacctgacttttgcttataaacacaaataggtgttttgttttcgctaatgaattcaataatcattttagaaaaattttaagataaccaaatttatttaaattgtacaatagatggatttaataggctcagtaaattaatctcaaagtaatctgaggcctcttaaacttttcattttaaaacatattttgatttatgaattgcaaagtacaaagagttctgtatacacttcacccagtttcccctaatgttaacatcttctataaccatcatacatttgtcaaaacaaaaaaaattagtattgatgtgttactactgactaaactaaagaatttttcaaacttcatcagttgtccactaatgtcttttttactcccccaggatccaatccaggaaaccacatttaatgtaatgagtgtcacaggtgatcagaaactatctggggccagtggtacaggcagtaagaagaatttaccaagacagtcgtaggtaaagaaaggcagatttatttgagaacgtaggaaaatgtattgcaagggtgcaacaggcaggtcagcgaaagaggagctgactgcaaagagtcaaaagcttgctagggattttataggatggtgcttgtgctctgcgcttgaagaagactttgtgcagtattggtaatgccgaggttgcagtgagctaacttgcatttttctgtcagccaagagtcaggtggtagctcggcacaggaagattgtgagtgatttacacatgagggctatgtgtcctggaccatgaagaaaggcagacttatagcttatctatctgctttctcgttttgctttcccctggtcctgccagcctgactccttctcctgaattaggactctacctttcttcacaccctgacagcaacaatgactaatctttggcatgtggttaaaggtctcatcttccaactgcttcttgctgaccaggggtgtatagttggccctacctaggattgttagtcggtcaggaggttatgtacacctaaatccctgagttgggacttaaattggtcagggttgctatgagactatgggagaacagcatttgtagcctaaaattttgttctgctgcattcaaaggaaagttatgtagctgatacctttgctgtagtactgttttggtttgaaattgttgtatcctagaaaacacaaaatcagatgtagaattaacaatacagtatgcaaataaacaaactaatatgagctttattataggcagaagaagttgagcaacccatggccaaatttaactggagaagctttgaaatagttgtgctgaaaaggaatcttgaggaactctgttttgaaggccctttaatatttttatgttgtctgttatcttttctaaactttcttctacctgacctgagttactgatgtaaaagcaacaagttttatttaacagcatgcaggtgcctcctgcttcagcaggaagcacctcctaagtgagttggttctgcaaaacataccctgccagcgagttcagggcctgccattggccttcaatggccgtgattgtagcttcccaagattgctggactaggatggtgagattatgaatactgcacttaagcatgggtatatctgcaaaccaaaagattgcactggctacagaatgtcctaggtcatttttctctatgacaggattattattggcgaggatgctaaatgatgggagactaagtactgcttctgatgtcctttggagggaccaacataagaaggattttaaatttggagcttggctagaggttacgaagtctgaggagttatatatgtgcactccagatattgctgcaactgtagtgtaagtgcctcttcacttaatagacaaggctagaaatatgttagatctgtataaaaagaagaacccagttccttttaatgaaactcctgaagaggaacctcacaaccaggcataggtgtgattagtttagattcccgtatggtttgcataaatagagggatcccatggtcccctgggattaaatgtggatgggcagtgacccaaaaagtagttatccacgcataagggggtaaaagtttgacttgtagtgttatgtgaatgtggggcctgacagatatgatttttgaatattaatgggataagagaaaattgaggaaaagatgtagatgtattagtgaagttgagaagtcgtccagttttgactgctatttctatatgttccatcctggctgctgaactatttataggcataaaggaattgttataaatctttctggcatgaactttgttgtttcctcaccatagagaaaaactgtggaggtacacagtgaacttgttaagagtcattgcatggcttccattctggtttgtttgatcatagctgacagtgtaattgcaatggacttgtgtgttaaagcccctgggaaagggccagactccttggaatttctagcattataagccatctctggtgccctccctatttgctcggtcaccgtgggtgattggcatgagggatcgattggcctaggtttacctcataaacctgtatttttggtgtgcgtgtacctggcgtagttgaatccagagtatttggcttgtgtgttagcaatttcttctatagatagtggaactgctaggagtgtaatgtcattctcgagtgactgcccacgtgagcatatccagcggttagtgctgtgtgttgtgttagcaacctgagatattactggttatagtgggtgcttggtgtagccatggaagcaatagttagccatgacagacagaataaacacagaagaatatttaaggaaaatgacaatatacagtaaacttagggagacaggaaagaagaaaggctgtaaagagtatgaaaaaaaccaaacaattagtacctcagcatatcaatgttgtggcatgggggtaaataacattgctaggacaaagataaagaaatttcccctgggctgtagttttggaggtcggcctgcaaatagcaattgtgtactatctcccttataaaagcattaatatcaacagggtgaagctgctcaagagaggcagttggatagttactgagaacttgcagtagaattgaataaaaagagtcagctttaagaataacgtttaagggccagtcacggtgactcactttgggagtcccagcactttgggaggccaaagtgggcagatcacctgaggtcaggagtttgaaaccagcctggtcaaaacggtgaaaccccttctctcttttttttttttattattatactttaagttctagggtacatgtgcacaatgtgcaggtttgttacatatgtatacatgtgccatgatggtgtgctgcacccattaactcgtcatttacattaggtgtatctcctaatgctatccctccccactccccctacctcatgacaggccccggtgtgtgatgttccccttcctgtgtccaagtgttctcattgttcaattcccacctatgagtgagaacatgaggtgtttggttttctatccttgtgatagtttgctgagaatgatgaggtgaaaccccttctctactaaaaaaactacaaaaattagctgggcgtggtgacacgcacctgtagtcccagctacttgggaggctgaggcaggaaaatcacctgaacctgggaggtggaggttgcagtgagccaagatcaggccactgcactccagcctgggcgacagagtgagtctctgtctcaaaaaaaaaaaaaaaaaaaaaaaaaagaataaggtttaaaggaggtgctggatttatttccattaactttaagggagatttaaaaattctaggttgtttggtttaacaaaacctcttttaccttttttaaaaatttaaatgagtttccaatgtttaccttctagttagaacgtaaataatgagtatcatctcagcactagcagctgagtaacagcagatttaaagcaggcagaaaaaaagagaggaagatagagagctttagaagactctacttaactctatagtgcaggttaaccatttgagctatgaatttttttgttgtagtttttccatcagtttaaaatgtgcacaaaattataatagtgaaagagatccgatctagcccacctgcccctcttgcctttagcttgtaagctgccttaatcattccagggcttttgggctgagttaattttagaagacatctgggttatagtttaatgataatagcccttcccccaaactcaaacacctttttaaagctaatgagtggccatcaggctagggggtggagaggagcctgatttctgctaaggcgtagccagccattcctgtagataacaccactattgtaggttggctttttgaggtatcttttcaggttttttgaatgtctgacacccatggctctacctgtacccaccaatcccactcctgtgacctcacccaaaagcgattcagtgtgcaggaggacagcttccactccctatgatttcatctctaccccaaacaatcagcagcaaccccagccacccccacccctctcctaaactgcctttgaaaaacccctaaactacgatctttggacgaggcacgtggcatggctggcctcatgtctattaaactttttctgtactgtaatgctgtactctttctttgtacagcaggcaggaaaaactcctcgggtggttacacaaccaacccaaaactcaggactcaaacccctgtatggctgttgttctactggatgggcctggggctcagatgttcctctcatacaaggaatgaacctctggtttggctactcctgtattccctcactgggaacacacagtcaggtgcgtctgtcccacagggccattctaagggtatgttcaagttattcctctcaggggcatttaccctacactttgacaagaggtttaaccttcctaagtttccattttctcattcccattttgcagacaggaaatgagagttgtagtgggatttaaattttataatcataagagatcatttagaagagtgcctggtacagactaagaactgaggaaatgttacccgttcttgccactgtgttccagaaacagtggagtgggtgcatcagtcttctgattgggtgggtaggaagcagctaagacttagtgctagaacaaaagtcatttaaggaaatcagactttggttagagcgaattagagttgtaaggaagaatgttccattgataaaatgaaagaaatatgaaatgagaatataattcttgaaagcaaataaaatgcagtttttcattactgaaaactatgtggggcagaggtcatgctaatcctccctgtgtgggtctacttttagtctatttgtgtcatcaccatttcaagcttagctcacatttaagcagtgaatagacagggaaagtcctctaatttgtagcagttaattttatttttatttttatatttttgagactgagtctcactctgtcacccaggctggagtgcagtggcccaatcttggctcactacaacctccgcctcctgggttcaagcgattctcgtgcctcagcctcaaaagtagctgggattacaggcatgcgccactgcacccaactaacttttgtatttttagtagagatggggtttcaccatgttgaccaggctagtctcaaactcctggcctcaagtgatccacctgcctcatcctcccaaagtgctgggattaccggcatgagccactgtgctggccgaggttatttttataataatcattacaagtactgtaattaagtttctaaaaaaaggcttattgtgtaataactattttataataacataacttggcctttgaatagtgctttgcctttttcagagaactttcagggtcatttttttatgtgatctttgagttacagtatggtgtaggaattataatccacattttgctaatgcagaaactgaagttcagagggaagaaagtgtatcagaaaaggcttcctaggggaagtgacacagcactgtagcttgagagatgtgtaggtgattcctcaagtagatgggggctggggagttttcagcagaggtgctgcagagggtagggcatagtgatagaggagggggagttctatagtgggaccaaatactttgatatatctgatgctttgggttaggggagcagtgtagagtcagggctttgtatatcaggctaggagtttggactatattctctgctagggaggtgcttttaggcaaaggagagtaatatgatcagatttcagtttaggaagatcactatgtcagtagtgtagaagctgaacaggcaaggtgtttaggtggtaggttcaagctagctgatattttctaaacctattggtcatgaggtctcagttcccgggtatggtgacaatgagcaagtgtagacagccaggttggcactagcagcataaactgcttgtgaaaaaagcacagcatttagacacagaaaccactggctcctgtcctggatttgtgagatctacaaattttcctggagcatttgccatttaatttcctttggcttacctcatctgtgtaatgagggtatttatatggcatcagctttgcatatgttaacattgatgaaatacttcagataaaacaaatcggaacttgggaatgaaaacagatatgaagaagccacaggcttgtcccaaaatcatagccaaggatggatggagggcttagcaggttacctatgctatatgagcagggttgataagaggttttaagatccagttttgagcagcctctctcataaataattattcaaaggacttgcatgttttgttgtctccctgagaagcagagtgcccacaaagatttatacagagttttcaagtttaacattgtattatagccaccactctctcttgaaatcaggtggaaagcaaaacaaaatgtccactagttctgaatgaatggtttatttatcctatttgcaattgcacagagaactgacttcctacgaagaagaaaacagttgatagatcttctgagacaataaactgggtgaacgaggggctttgttttaagtgtgctagacagaatttttccaggatctgaacttcctgtacctagggtgggaaatccagaaatatacagtagcccttccctcctaattctaaccctgcagaatttgtgtcagaaccaccaagatcagattctgagtggcatcatagcatttattaggagggaacagatcactgaaggtgaccactttcaatgttagctagtcacatacccaagatgtctgtgatcttatcaacaacagaaatcgatcttctaacatgatgcaaagaggggaaagaaagaaatgcctgagtggaggctggccaggaaaattctaatgctgatgaattgatggcaatggaagtttgtatatcatttctctagcaggcataggaaggtactttacacagtaggtgggtttctagaaagttaactatttttatttatttatttatttttgagtctcactctgtcacccaggctggagtgcagtggcacgatctcagctcactgcaacctctgcctcccaggttcaagcgattctcctgcctcagcctcccaagtagctgggactacaggcatgcgccactgcacccaactaacttttgtatttttagtagagatggggtttcgccattttggccaggccagtctcgaactcctgacctcaggtgatccagccacctcagcctccctaagtgctggtagaaacttaactgtaattttttcaaatggaattttcttttaaatacactttacgagttggtcatttaaaggaatattttggagaatctgcttgtgaacattcttttttttttttttttttttttgagagagagtctcactctgttgcccaaactggagtgcaatggcgtgatcttggctcactgcaacctccacctcccaggttcaagcgattttcctgcctcagcctcctgagtaggtgggattacaggtgtgtgccaccacacctggctaatttttgtatttttagtagagatggggtttcactatgttggtcaggctggtcttgaattcatgacctcaggtgatccatccacctcagcctcccaaagtgttgggattacaggcgtgagccaccacactcggcctgcttgtgaatgttgtttatgtttcatgggcttgtatttttttatactttccacccattcgaattttttaaagtgataaacatttgtcattaattgtcttacaagctcaataaattggtctttgctttctgacgcaatttgttattgttgctattttccttgagggaaaagcaaggtttctgtgtttgtatttaaacccctctgctttcttatttttctttgttgattttttcctctcctagtatgaccaatggtgagaagcctgagtttattgattttgactaggaatttactgactttgactttgtaatcaaggcaggtgaccacctttttgatgaggcctgagagaataagaaaagtcccaatcaccccaccacccacctacggaaatatatatacaccccatgccactgtcacactgaccctgaaatgccatcataatacattctctatcttaggctaacggcttcatgttctaaaatacaaataccctggagaattactggattaaatggtctattacagcataatgcttcaatgagaaattatctgaatatttttctcctggcagtaaaaaataaaataatgggagttttaatgggagtagagcaagaaagagatagtcttggaatctgggcaccatcccaggaagacagacttaactaaagggaaaagttctaggctgccaaagagctgtaaaagggatagtgaatgcctgggaagtatgatggagaagctgctcagtattgaaaaaaaggaaaatgcaaagcagagctaaggcaacttggatttatgatacaagttagcttggggaagactgaactcttagtatctttcatttcattatttgccaatcatttgagaagaaaaacctgaacatttcatacattccttctagcatttactgatcactcatatgtactggacactttgttaagtgctgatcatacaaagtagacctcaaagagtttattttaaagggagagatagggctgggcgcagtggctcatgcctgtaatcccaacactttggaaggccaaggcaggtggattgcttgagctctgtagtttgagtccagcctgggcaacatggtgaaaccccatctctacaaaaaatacaaaaattagctgggtgtggtggcctgagcttgtagtcctagctacttgggaggctgaagtgggaggatggcttgagcccaggaggtggaggttgcagtgagccaagatcacaccactgcactccagcctgcgtgacagacccaggccctgtctcaatagaatagaataaaataaaataaaataaaataaaataaagggaaagataggacaaaaactatatatattttcaagttgtgataagtgcagtgaagaacacaaaacgtgctttttatatatatttttttgttttctgctttacaattagattgccctgcaaaatctatggcaaaacagagaaaaattggtaagggctgcagtcttcataatctacataaaaactatgattgactcaggtcctgtaggaggaaatttctggggataatcctgtgacactctcagtactctttgaaattctatagagcaaagagcttgtggagtctggcaggaagagcaacgaaggtgaaggtgaagacattgagctggaatccggacaactatgtccgcaaaaccaagttggacttacagattattccaagaaactgtgatcctaccttacatccttttgaggtcctgcaagaatgtgtaagagttttaaatgctaccaaactggaaggagtatttgcaaaaccatgcctggcttggctggatggtcacgagatggagtgagttgcttggcaaagcatccaaagatcctggctactctcctttctaggggatgtgatggagcagttagaatttggaacctgactcagctgaaatgtatccgtataatacaagcacatgaaggttttgtacagggaatacgtgctcacttttgtgggacttcttttttcactgttggtgatgacaaaactgtgaagcagtggaaaatggatgggccaggctacggagaggaggaagggccattacatacaatattaggaaagacagtgtatactgggattgatcatcactggaaagaagctgtttttgccacatgtggacagcaagtagacatttgggatgaacaaataactaatcctataagttcaatgacctggagatttgacagtataagtagtggtaaatttaatgcaattgagacatttatcttgggaagttgtgcttccgacaggactacagtactgtatgatatgaggcaagctactcctctgaaaaaggttatcttagatatgagaacaaatacagtctgttgaaaccctatggaagctttcatttttatggcagcaaatgatgattataacttatttacttttgatatgcgtgcactcatgtaatggtccatatggatcatgtatctgcagtgcttgatgtggattactctcccactgggaaagagtttgtgtctgctagtttcaataaatctatttgaatctttcctgtagataaaagtcaaagcagggaggtatatcacacaaagtgaaagcaacatgttatgtgtgtaaaatggacttctgacagcaagtatattatgtatggatctgatgaaatgaacagttacctatggaaagctaatgcttctgcaaaatttggtatgcttacatcacaagaaaaagcagccaagtattataaccagaaactgaaggagaaatttcagcgtcatcctcatatacaaccgatagctcgtcattgacatctaccaaattctgtctacagcccaattcaggaacagtgcatcatgaaagaagcttgtcgatgagaggaagtgaatcacgttaaacacagcaagcctggatctgtgccaattgtgtcagagaagaagaaacacatagtggcagttgtaaaataatatttggtattcctaacaatcctgatgtataattagttgttactttgatttgagaactctacaaataaaagtgctgggactagattaatggtaaacatttcagttatgtatgtagagctttattgttgctccttttagctaccctgataaatgattcttaaaggtggcctagttgataagactgtcgttttatccttaatctgtgttcttctttcattgaaggatacagtacttacagtactagaaactaactcattttttcctgatttttttttttttttttttttttttttagacagagtcttgctcggtcgcctgagctggagtgcagtggcgcaatctcggctcactgcaacctccgtctcccaggttcaagcaattctcctgcctctgcctcccgagtagttgggactacaagtgctaatttttgtgttttcagtagagacagggtttcaccatgttggtcaggctggtcttgaactcctgacctcgttatcctcccgcctcgtcctcccaaagtgctgggattacaggtgtgagccactgcacccagccattttttcctgccttttgtttttggagatggtgtctcgctcttgttgcccaggcttgagtgcaatggtgcgatcttggctcactgcaacctccacctcctgggttcaagcgattctcctgccttagcctcctgagtagcaggcacctgacaccatgtcaggctaattttttttttcttttttgtatttttagtagagacagggtttcattatgttggccaggctggtctcgaactcctgacctcatgatctgcccgccttggcctcccaaagtgctgggattacaggcgtgagccaccatacccggccttttttcctttacagatatacttactttctctctgatctattattgtagacactgtacattcaaattgacatttaagacccaacatttcttctgatacctttaatattactttgaaaatgattgcaatgatgtttcttcctatgattccacataacatttagaagaatgatgtcaactgcttataactgaatttatttctagtgctttatttttatttggctttttgactctttcaaaacaatcaacctgcatttatataacttttataaataatattataatttgggtcaagttaagataataaaacttcctttcaccattgaaaaaaaaagagaaattctgtagactcaacattctaaacactgaggggctcctcagagccaattctaataattaaacaggtgtgattaactgctgcctgtgtggtttaatgttaaaccctaccttctgtttgctatgcccacccactatacgatgcccaccctcctgttatatatcccaaaattccaggcttgagaattctaatagactggcctgagaagaagaaaacagggaaatgtgattagtcatgaagcagctggtgacaaggagagaggaatgaggaatatgcccagagccgtggaaataaactaacaagaaaactgactgaagatgctccacgtaggagagtgaattcgcaccatttcaacatcagtaacttaggtaatgagaagagggagagtggtgaacagaattccttttaagtttaatagtgtgggggctgcatgcagtggctcatgcctgtaatcccagcactttgggaggattgcttgagcccaggaatttgagaccatcttggggaacatggcaagaccttatctcactaaacacacacacacacacacacacacacacacacacattagctgggcacagtggtgcatgcctgtagtcctagctacttgggaggctgaggtgggaggattgcttgagcctgggaggtcaagactgtagtgagctgtgattgcatcactgcactccaacctgggtgacaaagcaagaccctgtctcaaaaaaaaaaaaaaaaaaaaaaaagcatagcatggggatcccatgcacgaaactccaaagtaagcccttgaggacttgttgctcagtgttaaggtggtactataaatatgtactatgcatgcatagtcctaaacacttacttagcaaagcatgtgattcctaaagccattagaagtaagaagacagggagataacttaatgttatttttatattaaaagtttaattgtactatcattaatagaataccaaggaactatgtaaaatatgtctatgccttgttctcatgtacctactagtgaaagaggcaggagaattaattagagcaatcaaataaaactatctcctcaggtcttttagtggcacacatttttgtctgcccagcattccttgtgggaaacatgctcctcctccaacactccaaagtattcctggtcatgtggtttgggccagggatagtatgtgatgtaggctcagccaatcagtatattttattcctctcatcacagtgactggctcatgaaggagtatgtaatatatgacggaccatttgaaagtctctgggtgttttaccagagactttccagaaaaatgtcccttttttggatcataggctctaaaatctctagaggtctggaacagccaggatccatccatcttgctgctacatagagggggctaacttgaagatgaagcaaagtagacgcaaagaatgctaggaagaatagggaatgggggaagaaagagtccaaacagacattttgtccatgctaagagatccttgtgtgaatgaagctcagtagaaggatacattcctattagcctattagcaaggggacagttggtggggcagagggggtatgactcactgtagaaccacttgtccttgtgaggaggggccaagctcccccaggaaatttacagtggtaggggaatgatgataacaagtctgggacttacttgaagttatttgcctttcggtaacttcaagactgatgaatatgcacccactttcctggaagccgtcttgtgccctctgctgccttgatgttaacttgagttacctgattcacctgagatactgtcaaagtccaacataatggttttgttgtcttactcaagtgtgcgactttaagatgtttggaggcagggcctgtatctcccacttctgcatcttcatgcttcgcacagccccagaacccagtaagcatttcagtgatgcttggatgagtgagtctgataaggcgtatagaaatgaagccctgaaatattagcctgaaaaattcatggctttgcattgaagtactgcctttccaagcatcctcttaaaaaatacgaatacccagaagagacatagcatgttcaactagcgaccagcaattctcatttttggcagttatcagaacaaaggtgtcagaagtgttaaacagaacaactccatcttcaataggagctgggtaaaataaggctgaaacctactgggctgcattcccagatggttaaggcattctaagtcatgggatgagataggaggtcagtacaaaatgcaggtcataaagaccttgctgataaaacgggttacaggaaagaagccagcaaaaacccaccaaaaccaagagtgacctctggttatcctcactactacactctcaccagcgccctgacagtttacaaatgccatggtaatgtcaggaagttaccctataaggtctaaaaagggggaggcatgaataatccaccccttgtttagcatattatcaagaaataaccataaaaatgggcaaccagaagcccttggggctgctctgtctatggagtagccattcttttattcctttactttcttaataaactttctttcactttactgtatggattcaccctgaattatttcttgcgtgagatccaagaaccctctcttggggtctggattgggacccctttcctgtaacaaagagaactataataattggattttaggccatgtgcagtggctcacacctgtattcccagcattttgggaggctgagacaggcggatcacctgaggtcaggagtttgagaccaacctgcccaacatggtgaaatcccttctctactaaaacaattacaaaaattagccagatgtggtggtgcatgcctgtaataccagctacttgggaggctaggcaggagaatcgcttgaacccgggaagtggaggttgcagtgagcaaagattgcaccactacactccagcctgggtgacagagtgagactccgtctcaaaaacaaaaacaaaacaaaaacataattggattttaaggaacactctttgtatgaaagaaagggcatagatttgtgtaactaatttgaaaaacagtttggcattatttcctaaagctgaacattcatctgtgtatgacccaaaaatttcactcctagggatgggaccaaaggaaactgctgtggttcgaatgtgttccccagatgtcatgtgctggaaactgaatctccaatgcaacagtgttggtaggtgggacctttaagaggtgagggattaatgctgttattgtgggactgggttagttatctcaggggtgggttcctgagggatgagtttggcccccttctcgtgtgtgagcactctctcttgccatgtgatgcattccaccatgttatgatgtggagattaattcccttgaacctccagaactgtgagccaaataaatctctgttccttgtaaactacccagtgtgtgatattgtgttatagctgcagaaaaaggaccaagatagaaacttttacagatgtaaaacagaagatgtgtacaagaatgttcatagctgccctgtttttgatgcaaaaaacttggaaacaattgaaatgcctgtcaacaggagagtggatggataaattgcggtgtgtttacataactattgtaggaccataaaaacaaatgaaccacactgattcacaacaatgtggacaactcctagcaataataaaacattaagtgaagaaaataaatgccccaaatgtatatgatatgatatatagtcatatgccacataatgacattgcagtcagtgatggactccatatatgacagtggtcccataagattataatggagctgaagaattgctatcacctagcgatgttgtcctgaggaattgactaacaagaagtttttggaaatggaacaggaatgcatggctgaagaagaggtaagagaaaaggaaattgtaggagaagaaaaagaagaatccccaagaaaattcatgaagggtttagcagaaggtttgcaaacctcaacaagctccttaaaacgtttaaaaacatagactccaatgcaaagttttcattaatagagaggaattttcatagtgcagtatctgcttataagcaaatctttgaccaaaaaaaaaaaggaaaaacaaaccaagaaaaccaccatgcatgtatttctgaagagtgaccctcctcaagaagaaccacaagcaggaccttcaggaggaattccagaagaaggcactgttatcataggagatgacagctccatgcatgttactgcccctgaagaccttccactgggacaagttgaggaggtggaagacagtgacattgatgatcaggaagctgtgtatgcctaggctaaagtgcatgtttttgtgttagtttttaacagaaaagtttaagaaatagaaaataaaaatttaaaagtggaaaatttgaaaaaagctgatagaataaggatataaagaaagaaaatacaatgtgttcctgttttaagctaagtgtatttcaaagtttaaaaaagtttataaagttaaaaagttacagtaagctaatttattattgaagaaggaaaatatttttaaaataaatttcccattgcctaagtgtccagggtttataatctctacagtactctacagtaatgtcctaggtcttcacatttgttcaacactcactcaccgactcacccagagcaacttccagtcctgcaagctttacctatggtaactgccctatataggtatgtaatttataaatctttaatactgtctgttactttaccttttgtatgtttagatacccaaatacttagcattgtgttatagttgcctacaatattcagtgcagtgacatgctgtacaagtttatagcttaggagcaatgggttatgccatacagcctaggtgtgtagcggtctacaccatctaggtttgtgtaagtgcactctgtgatgttcacacagtgacgaaatcacctaattatgcattttttggaatgtattcctgtcgttaaacgatgcacgatgtatttttctagagttacaattaatataaaaataagctttatagaaatacatataggtgcaataaaactatatatttcaaaaagccaaggaattctctggatgatggtgaccttgtgtgtgtgtgtgggggggggggttgggggggtggcggggtgaggggtgtgggatgtgggcagtgtatggttagatgaagtttatgtcaaggttccagattttgttttggatggtaggtttccaggtacttatatcattaagaataatgaaataagaaactaagcacaaacatgactagaaagcctgggttccctaggaaactgtctaaggctgatgctttatttggaaagtgcaatctcagagcattgatagtaggggaaagtgaggcaaggaggaaggatagggagcaatgccggggtgctttggccttacttcatgaagagctctgctggtgagtcagcaggtgagcctgtccagccgcataggagtcttcaggtgggacaggtctgccttggagcagtccttgggtggaagaagggagaggaaatgagcagattgggtctctaattggaaggtaacttctctggggcactacctctgggttgcttatctggcctcttttggtggcagccgggaaactagatctcacatcttgtgttttatttaagtctagaagtggtgagagatgccagaatctcaagcctgtggcttttctgcctagctgcccagcagcagcaagggtatggtcccagccctccctggcaagatgctggctggccccaggcagagtaagttggtgctatggaggcaactgagtcagagctggcagccgagggtctatgggatgccatgtgagcaggagcttgggagtcagacctacgtttgaatctccgtgtgaacttggatcgatttcttaacttccctggaggctcatctagaatgtgggagtagtgataaccacctccaagtgtttctcatattagaaagggataatgtacataatgcaaccagcagaatctttggcatctaataagtgctcaaaacatgtaactccccttcgtcctacccctgccatgaagcacaactgagacagtattgggggttgagggtgggcagacctggcttaattccccttctctccttgtcccacctggcccatttcctggccttgggcagcccaagggcactgggccctgtgttacaggatgaaggggagaaagacgctttgcacccccttcctaaggtcgtcagtcctgaggctgcaccttccctctgtgcccttgatttgaaaagatactgggtttaaagagggatcgcaaacaaagatgggtgctccaagcaggcatataagctgctgtccccttgaaataatattcgtcaattttttgtctaatatttactttggctaggggcaaagctggtccagcaggacaaaggcatctttccccaatatgtcaggggttgggcatggagacccaaggccactgatggcagatttccaatttatttaagggatgtgtctgctgtcttctggcatgctaccatgccacctgttcacctggttgtttctcatgtgtctagagccccacaaagggtgactaggtcagccagagctcttgctaggcttccctttaattcaggattacttttactctttggtcacataagaatattcatttcctgatttgcctgtcttatacgtttaagtgctcgtgtatttcataacaccactataggatcttgcatttgaatacttaccagggactaaaataaattcacactgctattttgctgatgaagtgtcctattgtgtaagtgaagtttttaattttgtaggtttagatgagtaagttaaaattttcctttctggttcttaatttgttttctaatttggggtaaaatgaagttaggtgggggcaggggagaaattttcaaaaggagctcttcatatcagtaatgcatattttatacatgccccaactccaagacgcttctcctcagagccgtttcaagggcagagaagattcctgatcgctagattgcccctgttccctttgagttaatcctatggcctccacaagcatgtagaaaattctggaggagtggtactccttatgctttcacgaattttatttggcctccccattctggctcacttcttgtgaatgcagattcagttggccccaatttctttctaatgggcaggaatcaaaggcgtagaatgttgttgaaaggttttgtactattgtgcaaagtagtactgtacaaattatcttctgcctctttctcataagaccttttgagcaaagcccaattctagaattctggaattctactgctagaactttcctttggctaaattttgattgttactaaaaaatcagtatgccggaggaccacattttatttatttttttgagacaggttctcactcctgttgcccagactggagtgcagtggcacgatcactgcttactgtagcctcaacctcctgggctcaggtgattctcccacctcagcctcctgagtagctgggtctacaggtgtgcaccaccacgcccagctaattttttgtatttttagtagagacggggttttgccattttgcccaggctggtcttgaactcctggagtcaagcaatccacctgcctctgcctcccaaagtgctgggattacaggcgtgagccaccgcagctggccaggactgcattttaattgtcctaagtcatttgtgtcttaatttgaatggcagacagcttgtgtcagtggctgctgtgaggacagccctggaatggaggtgaggagagcctggagttaggtagctcaggacttagggagaacttcaactttggtaggagccatcccggacctgcctacagctagtaacattttgaacctgaaagcctcctcctccttgcaggtgtaagctgttccttagcctttaactttcaaattagaaatgtttatttagagtagcaatggaaaatagaagataagttagcaaagccagcagaagttggagaactcataaacaataaaatatcagaaaagtgttacccaaaatgcaacattgaaaaaaggtaacattaaaaaaaatctcgagagccaagaataaaggtgcctcaagggaagtaacacataccgtgatttttcttgcactctctttttctttagccctgtgatactggtctatcttttatgaaggtcctcttttatgaaattcaataatggtaactaatgttagggtgcctcctgaggcaacatgagattatatggtaggtaaacagtaggccgttgctgactcaaaggaaaggatcacttaggaacaccattagcccagtgccagtggtcccttttagtcagaatcctcaatctctgtggggatcaccctttggcctggactttattagctgccagattaaaggcacgagaattgagcctcattttttcccatttctattcttagataatccattcattctttttcaatttaccaggaccagtcccagaaagtgttgagaactgagtgtgagcaataatcactgatattatatagttccttgtagtttgcaaagcagctttacatacattattgcatttagtcctcccaataagcctgcaaaacaggcattatattattattatcatcacagtttcacaactgcagaaacaaagcttaaagagatgacaggacttgcctaagttcacggagagagggaatggctctcagctcaggtgttttgatcctaagtcctgttgctcctcagttcacattgaatctgaggagctgccatttgtccaccatgctcctctcactcttattaacaacaacaatggtaatagtggccaatgtttgaggggtattcacatgatgccaattacatcccatttaatcctcacaccaattgtatgatacaggcttaataactgatcttattttacagttgagtaaactgaggctcagagagggtaggtaagtctcagagaggtggggtatgtcgaccaagggtcatagctaggaggtggtgagataacatttaaatctagacctgtttggtgtccgtgctcttaaacacgcgactctatgaccttgctgtctctttggtttctcttccaaggtttctggcttagtctaaatgtttgattcaacacagcagaagcacacaggccgctttcaagggcaaagaatcaaactacaggctgtggggaggacatagagaatgaacaatgggttctccaggacttgtaagagtgggaagcaccactgacctgcagatgaggattgacggaacaaaacaaacagtaatgatggggtgcagacatgctaccccaaaatatggtacctcggcatattgaacagtgtaagctgaaggaattggaaaaaaaacacataagcaggaaggtctctgtgacctttgtccaggcttctttcctgaggcagttcctaaaacctggaaggcctctctgactttccgttgcagcaggtcttcaggtgctcatgtgagaagtgccctccccacatctggaggaaaagagcatccttacctctgaggacataggacacagagaaaaatctgaacaaacaggcctgcctaagttcccccggcttattaccattacatcatactcttttccctctcatatttctccatgactgtccactcttcatgaaacctactataaaaaacaggtttcactgtttcttcaggtcttcatttccttatgaaggctcccgtacccataaaacttacatttaaataaatttatatatttttttctcttgttcatctatcttttattagaggggcctcagccatgagcctaggatgggtgaggaaaatatatttttagtcactacgataacagatgcattagtcagaagggacatggagcctactgggggactgggaaaaaagctggatggattcacccacattcaggcatcggggacttcatacagatcctctggcctgaatcatttgcatttcattgcaggatggcagcgcttaacaccaaggcatcccttactaactaacaatgacctatcataaggcacgtggagggctcagggtcgccaactgggtacgggaagctcctggaaacaccctatgaaggcagcagcctgctccagacagggaacacagactgagagtatcaggactctctcgttggctacaaatgcttctgcagtaagtaaatcctaaaagataaaacttctttgatggaaaggccgtaatacacttaaatgttacttaacccagcaatcccattactgagtatatactcaaaggaatagaaatcattctattacaaacatacatgcatgtttatgttcattgtagcactattcacaatagcaaagacatggaatcaacccaaatgctcatcaatgatagactggataaagaaaatgtggcacatatacaccatggaatactatgcagccataaaaaggaatgagatcatgtcctctgcagggacatagatggagctggaagctgttatcctcagcaaactaacacaggaacagaaaaccaaagactgcatgttctcacttataagtgggagctgaacaatgagaacacatggacacagggaggggaacaacacacactggggcctgtggagagggagatgagagggggaaggagagcatcaggaagaatagctaaagcatgctgggcttaatacctaggtgataggttgacctgtgcagcaaactaccatggcacacgtttacctatgtaagagacatgcacatcttgcatatgtaccccggaacttaaaataaatattaaaattaattttaaaaagcaacaaacagttcctcaccacctttaagagatgtttagctagtttccttgctgattgaacctggcagaggtgaggggggaagttggtgagaaaagatctgggaatgagacgatttgtccagccccataaaaggaaatccctggaagaattggagcaggtgggagaatctgcatctctttcatcttccatcgctccctggggaagcagtggggcggtgcttctcccagtctgccttctggttcgcaggcctggaggcacattagaatcacctgagggggcttttaaatccacccatgcctgggacccacccagaaatctccaggagtgcagctgaggtagggaagtttttaaaaactcttcaggtgactgtgaagcagagagcatatcactgctcgagcgtttcagaaccagaaacaaataagtgacacaagtgaagagtgaaactacaacatttcggtgagtttggaagggagcaggcattgtagatagatttttaaagaggagaagtgggaccccgagaggaggagcaatttgcctgggtcagtggcagagttggggaaggaggtagcctcgttttctttttggtcccctatacccttttttattttctggtggcatattatagtattaattgttctgacggcttagctttatatgtacccagccatgaaatttccactctgtcattgggcaacctctccagttagacctacacactgttgtaaagtgtttcctggcagggaaacccaagtatttcgtttctaattcttagctctttgcaagtctgagcagtgggtcatgagactcccacaactgtttagaaggagccagggcccacttttcatgcattctgttcaaagcataatccatgtgcatgcagtgaaaatgcaaacgtgcgggtggcattcagacctaacgcagtctcagctttcaatcctgctgtgaatccagagtggctgtcatgggatctactgcagttaattttttcagaactcagagctaaatccctgaggaggcctgggctggagaggccacctgaatggtggcctgcttaaaggtgcggtcatgtttcctgatttaactgggtcagtttggttgtttatttttgccatttgatttcagggcagggttggcttcagtgtgctggcaattcccagatagtttatgctctgagggactgggacaggtgttcaagaacccccagtgactattatttaattttgttcctcccccagcctcatggtttatatatgagttgttatgtgacagagttctatttttaaccacagacatgctctgttcaactggaatcatgttctttagacactgcattatgcaagctggctccaaagtttgccagaagtgctaaactaaactgtgacaattcccagccgtagtcactgacacccccacagtgaaccaaacagcatgcttacttgcttcaagatagagtttcagttgtgttaaataactgtctggtgctacctgatgagaaagccatgtctggctgtttggatcagcttctctgatcttgtctcctgtctaatcccagaataaatcctttgggttttgggggaggacgttaaaaaggctctggtgaagaagattaaacctgaaacaagtcataatgaggcataaacaaggtaatactcattgtaaggtatcttcccaggttctaagcaggagaggagaaaagatggtttcgatggagggcatctgttgagaaacccctctgatgtagatgttcctgtggagtcatttatatccaaacattaggacattagacaagtgcactggtgggttctcagggttttttatggggtgatcataaagaagtggctctcaagaattgcatcgagccagggatcttctgacttctgaagactgacatctggcttatctaagatgatccagggaaggggcggagctagaagtctctgcgggaagattgttagtatttgctgggattctttggtggcaagcaacagaaataaactctcaagaagggttaatctacttaggcagaaaaggactttttagaaaataagttccatgagagcaagggctagcttgttcactggtatttcctcaatagaacagtaccttgaatatagtaggtactcattgtcttagtccgctcagactgttaacaaaattccttagactgggtaatttataaacaacacagatttattgctcccagttctggagtctggtatgttcaagatcaagttgccagcagattcggtatctgatgagagcccgttcctcatagttagtgccttctgtgtgtcctcacatggcagaaggggccagcaggctccctcacaccttttctatagggcactaatcccattcaagaggcctcctaaaggtcccacctcttaatacaatcacactggggattaagttctataaattttagagggacaccaacattcagatcatagcgctcagtaaatattcatggactaaaagaagttatagggtggatcaaagcattgttaggaagattgtgaaccagttttggaaaaagataaagaatgagagcatctctggagaggcttaggtagcaggaactaggtccctgacagtctcatcaggacaccactgctggaataactgctttccaaacatttttatatttttaagtgtctacactcatgcttcaaaatccagacagagagagtgagtgtatattaatcagggttctccagagaaacagaaccctctatctccacctctccccttctccccctctccccctctacctcccccttctccccctctccccctctacctcccccttctcccccttctccccctctcccccttctccccctctcccccttctccccctctcccccttctccccttctccccttctccccctctccccctctacctcccccttctccccctctcccccttctccccctctcccccttctccccctctcccccttctccccctctccccctctacctccccctctccccatgtgtgtaaaagaaggaattggctcgtgtgattgcagaggctggcaagtccagtctggcaggttggagacccaagcagaacccatgttcctatttgaaggccatcagacaggaagaattgatgttgcatatgaagacagtctgctagagaattatccttacttagaggaaaggttggtcttttaattctatttaggcttcaagtagttggatgaggaccattcactatggagggcaatcttcttgactgattaaaatgtgaatctctttcaaaaacaccctcgcagaaacactcagaatgtttgaccaaatatgtgggcaccctgtgacccagtcaagttgacacacaaaattaactatcagagaggagagagagaatgcaactgacctagcttaagttgtgtgcccacccctttggctggtagaaggcagggtattttgtcagttctagagattttgaaccatggggcagaactgatttcctaaagggaaagtggagagctgttaccaggagaaggagaataaatagtgggaagctacaaaacaactggctcttcttgaatgatggttttatttttcttattttgttacttgcttccatgtgagtaaacattaaaacacatctgtgctgctttgcttgacttcttccagctcctttatacaagaggaagaacagctgggagggagaaaaatattttttttcctttctctcttcacttccagtcctcagtagaggtgactgacgggtgatggttacctctgagtccttgcttttgggggtctgtgctaatgattgaacactcaaatgctgcctcactctgaagaggtccttcaacactgtaaaaggcattcacaagacatccctgccccggaagagtttgaatctgttggactttgtgcatttttcttcttttctatccttcacctactagttgtggctactacaaacccatatagttcttctggaattaaggagacacacttccctcaaagtgctttacatctattggtcagagatggtcataatgtactgagtttgttagaatgacgcgttgctatgtaccaggaagttatcacagggcatataagtctaccatgtctacagtgtgaaggatgcctcgttagacgcagcactcttgtgcaatgtacaatctgtctactttatatggcaggcctgaactactgagggagagagagaccaccagaaatcgggaaagcacaacttaattaatgctcttatgaatggtgtgtgctggggggtggttgtagttccctttgtgttctgaccaatagctgaaccactgatcagattcaagacagaaccttgaatccaaaactcctttagtgtggcaagtccaccatagttcctgaggaagctgccttcgaggaatcggggaccactgctctctttttaggggaatccctgagatacctgcatatctcagacccgacaagcagggagtggcaatgggcatattgctattccaggatacaactgctgtgagatcctcttcagaggtttataagcctgacttctcattagcacgttagatataaggcatgactcattgccaaatctacagacccatgatagggtagacaagatcaatagtctaaaatgaaaacagattttaaaatgaacagaaatttaatgctttttcccgtatgccaatggattacatggtacacatcctggggtaggcatagcccactttgtagaccactgatctagagcctggtactccccttacaaaacctgtgcaggcagggctaattgactcaacaccgtgggcctggagacatcctcaccctccattacaacaagtggacatgtggtttctaggccaagagttggcaaattacagcccattggccatacctggccagccccctgtttctacaaagtgtttttgagacacagccacactcacttggttatgtattgtccataccttttttcacactataaaggcagagctgagtaattgccatggagagcagatggtccacaaaacctcaaatactacccgacctttacagcaaaaggttgcccgaaccctgctccagacaggcagtattgatccctgtgtgttggtaataaaaggtaagacttgtctgctgcctctgctctggagttaggccagagtttgccgcatagctccttgtgttaatgaggctcagcttggccttgccttctggggattagcacctaatcccggctagctttcttagaaagctcattcactggtcacaaggatgcagagaagtgagtgtggatgaaactggtcctggtcacctgaagtccatgccttacacggcgtgggtcagctgtgtcctctctgctagctggcccctctgctacctacctctaggtgatgtgcctgctactcagcacaagtgacagagcagccacaggcctcccccactgcagggctgcacagctgctgcacatccccaagggggcggggcgaatgcatgctgaaatgtttgtgtgcacatgtgagtacattggttaggactatccccaactccagctaatgcaagcctggtagacacatgcgtttttgcatatccatgcacccttcttttgggaactgccgctagatgaaaatccaaatatttaattcctagcaattagtttgggcttgagtggtattcatttttattcagaactcaggtcctaggccttattcagatttcagtcccacgtgacaaacttccacagttcctctgagatgtcctgattctcactggtgagaatggcagagactgctggttccttacctaacagccatctaccctacaagccctgattttgagacagtctctgccacctaggctggagtgcaacctccacctcctgggttcaagtgattctcctgcctcagcttcccaagtagctgggactacaagtgcatgccaccatgcccggctaattttttgtatttttggtagagacagggttttgctatgttggtcaggctggtctagaactcctggcctcaggtgatctgcccaccttggcctcccaaagtgctgggattacaggcatgagccaccgcacctggcccctataagccctgattttattggaaacgtgtcctttagtgaattgtgcatctggaacagagacagacatgttgtgcttcatttgtactttatcatttttgtccttggtgcaaaggtattacaccctaatgctggctctttggggccatgaaaattgcagaagtcacggctcttcccacttcagtcactgagccaacaccagtactcacctacttcaaaatttatcttcccatgagaggaaaggaaaaccccaccttgtttttggtttgaacacaactgcatcaaattccttactgatgactgaaaaaattaaggaaaagctcagagtgaacaagaagtagatcagctttccttacagatgcacaaaattacacagcaggcctgggtttttttttttttttaaactttggagtagggtcttctgtccccacagctggagtgcagtaatgtgatcatagcttaatgcatccttgacttcgtgggcttaagcaatcctccacttcagcctcccaagtagctgggactacaggcttgggccatcgtacccggcctaagcctgggtttgaggtctagatttatcattctctcatcctgtgccccagagccagtcactttctcttaaaattctcggtgtcaaggcaagaccactgcgctctgaggcccccttgatctctagggcattaaaatatatgggagatttccacccttcctcacggggcttgcaggctgagggagtgagaatttcctcaccagcagcatgggcaaattcgtaaaaagaaagaaataatttgcttgtttttaatggccaccaaacttcaaagtctagtgaccaccaaccagtccctcctcagtgaacatggtcgaatacagaaaggctttctctggaagagcccagaaacctgctgtctcatttcaaaagccatcttccttccccgagacaaacatggtggaaaggaggcccgcctgataacactgagggttttggggccagatttttttctgcaggcagttttggacatttattttaatcttctttatgtgagctataaaacacatttagaaaagtatatattagctggttgtagtggctcatacctgtaatcccagaactttgtgggggctgaggcaggatgatcatttgagctcaggagttcacgtagtgagaccccatctcaacaaaacatcaaaacgttagccaggtgtggtggcacgcacctgtagtcccagctactcaggaggctgagatgggaggatcaccttagcctggggaggttgaggctgcagtgaactgagactgtgcccctgcactccagcctgggtgacagagtgagaccctgtctcaaaagaaaagaaaaaatatattaaacataatgaacagttaatgttttttaaaataaagtaaaccctttattaggtcaagaaacagaagtttgtgagacccctggagccctcctgcctatcccttctcaattgcagtcccctcatttaatggtaaccactgcctcgattttttttttttttttgggatggagttttgctcttgtcacccaggctggagtgcaatggtgtgatctcggctcactgcaacctctgcctcccaggttcaagtgattctcctgcctcagcctcctgagtagctgagattacaggcacccgccaccacgcctggctaattttttgtatttttagtagaggcggggtttcaacacgttggtcaggctgatcttgaactactgacctcaggtgatccacctgcctcagcctcccaaagtgctgggattacaggtgtgagccaccgtgactggccccccattgcctctacttttatggtcattgatgtctttgattttctttaaaattttactacagacatatatgtccatggccactattatttgattatacctgctattgaaatttatagaaatgggtccatacaggatgtgttcttcatatctggcttcattcaccaacatgatgtttatgagattcattctggtttttgcacatagctgtagcttattctgtcattgtcatgtagcattttattgcatcaataggttttcacaaattcatatcattgcacatacttacttgttaccaatttggggatttcatgatagatctgctctgagtgttcttgtccctgcctccctgtgcatatttcagtaggttgtccccctgcagtagaattgctgggttgtggggtatgttctgttggctttgctaggtgatgccaaagtgattctgtggatttatactcccagcaactgtacatgagaggtctccatgccccacatctttgtcaacactggagaatgctattctgtaaagttagctactctgggtggtgtgcacggctatatctgtgtgtgtgagtgtgtgtttgtgtgtgtgtgtgtgtgtgtgagagagagacagattttctaacctaattttcattattgcattagcctaatttttattaaaaatttctttttttttttgagatatggtctctattgcccaggccggagtgcagtggcacaataccagcttaactgggctcaagcaatcctccaacctcagcctcctgaatagctaagactaaaggcacatgccaccatgcccaactaattttttgtttgtttgtttttttgagatggagtcttgcactgtcgcccaggctggagtgcagtggtgcgatcttggctcactgcaacctctgcctcctgggttcaagagatgttctgcatttgtctgatgttttctcatggtgtctcactcgttcttctctataagctgggagttgggtctaaaggcttctttagataaatctcagtgtggctttaatgtgcatctgttggatttgttttttttctttttcttttttttttttgagatggagttttgttcttgtcgcccaggttggagtgcaatggtgtgatctcagctcactgcagtctctgcctcctgggttcaagtgattctcctgcctcagcctcctgagcagctgggattacaggtggctgccaccatgcccagctaatttttgtatttttagtagagatggggtttcactgtgttggccaggctggacttgaactcatgaagtcgtgatccacctgccttggcctcccagagtgctagaattacaggcgtgagccaccacgcccagccccatctgttggatttgtaatgagattgagcaccttttcatgcattttctggccatttggaattcttctctcttgaggtgcctgctcaagtctcttgcctattgttctgtttgctatgtgtctttttcctgttgatttgcaggagttctttatcttatacatgtgttgaaaatggcttgtcccactctgtggtttgcctttttactttttttttttttttttaatttcactcctgtcacccaggctggagtgcagtggcatgctctcagctcattacaacctccatctcctgggctcaagcgatcctcctgcctcagcctctggagtagctggaactacgggtgtgtgccaccacacctggctcatttttgtatttttagtagagatggagttttgccacattgaccaggctggtcttgaactcctggcctcaggtgatccacctgccttggcctcccaaactgctgggattagaggtgtgagccactacacctgatctgcctttttatttttgtaagggtatcttttggtgagcagaagttttaaattttaatgtccaattcatcaatatttctgtaacctgttgaaaaaatattccctaacctggggtcacaaagatgattatagatgatctccctgatcgccttccataactgggtctaagatcctcctggaagtgttgtttgtgcatggtgtgaggtggacgccaggtttcatttcctcccgtaacgacattaagaacatggtcctttccctagccctctgcagtgctcccttccttgtaacctgagggtccctgtgagcatgggtctgttttggagatctccattctatccattggtctatttttctaaatttttataccaatgcatactttcttagctgccataggtttataataagtcttgatgcctacctatgtaagctctccctctgaattactttaatgatgctgtggctaggattttgacatttcacaggagacttggctcaaacctcatgccccttttttgagataggattatggggttactattctttcctgggctgtgatctcagaagtaacttactcagttttccagttggtcctttccagggactcttctcacttgtgtcttattaaataaagatttgatttgagaccatggaagtccagtgttcggaatgcctgtatctgttatgttctactttttgggacaggtggacataaaggaactgaatctgaaataggtggtaaggaaaatcccctgaaatttgaaaatgggtgcctgagaggtgattttgatctctcctttggcagctgcacgctgtagagagaatgaactctagagtcaggtttttgggctcaattcctggatacaccagttactagccctatgaccttggggacattgattaaccatcctggcctcagtttcctcatcagtaaaatgggaatagaaacagactctacctcatgggtgtttgtgaggattaaatgcgattatatacaaaaagggcctggcacagaataagtgcttggtaaagcttagccatgattatttttgttgaaaagaattcatctttcctccaagggctttgagactaacctaggaggtagcaaaacctattcctcttgtgtttctgaggtgcagaggctatacttgttggagactcggcacaggccatgatgatggtctgaacattaccacctgcccctcagcactcagaaaagcagttagtttgtggctgttgacctgaggcaaaattgatacaaatagagtttatttgggccaaatttgaggattgcagccaggagcacagattcaagttgccttgaatatgcattccaattagcagcagttacaagcggattttttttttcctgagattacaagtggttttttttttttttttttttttttttttttttttttttgagacagggtctcactgtgttgcctaggttggcctgcagtgggatgatcacagctcactgcagcctccacatccagggctcaagtaatcctcctgccccagcttcccgagtagctcagactacaggtgcgcgctaccacgcctggcttattttttgtagagataaaattttgctatgttgtccaggctggtctcgaattcctgggctcaagcaatcctcccgcttcagcctcccaaagttctggaattacaggtgtgagccaccttacctggccacaagtggatttttaaaggcaagaaaaggggtatgggaaatgggctgacacaaaattgtttgtcagaaattctcatgggtttacagaaatatcgattagtgaatggctatctattgttaagctatagggtgtggattctagtgtggggtgtggcattattaggttaatttatagctaaatgtggaaagagcaaatagtctcaagagatgaatacgtagctcaaagtggggagtagggcatgattgtagtctcattttaatgtctctctgggcctgataattaaaaggacttgcattcctcagataaaagctcttttttctgcccctggctaatagttatctaatatactcgactcctttagttctttgaaccttacgttttggaggtcatagaagttacagagggcaggagtcagaggcacgggccgggccctgttctgtgcttgaccaccttgctgctgtggtagggcattcaccactcttcccatctctcctggtccttggcccttcatcgctggaggtggagttgttacagaggccaaatatggggagaaaccgtttacattcggttttctggggagccaaaatgaaagaccccagtggagtggagcaatgagtttacacctttagtagactggaaagaaactaaaaagggagatgtctcctcagtgcactggaagagggtgaagggcgatgcaatcttgggaaagctgggggctggggtgggtgaactgcattggatggtccgtgtcgggcagaatcatcggcatgctcagcccaccattgtcccaagccaagccagttggtactggtgcagagaagtagcttcagcttctggtctcaaagccatcctctgaaggatgccaccacctctcaagcccttttagaaatggagatggactggtggtggcatgggagggcagacctaagtctggtatgtcagtggagccagacagaagggcaggcaactctagttacattaaaatagcaatgtattgttgacgggttggaattgcacacttacaatcacactattctatctatagtattatcccatttaatgataaatatgtatttgtatatatgtatatccgaaaagatctggaaggttatttctgcagctttaaaaagaaattgtctttgggtggaattattagcacttttgatgttcctctatttttttttgtatttgtactatgtatctgcataactttctggttaaatgagtttatgtttacaatttaaataaaaagagaaggagcatcatttggctgcacctccctcaacttcagatgtaacttgtgggggtggaggacagggcagggaggccagctggggtgttcctcctagagttggcgttgatggtagggcctcactctgttccctacacaggttggtcactgcccagcctctaagatgcgaagctctctccagaccctctggcccccttactctaaggttctaatgttatttctgtttcaatatggggaagagaaacaaaaacagatgctgcctatctcgatcagggaaaggcaagagggtgtctttcttccatctgggttttctctgtgactgttaactggatgcttacaatgcatggggcagggtaacctcctgccacttatagtggtgggggttgatgtcagtgacttaagaaaattagggaataaatgtttcagttattttctccagtaacagaaggagggaggagttgaggcaggtatggtggctccaaaaggttactggtgtcaacccctcctgtgtatgcctgccactcctgtgggtggctgtcagcactgagctcacaagatgactgctggaccatccctgctgtggccgtgtccctgtttcagtcaggatcggacagggacaggggcagatgcacctcccaaaaggcctcatccccaggctcgccggcatatttagtgacattaatctgtgcaagaggcttggaatgcagttttttgttgttgtttctttttaaacaaacatactgtccaaagttctctcactaaggaaggaggaagaatagactttgagcaggcaacaagtactgtcacatagtccaaaagctctgattctcacagaaaagtccataatctttaagtgctgcagagatttcaggatcaaggtaaatttgtaaaaagttgggaaaccaaaggtattatacagtcccatgggaagagtttgctcaacaagacggttcttttgctgtagttggtgagccaggttcttgctccacgttcaccctcagggcttggtggggttggggttagcctgctctgcagctaggctggcacctgtcagtacctgggtgattgttccaacacagacggtacgtaggaagctggcacaagagctgacggttcttgtttgtcatcccctatatttccttgtgtccccactcagttgggcctgcctgcattcttttgacagtcgctaaagtcacagacatacttgaccttgcagtttttagaggggacctgtcacctttcaataaacaagagggaagatctttgagcagtgagttccagagaccctgttaaaaagaaaaaccttagacaagtttagcagagtttaagtgagaaaaaaacaaaaactcagaaaacaaaaacacatgacatgtgaatcaggcagccctctgattcagaacgggttctaagaacatggtcaacaatgtgatcaagtgttatggatgcacggaaaacagaagtgaggtacatatagggcttaactggttccggctcagcgtttgccttatttgatcgttggcagccagggattgaaggaagctcagttgccgtgatggcggagactcagctattttttacaaaagcatactcctaaatttaggctttcaattagattagtaagccaggctgcctgcagttagttaagtaaggacttgggtgcaaaggcttcctcaggccaaatttaggttattttaacatccccaatggccagagacaggcttcttggaagccaactgcttggagtaaaactgtgatgacaattccttttgaaacatgtactccttgaaatttggaagacattttgggctaatagatgttctctgtgcctgaaaataaggatggcttcttccaaaatgcaggtgagtcagcccttccctgcaaagaacttgctgactgctgcaattaggggcagtccacaaaagaaaaaccataaggctgcatcaaagcactggctcctctctcagagaacagaggagaagctgcccctcagaggaaggaaggtggctttccaggaggcagatgctgagtcaggaggaaggttgcttcaggatgttatgttaaaacaaaacaaaaaacagaccaggtgccctggctgacgcctgtaatcccagcactttgggaggtcaacgcgggcggatcacttgaggtcaggagttgaagaccagagtggccaacgtggtgaaaccccgtccctactaaaaatacaaaaattagctgggtgtggtggtgcatgcctgtaatcccaactactcgggaggctgaggcaggagaatcgcttgaacccgggaggcagaggttgcagtaaactgagatcgtgccactgcaatccagcgtgggcgacagagagagactccgtttcaaaaccaaccaaccaaccaaaaaaacaaggctgacccccacccccagcagaggctgaacttagaacaagtacagatcccatcagaactatgatctctttcagatcaaagaggctcatggtacattctagcttttcttgttctctgattctagacattttctgccttgaaataggagatttcctggggtgcgcccgcccgccttgcctcatctctcaaatacattcctgggagcaaggagccctgcagcaggcagctgcccagcgctcagccctctgctgctctctgctggaatgtcgctgccaacaccactagtgcttatcctcaaagctttggccaattcctggtacttctttttggcctgttaacagagagaagctgacaagcaaattacagacctttgtgacttagaactgaatgctaagtaaaatcaatgctccgttaacacagaatgagcaacatgactgttaaaaaagcaatgatagggtcgggcgcagtggttcacgcctgtaatcccagcactttgggaggccaaggcaggtggatcacgaggtcagaagatccagaccatcccggccaacatggtgaaatcccgtctctactaaaaaaaaaaaaaaattgccaggtgtggtggcgcgctcctgtagtcccagctactctggaggcggaggcaggggaattgcttgaacccaggaggggaggttgcagtgagctgagatggtgccactgcagcttggcgacagagcgagactctgtctcagaaaagaaaaaaaaaaaaaaaggcaatgatagagacatcagttgctttttaacttaattaccagacaagaaagaccgtaaatttcttgtacttaacaagaaatgcttctcaatggccatattgtgcaaaatattgtgcgcatactaaaagggacacatgaaacaagttatgtactctctgcttgcaggagtttataatcatataactcagaaggaggggaagtcattacaaaatgagacagatccagatatatcccatgagagagcaccagatagtgataggctcacattcagctagagatcagggaggttgtggaaaagcagccgatgcagccaggctgctgaggaggtgcaacattttggggagaggacaagagggatgaggtctcagcaggagggaagaatgctgtgtatatgtaagtgtgtgtgtataaagaactgtgtatctgtgcccatatgtttggaaagagtgttgtcaggttgccttgggttccttagagtctaattcaaaaagctattgaatacttcaggtagggttggaccagtaaagactgagcagtgagataatattttgagataggaataactgcccccttctgactgtttaacaaaaccctttttactatgaaataaaaccagctatagaaaaccacacaaaagacaagtatagcttaatgattgcaacgtggacacccaaacacagcagcctcccacacccgtaagtaaccaccgttctgacttttatagcaattacttatttgcatttctttctagtttgtcatctaaatgtgtagccatagacactgtagtttaatattgttcctccttttgaatattgtcatgtgtcctcaagttatttttaatttacgtgttcccctccatcttttcctttccctttaaatgtatgggcttaagaatctgggccacttgacctgtgatctggatcttagattgcgtgtacgtggtcatctctcatgttcctctgacctttgtgatcctgcagatgggcagctggatccagaggctggctcaccttcaggcttgagcccttggtaagatgctaggtggtgaggcttctttcatctcgtaatctctcttttatgtgcatgatgttagcagccatcgattctcaatgtctacgtggactaactcattggccgttgcaaaacggtgatattcggaaacaataatctctttgttgtttcatttgttagttagaatacatctataaggagaagctttgccatggcagcagttctttagaaaaaggtaattctaagcatcttgtgtagttttggatagtcacatcctcctaaggctgagcccttagtaattggctctctcagaatcttgcagaggccaaactggccccaggaatagtggcccagaactactggccactggccacttgtggacgtaatcagaggacccctaccccacctgccactcttccagtgacctactcctcatggggtgggatagctgtttctgtccatatggaagattaaacactctaaattatcttccactggaaaactggaagcaaaatgctagacaaaacaacatatttaaaacatgtaatgctgagcttctttgaaagaaatctggagaggtcaaaaaacaagaaggaagcaggaattctgtgaagtaataccgagggtttccgctacagacaggagactttcagcttcctttttgatagttgcaggggagatcagagggtagacgatgaggctagggcttgcccaaggagtgagtctttgttaggagactcttctgcctaaggatgagaacccaacaggctacaatctgatggcaggagtgagcaagaaataaacctaatacgctgaagaggatagtaaggagaattgcctgtttcaaccttgacaccggacgagagggaataaaaatatctcccatgagaatttgtaatgacaagctggctctctcagagttgtggtccaaatttacgtaacctatgtggtaaaaaacaaaacctcaaacagataattacatttagaatggttctgggttgagactgggtgcagtggctcatgcctgtaatcccagcactttgggaggctgaggtgggcagatcacctgagatcaggagttcaagaccagcctggctaacatggcgaaaccctgtctctactaaaaatacaaaaattagctgggtgtggtggcgcatgcctgcgagcccagctacttgggagacaggtaggataattggttgaactcaggagatggaggttgcagtgagccgagattgcaccgctgcactccagcctgggagaaggagcaagacttcatctcaaattaaaaaaaaaaaaaaaagggaatgcttctgggttgatagtgtccccagaaaaatggcagaagcaaacataaaaacttcctggaggattgcaatctgaacgacagcttcagagatttcctatggtgaatttctttacttttaagtaagtgagcatttcaaggtcaaaaatcttaaaaagaaaagggaaatgaggcacctgactgaaggccagttggaaaaactgatatccaaaacaggctctaaagactatgagtattaaaatcatcagatgcaaagtatacaatagttatatgtaatatatctaaataaataaaagcaacttgaaaatatgattggaaaagagactgtaaggcatcacaaagcaaatctgcaaaagaaataaaatttctaacaataaaaaatcagtaattgaaaataaaaactccaaggatagattaaataaatcagattttagatgaagctgaggagagaactagtgaatgggaaaataaattcgaaaagttatccgtaacatagatcagagggacaaagacacaaaaacaagacaggtaacaagacatagaggatagagaagagtgtttaatagatgaccagctagagtttcagaaggagacaatgtcaatgaggtaatgttgaagagacaatggctgagaattttccaaatttgatgaaagcagatttcatcagatttagaaagcccaagaaatatcaagtagtatagatagaaataaggccgggtgcggtggctcacgcctgtaatcccagcactttgggaggctgaggcgggtggatcacaaagtcaggagattgaggccatcctggctaacacggtgaaaccccatctctactcaaaatgcaaagagttagctgggtgtggtggcgggcgcatgtagtctcagctactcgggaggctgaggcaggagaatggcgtgaacgggaggcggagcttgcagtgagccgagatcgcgccactgcactccagcctgggcgacagagtgagattccatctcaaagaaaaaaaaaaaaaaaagaaatctaccaagacacaccataagcaaaccatggaacaccaccacaaaaatgagatcgtaaaaatagccatattaaaaagaaacagcaattagagaaggttgtcttaatttttttttttttaattgagatggagtcttgctctgttgcacaggctggagttcagtggctcaatcttggctcactgcaacctctgcgtcccgggttcaggcaattctcctacctcagcatcccaactagatgggattacaggcatgtgccaccacgcccggctaatttttgtatttttagtggagacagggtttcaccatgttggctaggctggtctcgaactcatgacctcaagtaatccacccgcctcggtttcccaaaatgctgggattataggcgtgagccaccatgcccaccctaatttttttgatacataatatttgtatatatttactgggaatgtgtaatattttgttacacacacagactatgtgatgatcaagtcattatttaggacatccactgcctcaagcatttatcatttctaggtgttgggagtatttcaagtcctctcttctagcggctttgaaatatataacacgtttttgactctagtcaccctactctactacaaacattagaatgtattccttctacttaactgtatgttcatacccataaatctacctctcttcattcttcttgccccaacacacttcccagtctctggtaagtattattctactctctgcctccacaagatgaaatttttttagctcccacatatgagtgagtatatgtgatatttgtctttctgtgcctggcttatttcacttaatataataacttctaatttcatccatgttgctgcaaatgacaggattctgtttttttatggccaaacagtattccattgggtacatattactgaattttctttaccattcatcctttgatggacccatgggttgattccatatctttgctattgtgactagtgcaggcatccctttgatatactgattcctttttctttgggtaaatacccactagtgagattgttggattatatgatagttctatttttcattttttggagaaatatccatactgttttccataatggctaacttacgtgcccaccgatagcgtataagagttctcttttctctgcattctcctcagcatcttttctgtctttttggtaatagctattctaactggggtaagattatatctcattgtagttttggtttgcatttccctgatgattagtgatgttgaggatttttaaatatacctgttggccatttgtatgtcttcttttgagaaatatctgttcatgtcctttgccccatttttaaatttagttcttttcttttttgctgttgagttcgttgtatgcttttgatattagtctcttgttgaatgaatagtctgcaaatattttatcccattcaacagtttttttcttccctctgttgattgtttcctttgctgtgcagaagcttttcagtttaatatagtttcatttgtctatatgatggatacacattttgttgcctgtgcttttgaaatcttaatcataaaatctttgcctaggcgaatgtcttagtgtttccctatattttttttctagtagttttatagttttgggtcttacatttaagtctttaatcaatttttgagttgatttttgtatatagtgagaggggtttagttttattcttctgcatatggatattcagttttgccagcaccgtttattgaagagactgtcctttttcccgtatatatccgtgttgcctttgccaaaaatcagttggctgtaaatacataaatttatttttgggttatctcttctgtttcattgatctctgtttatttttatatcactatcatgctgttttgtttattatagccttgtaatatattttggagttaggtaatgtgatgcctccaatgttattcttttccctcaggattgctttggctatttgggctcttttcgggttccatataaattttaagatttttttttctatttctgtgaaaaatgttatcagtattttgatagggattacattgaatccatagattactttgggtagtatgatcattttaacaatatgagttcttatccatgagcattggatgtctttccatttgtttgtgtcctctttaatttctttcattagtgttttatagttttccttgtggaggtctttcacctccttggttaaatttattcctaggtattttttttttttttggtagctgttgtaaatgggattgccttcttgattttatttttcagctagctcattattggtgtatagaaatgcagctgattttgtatgttgatttttgtatcctgcaactttactgaattaatttattagatccatgagtttttttggtggagtctttaggtttttctaaatagaagatcatgctatccgcaatgagggaccatttgagttccctgttttgcatttggatgctttttatttctttctctcacctgattgctctagctaagacttccagtactatgtttgataggaatggtgagagtgaacatccttgtcttattgcagttcttagaggaaaggctttcaggttttccccactaaatatgatgttagctatgagtttgtgtctttgttatgttgagatatgttctgtgtctagcttgttgagtttttattgtaaagagatgttgaattttatcaaatgctttttctgtatctattgagatgatcatgtagtttttgtccttgattctattgataaatcatgattattgatttgtccatgttgaaccatccttgcatccctgagatatttcccacttgatcatggtgtattatctttttttgacatgctgttggattcacttggctagtattttggtgaggatttttgtcactgtgttcatcagggatattggcctatagtttcctttttttgttgtgttcttgtctggttttggtatcagggtgatgttggcatcatagaatgagttagggataattcttttctcttcagttttctggaagcttgaggaaaattggtgttagttattttttataagtttggtagagtggcagcaaagctatccggccctgaactttgctttgttgggagactttattactgattcaatctccttacttgttattggttttctatttaagaaggctggttcttaatagcaaaaatggaagccagaagacagtagcataatagcttaaatttaataatagaaaataactttcaaaccataattccatactcacacaatatttctcaagtattaggacaaaattaagagatttttagaaaaacccaaatttgagcatttaataatagacctttatcagaagaaaattcaaggaagaattttaggaagaaagagaagtttccagataggtaaaaaagaatgataaacacagacactggtaaatgtgtggatatcgataagctaacattaaccctataaaataatgatattaataagtctgtatttatggaggcaaaacaaaataggcccaaaatactgaacagaaatagcatataagttattagtgttatgattagcaaaaacatattctatccttctagtattgtttgggaggaaggtaaggatattgattaactttagtctttataagaatatgcatcttaaaacatctgggggtaaaacaggaaggatagagaaagagaagaacaatcagtagatcagtagaaacccacactcagtaatctacaatagggatctgtagaaaattaagatggtaaaaataaattgaaacttacctttaatcccaacaaaggtaaatggaccacaattcaggtacaaggtaaagaatgtcagattgaatttaaataaaattatgccattaaatgagacataaggatacaaaaaaggtgcaaagtcaaaggatagaaaagctggtaacttcaaaataattaaagatagactttactggaaagttataacaattctaaacttgtatgtatctaataacacagtatcacaatattttaagcaaaacgacaaatctaggagaaagtgacaaatccatcattatagtacaaaattttaacacattgctctcagtaagttttggattaagcagacaaaaatcaatgggatataggagatttgaacagcgcaattagcatgcattgtataaagaacttacaggaacagttggagaatatgcatcttttgctggtacataagaaatattgataaaattatccacatgctagatcacaaatctagcttttacaaattttggaaattcagtaccatatagaacatattctctgacaacaatccaattgtgagatataaatatctaaaactaaaaaaatcctctgtatcattcagtactcaaatcaaaaaatcaccatagctattttgagcagaaaaggtcttcatactaggaatcaggtgattacaaaactgttggaaggcatggataattgaactttaggtggggtttatggagatggtacccagaacaatatcccaagggcactgccctggactctgccagggtgggagggtgggaaccagggcactgtgcaggtttcctgtggcagctgtcgtgccactgggaactgttgagttgaacaggccactggaccgtgatccaggcatctcagtctgtttgggctgctatcacaaagtacattatattgggcaatttataaacaatataaatttgttgctcacagttctggaggctgggaaacccaaggtcaaagcaccagaagaatgtgtgtctggtgagggcctgtttcataagtggcgccttcacattgtgtcctcatatggtggaaccctcttttctttttacttctttttctttttttttttttgagatgggggtctcactctattgcctgggctggagtgtgctggcatgatcacagctcactgcagcctcaacctcctggactcaagctatcttcccacctccacctcccaagtagctgggactacaggagcacactaccacgcccagctaatttttctattttgtaaagacaggattttactgtgttgcccaggctggtttcgaactcctgggctcaagtaatcctcctgcctcagcctcccaaagtgctgggattacaggtgtgagctgctgcgcctggcaagccttttttaagggcactaatcccatctgtgagggtggagtccttatggcatagtcacctcccaaagactcccacctcttaacacttgctttagaggatagatatcaggggatatgaacattcggatgtgaacattcaggtcatagcccagggatcaggaagcagcccctgctgccatcacagctgccacatacccacaaagccagtgcctgaacatgagaactctgagttcagtgctgccaccatcaaaaccaactcttaaaaaacccagagagactagacacaggagtgctatggaagaaaaacaaaacattccatgaccttgcctgtcagcaggaagagggcatttacttctgttcctcctttcaaatcatgtgtaggtgtgttgaatggaggaacctaattcacattcagaactgtagctgcaagggagtctgacatatgaagtttttcactttttggactctgtagtacttctgtagtgtataaagaggtttgtagaaagaggataaatgccagtttaccaaatccatcacccctcatgggtcaaaggaaaaaattctgatgtaaatattttaaaaattgaacaataaaatacaacatatcaaaacttgtgaggtacagctaaaatgacacccagaaatggatagtttaagtggttatatcagaaaagaaaggctccacatcaatgagctaagattccaacttaaaaaatgtaagaataaacctggtgtatcattcccaaagaaaaagagcagtttagaaataataagagcacaatattgacatagaaaagaaagacacagtagagaagatcaacaaaaccaagaactggttcatagaaaaatagcaataaaatagacttcaggcaaaattatcccataaaaaagagaaaagatgtaaataacaatgataggaatgaaaagggaaataaaacaacagatgctgcagacattatgatagtaaaaggaaattatgaacaactttttgcagataaattggaaggcttagattaaattattatgttcttagaaaaatataactaaattaaattaagaataagtagaaaaatgaatagttttatgatattaaccaaattggatcagttgttaatatcatcccttgaagacaccaagttcagaaggttttataggtgactttcaccaaacttaaaaagagtaggtaattctgcttataagcaaaccctttcagggaacttattttgagaagagctggatttttaatagaatcttatttttaaatgttggcaattatttaaacatttttgtcagtgcaggcaaaacaaaatatgtctgcaggatggtttcagcccacagtctgacggtatgcaacccctgatctaaaccttacaaaggagagctgatccaaatcatagtgcaattaaactgaatgatttaggtctaacattaagaaaatttgctgatggaattatgagacactgataagcatttccagaggtggttgtggaaataggctctgaaggctaaaaattatagctgactgaagtactcctaataagactcacgtgcagtcttgcctggaggcagagggatggaccagatgatctttctgggttgtttcacggactcttctggtctttataataaatgcagttttctcaatgcatcccttctgtgttaccatctgatccaatagtaaacagtgatttgatgcttcctccagacaatcttgcttcaggaaaaaagggttagaatatttaggcccaatttggggctgagaatctttcacagcatacaattacttacatgtctttgattaggagagttaatatagtgtagtgattaatagcacagactttggatccaaattcttttaatttgatcttgcttctgtcacttcatagctatatggcttttccttgcctttgtttcctcaatggtgaaatgggaataagacgggatccctgttttaaaggcattcacactctagttgtgggagacgacaaaaaaaaaaaagtgctgggggtggtggctcacatctgtactcccagcactttgggagactgagatgggaggattgcttgagcccaggagtttgagatcaacctgggtaacattacaaaaccccatctctacaaaaaatacaaaaattagccaggcatagtggtgtgtgcctatagtcccagctatttgggaggctgaggtgggagaatagcttgagccctgaagcgagaggaggctgaggctgcagtgagccaagactgcatcattgcattccagcctgggcaacagcaaaactccatctcaaaaaaaaaaaaaaaaaaaagatgcatagtatgtatcagctagcagacactatttccccatccttgaatctggccttggccatgtgattggtgtggctaatagcatggggcagaagtgctggtcctctagtcctgagtctgagtctcaagtgctggtgtgtttccacttgctttcttgcacttctgttattgctatgactaatttgctaatccccggggaatggaaagatagatggagccgagctacattcagcctagattattcaatccctagctgcttacagaagtatgaatgagcccaacagagaccagcagaactgcccagccctgcctagactagccacctccccagctgactggcagatgaaggagaattaacaaattcctgttattttaagccatggagttctgggtgtttttttacacagccatagctcactgacataaacagctgagatttatcaaggtctactttgtgcccaggactcttcattttcacagcagtcgtggggtaggtacggggcatgctaacttaattaaaatgtaattaatggaaatttgatatagtgcaataaagatattaataaaatcgtgctttgtgtgcaaagtttgaaatgaggcaaatttgtattatacatctcacctcctcccatcgctcccccacccccaaccaaatcttgtcaaacatcatggaacatcaaggttacatgactggttgtaaccaaggctgactggctgagtgtgttgtaaatggtgcctgcttgacagcagaaatgtttgatattctttgtctggattagcttaaattactgcattttgtataatgagaagtctacattgaatttgtcatataaaaaggacaactactttggactatcattattagctccaatgaacagatgagggaagtgagacgtagagaggttaagatcatgtggtcagtaaatgggtactgccttctaggatgatggacaatgccagaagttagataaatgccaaatgcctaaaatcatttttcctcatcacaggacacagttcagcagtatctagttgctgcagggtatttgacttcaggctgagagggtcagtccaggtttaccagaccatgcgccctttgctttctctcttcagattctagaatttctagtgattcaggtgttgattttgcatattctccctggtctttgatattttcaaccttgtatttaacactactagtaatgtgattgttctctgctccctgtgtccatgacttttaagcatttcctactttattaatgtgctttgctaatttggattaaattttaaaaaatcatccatctctgtcttttccctttttttcagcggtgttctcacctctgccctcaggctcatagaaacaccaacatggcacatgtatacatatgtaacaaacctgtacattgtgcacacgtaccctagaacttaaagtataattaaaaaaaaaaaaacaaaaacaaaaaaaacaaagaaaaaaagaaactgggcctaaatgggagttaggtcattcccatgcccttagtgggctttcttggctctggaataaattcctggccctttattgccctctagtggcctcctgaattactgcttcatgtatgtgacgtgtttaatccactgttttgaccattttgaaaggatatagttcataacagcatttcatctctcactggatccagtctccttcatgatactaagttatgtgtttgaggaaagcttagacatttaaagatttgaggcaaattgataaaagttatttcagagaatcccaggaaagttctgctctaacattttgacctccagttgagccccgtgctaacagatacttttcctctcagcgttaatgagaagccagtgaataagtcagtcaacaaacatttactgagcacctgtcaagtaccacacactcttttagatgctgggacctaggcggaagaaagtgtgtcaagctcttgcgttgcttttcaaaaactattctgctattatcattttaaaaagctaacaaccagcccactcactttacatgacttacctgaagaggaaaagttcatgttgctttctctaacccccagtgaatctacatcactttttatagtcctggcttggttagttgtaatacgatcagataagtcaccaataatgggttaaattatggtaaccaaatttttcataacaaatgtacaatgagcaaattcaattttctacagcaaatagtaaaacaagtgtcatagtctctgggttaaggttatgtaacagtaaaccatggcagctaaaatagaatttcgcaagaattcttgtggcaaatgaagcacccagttttatgatctggcttgaaagggcttttactccaacttggctaaaattcatctttttggtttctttgagactagctgggcttgctattctcaaagcatttgtggtgatagtatttttatttttttaaagtttcttaatgaccatttttggaacatgtagcttctgatttcaagtataatcttaaggctgaaaaaagtcctgcagtttatagctttctatttttacatgtaatgctgatggccaaagctgctgctgtttaggagcttgccttcttgtaggggagagagcctgtgatcgggtaagtaagtaagcccagaggagcaatgcctgggttaaaagtcagactgggctaaatgtcatagttctctctggctctatccctagatatttgggcttccaaggagaatattcaaaacacgacttaatttaacacctgctgtggtactgcaccagctattaaatcttcacagggtctattgtccctgactggcttcacctggccctgggccctggtgggattggaaatgtcctcctgaccggtgttagtcggggggtcacttcctcatgctatgctgaaggcatgcgacctcccctccaggagtcagtgcttagcacaagtctccttctaaaaggtcagtgccttttgaggagtttccctctgtctgtgtggaagagggtgtagggggagtttttggagataccgaacagctactttaggtagtctccctctctcaggcccctcccatgaagagctccatgcagtgaagccagtccaggttttgtggttgatatgttttggctctatgtccccacccaaatctcatgttcaattgtaattctcagtgttagaggtggggccgggtgggaggtgatgggatcatgggggtgtttcttatgaatggtttagcaccatcctcttggtactgtcgtaatgatagtgagttcttgtagtatctggttgtttaaaggtatgtggcacctcctgccttgctctctcttgctcctgcttctgtcatgagaaatgccagcccccccttcaccttctgccatgatcagaagcttcctgaggcctccccagaagcagaaacctctatgcttcctgtacagcctgcagaaccatgagccaattaaaccacttttcttataaattacccagtctcaagtatttctttatagcaatgcgataatggactattagtctggtggggcctgaaggttgacgtaattgtgtgtatgtgagtggtctgtaagcgagagagcacaaaatttggaataaaaactagatacaaaaaggaacatttatttagaatgagaaagatgtcatcagaaattaaattttttaagctaacgaatgctagaaatgtcacaaaattgggttgcctttcttggtggctaggaggaatggacttgaaagagagggatggcggttggagaattagcaatgccagagaaaggtgagagttctagaggccccatgagtgagccaggggcctaagagtggctgtgagaagaacaagttcccttcagcttttggagcactggtcctcaaccggcaggagcatcagctggaaactggttcaaaatgcagattctaggtcctcaccccagaccaattgaatcagaaactcagggatggggtccagccatctgtttcaacaagcccccagatgatttggaagcatactcaagtttgacaacccctgatggtagaggagagtggaaccctgttgtgcatgtgagcatctcctattaaaaatataattactggccaggcgtggtggctgatacctgtaatctcaacactttgggaggccaaggtgggaggatcacttaagcccaggagtgcaagatcagcctgggcagcatagaccctgtttctacaaaaaagaaaaaaaattagctggatatggtggggcacacctgtggtcccagctactcaggagactgaggtgggagaatggcttgagcctaggaggtcgaggctacagcaagccgagatcgtgccactgcactcgagcctgggcaacagaatgagaccttgtctcaaaagagtggctgaatttttttttttaaataatgtattttatgaggtgagtgtagtggtgccctcagctgaggtaggaggctgaggtaggagaatcgtttgagcccaggagtttgtggctgcaatgtgctgtgattgcacccatgaatagccactgcactctagcctgggcaatgtagtaagagccggtgtttaaaaatatatctagatacacacacacacacacacacacacacacacacacatatttaggcaatacacacacagatgatatctttcataaagcaaaccaactcatacagcttttatgtcatggttgagtgtctgagagataagtgataccatccaccgtgattgggtgctaaagagaatacattttaaggctgggtgtagaagggaaaattctcaaatctcagtattctccacagtatagtttattagccagagacacatggtaggttgtttttctgctaaatttatgcaagtgattgttaaaattttgcatcatttacaaacaaccaaaaccacaacaacatcgaattcagggtagaaatttattttattgtttgccattaactgagctaacttatttttcttttaactttccattttttccagcttttccttctgtgttcatggttggggtgttaatagcatgtctaaactaattgcactcctgatggtctaattctagttactgtcatttttggcaggaaaattttgagtttggcatgctctcacactgcacacaggcatgctaaattagctgagaagaatctgagaatgctagatttttataaccaggcagaataagtccaaaaataccatcaaggattgtacagaacagttaagaattctgcttggtaggcactgggcatagagctgccaaaacaacaaaacaaaacaataaaacctaaaaaagaattgcatccactccagggaaagcttgtctgatgaactctcttgccactctggttttattggtgtggaccttcaggatgcgtattaacgttttagtgaagaggtctttgggctacacatgacatgacagaaacccaacttgaactgattcttacaaagagagaatatatcacctctcataactgagaagactaggaggaatcaggcttcaggcatggctgcctccaggggctcaaatgatactgtgttaggcagtctctcaaatggctctcaatgatcctggcctcctggtactcacgccctgtgtaatcccctccccttgagtgtagttggacctaagatctgcttctaacaaatagaatacaataaaaatgatgggatgtcgtttctgagattagcttgcagagggactgtgacctgggccttgcgtgccattgcttgctcttctcatagagccctccacttgcaggaatcaaattgtcatgttgggagtagtcctatggagaggccccggtggcaagaaactgaggtctccagctctcagcaagaacccgaggcctgctaacacccacgtgagtgagctcagactcaggtgtgctctgaaacctgctgccaggtgagtgcagttcttcccacagggagccctgagatgaccgccgcctccggggagaccttgaatcagaaccgcccagctaagctactcctgcatttctgacccacagcacaggtgagatagtaaacgtgttgctttaagtggcttctttttgggggtaattcatcagtcacgctcggtaaccagtaccgatgccatctacacgtcgtcttctctccatcttccccagagctttcctctatgtggccttcatgaccaggcagagatggcaaaacagtggccgggaactccagactcatggcctagctccctccaatagtggctttctcctttgcagtagataaggaaaaattcctgggatcgagtctcatgaaactgacttgggttgctttctgctggagcccttagcattgatttttctttgtgctgttccctctgtcagtttggaaatgtgaaagattgtaacaggaaagttccatgtcagtctttgtggcctccctgctttcagcctccctgagttctagcctaggccaaaagtgacactggagtttcttctcctttttttttttccccccattggtgaagctcgacaaaaatcaaggtgatgggacagagaaggtacagacagatgaggcagtggtaggtgcctctgccgctaaagagtgctatcgtcaatttatttattgactgttaatagttactagtgactactaaagtgttcagttttaatttttattttctatctttatgaccaagcattgattagtttctataagcctcctgggcccagtgattggctcaactgctgaaattataccatatagttatataaacatgtaccaagcgttgaatggctgctgctgagctctgttcccaatggggatcacggctgcagcattcatcctgagttttgccttcccacttctagctgggagtggaggaacatcacatgtaaaggccagggctatagatttagggacctgggtttgagtcctggttagagtgttgccttggcctttctgagctgtagtccctttttatgtaaaacgaggattttagtgcctgcctcatagagctgttgtaactattaaatgacacaaaacttatgctgttgtttatatttacttattcctggagcaaactaaatgttttatacattgtccatagaaataatgttttaatgtccctcttaaaatgcagaaaccggctgggcacagtggctcacgcctgtaatcccagcactttgggaggccgaggcaggcagatcacaagggcaagagatcaagaccagcctggccaacatggtgaaaccctgtctctactaaaaatacgaaaattagctgggtgtggtgtcacgcgctgtagtcccagctactcaggaggctgaggcaggagaattgcttgaatccgggaggcagaggttgcagtgagccaagatcgcgccactgcactccagcatggtgaccgtctccaaaaaaaaaaaaaggcagaaaccaaatctgaacagacacctcatgtaatgatgtaattacttcaacaacttctgaactcttctaatgacatagcttagtctgtatagatttttatttttacttttggtagacacatatattgttgacttaaattgatcttttaatgagtgaaaaaccctcccagttcttttttacatggactgttgacaaacctcatatctctgactctgcacttgtcccagtgaatatttgtactcaaacacttggcttcacattgatgcctttgacactcgttttgttgtttgtggacatattcattttatctgcccggtctttttgaattttttttgcctttgcccagtagattggttggatgtgcactatgctggatgaataatttgaccatttgatgaccaggccatccatcttgtcagttgagacattgcaagagtctagtctagagacccttggcacaccagtagagaccccttttggctcacacttgctggataatcaatctgtacttcctttttttagccagctatggatgctcctaatcgttctaatcttcaacccacatagctctatattccccacctggatgccatgaaagccttttctaaatgcttttttaaaattcacagcctatatctacattattataattatcataaaaagaaaacaggctggaagcagtggctcacatctgtaatacttgcattttgggaggccaaggagggcagatcgtttgaggtcaggagttcaggaccagtctggccaacatagtgaaaccccatctctactaaaaatacaagaattagctgggcatggtggtgcatgcctgtaatcccagctacttgggaggctgaggcaggagaatcagttgaactcaggaggtggaggttgcagtgagctgagatcactccattgcactccagcccgggcgacagagggaaactctgtctccaaaagaaaaaagaaaacaaaaggtccttctatatcattagctgtccctttgttgagcagaagtttcaagacgcagtttcctttactacttgcgaatgatgctattgctaccacggaagagtttctgcttttccacatttttgccagtacttggtatgatcagattttttaaatgaatttttctgagggtggaatgctatcttactgtttttgtaattagaaattcctactcactagtgaagaagagcatgttttatattcattgacaatttgagttttctttgatgacttgcctgtttatattctttgctcatttttttgaattttcattttaaacttaatatatcttgatatttctagatatgtgcacatatagagtgctagtattttgtttttaacaactgcagaatgttacattttatggatatagtatgatttatttaaccatattcttctgatatttagtttttttcctagtttttgtttcctactataaacattgccttacttgatatcatttggctagtatatccacagataaggttccattccaggaggaaattgtagattgtttttaaagtttgtgcattttatattttaagcgatattattaaacagctttccaaaaatgttgcaccaatttacaccctttccccaacaggtatctcatctgttgtgacgatgtgtcaggacagggctatctgtgttcttcaactgactaggccatttgtacaacatgcccttggcattgtcttcacttgtctctctctcttttttttttttccccaagagagctctctccatggtacaatcatcctctcttgcccagctttccacaggattctgggggagactgtattttcatttagcaagcatttgctctccctctcccatacccccgccacccctttatgggaagaacatattatcccactgatgttgggttggccatgtgacttccttcagacatcagagtgcaagtgaatgaggcatgagcagaggctttacgtgtgcttgtatggcttagcttccctcctgtgccactgccattttccatgagaagagcatgccccaggtggttctggttcagaatgagagacacagggagcctgacccacagcctaaagcagtcacaccagccaacccactgatccgtgagtgagaaatacatgcttttattgtacttgccgagatttttgggtttgggttgttacatggcatgattgcaacaattgctgactaataca

SEQ ID NO: 23 - DNA, 195364 bp, Homo sapiens
gcttacctaagtacctagaagacaaagtaagaataagtgcatgaagaaaagcgtgatgaccataaactaagtacagaactaaaaacaagatctatggcaggttaatttcaaaatgcactcatgaaataaaatattaaatgctgacgtgccatgcctgccttcaaaaaccagcctctggggacctgccactgctgaggccactgagctgaatcagaaaagtcacaggcacttgcttaagtgggagaggaaggtggcgatgcctgggctctggagtaagaggcctggggccagagcagtcacatggccagtggtagcggccgggagccttgtgggccactgggctgttactttggaggaggggacggcgggccctcctgtgtgagcttagctctcagacatctacatggactgtcactcatttgcctactcaacaacatctgtgcaggctgccaggtactgttcccagcgctgccaatactgcagagaacaaagctgacctggttgccccacggggcttggatgctcccaggaaagtcacaagataaacaggtgcataactgcacatgtggctatgatcttaggcactgctaaatgctgcaaggagatgctttttgactccttgtcaccttctccaaggccatgtctggtttcagtggtagtgggcgtagccacttgggtacaccatgacatcctgccacgtctagctgctcaacctcacagaggcacagcctggagtgcagaaaccctaaagcccctaaaggacccctcaaccaatgggggataagagtcggtggctacgtgcccccgcctcccagggctgcaccctccatgttcctcttagggtccctgagggattctgtcccaggtgcccacagcagtaactgtaggattctgtcccaggcgcctacagcccataagaagtagagctgaaatttgaacccaggcattacgggttctcttctataagcaagagacaaaggagtggacagccagcacgtgctgggaaaagcctatgacccaggattcagcccatgacttgggcccactcaagggagcaacacacccatgggggaaagagattggcagccatctaaccatgaaggatggggattccccgccaaggataccaccaccaaagggacaaagtccctctctccaggaggacttcgccaaggagttgaagaaacagacatgcacacgaccaccatacgggacaccaacaccacaaagacaaggagggcatccgagcagagggaacattcacaccgggccttgacgggtgtgtaggagtcctccaggaaggcgaaacagatgaagacagtgcaggcagagggaagagagtccacaggcctagggaagcgggaaggcaggccagcgcggcacaggggaagagctgagagcctcggacacagatctggattcaaagtgcagttcttcccaactgcagcatctccagcaagcgactctggctctccaaggaaaatgtcaggttcctcctcagtgaagtggggataatttctacttgtgggtgtcactctgctcattactccctcagagagaagataaattagataaactaacacacgcagagctcctacgtagggcctgggacttgggcatccctaaggtcagcatcgtgtgtgttggggacacacactggaggggtcggctggccagcacctgtcataaagggcaccccatgtcatgtctgagcgtttggaccttatggagaaaaggtgttggaagtgggaggcgggggagcaatctgacctgaaggttagaaagccacccctagcctggactgcaagctcactggggtcagggaaaggactcaactcagtacttggcaaagggcttggggcatagtagatgctcgagaaatgtcccggagaagacaaggtcatgatcaagggtggagccctaagaaacgcctagacttatcgggcaggaagcagaagcagcagcagaaggaagtgagaatgacaggagagagacataaaaggagaactaggcaagtctagccacgcagaagcagaagcacaagcgagggggactatcttttcaggaggtgctggccactggcaaatgctggagggaggtaaagtggatcagagacaaagaaatgaccactaaatctggcaactggaatatttaccaaagacctagacatagagctccatgctctgggtgtgggtgggcaccagaatgaaatggggtaaagaaaggatgggagacaaggaggtatttataacacctataaaatctgtaagggatgctttcaaaaagtttgcattaacttctgaatattttcaagggacaaaaacccaattcacctagtgtttagggaatgctttttttgaacttgagacactgtacttaccaggaagatacacatctatcatccttcatcattttctgtttgtggtgacacagccacaaacagaaaagaaagcacaaacatcaccatgcagtagactgaaagagctaccacaaagcccacgcccctgtggacacacaaaaaagctatgcagcgtggctcagggcctcccagcaacagatctgtgggcaaagaaggcaatgggagactggatagtgcagaaaattacaaaggtaatgttttcgcagcccttcagggtaccacttaaaaacaaaaacccagccgggcggggtggctcacgcctgtaattccaacactttgagaggccaaggcaagtggatcgcttgagcccaggagttcgagacctgcctggacaacatagtgaaaccctgtctctacaaaagatacaaaaatgagccaggcgtggtagcaggcgcctgtagtccctgctactggagacgctgaggtaggagaatcgcctgagctgggaggcagaggttgcagtgagccaagatcgtgccactgcactccagactgggtgacagggcacgaccttgtctcaaaaattaaattaaattaaaaacccaacattgtttctggagcaaagtaggaacccaataaaatgtttgtcgcatgcattaacggacagactgttcagcactttataactgcccaaagccctgtcacagatttggagcttctttttgatgtcacattcccttagaccttaggaaagaaagcaatttctctccttcccttctcgcccaaatttctgaaacccgggtgtgtatgttcagctagggaaaaaatattcaggtgcaaaacagcacgataaatagactgccggctctctgtgtgttgtattgccatatacgcagaggtcatggacagcaagtgaatttgactccttcgcattccagctcccttcttttggtcgctatactccagttttccgtaggaaccacctctctgccactctcagtctctgtcatccaggtagggctgatgccacctccaagaggcatcccctaggcctgcactaaggccagtcagtcttcctggaggcatagcaggccagaaaatggggctgtgagacaggagagtgcagaggcaaggaaggcctccttcaatcctttcttcaacatctatgccaagtggttagtcggactctcctgacatacctcctgtgatgggggcctcactttctcctctggtagcccgttctaccttaagggcctcttcctctccaggtcaacccaaaatctatctgatatggtttggctctgggttcccacccaaatctcaccttgaattgtaataagtgtcaagggcaggacggggtggagataattgactcaggggggcagtttcccccatactgttttggtgatagttctcacaaaactgatggttttataaggggcttcccccttcacttggctctcagtctgtctcctgctgccacgtaaagaaggatgtgtttgcttccccttttgccatgattgtaagtttcctgaggcctccccagccatgcaaaactgtgagccaattaaacctcttttctttataaattacccagtcacgggtatttcttcatagcagcgtgagaagagactaacacactatccctgaattcctactgcgtggtcccatttaccacatagggttggtgtgggggtaggaacacaagaagtccacacttaccacatgacagcccctcaaacatctgaagacaacactggtgtctcccaaggatctctcctcttggtctcacaaggttaaatatgcccaatttcctcagtcagttctcacatgagaggctttaaattccttgtccagcctggattctcctctcctctgagactgtgtccagctgcctaacctggagactatggccaggactcttttagatggaaactaaatccagaacccactcacactggcctgagaaaaaatattacttggctcatgaaagtgaaccgtctaaagagaaagcttcaggcatggctggatcccagagttttctggcacgtcacctgtctccactcccaccaccaggctctgttcctgagttctcagacaggtactctctataaatggtagacatgccctgtgagctccaagccctcattattcttatttgttttaatcccagagaaagataaaaagactctttaccaacaactctgtccaaagtctcagggatgaatctgattggctagatttgagtcacaagggcccttgaaccaatcggttagcagaagagtggcttgctctgattggacaggtctgggttatgtgcactctcacaggaactacattggttgaccaggattattatgaaatggaagggagaggttcccccaaaggagggaatgctggacagaaaaaaaaacatcaatctctacatctctctctgtggtgttttgggttaaacactactggctgaccagagcctcatgggaatatcatctccacccagaccatcatccaacaaatgtcacagggcacctgcctccaaccaagcatcttcatgatgctgcccttcatgaagaagccttttctggtaaccaccccacatctcaaatttatttcaacctatccattgatatgtaacaccttctgaaggtgctactttaacaataaccacatttattgagctttactctgtgtcaggcagtactctacaagcattatatggaacaagccagtttatccttacagcaacctacatgcaatcattatccccacctttacagacgagaaaacacagaccctgggagatctgcccaaggtcacacagcacagcaaggctatcgttcaaagcaagacgccccagcctcaccactgatgctcttaaccaatcagctctaaaatctgcaccaacagaaaactggactcattcccagatgcctggattccttctaaaataaaactgcttgcaacacataatttgaggtccatggatagaggattgctttaacaatgtcacatttgtatgagagaaactacgtagccatttttaaactggtattgcagaagaagaggggaagatagggaagaaactttggcattacagttgttgtgggaggtggctctaaaatatctatgatccccttttgtagtagaattacatacagaaaactatttcaagaatatagataaaaatgagaccagcggtctgtcctgggagatgacaataaaatgtcagctccacgaggacaggcgccttttctgcttctgtatttatcctcagtgcctacagtcgtgccccacagagtagcagtcccatatgtcgaatgaattaaatgaataaacaggagaatgaaggaataaacacaggaaggaacaagttcctgagtgtttgcaaaactatatctgaactatatctacttggtattctcttcttttggtttagtcttgctttatgagtatgccacagagaatatgtattatctgaatggtgcagaaacaaaatgtgatttcacagacagccccagccactgcctcgccacacatacgtgatctgtaagccctttctgctgtggccaggtagatcatacaaccggtctggcaaatggcccctttccctccacctctgccagctgagccctgattgctccaggctcccagtggctctgtcaggtgaacctgtgaccctccagcccagctcagcacccatttccttcccatcatctctcccccttccatcttcttggtgctcttgaacgctacttccacatcacttgaattccaaaaacaaaaatggcaatcgcagtaattgacatttatggagtgctcactatgtcccaagcagcataaggacttgcttccttaatcctcctaatgaccacactgtagcaggttaccagatgggtaactcacctgctccagagcacatgaatggcaggtatttgaacccaggcaatcggacaaaacccaaaccttgaactactgagctaagcacctctcatcatgctccttcatgcagacccgggccaagggtctaatgcgtgtccacatggggccaaatgcctattgcataccagcctgggccaggtgcctactttgtgctgagtggggacgtgtactgaaagcttccgagtggaaagcataatgcctctacgagtgctatcagagtaaaaataattatttgaggccgggcgcggtggctcacgcctgtaatcccagcattttgggaggctgaggcaggtggatcacctgaggtcaggagtttgagaccagcctggccaacatggtgaaaccccgtctctactaaaaatacaaaaacttgccgtgtgtggtggcacatgcctgtagtcccagctacttgggaggctgaggcaggagaatctcttgaccccgggaggcagaggctgcactccagcctgggcgacagagaaaaactttgtctcaaaaaaaagaaaagcagtggtaggggtagccaacacacaccgtggcctgtgctctcattttaggtgcattacttcagtgaaccctcccagtcaccctcagaggtaggcatgtcaggattcccattttacagacctaaaaactgaggcacagagggagggaggcacttgcccaaggccacacacacaatgagtgagaagcagagcggagatgtcaatctagaatgactctttctttctttctttctttcttttttttttttgagatagagtctcactctgctgcccaggctagagtacaacagcgcgatctcggctcactgcaacctctgcctcctgggttcaagtgattctcccgcctcagtctccgagtagctgggattataggcgccggccaccatgcctggctaatttttgtatttttagtagagacagggtttcactgtgttggccaggctggtctcgaactcctgacctcaagtgatccacctgccttggcctcccaaagtgccgggattacaggcatgagccacggcgcccggactagagtgtttctgattccaaagtgtactcagagttgaaatgaagaaggaatcacactaagctaggtgggtggctgagtcctaaatgagttgagatggggaagaggaataccgcatggtagaaacctccaaaatcaaaagcaccaagacgggaaatgttacagtgttgggctgcagatgtgtgagggagggtgtgtggagctactagagaggagatatgggtggggacaaaccgactagaaagccaagcagacagcatgagtgtaatccaatggggcagaagggagccatagaaggttaatgagcagaggagtgacttgattagaaatgtactgtagaaagaattaccccagcaagggaggacagagtggataccagacaaggaagattaagggcaaatagactgttgctatgaagaggaaagcagagatgttaaggggcaaatggacacttttgtgaaagtggcatgccattcttccctaggaagccacctcctcaagtcagtctcctggtttgagtggggctgccccgccccccacccactccagaggtgggcatgtgatccaggcctggccacgcagagtctccatgattggtctagggatgggcacatgacctcagggccaaagacagtccagggacccccaaaatcactggcaaagaggcttgctccgtctttccaccaagatggctctgcccaggggctaaacctcccccctccccgcaagaatggaggtgaaggatgaagacagagctaggaggaggaggagaggctgtttggagttcgggcagtctttgctgctgctaggacttcccctggagtttccaggctagaggccacagtggattttctgcttacattaatctgcactgggcatttctcaccgccctcgcaaggtctctgaccatcccaggcgaactgagctatggagcaagaagcaagagcggaggtagcggaggggcaggcagcgaggaaggccgggagccaggcaagctcgggaagaagcagcgcagacccagagcaggcagaaagattgggaggatgagtgcgggggtgggagggaactggcctggcagcacagacaccccgtggccctctggaaaacagctctgagggaggaaaggccaggccaggaggctgggaagaaatgaggaggggaggctgggtggagagatcccattctggaaagccgtgggggaggaaggggagaagggacagtagcctgaggtgggagggccagggaagggggtgtttcagagagaatgcctgagtgccagagtggggagggttgggagaagagcaggaccccaggaaggcccacaccctgaggttataaggaagaaactgggtgctgtttctggccttccaagtctgctggccaccttgtgagatgtttggaagcaggaagcccgaaccagagtggaacctttcttctcaggcctgtcaggatacctggcagggaactggggccacaaaagagccctctctgagtcacaagtgggcaaccatgtcatttgcaacctgcaagcaatcccacgagaggtgagaatctaaacaacctcctcagaagccaagagcacctgccccgagccagcctgcctgggttcaagtcccaactctgccactttctagctgggtgaatgcaggaagcctattaacctctctgggcctccgtttcctcatctgtagaataggagtaaccttagtacctgccacaccaggctgttctgaggtatgaccaagataaggcacgtcgagcgtggtgactgctatccagccagtgccagtgttgagtccattgtccctgggttatgaggacacgacgacaggaaggaacaagcgtttccgagaggaacaagagcagacacggcaaccataattctcctatgcatttgtccaacagatggctggggaaagaaagcactgcagctgaagctcccatggcccattcatgaggatccacacacagcagggaagcatttttagcttcctcgccagacacgcgccactccccactcccatccctggggggcaggaggtgggtctgagcagaaaaccacaagcctgtgggaggagggaagtgttctcccactacaccagagtgggctgaggcctgggagcacctgccaggagcctcctgatgggatggatgctcttttcctcatccccttctacttgctggagagaacagtagcttcagaggcagaacatggtttgatgggggaagggagggatgggtgaccagcgggaggaaagaagctgaatttagggagggaagctggtctgtaaagcatagcctcagagccggcaaagcagaaatactgctgactctcctggctgttcacggaccggaggggagaaagttaagagtttgcacttactccacttgcaaaagcattcaactacagaggcggagggacggaggcctgggttcaaatcctgccctgccaactctccacatcgttgcagtgctttatgctgcgattttaggccaactgtttacaaaagcaatgaatgaatgtctacaggcagcgctcaaggagtaattttagttttgtgtgtgtgtgtgtgtgtgtgtgcgcgcacgcgggttctcagtatcacccatcctctagtagtcacaccacaaataccctttgaattgaactaaatgcaaaatataatttgattatggaagcagttaaggaaagaaacacccacatgatccctggcacaattttgtactttttatttatttcgcaaacaatcatgtagcttgtacaggcactgttctgagcattttatacatactgactcacttatcctcgcaacagcactgtgagagtgcaggtgaggaaaccaagacccccagagattaaggaactcgttccaaaccacacagccaggaagcagccgttcagggattcgaacccacaccgtcggccgggcgcagtggctcacgcctgtaatcccagcactttgagaggccaaggtgggcagatcacctaaggtcagaagttagagaccagcctggccaaaatggtgaaaaccccatctctactaaaattacaaaaaattagccaggcgtggtcgtgggcgcctgtaatcccagctactcaggaggctgaggcaggagaatctcttgaacccgggagacggaggttgcagttagctgagattgtaccactgcactccagcctgggcaaaagaggaagattctgtctcaaaaataaataaataaataaataaataaataagtaacccacaccgtctggctcagggtccacgccgtaacctccgggctgtgctgccgttgtccgaaagcttgcttccaactaaagaccagagatgggagggagtcgcattctccaatctctttaaaaggtcccattaccaacatcacagagcctctgccactaccgaagggtttatggcgatgcctgccacgtggtctttcttttcatggttcacaagccacagggaagtgcctaaggcacacaaatcttaagtatacagtctgatgatttttcacgcgggtacacacctgcataaccccctcccagatcaacaaatgtctacagagacattttcagctcccagcagtccgggtggtgtgcccctccccatcagtggctatctagccccaaaagctaatctcgattctgacattcacaccatagattagtttcgccttgtctaggatttctaaatggaatcatatggtgtgtactcttttgcatctgattctactcgtcaaattaaaaatcacataaaatcagcacacgggcagacaatgatagcgggagaaaggagggcgcggctgagtttctttcccttccaagcagccccctagcctgttcgtatttgggctcagtgactgatcaaaggggacagtgggaagagctggatggacactggagtttggaaacacaggagttgaccttagaaaaccagtggaccgcagggggcaaaagagctgccccgcctggagaaggcattgtaggatggcggaggcaggtgggtcacttctgttgcttcggatgtccagaggggagaaggttttatgaggccttaaaacgctcacaccgggttcctcccacgccatgcgccaggggcaccccatgtggccaccggttcctcccgggttcgctctggccggggctccccgggtgcagacaacctcccaacgaccgcgcatccgcccggcaggcgcgcctccctacctgtgcactgctggatgaagtgctggtactccgctccctgctcgccggggacgatggtggagccgtcatatttaaaagtcaccctttgggttgggagaagaaaaaaacacacacacacatcagcgctggtggccgcgcgacgcggcgcttgcagaggacaatctaacagacgcgctggccacggagaagcccgcgggggcctggcacgccgtcccggaataaggcgaggaagacagcgcgggaggcccgaatccgtcccgcctggaggccggctcggtgcacgaggccccgcgcgagcccggggagcggggcgtggagacgaatgaaaagttcctaccagatgacggccgagccgtcgtcgcgcaccaggttgtacgccgcccggcaagcctctttgtcgatcttggtggccatcgccgcggagccgcagcgggacactgtccggggcggccgagcgcgcccctggccggcggcggggatgggagcgcggcgggtacgcgccgagggcgcacgggctggcggcggtggcgacggctacgcggcgcctgcaagctgcgagcgcggcggcggcttccactgcggacggagagcgcgcggggaccccaggccgtggcccgccccgcccccccgcgcccattggccgcccaggcggcggcccgcctcttcattggccgtcgggctgcgggggcggagcgtcttgattctctggcggccaatcccagaccggaaggcttgcgcaactccgcggtgggggctggagtaggggctttgcctcctccctctcactctccctcctccctcccgctctcttctcccccaacatccctcttctctctccttctccttctcacttcccctcctcccctcccgacccctccctggaaactcccactaccccaaccccctttcccaccccgccttcctcctctccctcctccttcctcttcttcccccactgcttgcttcccccacttccctgacctcttccccctcccttccctccccctctttctcccttccccctttattcttcttcctctctcctcctccctcttcttgcctatcccagcccaaaacttctccatcctccctatttccttctccccaagctctcctctttcctcctccttgaccccctcccctgctgcccccggcttcgcctccctcttctccacttaccctcctggcatctcctccctccctgtcccctactccctcctcctattccccctctcccccttcctcattctccccacccccctgcccctgaggctgcagggctgcagagctccacaggggacctccacgtggatgatgtaatgcgtcaaacccaaggagacaggctggccactgtccctaccccagcgtttggttccatggattctaggtggggaggaactggaaagaatgaagcattttaaataggagggggtagaaagtggactgcttccaaaacgctggtgggctcgcgtttactctggattctggtcatttgcattcctatcttaacctctccctttgggctcctctgaaagcacgagctgactcattctgtcttcctcattccttcactgactcattcattcattccctcatccagccattccacagagaccagttacagcgtccaggtaggtaaaaaggcaggatcctgaagactgggctcttgaattgcatccagtactgccactttccaactgggggccattggaaagcctcaaaacctcttttaaatgactcctcaaatgggaaaaatagtataactgacatcactgctttgttttaagtgtaattgaaatgatacttggaacaaatatactagacattcgataaaatgtcatcattgttggttattaagtgataaaaacaaatcctaaatagaaacccaaaaggtcagggacaatgtccaattaatgttagaattctcaacaagcaaaaaaacaaaaacgagaaattgaatgaatcaatcaatcagtcaatcaatgggtagttgaatgggtgggtggacaggaacacagtttcagaagagtagaggcagatgctgttataaataagacaaaaagaaattcacatttcataccccacaaagccattcctaccttactccttgacaagggtaatgggacaattggccattagaaagaagaacaaaggtggatcctttgatcagggaaaattccaaaaggatcaaaaatttaaacacaaataaaggaaatcagaccagtcgcagtggatcactcctgtaatcccagcattttgggaggctgaagtgggaggatctcataagctcaggagttcgagaccagcctggataacagggggaaagcccatctctactaaaaatacaaaaattagccaggcgtggtggcagacgactgtaatcccagctacttgggaggctgaggcaggagaatcgcttgaacccggggcggggggcagaggttgcagtgagctgagatcgcaccattgcactcgagcttgagcgataaagcgagactctgtctcaaaaaaaggaaatcacaaaagtgccagaagaaaatatggggagcttccttctaaccataaaccatgttacccaaatccaaatccaaaagccattgaaaagatgaatacattcaaacacataaaaagtgatccaggaaaaaaaaaaaaaaacataccataccacctcatgcaaagtgtaaacataaaaagacaaagcagtaaaaagtgtttgcaactcaagtaaagaattagtcttgctaaaatatagagaagtcaaacttaaaaaaaagaaaatgaaaagaacaatgggcacagaatatgaccagacagattaaatgatcttaaacatgcaaaaagatgctcaacctcaactcctagtaagagaaatgcaaattaaagcaaaattgagatacctttaaaaaataaataaataaactagcagtttggtaaaaataaaaaactttgacaagcctactttgctggggaggctgtggaagacccaggtcctcttgtacattgctggtgggagtgtgaattgacacaacccccatggagccgccgtagaggccagttggcaatgtctagcaaatttacaagtctgtgtgcccttgatcaatccatttaccctatagggtcagtggtgcccagccatggctggacatgggaatcaccagggtcccctgatcccacacccagacattctgatataattggtctgagatatgccctgggtatggagatttttttttttttttttgagaaggaatctcactctgttgcccaggctggagtgcaatggcgtgatctcggcttactgcaacctctgcatcccgagtagctggggttacaggtgcgtaccaccacgcctggctaatgtttgtatttttagtagagatggggttggcaggctggtcttgaactcctgacctcgtgatctgcccgcctcggcctcccaaagtgctgagattacaggcatgagacaccgcactcggcatttttttttttttttttaaaggcagggtcttgcctgcctcaaaaaactctgtcacccaggctggagtacagtggtgcaatctcagcacactgcagccttgacctcccaggctcaagcgatcctcccacctcagccactcaagtagctgagactacaggcacgtgccaccacgcctggctaatttttgtatttttttgtagagacaggtttttgccatgttgcccaggctggtctggaactcctgagctcaagtgatctgcccgccttggccttccaaagtgctgggattagagttgtgtgccacccgtatggggatttttgtaaagccccctgagtgatgcttacgttcgactggggctgaaagtcactgctatagataatagatacacttgtatgtgtgcaaaatatatccagggttattcattgagctttacttttaaggcagaaggtgagggctaacctgagtccccatcagtgaggggctagatgaataggtaataacgctggtgaaccatgcacgactatgaagctgtaaaagaaagaaaggatgaggaccctctctagatgctggtatggaacattctacaagatagatcatgaatacgcaaagctagctactgaatagtgtgttcagaacaacactaccttttgggtaaaatggggtgggtgttaatattgtatttgttttgtttttttcagagggagtctcgctctgtcactcaggctggagtgcagtggcgcgatctcggctcactgcaatctctgcctcgcgggttcaagtgattctcctgcttcagcctcctgagtaactgggactacagtgcacgtcaccacgcccggctaatttttgtatttttaatagagacagggtttcaccacgttggtcaggctggtgtcgaactcctcatctcaggtgatccgcccgccttggcctctcaaagtgctgggattacaggcgtgagccaccacgcccagcctgcatttgtttatattggcattggcattgaaacttctggtagagaacacaagagaaaactaacagtacctgtggtggaggtgaagcagaaagtcaggcaaaaagggttagggattggggtaggagggtggtgggtgttactacataccttcttgttttagtttagttctcgaccacgtgaatgtattatctgttcagaatgctaaactaccacccagaaacgtggctgccatactgaattcaatcctcagtctccatggttcagcgttcctggaggaatcctatgaatgtgtagggaactgggaagccccacttcagtcctcctttcattgctgttctctttctagtcattgttgcgatcgccctctactggaccgaaagtgtaagggattggtttgaaagagaaccctgattttgagcaccttgctgtccatttgcccagctaaaggagaaaaataaacctcatatcagaaataaatattctgtgtaaatatttgtttaaattgcaatccatgtgatataaaacaatctaattcaattcatgtttctttaagagaaatcaaagtatttgacacttaactatgtgctatgcactgtgttaagaactggggaagtaggccaggcgcagtaatcccaacaattgggaaggccgaagcagaagggttgcttcagccgaaaatttggagaccaggctggtcaacatggcaaagccctgtctctaaataaaaataaaaataaaagctagtcaggaatggtggcaggtgcctgtaatcccaactcgcgagaggctgaggtgggaaaattgcttgaaccaaaaaagatcaaggcttcagtgagctatgatcaggccactgcactccagcctgggcgacagagcaagactctgtctcaaaaaaaaaaaaaaaaaggaattgggaattgctataaattaatccatccattcattcattctttcctggcactgagcctatttcgtgtccaaggcggggtcacaaacttacttgcctgtagggggcaggcatggaatgtaaatgaaccaagcacagaccatgtaagaaaatttgttctggaaaaggtgatcctctctgttctgtcttcctccaggtgaaagtttcatgctcagagcagcttcctcatccaaagagagtcactggttctcagctctgccatagttgctatgcacaatgccaagcttctggttgtttcagcaaagcaaaaaatctggatgtctctgagaaatctcttattcctacattttggtgataaaaatgcacacaagagctatttgtgtgcaaatgtgaactagactaatatctcccagtcctctcagggcttaaagtctattatgggtgacaagcatttacttcactgtggacactgttggttgtcagcaacagaaaactcaattcaaatgggcttgaacaatggaaaaaaaaaaagtaaagacctgctgacaagagtccagatgaaggtggaattcaggcatggtttactcctggctctgtagctctgcatgtctctactttgccctcctttgtgtatcagtttcatcttcaagcaaattctacccctctgcttggcacaccccatcccaaaatctgaatggctaacttctcattctgacctcaaatgttaccccctccctcagaggggctttccccagcatcccaaagtttaaaagtccccctctgtaaccctcctccagccactatcccataaccattttttgttttccgtagtactcactaatcactatctgaaattacctttttcatttatccctttactcgaatattgtctatccactcctagaacatcaggtctatgagggcaggaataacgttcatcttgctcatcattgaatgccagttcccggcacagcaccagtcccagacagacacacaacttgttgttgaatggaaggatgcagagcgacagggagtgcagagccaaggaaggtggtatggacaaaagcacaggcatagaaatcaatggaatagaactgagagtccagaaatacactcttacatttatggccaatttttttttttttttagaaagtctcactctttctcccaggctggagtgaagcagtgcaatctcggctcactgcagcctcctccccttgggttcaagcaattctcgtgcctctgcctcctgagtagccgccactatgtcccgctaatttttgtatttttagtagagatggggtttcaccatgttggccaggctggtctcaagctcctgacctctggtgatccacccatcttggcctgccaaagtcctgggattataagcatgagccaccgtgcccggcctggtcaattgatttttgacaagtgtaccaagacagttcaatggaaaaagaacagtctttcaataaacagtgatgagacaacttgatagcacatgcaaaagaatggagttggacacttacctcacaccatatacaaaaattaactcaaagtggatcacagacgtaaacataagagttacccttagatgaaaagataggcataaatctttgtcatattagattaagcaaagatttcttagctgtggcacaaaaagcaggagtgattaaaaaaaactggataaattggacttcatcaaaactaaattgttttccttttttcttttctttttcttttttttgagatggagttttttgttcttgtcacccaggctagagtgcaatggcttgctctcggctcactgcaacttctgcctcccaggttcaagagattctcccacctcagcctcccgagtagctgggattacaggcgcctgccaccacgcccagctaagtttttgtatttttagtagagacggggtttcaccatgttggtcaggctggtcttgaactcctgacctcaggtgatccacccacctcggcctcccaaagtcctgggattacagacatgagccactgcacccagccaaaacaaaaactttttgtgattcaaagggcaccattaagaaagtgaaaagacaatacacagaaaagaagaaagtacgggcaaaatcatatctgataagggcctagtatccagaatattaaaaacaaaaaccttttacaactcaacaataaaaaggcaaatagcccaatttaaaaatacacaaagaatttgaagaaagatttctccaaggaagttttacaaatggccactaagcatatggaaagatgttcagtgtcattggtcattagggaaatgcaaatcaaaagcacaaggaggccgagagcagtggctcacgcctgtaatcccagcactttgggaggccgaggccggtggatcacttgaggtcaggagttccagaccagcatgaccaacatagagaaacctcgtctctactaaaataaaaaaaattagccaggtgtggtggtgggtgcctgaaatcccagctacttgggaggctgaggcaagagaatcactggaacccagaaggcagacgttgcagtgagccactgcactccagcctgggcagcagagcaagactccatctcaaaaaaaaagcacaagagataccacttcacaccagaagacagacagacaataaccagtattggtgaggatgtgaagacgctggaactctcacacagtgcttttggaaatggaaaatggtgcaactgctttggaaaacaatttgccagtttctcaaaatgtgaaacatagagttattatgtggcccaagaattccactcccaggaatatacccaagagacaggaaaacatatgtccgcatgaaaacttgtatgtgcatgttcatagcagcattattcataatggccagaaagtggaaacctaaatatctgtcagctgatgaatggatagacaaaagtggtttatctgtataataggatattattcagccatacgaaggagttaagtattgattcattctacgacatgtacgaacctcaaaaacattatgctaagtcaaagaagccagtcacgaaagaccacacatcgtatgattccatttatatgtaaagtccagaataagcaaatctatggagacagaatgccgattggtggctgcagggtcgggggaggaagaatggggagtggctgctagtgagtgtggggtttccttcaggggttgaagaaaatgttttcaaattcaatagtgatgatggctgcacaactttgtgaatttggttgcactaaaaatcactgaattgtacacttaaaagtcatatatatatatgcatacatacatacatatatatatatatatttgagagagagtgcagtggcgtgatctcagctcactacagtctccgatcctgggctcaagcgattctactgccttccaagaagttgggattacaggtgtgcaacaccatacccagttaatttttgtatttttattatttatgttttattatttatttatttattgagacagagtctcactctgtcgcccagctggagtacagtggcgccatcttggctcactgaaacctccacctccctggttcaagcgattctcccgcctcaccttccctagtggctgggattacaggtgcacaccaccaggcccggctaatttttgtatttttagtagagacggagtttcgccatcttggccaggctggtcacgaactcccgacctctggtgattcgcctgccttggcctcccaaggtcctgggattataggtgtaagccaccaggcccagccaatttttgtgtttttagtagaaactgggttttgccatgttggccaggctagtctcaaactcctgacctcaagtgatccacccgcctcagcctcccaaaatgttgggattacaggggtgagccaccacgcctggccaaagtcttatatattttttaagctcagcaaaatactagtcccaaaattatatttttgaactaaaaaaagagaatcacagaaagctcccaggttttgggctgagcatccaggtgggaggttgatggggtggcagtgctgcatcatgcttggggtcactgcatttgagctgctggtaggacatgacagtggagacgtccagcagccagacgggtctgagactcaggacagagcctggcttggagatatggttctgggagccacagggctctcggtggtgattaggccacgagggtgtgtgagttggcccatggaggatgcttaggtggaagaagaaggtctggggcagagcttcagggaacaccagcatttatggggaaaggagcctgcaaagaagacaggattgtccagagggggaggaagactttttttcctttttttttttgaaacagattctcactctgtcacccaggtgcagtggctcacacttgtaatcccagcactttgggaggctgaggcgggtggatcacttgaagtcgggagttcgagaacagcctgaccaacatgataaaaccctgtctctactaaaaatacaaaaattagccaggtgtggtggcacacatctgtaatctcagctacttgggaggctgaggcgggagaatcgctcgaacccaggaggcagaggttgcagtgagccaagatcgcgccattgcactccagcctgggcaacaaaagcaaacctccatccaaaaaaaaaattatataattataacatatattagtaatagtaaccatattccatatcatatatgttatatagtaaccacattatgtaaaactaataatagaaatgtcttcctggctgggcacagcagctcgcgcctgtcatcccagcactttgggaggccgaggcatgcagattatgaggtcaggagttcgagaccagtctggccaacatagtgaaaccccatctctactaaaaataaaaacagccagatgcagtggtgtgcgcctgtaatcccagctactcaggaggccgaggcaggagaatcacgtgaacccgggaggtggaggttgtagtgagctgagatcgcaccattgcactccagccccaggcaacagtgcgtgcgagactctgtctcaaaaaaaaaaaaaaaaaagaaacgtcttcctctatattgtgcgctatgtgccaggctgcatgctacgtgcctgatggctatgttcccagtgaattctcacatcgacccgaggagatgctgcaactgttcccccaacacagatgaaggaacccaggcctcaagacaggaaggcacctccgcatgtctgaacatttttgaacccagggtcttggcctctacaccaagaagtagcgtttggggaccttgacattgaaccagggtggctcactacatgtgccctgaagcaactgaaaaatctgtgccggctttttaagaacctggtttttgcatggactttatttctttcattgcaaaaacctcacagactctttaaggtcagcgtcctggtttccactttttctttcgggctaccaattaaaaaaaaaaaaaaaaaaaaaaaacaacacctgagctgtaattggagcctgggaataaaacataaccctgaaacttgcttttctcagcaaggtagttgtcattctgaagcaggtgtcttacacgaaatggctatttatagaaaatgatatttatgcaatctgtgctgatctcactgactgtcaaatctctgaaaaggggctcgcaggaacagtggaagatgcagatgtggagcccctgaatgagggagtgtcaaacggcactcttgagtgctcctccccaggcaccacgacctggggcttcagcctccagtgaggaagggcagggaggggtcacaggtagcccaggtcgcttagccaggaagtgtgctccaatggttaggggctagggcagctgctcacccaaaccctggctctgccatacccctgagctccagttttctcttctgtgaatggagcatctctcatggagggtttttattttttgaggatcacagtaaaaaattcatgtaaacatatgtaatgatagcaggtgttttaagcgctagcttcccaaaccagtatatctgtatgcaacttcccaaacctgtatatctgtattcaactacattaccgaaagtagcacgccatgctagacttcaccctggaaaacagaaactatcaactatataaaagtaggaggccgggcgcggtggctcacgcctgtaatgccaacactctgggaggccgaggcaggcagatcacttgaggtcaggagttcaagaccagcctgttcaacatggtgaaacccccatctctactaaaaatacaaaaattagccaggcatgatggcaagcacctgtaattccagctactcgggaggctgatgcaggataatcatttgaacctgggaggcggaggttgcagtgagcctagattgcaccactgcactccagcctgggcaatagagcaagagtctatctcaaaaaacaaacaaacaaaactaggaaaaaatgaatgcaaggtattggcattggctacatcagggacaagcaagctgaaaagctgagcaggttggtgaagccccccaagactggccacagcacagagattagcaaatgaccctcagccagaagaacaggggaaggaggggggaccctggagaccaggacctagcgtcacccagggattgctggagtgcagagctgtggctgctggagatttgctccagagagaggttgaaatacccccgccttttcttccttcctgccctccagccgggagccactgaccagggacttaggaacacagcctgaaagggtgacacctccccacccctccacctccccaccgcagaccccagcatcacagcaattcccagcagagcaggctgggcaagggggaggagcaggtctaacaagccctatagcgggactcacaccccaaacaagggtgctgtaccgtaagctgctgaaccacactttgcggcaagagagagctcctcagaaacgggagacggttctcaggtctcagggcctcaggaagcctctcttctgcacgataaacccacacccatagcttctcctcccctcctaagcccgctctgtgtcagctaagtccccgcttaagcacatcagaacacaattcccaaagtgtggtccatgagacctgagaaccgtctccccattcctgaggcgctctctcttgccgcagatggtcatcttcctgcatgaacctctggagagcagaacaaaaccagttacagagagacagtgttggggtcaacataaagaaggtctttccaattgagaccaaatacactcctctgtgaggtagtgagttcccggtgagagcaaagggctctgagaattttatttatgtatttatttatttatttatttatttatttatttatttttacttctaatagtactttgctttttttttctttttttttttttgagactgcgtctcactctgtcacccaggctggagtgcaatggtgtgatctgggctcactgcaacctccacgtcctgggttcaagggattctcctaccttagtctcccaagtagctgggactacagacatgtgccaccacgcccggctaatttttgtatttttagtagagacaggtttcaccgtgttggccaggctggtctgaaactcctgacctgaagtgatccgcccaccttggcctcctaaagtgctgcgattacaggatgagccactgcgcccagcctctaatagtactttggaaagaatttttttttaaaacagggtctcactgtgttgcccaggctggagtgcagtggcgtcatcatggctcatggcagcctcgaactcccaggctcaggtgatcttcccacctcggccttccaggcgtgcaccaccacacccagctaattgtttgtattctttgtagggacgaggtttcaccatgttgcccaggctggcctcgaactcccaggctcgagcaattcacccaccttggcctcccggaatgctgggattacaggtgtgagccacggcacccagccaggagtcaattcttgacttagtggctgtggccattctgaactggtttctccttttgctggatcaaagaagttacggtgacacaaaggatcttgtatcattcattgagtttttacacttgctttgtaaaaactctctgttctatttcccactaccaggctgtaagtttcccgcagacagacttgtttatctgtgtgactttaggcaaaaaaaaaaaaaaaaaaaaaaagcaagagagaaagaaaatctgaggttttggttttaccaaaaccacacaaatgtaccgcagaagtcctttaaacagtaatttttcccagaacaataaaaatataattttaggttcatacgtgtttgtttctgaaacacttactacatgctgaaggagaaagtattacactggggaggcccacagagaggaagaaattaatgtgagcaacgtgcaaataaaaggccacaattatctgcagcatttgctaaagtgagcgagcatgcctttggctctaaagtaagcctgcccttgactgtaagcctataacagcggcatgcagtaggtaaagaagtattgtttaagttaattaacacagaataccccatttaattcagtaaatataataaattaatgatctttagttccatatttgggcataggtagagaaaatagcagagaaaagagagaaagaaattgaaagaataggagcaaagacaagacagaccttcagaaagatgtggggccaggtacagtggctcacacctgtaatcccagccctatggaaggccaagaaaggcagaccgcttgaactcaggagctcgagaccatcctggtcaacatggtgaaatcccgtctctacaaaaaatacaaaaattagccaggtgtgatggtgtccgcctgtagtcccagctacttaggggtctgaggtgggaggattgcttgaaccccagaggtggaggttgcagtgagccgagattgcaccactgcactccagtctgggtgacaaagtgagaccctgtctcaaaacaaaacaaaacaaaacagaaagatgtggaagccttcttgtcctgtgaaatcaggactttggtcagtcagctaattgtgaatctaaaaagtcagttaagtcagggagacaccttaaattcatttatatcgtatatctttttcttgccctagtatttatgagtgtgtcctttctttgagagcggcctggctgaaataggcgttgtgtctctcttctcccatagaccacaaccgtaacccttctgctacaatttcccacttcctattctttacacaaagacactttcaaaatcatatatgtgcagaatcattccagggttcacaattccctccacccagccttccccagtttctgcaattaattcggtatcagttgtcttagttacatcttgaagtcatccaaagtttcatctgagttttatagcgattatattccttctgtttatcctcatgttcccacaacttaagtcacatttaattaaatcaattaatgaccataatcaacacaactgccacgaacagttttgggagcaaacgcggctagttctagataagcacagagcccgggtggttagggaagatgctcaggaggaggcttcagcacactgtgtgcagctgctggcatgtttcacaggagaaatgggacaagtctgttaatctagtgagtgagttcagcagaagttggttaagacagcgtgttaaataaaggcttaataattaaaatttgattagacattagaagttagaggtgtctttcatgcattggctaatttcattcaatcatccattcattctttttgcttgtttttgtttttgacacacagtctcattgtcacccaggctagagtgcagtggtgcaatcacggctcacagcagcctcgacctcccaggctcaagtgatcctcccacctcagcctccgaagtctctaggacaacaggtacatgccactatgcccagctaattttcgtatttttgtagagacaagatcaccctgtattgcctaggctggtctcgaattcctgggctcaagtgatcctcctgcctcagcctcccaaactgctgagattacaggcctgcaccactgcgcctggcccatctattcatttttttcattcaacaaatatccccttggggacctcacaacactagacacagtgcttgctgcaggctgattggcagggtcagtattgctgtgcccattttattggtggtaagactaaggctcggccatttgttcattgtcacacacatggtaagtaaaagcaggctgggtgcggtggctcatgcctataatcccagcactttgggaggctgaggcgggtggatcacctgaggtcaggagttcaagactagcccggccaacatgctgaaacctcgtctatactaaaaatacaaaaattagccaggcatgatggtgcatgccagtgatcccagctacttgggaggctgaaccaggagaatcactcgaactcaggaggcggaggttgcagtgagctgagattgtgccattccactccaaactgggtgacagagcaagactccatctcaaaaataaataaataaataaataaagtaagaaaaatagtaagtaaaagtgccagcccctgaagccaggactcctgattgtagatcctgatacgctctctatgaaatgttgtgggttcagattgaccttccctttagaacagaagttcaggctctccaagttgacacctagaaaacaggccatcctggcagccgttccggagaatgacagataaatggattgaaagtcaaagtgtccagtgtagagagtcaggatgctgaaaccaagcagaaggcatatcgggtggaattctgaagggactgtaaacaagggactgtttagagaactgggttagaagagccaacaagagcaattgagacacccaggggagcaagaatgggcgctgttcccacgctaggcaggacagatcaggaggaaagcctgtgcctggagcctgcggagctggagtcgcgggggagggattgtctggaccaaagtcaagttcctcagagcctgcctctccactcggccttgaccttggacccatccagtctttggtctgctgagtcccgttttagtaaagaatcctgctaagtcagttcagggacgatgccccaacccttgatatctgatcacatcccccatcctccccacccttgctgtttaagttcttggtctgtctgtagcaagaatcctgtgaagtcggtttagcaggactcccctcgccccaatgtcttcccttagtgacttctcatccactcacccctcactctgctcaccagctaccaatctccgctgtctttgctacatttgtttttgagctcagtctctctcccccattgcaatagttttgaataaagcatcagaataatttgtctgttagaagatcgcccagcaggagcagtggtcatggaaggatgtggccacgggctgacctcagcccgaagcagggagtgtgctggggagaaatgccccaacctctctcctgccggcctccagtctccttccggtgcctcccagtggctgaacccaaccagaagtcataggaggagcagcccaggtgatgccatccttcaaagtcagacaaggtcagagaaagtggaaaatggggagtgaacagggaatactagcccacaccgcttgccaaagagtggtgtaagctgcttaataaatagagtcaggtttctttcttttttttttttttttcccaggctggagtgcagcggcgcgatctcggctcactgcaacctccgcctcccgggttcaagcaattctcctgtctcagcctcctgagtagctgggattacaggcgcccgccaccatgcctgactaattttttgtatttttagtagagacagagtttcaccattttgaccaggctggtctcgaactcctgacaggtgatctgcctgcctcggcctcccagagtgctaggattacaggcgtgaaccgccgtgcccggcctcttttttttttcttaaaatgtgaagaattctctgagactgacccaagagacatggcaggggcaggaggaggacatgccagccagggcagtaccactattggtgccagtactctcagccggtcagcggcagtgggcagggtcagggaactaattcacaaatctaggaatgttcttaatggtgacacctagacaagagaagagactgaaggtcaagaaggcacacgaggggatggcagagatgaccctacagttcccaacctgattcaaggcagtcccagtaggcatgggactgtgatcgtcaatctgttagatgagacacagtgtcctggcgaaacacacatccttcgcatcttcctcctgtcgccgcacagctagcggctctgagcaggcctcgatattttgtgcaagggcaaaatggcagggaccaccagccagggccaccgaactcttgttttctgccccaggacttcccagaccccatggcgtgcaactgtgaagagctctccagggacttatacatgcacaaccagaggatgacagggctgggcccttgaccaatgggagtgtgaaagccgttaatcaaatgtgtccccctttcttcgggaggccaaggcgggcggatcacttgaggtcagcagttctagaccagcctagccaacatggtgaaatcctgtcactactaaaaatacaaaaattagccaggcatggtggcgggtgcctgtagtcccagctactcgggaggctgaggctggagaatcgctcgaacctgggaggcgcaggttgcagtgagcagagatcgtgccactgccctccagcctgggtgacagagtgagactgcatctcaaaaacaaaacaaagcaaacgaataaaaaacacgaatatgtccccctttcctctcctggttggacagttctgagatgcatttcactccccaggagctcccacaggattgaccactcggtcacccgaacactggatggcatgacagtgcatcccagactggattccccagtaccctgttccacacccacatcccgcattccaagttacacgtgttatgtaacttggaaaagaaaaatacaaagcatgccagtttccttccgggaatcaacagcatggaaatggcgtggactggcctcaagtacacagatccataactcagggctctcagcagacaaatatgtcttaatccctgaaatactgccacttctgagtttgggggattaaaatatcattagatcctccatttgtcaggacgcacttgtcacaattgagagaaacagaagctacgtcagcttaagccaacagttttggggagcagggggaagatgggggatttactggcacaggtaaacaccccatagaaaggagaggtacagagagacctggggacttgagcaacatcatcttcaccctctctctccctctgtcttgttcatctctcagtcctgtttctctgtgttggtcacatttttcttttctttttttttttttttcttgaaaccgagtctcactctgttgcccaggctagagtgcagtggcacaatcttggctcactgtaacccccgcctcccaggttcaagcgattctcctgcctcagcctcccgtgtaggtgggattacaggcatgcaccaccacgcccggctaatttttgtatttttagtatagatggggtttcaccatattggccaagctggtcttgaactcctaacctcaggtgatccacctgcctcagcctcccaaagtcctggaattacaggcatgagccactgcgcccggcctcatattcacttttttttttttttttttttttttgagacggagactcgctctgtcgcccaggctggagtgcagcagcgcgatctcggctcactgccagctccgtctcccgggttcacgccattctcctgcctcagcctcccgagtagctgggactacaggcgccggcaaccacgcctggctaatttttttgtatttttaatagagacggggtttcaccgtgttagccaggatggtctccatctcctgacctcgtaatctgcccgcctcagcctcccaaagtgctgggattacaggcgtgagccaccgtgcccggccacattcacttctactacagatgacctacagttctcttccatgcagagaactttgagcttacctcactcccagtcagtgacagatggaaagaagaggtctgtctcccaacaactatatacaaatcctagggaaggattctgattggccctgctgggactacatgtccattctttgggccaatcactgtagccaaggaataggcgcctatgattggctggacctggccatgtgcccatgggggtgtgttatgaggggttctcagatggacagcttcaacagagattagcagctgcaacagaaacttctggaaaggcattgaggagaaagagctccctaaagggaggtgcagctgttgatccataccccttaggctttaatctttggctgccagtatctgcgactctgggcctgagggcttttccccaaaatcacggaagatcgctctcccaattatccagcaggttgcaagtgggggctaattaatacctgtgagcagctgtcagccaatactgccaggatggatgtgtgagtaccccgacgcccccctgggtgggatggctcttctctatggtatgaggcccctgttaccctcatcagtgacacgctttatcatgcctttaggatccattctctcccctgtctcacttcccctcccaatcagtgcttccggcactttccaaattaactactcaaacttgaggcccaacttcaggggcggctttagggggagcctagactaaggaaaactggattggtgggagcaggggtcaccgctctgcgggaaggaagacagaaccagtcactgtcagccccagccccgcctactcattcagtcactcatttgtggcatcctaagtcagctttctcttcctttccttttcttttcttctcttctttcctctcctctcctctcctctcttctcttcttttcttttccctttcttttcccctcctctcttctcctctcctctcctcttttctttttttctgagacagattctcactctgtggcccaagctatagtgcagtgatgcagccactgctcactgcagccttgacctcaagtgatcctcccacctcagcctcctgagtagctgggactgcaggcacatgccacctcgcctggctaatttttatattttttgtagagatggggtttcaccatgttgcccaggctggtctccaactcctaggccaaagcgatccatctgccagggcttcccaaagcgctgggcttgcaggcatgagccaccgtgtcctgccaggccaggtttctaagaagcgggacctgagatatggattcctgtgcagtggtttattgaggaggggctctcaggagacatgtatagggagaagagggaaatagggcatgacaaggcagggagaaagcctggcacagacgcgtcgctgcaggatcctggcctcagcctgatccccagggagctgtggagcatggctagggccacacgcttgacctctctaccttgaggcaagggagccagacctttataccctgctgatggccagtcacggctgcacgctgccctcggcaaccagggagcgaggctggaagctttcaggcactttcagtattctcctacccaaggggctggaaagtcccagcaggcaggagatgggtgcaggggtccagaactagggatgtgggtgaggcctggacagcatcctctgcttgtggcttgcaagtgataagaaaaaggagcctctcagctgctgagatttttaagcagacaacaaatgtatattgaatgtgacaaagagttagaatatgtgagtttcatctttacaaagtttacaatctacttgtggagtttaaaatacagctactggctggttgtagtggctcatatctgtaatcccagcactttgggaggctgaggcaggaggatcacttgagcccaggagtttgagaccaacctgggcaacatggcgagacctcttctctgcaagaaattaaaaaattaggggacgttgggcggagggagagagcagaaaagataactattgggtactgggcttaatacctgggtgatgaaatatgtataacaaacccctgtgacatgtgtttgcctgtgtaacaaaccttcacatgtacccccaaacctaaaataacaatttaaaaaataaaattaaagttaaaattaaaaattagccaggtgtggtggtgtgcacttgtagtcccagctactcgggaggctgaggtgggaggatcacttaagccagggaggtcgagactgtagtgagctctgatcataccattgcactccagcctgggggacagagagcaactctgtctcaaaaaaaaataaaaataaaaattgatatggtttagctgtgtccccacccaaatcccatcttgaatcatagctcgcataattctcacacgttgtgggagggacctggtgggagataattgaatcatgggggcagtttcccccatactgttctcatggtagtgaataaatctcacaagatctgatggtttttataaggggaaacccctttcgcttgactctcattctctctttacctgccaccatgtaagatgtgcctttgctcctccttgccttccactgtgatcgtgaggcctccccagccacagggaagtgtgagtctattaaacctcattttctttattaattacccaatctcagatatgtctttatcagcagcatgataacagactaatacaaaaatacaataaaatatagctactttaatcaccccatccagacacccaactcagtgctgagtggtttctgctctcatggaatccaaggtctgctgcttccgccccatttcccaccattccctgcaagcatattgtggtccagacagtctgggctcttcatgggctcagaatgttgcttcgttcttccaggcctttgcacatgctcttcccttcacctggatcccttctctccctcatctgcagggtgatcccccacttacactttcaaataccattccaacaactctcctcaatgtttatacatcatgagtaaattcaccttatcccagggattccaggaaagtgtagggtttctttttaaagttagtagaatttaccatccccagagcaaaacagaaaagtctccaggaggcagagatgtgtgtgtgactgacagcagcagcaagcctgtatcagtcacttgtttatggcacctcagtcaccgtgctgagatctatgtcataacttgctaaatcctccctgcaacacttgaggtaggccctattgtaacccttacctcacagaggaggaaagggaggcacagagaggctttgtaacttgcccaagctcacacagctggcaagcggcagaagcaagggtcgatctcagaccatctttacaccagcatgctgtactgaatgaatgactgaattaatgcaaccagcaacaccaaaatgatgcaagatctagagagaagagagccctactgagccagttcctgcagcgtgagagaaggtcctggatggccagttaaagggtctggctacagatggcagagatggcagtcgaggatgggcacctgctgtgtgaagcaggctcccagggccctgcagtcctccttcgcttgggttcccatggccaaaggccagcctctgccttcctatatctcacgatactgcaattgcatgttcatgcgcctgcctctcccacttcagacgcagggccagggttccactcagccctttcagccaggactgtttgcctcgcctagaaacaacccatttttctttctttctttcttttgagatggagtttcgctcttgtcacccaggctggagtgcaatggcgcaatctcagctcactgtaaccgccacctccagggctcaagcgattctcctgcctcagcctcccaagtagttgggattataggcacccaccaccatgcccagctaatttttgtatttttaatagagacggggtttcaccgtgttggccagactggtctccaactcctgacctcaggcgatctgcctgccgcggcctcccaaagtgtgggattacaggtgtgagacatcacgctaggccccatttttcttttgcccaggctggagtgcagtggtacgatctcggctcactgcaacccctgcctcccgagtagctgggattacaggcatgcaccaccacgcccagctaattttattttatttttatttttgtatttttagtagagacagggtttcaccgtgttggtcaggctggtctcgaactcctggccccgtgatctgcccaccttggcctcccaaagtgttgggattacaggcatgagccactgtgcctggcccccatttttcttaaataaaggagagaacaggattcaagactttaggagccctggtgagaacacagccagatccactccagaggcagccgagcaagaagccacttcctgtcaccaggtcagtgtcagagcagctgctcagctgacgaggaactgaccgtgcacttgctatttccctaaggagaggtaggcctggcctggacttccagcttgaactctgcagacaggacctaaggggtcccagcctccagagttgtgtgggacaggcagcttgtcagggaaggtgatgcaggaggtgacgttgaagagggtgactgtgagttctgagaggatgtgtctgttattgctgcctgctgctctgctcctagaatcccatggggacctctgagcttggggtctgctgtgatcaactaacaatggcttccatgggcatgggatggagagtgaaggcatgcatgttaactgtcccccatcctgagtagcagagccatgggagaagggagctgggtaaattactagcaatcagcagcgtattaagcacttagaatgtactaggcaccatgttaaatgcttttcctgctctatctcatttaatccttaaactaaccctaggagaggaatgctattattattcctcctttagaaggtcagcaccatgaggaacataattttctaatctgcactattaatgctgtgttgtcagcacctaaaatagtacctagcacatggcagacactcaataagtatttgctggcaaatagattaactctcattttgcagatgaggaaactgaggcccagagttgtacgtaacttactatctcagagcaaaacagaaaagtttccaggatacagagatgtgtgtgtgtgactggcagtggcagcaagtaaccagcaagttgcaagcagctgcgtgtgtgcccttcctgcggcaacaatgctgggagggctttgatctgagttgctttgttttatatatgagagatttgacgggtccaaaggaaacgaggctcacacagggttacctgctgagcctggggtccagccaggtttgcaaccttgaaatcctaagtccctgagccacttcatttctatagttgtcagagagacatgcaatcaggtccagcgtgccttggaggaacaggttgtgggcaatgccagcctggctggggacctcagtgaccattctgtttgagagtaattctgacccaacagaccccacgacaagagtcagctcaggcaaaactgtgatgcacaggaagcctcctacctgtttccctccctccttctccatcactctgtctggggggctggtgtcttcctttcattccaatcaaacatgatctctaaaaagtgcctgaacctgatgaacgctatggtataaatgactacgaaaaggtattcatttttgaatcatttctattttaacaggaatcaaaggctcaagacaaagaatacctctctaaatggcagaaaaagtgtccatttccaaatgatttctgttttagcaggaatcaaagcctcgagagaaagaacacctctctaaatagcagagtgtctaccaccatcagcaaaagctacagtgtacagggctttacgtaccaggcactgttcaaagtagtcagcctgtattcattcacgtaattctcacgacggctccatgagagaggaataagcgcttcatttagagatggagaaactgaggcacaacggagctaagttgctggcccagttcacacagctgggagtagccaggtcaggactccaatccaggcaaagcagagagaaaaatactggtgaggaggagggaggaggaagtgggacgttccagctgaggagaggtcttttttccttaatctgatgttaggggccacccaagcactggggccagacgcccaccatggctctgcgcatttgctggtttggtgatctgaggacatctgttgcttcttgtcctctggtttaacagttacaagtgtacaggagcatgtgggccaagcatcccgcgtgcggacgtgatctggcttggcctgcaggcctgctctttcatgccaggctgcaattttttgagattactcaaccttcggaagggaagctgggccaaggacagacctttggtgagaagcagggggagtttagagaatcagccctcctcctcctcctcctcccagcctcctcccccaggagactcggacttggaaacacccagcagggaaaattgctgcagcagcaggtagcagttattatgggacctggaccgccccttccaggcccagctgttctctgggaaagcctggcggcagctctcacaccctcttccaaatggtcttcagagggagacggagatgctcctcgccccgcctgttgatcttcaccactgcaacctcctgtgtcccaggcatggtcagcttgcagccctgggggcggcttctggtgttctggtgaactggttaactgggcactggcatagatagcctgggtttctcatcctggttcacgtgcttaccagctgtgtgatatcgggtgagtcatctaatcattcagaacctcagtttcctcatctgtaaagtggggagaacaatagcattgaccataggttactgtgaggattagacaggggagggagcagagcagttagcacagggcctgtgcatgaattatgatcaaactaggcctaacttgcccaggccccgccccatgtttttgctattctgggcttccagatggtgtgcctctttcactgggtactcttctgtgacatttgtttctgcacagaggtattgaggatggagataacctaagcctggagtggtcgtctttggtgacagtggcaattgttccacccaggaaagaaaggaagaaagaaagaaagaaagaaagaaagaaagaaagaaagaaagaaagaaagaaagaaagaaagaaagagagagagagagagagaaagaaagaaagaaagaaacgaaggaaggaaggaaaagaaagaggaaagaaggaaggaaggaagaagggaaggaaggaaagaaggaaggaaggaaagaaggaaggagagagaaaggaagaaaaaaggaaaaaaggcaccatgttggggagagagtgtgcaaaagaaaggaacaagcttttctcctgcttttttggaacaaaaggtggcccacattttcatcctgcactgggccatgcaaaacatatagctggctggctccatcggatggtgcctgaatctcagaagtgacagtgttgagctgctgttgggggcaccaattaggacaggctttcaggggagaggcatggtttagggtcttacaaatatgcagacctttggagccagcaattccccttcactgtcagagatgtgcatatggatgtgtgagcaaggatgttcaccacggcatgattcataatagagacaccagctggatgcccaacaatggggggaggtcaagggcacaatccatactgaaggatcaggcacagccattaaacatcatgtcatcaacgaggacttactgacatgtgaaaaactcatgacatttgcaaaatggggaaaaagtcagctaccaaggagtgtgcaccataggatctcatttgcataggcgtgcagggaatatatgcaggagaaaaatattgagctggtttatccttaaatgccaatagctgttctcctcaggtgggttatgttttcctcttctgggcctgttttccaactgtctgcactgagcacacatcactgtcatcagtgcactgaggtactgttgggcagtggccaaggctagggctgcagacactggaggcagactccctgggttcaaagcccagctctgctccttacgagttctgggaccttgagcaagggatttaacttctccaggactcagcttccccatctgcaaacagggaaagtaatgataccttcctcaaaggatcaaggtattaactcaccatgatagggtcatggctgattgacttgtttggctgtcttcctaaaacccctgaaattttcttctttatatccctggcacctaccacagtgccaggcttacagcaggtgttcctgaaaagtctgctgaatgaacgaaggagggagtgcatgaattcatgtaaggatggagatccacatcccagggtacagagatagtatcaaatgagttaatacatgcagagggcttacagcactgcctagtgcttagaaaactggaattatcattatggcaaagaaattgtgtaagaggaaaatgttgagagaacaatatgaaccaatttttttgaatgatgtagaaatgagtgtttgttttattttgttttgtttttgagacaaggtcttgctctgttacccaggctggagtacagtggcacaaccacagctcactgcaacctcgacctcgtgggctcaagcaatcctcccaccttagcctcccaagtagctgggactacaaatgcatgcagccatgactggctgatgtttaatttttttttgtacagacgagagtcttgctatgttgcccaggatggtctcgaactcctgagctcaagtgatcctttttcctcccaaagtgctggaattaccggcatgagccactacacatggctgtttggttttttgttttgaacttttctgtattgagagtagctgagtaaagcatgcattacttttataatttgggaggacacaaaacgttactgaaagaaaaagactgagagagtggttcacaaagtgctgttggggaacgcagggtgaagccaagttagccgagtccacaccgttttcatgtcaaggtcatgtgtggatgagcttgtcttaggcccttactccggcccccatacaccaggttgcacgtcttctcattcatgatgaacacaacacccggaaggccgatgttcatgctgagttataggctctacagcgaaatctcttgttagataaatagatagatagatagatagatagcatagatacccatatatagaggtgcatgtatccatttatctatataagagttataggctcttaaaatatctacagctaaatctcttgttagacagataaatagatatgatagatacccatatatagaggggcatgtatctatttatctacctatatctatttatcaagagaatctttaactctagctgtaaaaaagaatatgtccaactcttggtgctccgtgtattgccccaacacagtactcaccacgctaggaccattgctgattgacttgttttcctgtcttcctaagagccctgaaagtttcttctttgtatccctggcacctactacagtgccggccacacagcaggtgttcctgaaaagtctgttggatgaatgagaggcagtgcatgaattcatgtcagaacagagatccatccacatgtcggtatggagacagaataacaggaggattagctttgtctggggtagggacaggtccaggaagggtcaaagacaggcaagtaaggcttggcagggtgaatgtgtacagtccccaaagaaaaggggagagagagagagagagatgggggacagcaatccagtcagtgagaacatcatttaaagatccttggctcacacctgtaatcccagcactttgggagcctgaggcaggcagatcacccgaggtcagcagtttgagaccatcctggccaatatggtgaaccccatctctactaaaaatacaaaaattagccaggcgtggtggtgggcgcctgtaatcccagctactcaggaggctgaggcaggagaatcgcttgaatccaggaagtggagatttcagtgagttgagattgagccgttgcactctagccggggtgacagaaagactctgtctcaaaaaaataaataaccatcccggctaacacggtgaaaccccgtctctactaaaaatacaaaaaattagccgggcgaggtggtggacgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaagaaaaaaaataaataaataaataaataaaataaataaataaataattaaaaaataaagatcctgtaagtgggctgggtgtgctggctcacacatgtcatcccagcactttgggataccgaggcacgaggatcgcttgagcccaggggttcaagaccagcttggacaacaaactgaaaccctgtctctataaaaatcaaagaaaaaaaaatagccaggtgtggcagccggcacctgtggtctcagctgcatgaaagactgaggcaggaggatcacttgagcctgggaggtggaggctgtagtgagcactacacaaaagaaatcgctgatccttcagcagccatttcccactccagcaactccccgcccctggcaaccactcatctactttctgtctctatggattggcttgttccggacatttcacatacacggaatcatacagtgtgtggtcttttgtgtctggcttctttcactaagtattacatctccaaggttcatcccgctgtagcatgagcgaagtgtgacaattgatagatggatcgatgaaggttacattcattcattccatacacatttactgagcacctactgtgtgccagtcttggcgacgacccagtcaggaatagaactaacagtaaaccctgccctggagggcttctggtagggaggagagacaataaaccgaataaactagtacattatttggaatattagacgctgataagagctcaagtgaagcatggggttggaagttgggtgcagagagaggggctgtgacttcgagcagagcggtcagcaaaggcctcgccgcagggtggccgcagggacgctcccgctcagcccggaaggaggcgagaggcgcggtgcccgtcccggcgactctgggccagcaaagagctcccagcgcacgcgtcggtgcctcgaggcccgggaccctgcgtgtctggtccccgccgtggccctgcgtccgtgacggtgggtggcaccagggagcatttcgcgcggcggggctggggcctgcctttgaagggacggagtcgggcgtcgtggtggggtggacaccggggatccccggggcgcggacgaggggggcgtccaccctgcgagctcaccccacggcccccgcgtcccgccctcagccgcaggccccgccccgcgccgcccggccccgcctccccgcggccgccgccattggccgcgcgcgccgcctccgccctcggcctcgcacttcctggcggagccatggctgcgcagcgggctggccgggggtctcctgaacccgggccccgccgccccgaccgcccggccccgccgccggggctgtccccgccgcgtccgtagcgcgtcctgccaggtgggcctccgcgcgcgcccaccctccagcccgggaccgccaggaagccgcgcccggccggggcggggagctggcggagatcgggagggtccccggccaccgcgagccgcgacccccctgcgccccttggtgccggggcgggcgggtgggcgagtgggggcgccgcggccgggggaggggccgccgcccccgcaggtgacacaggtgcggcctgtgcggaccgccccgcgcgtggcaggtgagtggcccccgccccgggccgtcccgactccgcctcctcgccgccggctggagcctgctgggcggccgttgcgctgagttccgcctgggctgcggggtccgagcgaacgacagcggcgtccccggagaccccgccggcgagccggtgtcagcagcgtcgctttctccaacgctgaggtcgggagggagcttggggaggaggcgctctgggaaacccccggccggacggggcctgcggtcccatgtttactggaagaccttttccagtgacctgggattgtcactgtgcttgggggtggccttgacccttcacctgcttccaaaaagcgtcggaggccgctgacgtccaacacgggtggaaatcagaccccacccccacgcacttgcaggagacagcagggagcctccggccccgcgaactctctctaggtatcttggcctagaaaataaagcgttgagcgttagaaggcctggttgattctgggcaggctgcctggggcggtggagagagagggcacctgctgcttgctgttctgtgaccttgggcaaccccccctggggcacccgagcgccaggtctcactgtgggaacgacggtgtcacctctcagcgtgaaggtggaatgaagtcgagtccgcggtgggcaccgcaccaacgctgggtttcttctcttccctctctgggctctccagcatcctaggggagggccggggtgggaacagcttgtcattgtcacaaagtttctagtttgtcgagaggaatccagttgccccttctctccctaggggagttgcacgggacggactgtgcccgaattcattccttccatgggaacactggagtgccctccctgtgtccccagttatctaagaacagtgctgacttcttgtcacattgttctttattagtgaagactatttgttcaataggtaacaaactcttctcatgaactcaaatagcgggggaaaaaaatcctctttaaaaccttcgtctcagtatgtgacttgtgctaatattagttggcaaagtcccttctctgtgttcccttccatctttgaagcacctgcccctccccctgcctcccccgccccccacacaccaaagcttaactctgtctgcagtgatcccccacccaagagccaggcagtgtagcctaagagttaagagcatgggcgcttccctgagctggaatcccaattctgccagttcccagctgtgtgacgccgggcagcttatttcacctcactgctctcagcatcctccagtcacagtgctggcctcatggggttgcagtggggactaagtgaagatgcagagaagcacttggggacagtgtgtgtctagaatgtactgtgtacatggtagtcatcactgtaccacatcctcatctgcatcatgatatttttaaagtgtgatactctcgaacccgggcctcattcagcagcgtgtcatggtgatggatccaggttttgaagctggacagaccgaggcgtgattctcggccgtttactagctttgtgaccatgagatcaatatcctcatctgtgaaatgaaataagtgatatcagcctggccaagtataatctttgtgggggttaaatgagatggcacacttaagtcacttagcttggttcgagggctgtagtctgggctccgaaatgataacttatcattataaccttgatgtagccaaaaggtaattatttgtaggaagtgaaccaaatgacatgatatcagattttagatgataaaggaatgggagttaaatgttctgtccaattctaacaacccgatgatttctcaactcggtgtaaaagagttctttgtagtgcacggtcctccctccctccttcttccgtgtgactgttttcactgtcatccttggtatctgctagcagggcctgaaattaatgaatgacctagagttatgactgcatgctcagaaatcctgttcttctcctagggctgaaatctctttaatgatggagggaagcaggcagacgcgagtgtctcggccatacaagatcagcgaatcatcaaaggtctgtgaatgttcactcaccacctatgcaaattgcctaagaagtgtgatcctttttctgattcactcatttctaatcacagactgatttttttgtcattggtgttgtcagtctccttaatgacaagtaaaggtggaaacgggcaaggagcagaaattgtcataaaatcagacagtgggaagtatgagggatggtagagacgctatggccagatgtcttcatttttccatgtgacattccggagctttctttttgtgacaacttgactcattcgttaacccaaggaggtggatgggacaggaagaaaactgggattcccatgcctgcttgggggctcaaaaactccaaggacaggtccattgagaacccagccttctaccttagggtgagggcaacacaccgtgtacccggaccccaagggcctggagtcgtcttccctggtcatgattccctgcgacctaagagcaagtgagggcaagttccccagagccaggctactgggggagttctaattagaaatatgtagcctgttcccaccagccacattaaaatccaagagccagacccggctgctatactttccacaaactcctgtccccacagctgctgttggtaaagagtgggggagccattggtatgaggttcctggtaacctgtttccccgttataaatattcgtaatgccctctgttctttagaggtatcccttttggagattaaatcttatggttacctcagatcatggattctcaatgagtatgatattgccctgaagtgggagaaaattggttctcgggagggtggaaggaattttactccttttatgcataagacacaattatacatacagtacatgagcagacatacagtgcatctgtgatgttaagattttgctggggaggctattagggaaaaaaatcttaaaagccttcttgtggggcaataatgaaaaaagatacagaaacacttctttagatgaagggagctggcagcagcctatagagttgagaaaaagggggaaagagattctacagattctaaaagaaaaactggctgtcattttcaagagaggttggctctcttgagatatgacctcctgttctcacgtgagttccccaagaaggttcctgccaagcccagctttatcgattgtgaaaacccagagaggtctcgccgctcgctcacaagggctttgtttgggagcttagcttgggagacactgctgctttctaagtttgacagcactggaagtctttgtccattaatgccaggaccctgagtttgtttctgtctgaactgaatctcttaggactaggcttctgtatcactggatgatgtttctaactttttttttttttcgagacagggtcttgctctgtcacttaggttggagtacagtggtgcgatcatagctcactgcagcctctacctcctgggctcaagtgagcctcccacctcagcctcctgaggagctgggaatacaggtgcatgccaccatgcccagctaatttttgtatttttagtagagacggggtttcaccatgttggccaggatggtcttgatctcttgacctcgtgacccgccagccttggcctcccaaagtgctgggattacaggcgcgagccaccatgactggcctgtttctaactttttatttttaaaaagtgtacccattaatttctagacattaaacacacctatgttgccagcacccagatgggtaaaaaacagaatactaccaaaccctcccagttgttacactcaagatagtcgctgtcccaaccccaccgctgtggtttgatctgcttttgaactttgtctaaacgggatccgaggtcgggtactcttgtgtgtggtttcttttgtgcaacattgtgcctctgagcctcacccgtgttgctgcatgtagttggtagtggtaggttttgctttctcagcatgttggtgtcttcccactgtgtggccacagtgtctgttcacctgtctgccctaagatgtgttgctcagccaggcacagtggctcacgcctgtaatcccagcaccctgggaggccgaggcgggaggatctcgtaagctcggagtttgagaccagcttggacaacacggctaaacctcatctctacaaaagatacaaaaattagccgagcctggtggcatacacctgtagtcccagctcctcaggaggccgaggtgggaggctcacttgagcccaggaggtagaggttgcagtgagctatgatcgcaccactgtactccaacctaagtgacagagcgagaccctgtctcaaaaaaaaaaagtgttgttcctttttgatgctaaattctttttccacgtctaatacctggtacctgccgcctcctcccaggtgtaagcccccgacaacctgagtttctccctctacttggccttgcatctgattaaggcactgaaataggaaataaagaaatgaacaagactcatatcatcagagaatgctgtggattggagcttctaagttacctgaaatgcggaaactctgttaccaatgtccctttataattgggaaataggccaggcgcagtggctcacgcctggaatcctagaactttgggaggctgaggtggatggatcacttgaagtcaggagttcgaggccaacatggtgaaaccccgtctctactgatatatgtatatatgccgggagtggtggcacctgaggtcaggagtttaagaccagcctggccaaaatggcaaaaccctgtctctactaaaaagacaaaattagctgggcatggtggtacatgccggtagtcccagctactcaggaggctgaggcaggagaatcgcctgaacctgggaggcggaggttgcagtgagccgagatcgagccactgcactccagcctgggcaacagagggaggctctgtatccaaaaaaaaaaaaaaaaaaagggaactcgtgtgcctgtgtttttggaaagttgtctatgcagctgtgctaaaacaccagaagcagattgcagctgattgtacccgggtacagcatcactccagcccacttagagcagaaacccagttttggaaacaacactgctcttgccccctgccccagctcactggagctggtgtctcccctcggcagccgttcactggggctttccccagtcctgccccctgggctctttcccttttgacactgcagtctggggttgtgtgtatctccgtctaagcatggtagggccagcaccctcaccagcgtggagacagccagggtccccgggtggcagatagccgcctcatgccctcatatgcgtctctcaggccgctaagcctgtactatgacttgatcaccgccactgtagtactttttaatttccttccttcagctcacacccaagaggggcctccagtcaatgtctgtagaagcactgaccattcctgcataattagaagctgaggcctagcacggtggcttatacctgtaatcccagcacattgggaggctgaggcaggaggatcgtttgaactcaggagctgaagaccagcctgggcaatgtagtgagaccccatttctacaaaaaataaaagtaaaaaatagctggatatggtggcacacacctgtagtcccagctgccaaggaagctgaagtggagggattgcttgagactagttttgttttgttttgttttgttttgttttgttttgttttgttttgttttgttttgtttttgagatggcgttttgttcgtgttgcccaggctggagtgcagtggctcactgcaacctccgcctccggagtgcaagtgattctcctgcgtcagcctcctgagtagctaggatgacaggcgcccgccaccacaaccagctaattttgtatttttactagagacggggtttcaccatgttggtcaggctggtctcgaactcctgacctcaggtgacctgcccacctcggcctcccaaagtactgggattccaggcatgagccaccacgcccggctgagcctaggagtttcaggccgcagtgatctctgatctactgttgcatgccagcctgggaaacagagcaagaccctgtttctaaaaatgagaaaaaatttaaaagcccggtgtaggccagcctggctctctttgtgggtaaccaggataaatagagatctccacgtgtgtgacctgtgaactgaaaagccagcctggaatggaagagcgggagagcccgtcctctgaactcagaaggaaatgccaagtcggatctgtctggcatcctccacaggctgtgagaatgtggcctgctcctgtagcatggacagagaagttgctgttggaattgactggatgtggaaataccacagggaaataaagtgtctcaatgacaaacgcatgtatggcaacaaaaagaagatttgaaagggaagaaaaaaataaaacccactgctgtaggacacatgttaagaagcaacttttaagaattcagagcctgggcagtttagggagacgttgtccctgcaaattataaaaatcagacaggcgtggtagcgtgtgcctgtagtcccagttactcaggaggctaaggcggaagaatcacttgagcccaggaggtcaagggcgacatagtgagacctcgtctctacaaaaaaattttaaaattagccaggcatggtggcacacacccgtagtcccagctactcaggaggctgaggtgggagaatcacttgagcccaggaggtcaagggtgcagtgagccgagattgtgccactgcactccagcctgggcaacagagtgagaccctgtctcaaaaaaaaaaaaaaaaaagtcgaaccacatagctgctaatacctaatagccctcggtcagttttcttcctccaaccacatttcccctcttcaggctagtgcccagccagttcttcacctcagtcaccctggaatagaccagctatctatgtgatagttttcagttacctgtttctccctatgttgaattcatttatttatttatttagagacagggtttctttttgtcgtccaggctggagtgcagtggcacaatcatggctcactgcagcctcaagctcctgggcttgagcgatcctcctgcctcagcctcctgagcagctgggactacaggcgaatgccaccacgcccacctaatttttaaatattttgttaagacaggaatctcgctatgttgcccaggttggtctcgaacttcctggcctcaagtgattctcccgtctcagtctcacaaagcattgagattacaggcatgagccaccatgcctggcttgaattgttgtgttgtttggttttgggtttttttggtttgttttttgttttttcttgtttgttttgttttgtttgtttgttttttgttttttgagacggagttcttgctctgtctcccaggctggagtgtagtggtgtgctcttggctcactgcaacctccatctcctgggttcaagcaattctcctgcctcagcctcctgagtagctaggattacaggcacacgccaccatgcctggctaaattttgtatttttagtagagacagggtttcaccatgttggccaggctgctctcaaactccagtagccgggctgtcgtcccagctactcaggaggctgaggcaggagaatcacttgaacccgggaggcagaggttgcagtgagctgaggttgtgccactgcactccagcctgggcgacagagcaaggctctgtgtcaaaaaaaaaaaaagaaagaaagaaagaaagaagttatattaataagagaaggaaaaaaaaaaccacgatacacaggcatactcagaaacacctgtacttcctgcagtgccctctgatgcagcattttatttcctgttttcttcagtttcattttgttgaaaatgctggtcaggacccactgggttggaccagggccgagcaggctgctgcgccgtttctaatgtgtcttctctgtccaggtataccgctgggccgaccactcaagcacggtgctgcagcggctgaacgagcagcgtctccgcgggctcttctgcgacgtcgtcctggtggccgatgagcagcgtgtgccagcccatcgcaacctgctggccgtgtgcagcgactacttcaactccatgttcaccatcggcatgcgggaagctttccagaaggaggtggagctgatcggcgcctcctacattgggctcaaggccgtggtggacttcctgtacggcggggagctggtgctggatggcggcaacattgactacgtcctggagacggctcacctgctgcagatctggacggtggtagacttctgctgtgagtacctggagcaggaggtgagcgaggacaactacctgtacctgcaggagctggcctccatctacagcctcaagcggcttgatgccttcatcgatggcttcatcctgaaccacttcggcacgctgtcctttacgcccgacttcctgcagaacgtctccatgcagaagctgtgtgtctacctgagcagcagcgaggtgcagcgggagtgtgagcacgacctcctgcaggccgccctgcagtggctgacgcagcagcccgagcgcgaggcccacgcccgccaggtgctggagaacatccacttcccgctcatccccaagaacgacctgctgcaccgcgtcaagccggccgtgtgctcgctgctgcccaaggaggccaactgcgagggcttcatcgaggaggccgtgcgctaccacaacaacctggcggcccagcccgtcatgcagaccaagcgcacggcgctgcgcaccaaccaggagcgcctgctgtttgtgggcggcgaggtctccgagcggtgtctggagctcagtgacgacacctgctacctggacgccaagagcgagcagtgggtcaaagagacgccgctgcccgcccggcggagccaccactgtgtcgcggtgctggggggcttcatcttcatcgccggcggcagcttctcacgggacaacggaggggatgcggcctccaatcttctttataggtatgacccccgctgtaaacagtggatcaaggtgagattaaagccagattatttcttttctcttgaggactctctcggtttccttaacctagccttgactttccttacctctctggggccttgacaactatcctgcttctgaatgaggtgtgatgataaagtgacgagcagaataccccggggcctacatcctggacagggagagggagagccgacccaccccttcgaggggtccgtcatcgttcagagcagcactgcctggcggggctttctgtgcagatggaagggtctgtctgtacttcccgatacggtagccacagccgcatgtggcgactgagcacttgaaatgtggccagtgcgactgaagaagtcaattttcaattttatttcactttaaccgattgacgtgtaagtgtatgtggccgcacgaggcgtggctaccctattggacagtagcatgggtctagatgtttgatccatggttcaacatccccaggtcctggagtctctgtggggctcctctggaagcattttgggagatagtttaaggagaccactagtgctcacgcctggcccttgggcatgtattgtgtcctgattctgggaagagcgtgggccttgatgtcagacctgaggtctcatcccagcctggctaagtcatagctaggaaatttcagattcttgtcctctccacattttggattccccttctgggaatacgtgggggacagggagtgcagtagctcatgttgactggcaagcccctggcgtagggaaggtgtctcctttctgctgggagcgctctccagccactcggtccccgggacagtccatctcagcctctatactcacacctcagcgtcgcgcccagctcagtgctgttctcagctcaaaacccagtcagaatggactccagctgaccttttgattttactctcagaaatctgagactgccctccaaggtcgaagtgtcaccactggaaagggtccctggctttggagcctcctcccgaagcctggcagcagtggcagcagtgtgtttgccttggattcgtttaaaaaaagaaaaaaaaaagttggctcttctactttttgtgtgtgtgtgtgtgagacagagttgttctgtcacccaagctggagtgcagtggcacgatctcggctaattgcaacctctgcctcccaggttcaaacaattctggcgcctcaacctactgagtagctggaattacaggcgcctgccaccacgcccggctaatttttgtattttcagtagagacggggtttcaccatgttggccaggctggtctcgaactccgtgacctcaggtaatccacccaccttggcttcccaaagtgccaggattacaggcgtgagccaccgcgcccagcctcttctgtttaatttcctgtcgaatgccacgtcctgctctgttaacacggagtggcagagcagcactaactttacaaatctgatgtggggagaggaaagatgaatttttatttcataaagccactagatcagcaattctgacccctgtgaccacagagttcccatccacgcggctaacgacatgaccagagaagttcgggggttcagagcatctccatcccccttttggggactcagagcgtctccatcccacttttggggattcagagcatcttggtgaaacctcgggggctcagagctcccacctgaagaagccctctttattcaggtgcagttccctttcccaaacattctccggggttgtgcattccgcagacacatttgggaaccgcagcgccagatgttgatgctgtcccgggttcggggaagggaaggtacaggtatctcaactccacaggtggcctccatgaaccagcgccgtgtggatttctaccttgcctccatcgaagacatgctggtggccatcggcggccggaatgagaacggagcgctctcttcagtagagacgtacagtcccaagactgactcctggtcctatgtggccggcttgccaaggtgatctggggcttggtggaaggttctccaaatgggatgtttttaagggacatagttcagtccacgtgcctcactttctgggcatgttggcctccaattccaggaatgaaatcttccggcttgtcaggaagagtgggtacaccatgaggggcggagggcgtgacggtgcacagtccgggctccggtttcagacttagggcaagggtcagctctgccgccatgacggacatccctccatggctgagtgtgtgcagttgctgagcttcagagggtgaggcctgacctgaggatctccctgagcttgggcaggaggagttcaaagagatgggggtatatgtgctagatctaagcctcaggcatgggtcttcaccccgctcggcctttagttcctcatctgtagaggtagacgataatgatacccaccccacagcactgttgtgcagagcagatgcagtgctgcttgtgaaacctgcatccacatgcagggagtgccccagggtggccgcctcaccctcctcagtctcccctgcgttccgatgtgcatgtatcgagcatttattatctccatgggattagcagaaggtgcacaccattttttccaccagttccctgttgccgcacccagcagtgcactttctgaaccagtctttgctgtggaatacatccaggtgtccgtaagagttagaagtgtgtggggtaagcgctcgtatttttgtttttctgagagagagtctctctctgtcacccaggctggagtgcagtggcgcgatctcggctcactgcaatctctgcctcctgaactcaagcagttctcctgcctcagccttctgagtagctgggactgcaggcgcctgccaccacacccagctaagttttgtatttttggtagagacaggatttcatcatgttagccaggctggtcttgaactcctagcctcaagagatccacccacctcaccctcacaaagtgctgggattacaggcatgagccactgcacctggccatattgatcctttcttattcactaaaggccctggtttacatcagggttcccacttcctggcacagttgtgtgggttttgaggaacacaaagcaacatgaatccaccattacagcatcacgcagaatcatttcactgccctaaagcccactgtgtgcgtgctgtccatccctccctcccctctccccacagtcctggcagccactgattttgctgtctctatggttttaggcaaaacttttcccgagtgccagcacagttagaattggactgtatgtcgtatttcctctttgatgtgtgattcatcgggtgcatgtgtgcctgctagctcattgttctagtcgtttccagccattgtgaaaagggtgatggtcctgtgattattcccatttcccagatggggcaagggagactcagagagagtgaagctgggttctggcccaggcggcctgactgcaaagctgtccacttccccgccctgccctgccatttctttgctaatgacggctactgtctatagagtgttcatggggtgcccactccctatattcttaaatcctcatggccctctaagacggcaggctgttccccggctcggagggggtaagcctggcacagccctgagctctccctctgtctctgcccgtcgaccctgcaggttcacgtacggccacgcgggcaccatctacaaagacttcgtgtacatctcggggggccacgactaccaaattggcccctaccgcaagaacctgctatgctacgaccaccggacagacgtgtgggaggagcggcggcccatgaccacggcgcgcggctggcacagcatgtgcagcctgggtgacagcatctactccatcgggggcagcgatgacaacatcgagtccatggagcgcttcgacgtgctgggcgtggaggcctacagcccgcagtgcaaccagtggacccgcgtggcgccgctgctgcacgccaacagcgagtcgggcgtggcagtgtgggagggccgcatctacatcctgggcggctacagctgggagaacactgccttctccaagaccgtgcaggtgtacgaccgcgaggccgacaagtggagcaggggcgtcgacctgcccaaggccatcgctggcgggtccgcctgtgtctgcgccctggagccacggccagaggacaagaagaagaaaggcaaaggcaagaggcaccaggaccggggccagtgaccctagctgcgcctcttgggaccatcctcaccgtcacctcccagggctctgtagaccagcagcaacttcttagtattccggaaacattatgtacaacttagcagctttttttacttttatgattcttggtatttctatgatatcacagtaaccaattaaatactatctgtaactttacatatcttgcttgaataactaaccctgggcccaggcagtgagcaaccccttgtatcttcacaggtctttgccccgtgttatgattcctcatgggtccttgctgactgtccccctgagagtagctggcacgtgggtaacacagaaatttctgtagtgaagcttgggcctcaaagggttctcttaggccacctagtccaagcctccccaaacctggctgaacttttaagaatacagatgcgtgagccccgctcagaattatggaatccaaaaccaccaggaacggggaggaggtggtgcccagaagctgtattttaactagttcttggaattctgggtattagtcacatctgggaatcactggcaaggtccagtgtgtttgttttataaatgagtgcacagagaccacccatgagggtgagtgagtgagtgaccaggggccacgcagctcgctagactgtcagatgagacatgatgacttcccgctggggagctgttctccgtatcaggtgaacgctgtttctgaataattccgtctttcctcattggaaaccttcttgaattctaaaacgttacaggtaaccaaaaacgaaaaaaggtatgaagctctttatacatatttttttgtaatttgtgcatttttttccttttttttttttctgaacccactgtcttttatattactgatgtactgagctcccaaatctgtttatttctcaggaaagaaaaagtgagtgctatggaatttgccatcgttctctgtgactctatcttgaggcgctgttgaaagttcctgcacagaggagcacatgtggatccctgagaaggcagtggagggctccctaactcccacgccaggtcctgccccagttttctgcttctaagtagtttcgtgctgctgggcaaattctcgaacaagtccgtgtgttccctcatccaccccgcttagccacaggattagatggaataccctccaggctcctcccgggtgatagggccattcagcctctgagctgttcgtacccggatggcatccccttcaggatgtggagctggcctgcactgactcctgcaaacagttcctaaagcaggtgtcagggtcgcttgccctttaagagggctcttagctgcccgagtggatgagaaacgtgcagaactatgggaggataggagtgtgatgggttttaagcatgagccaaggaaggcatgaatgagctgtacctcacccagcatccgatggcagagatcagtaaacttcaagatgtgcttcatcttcaatcctagtctaacaccagtcttcctgcagacagttccgagagcaggtctcgatgtcacttgccctttaagagggctctcagctgctcgagtggatgaggatcaatgtgttaagattgatattagactaggaaaaaaatcttagttaactttaatttccatttcttctgcttctttgctgcccctcctttcccttcccttcagggtttactgtggttctcactggtctgtttatgtagccatccagaagagatgagagcattttggggactgaaagcttcaatagccaacttactgccctctgtggttagtgaggagggcagtctgcatgttcagctagctagttatttgcatgtgaagtccctggaggcttacaaactgttgagaggttctgcgaggcatacaaacaaacagaccaaaaggctggaaactctgcttggagctctgcagcattccggtgtatgaaaggttccgagaagtctcaacccagcatttccaaacttctttgagcctaaaagtcgtttgtctcatacctagtcccagacccccacaaaacatgttttgcagaacttctgccaactttgggatagcttacccccttcctattcgggaaaggttttattgcttgtagacccctcagaaggcagggtagggtgtacgtgggctgttctccccatctcagcctgggtcatgaacaaacgggcagttgtttggcctgaatctcggggcaagttggggagagcacatagaaagactctgtgagtgatttggggagtgggatagctttgaccttggagagaggagagccattggttttcagcctaagccagctcttttatgttttgcttctgggacttgtccctggaaatgtgtgagcttctggcctctattctgattttcttgtgcctcatgagttacatacgacgtcctgcgcttcatattttgtggtgtctctcctgatactatgaaggtggtttgtaattgacatggctttgaccctaatattactaaggttgggaccacccttttaaagggaggataaacaagtttcatcttgtgggtcaacttctaatatttgatggtggctacactgtgacaagaaaggtttttgagcttgttggggtcagtggatgggcacaagggcacccagtggtggtgcccgggccaggtttttgttacttgtctttttaagttgaaaattcaccctactgtgcatgaaaatggaactgaaaatggaagagaccatgcctgggcaacatggcaaaaccccatctctacaaaaaaattacaaaagattagccagggatggtggggcatgcagtagtcccagctgcttaggaggctgaggtgggagaatcacctgagcctgggaggttgaggctgcagtgagctatgaccacaccactgcactctaacctgggtgacggagtgagaccctgtctcaaaagaataaaatgttttttaactcagatgggcagagtttgggctgtgcttatgcagtggccatttgaaccgcacagtcacgaatgtggggttttaaactagagtgatgaaggcacaggtgcttgcaggctgccattttgagagggaaacagccacacatgtcatcatgttaaactttcagtgtttcaagctattctgcttgaattttgaagacacctggatctttttttttttttaacatttcaaaataagcatggcaggcttctattgaggtttggacttctctcatttctaaagaattagagttgtaacttcatattagttgtaagtttggggtttggtcctcacccaagttggaaagctgtttgcttaagacatagatgtattataataatagaagggagggagtagaaagctgatgaacccttgttacttatagcaaacttcctgctgttttaaatgcacagagattattttatcaactgtggttagcacgcaattggtatttttattgttctgccattttattgaggctatcaagtgggacttcagacctggctctgagcaggaccacacgtgtgtatttatattgagtgccctcactcatgataaggtgacttcatggagacccagaaactcaccctaaggggtgttcacctttgaggtgggcatccagatgctgaggggaagtggggtccatcctctgaggtccaggggcctactttgtgagctcagttgtgttcacctgtggttcagtgtacctcggcccctaagccaagtgatcgttcagtgacttgcagcaatgtgggaagtgaggggacccctgccacaccccccaccaccccctgtagagtcactgaccttcatccttcaccctggtcctccatggtgcagcagcatctcatgggccttgtggctgtcagagcccgtggttggaaccccgtccactggtcccaaacctggaggggcagctgcagatgaggtttagacctcctggtgtctccgtggattctgagtgcccaggaggggaggggagggggtggcatcctggcctctaggataaatgcctggagtatagggcagcgccacgggcacttggagaccctgtcctgcgcatctgccaagcctggcagtttttagagttttttgaaatgttttgatactttttgatacaatttgctaataactgttttgtagaatgcctgccggggttttccacctcatccctttcctccggccccttgatttgtgctggacaacaaatggcagcaccaggacctcgcctcatgtggctttgtcttggatcttgcccttctccatcgctgatgtgatacagctctagaatttcgtgaagttgcatgcaaagttgcatgcagcccgtgggtatgactgtctcaggcccccagctcatttgccaagaggaaaccttaacccccctgagagggtctgcgtttcttctagagctcctacctcagtggtgtgcacagagttggagacacctgagggctggtccacgtctcacctttgccatacgggtcatttcttgatcaaatatatgactggggtcctggtttactcccgcccaccctttcttttaaagtattcttaacatgaaatccacaaaagcggaaacaatgaaccattcttgcactttacagaatcattgtccttagctttagaggttgttaatttcttgtttttaacatgaacagaatgtgtggttctgaaggtgtgtgggggtctcaagaaattgtcctttggggccgggcgcagtggctcacgcctgtactcccagcactctgggaggccaagggggacggatcacctgaggtcaagagtttgagaccaccctgaccaacatggtgaaaccccgtctctactaaaatacaaaaattaggcagtcgtggtcgcctgtaatctcagctcttccggaggctgaggcaggagaatcgcttgaacccaggaggcagaggttgcagtgagccgaggttgcgccactgcactccagcctgggtgaccgagtaagactgtctcaaaaaaaaaaaaaaaaaagaaaagaaattgtcctttggttgccttagttaccagagttgaatgaatgtacacatttcggtagtgggggggcagagcggataaccccttccttgtctgtttcctttgagaaaggacactccaccttttcaaaggtacttaaagccatctttacagattgcttgtaatgtaaggaaagagtcatgtcctttggattgattgaggttaaatcatcaaccactagccccctttcaaaatcagcgagatatttgatgattaagtgattcattgggtatgttctggctactgatgttactgaaatctgcaatcgtgtatgttttttaatttgttgcttttgtatttgtaattttatgacatttcgaagtttctgtgtcttaactctttttaattaattttctgcacgttgcttttttctctttgtttttaattccatacagagtattcaattcttgaaacacattaaaataatttgcttgctagggtatggtttattttataattacattcctagtcttgtgtggttattgtaatgatgtctggtcctaatttctctgcccgtatgaaaaagaaccccttgcctgttgatcctaaatataatttggaaattaaccagacttccttttggtgttgtggggaggctgggacatttcaattctgctttcattgtgtttctaattactgtattttgccaggaatttcattcagttccttgattgcagggctaagtccccgtgacctgaaatgaaactatttgcttaaatgtgtgtcaactggggtaatttgattagaaaagaaacacagaaaccaagggaaacagcttatgacaagcagtgtgctatctttatcagaaaaaatgcaatcacaatactctaagaaccagctctgttttccttcgggcgctcccctgccttgctggggttttgcaaggccaccagcagagaagcccaggcacggttgtgcaccctttccttgtcccttcggcaggtcagcatcgggagggttggggaggggtgtctgcgcagccatcatacctgataaggtggttagaatttgcctctgagccagtgagccccaaacgggacccgctgcccggtgccgacttcctcacctgggttctttcgcatccgcttcagaagcatctcaggttaggttgatagtctcccgattttccaggtgaagaatccaaagctcaggttaattaccttaccccaactgtattgtcttccccgcccagccagtcagtcgttgccttggtttgagttctcttcaacgcagaaccttagacaaggacttggacacaggtagggcagagaggtggtccccgggaagccagaatgccatgaagaaggagagaaggcccacgagaaggtgctttattgccgagtaaccccaagccacggcttccaacaatatcatggcggaccactctgcaggttgactgggcttggctcagaggctctcccctgaggctcctgcacggtcacatggtcatggacaggtagtggctcttgaaggcgtgagtgagaacacacagctcctccagcatctccctctccctttcttctctctccctctctccctgccttctcatttccccttctcttccccgcccccccagtctctttctctctctctccttgttcactttggtctggctctctctggtctcttcacacggcctcacctagatttcttacatggcagccaaaggctcccagagcaaacgtcccaggtgtgatgagcagaggccacgtggcttctgccagaacctcctgggaagtcagggagtcagtttgctgcatttcacctcttgaggccatcagaaaactcccccaggttgctggccctgcgagaggtgtcagccgtgtcccgtccctgaccctggaaccctatctgcaaaccatgggaggagctgggtgtgatggctcacacctgtaattccagcacttttagagacctaggcaggaggattgcttgggcccaggagtctgagaccagccggggcaacatagggagacctctgactctacaaaaaaaaaaattttttttttttttttttgagacagagtcttgctctgtcacccaggctggaatacagtggcaggatctcggctcactacaacctccacctcctgggttcaagcgattctcctgtctcagcctcccgagtagctgagattacaggcatgcgccaccacacccagctaatttttgtatttttttagtagagatgggttttcaccatgttggccaggctggtcttgaactcctgacctcaggtgatctgctcatctcggctcccaaagtgttgggattacgggcgtgagccaccgtgcctggctttttttttttttttaacagggtcttgctctgttgcccaggctggagtacagtggcgtgatcttggctcactgcagcctcctaggttcaagtgactctcctgcctcagcctcccgagtagctgggactacaggcgtgtgccaccatgcccagctaattattattattttttttaatagagatggggtttcaccatgttggccagactggtctcgaactcctgacttcaggccatctgcccacctcggcctcccaaagtgctgggattacaggtgtgagccaccgtgcccagccaaaatttttttaaaaaaaattattcaagcatagtagctcacacctgtaatcccaacactttgggaggccaaggcaagaagatcacttgaagccaggatttcaagaccagcttgggtaacacagtgagacctgatttccacaaaaaaaatggaaaatcagccaggcatggtggtgcatcgttgtagttctagctgcttgggaggctgaggcaggaggattgcttgagcctgtgaggttcaggctgcagtgagctatgatcacaccactgcactccaggctgggctacagagcaagaccctgttctttaaaagaaaaaaaaaaaagccctcagtggaaggaaggtatgttcctaaggccactgcctcagacggcaggggtttgatgttgctgggcccgcatgctgtcggttggagaggagagcatttatggggcctgcgctgctcagtgagggctgctcccagaggccttggcgcacttcagctcctggctgccgtgcacacacagagccaaccaacagccaagcagggcctgagtggccatgggacggaagtgcagtgtgtgatggaggggacaccgtcagcacgtggccaccccgagcctgcactgggtgcccagcgccgctgtggctagaatcagcagagggccaagggcctgcactaggacaccaggggtagctgctcagcaggggcagatgttaacccaggtctgccagctaagaccacatttttttttgtttgagacagaatctcactctgtagcccatgctggagtgcagtggcacaatgtcagctcgttgcaacctccgcctcctgggttccagcgattctcctgcctcagcctcccgagtagctgggattataggtatgcaccaccacgcccagctaatttttgtatttttagtagagacagggcttccccatattggccaggctggtcttaaactcctgacctcaagtgatccgcctgcctcggcctcccgaaatgctgggattacaggcgtgagccaccgcgcctggccatattttttaacaactctaaaacaaccaccaccagagtctctgtatagggttcagaattgtgtccccaaaggctccactacaatgcaaatgtgtgagtggagaggttaaccagggaagccctggacttccacaaaaccatcggcagagatttctgttacctcacccaaagggaacagagaggcagtggataccggacagggcgtcttcgtggggtcaggggagggcggagggaggacccgcacagaccccatcgttgctacctgttggctgaggcctgggccactctctcaaggacctgcccacagccttaaatcaagaccgattagaactcactttcccgctggagcacgatagttctgaatgaactctgcgttcactctcaacacacgtactcatcaagcctccactctgtgccagacaggcgctgtactagatgctggggatcgggtggtggacaaagaagcaggctgcctgcccccaggggcagaaacagaccaacaagatacataggtcaggtggggataagtgatatgaatgtactaaaacccgctgtgttgtatacttttttttttttttttttttgagacagagtctccctctgtcgcccagtctggagtgcagtagcacgatctctgctcactgcaacctccacctctcaggttcaagtgattctcatgcctcagcctcccgagtagctgggattacaggcaccggacaccacacctggctaatttttgtatttttagtagagacggggtttcaccatgttggccaggatggtctcgaactcctgatctcaagtgatccacccccttggcctcccaaagtgctggacaggcgtgagccatagtgcctggcctacattgtatactttcaatgtatacaagtcagtggattttagtacattagtttgtgaatctcaaactacaactttttttaaaaagctctgcaggggaaggatgtgcagcaagttagaggagcaaagtgctgaaaatgtgagaaatgggagctggcgcatcacagaaggctgtgagctcgggaaggaggtgatctgattcgttttcaaaggagagcttcggcagctgctgggtgtgtgtttgtgtgtgtccaagtctatgaattttaacaaataaccaattattcacaaaaatcaaagcccattaatggatgcatggataaacacaatctggtctgtccctgcaacggactattatccagtccgtaatacagaattaaattctgatccacgctacaacatggatgaaccttggaaacgtgatgctgagtgaaagaagccagacacaaaaggccacatgttgtatgattccatttctgtgaaatgtccagaattcgtcagaataggcaaattcatagagacaaagtagattcgtggatgcttagggctggggtggggacgaggaaggatggggagcaacagctcaagggcacggtatttatctttgtggtgatgaaaatgttctaaaactgggtgatggtcgcacgcatctgtgactgtacaaaaaatggaatcgtacactttgaatgggtgaaatgtatggtatgtgaatgatatctcaagttgtttaaaatattagagcaatatttccctccattctcggagttctgtgtattggtctcctagacagtacaggttgagaggcagaattcaacctccctgcttagattctaaaacgggttaaaacggtgagactagaggcaacattcatctcaagtctgcgtgagagcagagctcagggcatcctccagggggcgcgctagagcagcagtcctgaaaatgcggtccctagaccagcagcggccgtgacagtgggaacttagcaatgcaaactgccaggtccacccccagaccagctgaatcagccactcctgggctgggggcctgccaatgcgtgtgtttacaatgtttacaagccctcccagtgattcttttttttttttttttttttgagacggagtcttgccctgttgcccaggctggagtgcggtggcgtgatttctgctccctgcaacctccacctccacctcccaggttcaagcgattctcctgcttcagccttccaagtagctgggattacaggcgtgcgccaccgcgcccagccaatttttgtatttttagtagagacgtggaggggaggggtgggtgaggtgggattcaccaagttggccaggctggtcttgaactcctgacctcaagtgatccacccaccttggcctcccagagtgctgggattacaggcgcgagccaccgtgcctggccctctcctggtgattctgatgcctgctcaagtcggagaaccactgttctccaaaggtatctgtctccattctccacccacagacctacctaagctatgagtccctgcccatagccaacagctgtgcctggcttgctccggccgaaacctgaaccaaggggcagctttcagattaagcacagccgggtctgaatcttctgccttgggaagtctgggaaaggccttggagtcagcctctgcaggggcatgcacctgttgcctccctgagaaagtcacctcctctgtgcccttcctgttgatggcagcaggaaggctgtggcatggcccaaccctttaactggtgtccagcatccgctggctgtgtgctcagagcatgctcagagcctcatgctctgttcggatgggatccttttaccaggtatgctgcaatagtgtgattcatccccccaggggccccagccccactcttgcaggcatctaaaggtgctaaaaatacataactcctaagtgcggttctgtatttctgactgtaccagtgttgtgggcctttttatgctccaagctgaaattcaagaggcctggattccaatataaggcccatgattaatgggcctccagcaaggcctcactcagcatctcctgtatttagatggggcctaaagcatgtctctgtgatgtggaccaagcacggggctataagtcagggagtgtgagttgcagccttggctctgtcacgtgcacctgggccagggcttcatcttgttcaatttcagttcctcacactatgggataagatggttggagattagcgctcctctgggtgtgatctgcagagccctggtctgcctaaaggacctgcctgaggtcctttaagcagctgcctaaaggagtttgtggtcaggaaacatttggggagctctggagatacattccccctctgggagactcaacattagagaacacgttcatatttcttttattttcttttttctttctttttcagatggagtcctgctctgtcacccaggttagagtgcactgcaacctccacctcctgggttcaagtgattctcctgcctcaacctcccgagtagctgggactataggcgcctgccaccatgccaggctaatttttgtatttttagtagagacgagatttcaccatgttggccaggctggtctcaaactcccgacctcaagtgatcggccctcctcggcctcccaaagtgctgggattacaggtgtgagccacggagcccagcccaaggcctggcttttgattttgcagatctaaaatcttgatttggttcatgcatctgtagtggttaagtttgcttgtaacttggctgggccgtggcacacggctgtgtgtttgaacattattgtagatgtttctgtgaaagtgtttttggatgggattaacatttaaactgatggattttgagattgccctccagtatgtgggtgggccttttccaatcggttgtaggccgtaagagaataaactctgagtttcctgagcaagagggagcagcagacagccttcagacatcagctgcaacatcagctcttccctgggtctccagcctgccagctgacttaaagtcattctctctgtctctccctctcactgtgtgtgtgcatgtgtgtgtgcgcgcatctggccatggtggcctgtgcctatagtcctagctactccggaggctgaggtggaaggatcgcttgagcccaggagttgaaggctatagtgagctgtgattgagccactgcactccagcttgtacgacggagccttgctccatctctcaactatctatctatctgtatataaacacgcacacaattgatccttgaataatatgcgtatgaactgcgtggtccacttttacacgaattttcttttgtttctgtcgcccctgagacagcaaaaccaacccctcctcttccttcttctcctcagtctatgcaacatgaaggcaaccaagatgaagaccttcgtgatgatccatttctacttaatgaataataaatatattttctctttctttttttttaagagatagagtcaggctggagtgcagtggtgtaatcacagctcactgtagctgcaaactcctaggctcaagtgatcctcccacctcagccacccgagtacctgggactacaggcacacaccatcacacctggctaattttaaaacatttttgtagagatggggtctcactatgttgcccagactggtctcagactcctggactcaagcgatcctcccaccctggccttccaaagcgttgggattacaggcatgagccaccgtgccttatgattttcttaataatgtttcttttctctgggtcactttattgtaagaatacagtatataatacatgtcacatataaaacgtgttaatcgactgtttatgttattggttagacttctggtcaacagtaggctattagtagttaagttttgggggagccaaaagtcatactaaaatttttgactgtgcagggggtcagtgccccaacccctgcatcgttcaagagttgtccacgtgcacacgcatgcgcgcacacacacacacacacaaacacaggcatgcacacacatgcacacacatgcaaacacacaggcatgcacgcacacacacgcatgcacacacgcacacatgcacacacattttattggtctgtttctctggagaaatctgactagtacaacttccacagaacagactcagggaacacacaacaggaactggaccgaaccctagaagacagcagtgagggcagctcctcccaagaggcagggctttgcctcacatacctgctcacccactttacatggagagagaagtgagttgagattagaacatatatatacatgtacatatacatatgtacatgcatatgcatacacacaaaatacacacatatacatataatacacatgcacatatatgtatgcatacatacatatatacatacacgtgcacatatgcatatacatacacatgcatgcacatgcacatatataaatgcatgcacacatacacatatccatatccatacacatatccatacacatacacatatgcaggcacatatacataaagccatgcacacatacacatatgcatacagttacacgtaaatatgtacatagatccatgggcagggccaatggcttttctgcttggtcagaaacctggaagaaaaacagtgtctaggacagggaggactggagaagagacatgtggatgggctcactcacatgggcccggagtgtgaagatctttgaatccgtgttaatgttcactggagaacattcaccatgcaagaagcactcagcgactaagtaagcaggatgattttgcccatagatgtcagccagcctctgaaattaccaccccactgctggtacagtgggcacatgaacagaatagccgaggtagcagggatgggggctgtgcccgggctcagcagcacacgcaccacggctcacctaactgctcccacccccaacacagagcaatgctgagctgcccatatggcaccattcctcgagacccacctgccactcggtggccagttggttccactgggccccttctaccctgtaaggctcagcagatcatgttgccccgaactgacactgttccaggtatagtttgcccttgcccacagggtctctgcagaacctctagctgatggctttcacagcgtttaattcactgacgtgggatcctgcgtaacaacaccttgggacaagagacccactttacagaagagaaggtatggccgggtgctgctggctcacacctacaatcccagcacttgggaggctgaggcaggaggatcccttgagcccagtctgggctgagttcaagaccagcctgggcaacatggtgaaaccctgtctatacaggaaaaaaaaaaaaaaaaaaaaagcagcagcagaagaggaggaggagataagaaggtgatcatataaccttgggattcccggtcccatcactctaccgcctagaagctgccagtgtgataaggtgatagaaagatcttttgaaagcacagtaaacgtggcagcctagagacattccaacttgtacaacagatcaaagccccgtctctaaactatctgtctatatataaacacacacacaactgaaccttaaacagtgtggttgtgaactgtgtggtctacttttacacgaattttcttttgtttctgagactttggggcaccacctcctgaaatgtaacataccccctaaatcaacgaccaacatagcatgcggtgttcctaaaatggagaaagcattagtctaggaacaaagggatggccggaggtgcggccctgctgagtgtgttctcgatgaccacgtaggaggtgtgcctcccactcctgccaccttcgctctggaggtctaaagatgcagtttctccgaagagttcatgtttccaccaagagatgcagagaggtcccattcaacttgaagctctgcttcctcctggtcacttctggctcctcatggaagcagtctgcaggctgggatgcagcagcaggaggcagcagggctgctattacacacagaacggggggggctctctcagacctcctctgcttagcttccgtagagattgcaacagcagcagccacagcctgcaaaaggcatgatggccaggggttcagaccctccaaggatgagaatctgagtcaccccccagttccaggttaccctgctgggaccaacagagggcctgggtcagggtgaggggaccctagtagaggatggagaagaatatcagctgtggcccccagacagctgggttggttccatgaactttctttcctctagtaaatttcccagccgggatcctggagggactgtgtatttgtttcccggggctgccataacaaagcatgacagactgggaggcttaaacaacggaaacctattttctcacatttctggagcctggatgtgtgagatcaaggtcggcgtggttggtttctctccttggcttgcagatggccgtcttctccccgtgtcctcacgtggtcttccctctgtgtgtgtctgtgtcctaatcgcctcttcttgtaaggacaccggttgtattggattagggctcatgtgacctcattctcatttaatcacctccttaaagaccctatgttcaaatgcaggcacatttctgaggtcctgggagttagaacttcatttgaaatgtgcagggaacaaaaaattcagctcataacaagctgtttccatgtaggttgaacttagtgtattaaacaagtgatctaacagtgcaaggggtggacagtacagaacccaggggcatcgtccctgcccccacccttcaagactgcagtgcatggccaggcacggtggcttatgcctgtaatcctggcactttgggaggctgaagtgcgcagatcatttgaggtcaggagttcgagaccagcctggccaacatggtgaaaccccgtctctactaaaaatacaaaaattagccgggcatggcggctcatgcctgtagtccgagcaactcgggaggctgaggcacaagcatcgcttgaacccaggaggcagaggttgcagtgaaccgagattgtgccactgcactccggcctgggcaacagagcgagactggctccaggaaaaaaaaaaaaaaaaaaaaaaagactgcagtgctcattctcccagctgccgggaacattgcccctgacagtttgtggctgagtctctcactgggcatttcccctggccaaaggaactgccttacccagggatgccctcctcccagggaaagctcccatgccatgtctggccaacacgggagttcagagctcagcctcttttctccaatatgtgacacctctgagggccatcccaggttcagggctgtccataaaacctcagtttaccttctccctctgctcaatcctgttccccgcagccctggcaggtgttgattctcagagcacattccccaaccaattccctgcatgcaatctcatagtctgtttttgggagatacaattgctatgggtctaaaagtttgtgtcctcccccaaattcctaggttgaaatcctaacccccgaggtgatggtgtaaagaggtggagcctttgccaggtgattagggcatgagactggagccctcatcatgggattagtgcccttataagaaaggcctgagggccgggcacagtggctcaagcctgtaatcccagcactttgggaggccgaggtgggaggatggcttgagcccaggagtttgagaccaacttgggcaatatagcaagaccccatttctaaaaaaaaaaaaaaaaactatatatatatatatagttttttttttaattagttgggtgtggctgggtgcggtagctcacgcctgtaatcccagcactttgggaggccgaggcaggcagatcacctgaggtcaggagtttgagaccagcctggccaacatggtgaaaccccatctctactaaaaatacaaaaattagccaggtatggtggcaggtgcctataatcccagctactcaggagcctgaggcaggaggatcacttgaacccgggaggcagaggttgcagtgagctgagatttcgccactgcactccagcctaggcaacaagagggaaattctgactcaaaaaaaaaaaaaattagttgggtgtggtggcacatgcccgcagtcccagtagtcccagctactcgggagccagagactggaggattgcttgagcctgggaggccagggctgcagtgagccgtgtgtgcgcccctgcactccagcctgggcaacagagcaagactttctcactttctctctctttctctctctctctctctgtatatatatgcctgagagagaccccttaacctccaaccatgtgagcacatagaaagatggagccatctatgaaccagaaagccctcacctgaatttcctggagccttgatcttggacttccagcctccagagctgtgagtaataaatttctgttgtttataagctactcagcttatggcgttttgttgcagacaccagtctagggcaaatccttgtgcactgaagtcactagggtcaaattctcactattggctgtgcacaaaagccagcacatacgcataaaccgagactcatgtgcagggctttatcccaactttagccgtcaccaggcaggaaaaggaaagtcccaggctgttattagggaaaggcaaatgaaaccacaataagagaccacgtcacagggactaggagggctagaaccaaagatagataatagcaagtgttggtgaggatgtggagaaattggaacccgtctgctctgttcatcggaatgtaatgggaacagtggtgcggccgctgggggagacagtctggcagctcctcaaaaaggccaacaatgcgttaccctaccacccagttattccattcctagggatatgctcaagggaaatgaaaatgcatgtccacaaaaaaactgtacacaaatgttcataacagcattattcacagtagacaaaagtgggagaaaacaaaatgtccatcaatttgatgaatagacaacaaaaatgtggtctctccatacaataaaatattattgcatcatgagaaggaaggaagttctgatacacgctacaaaccaggaaccttggaagtatcatactaagcgaaagaagccagacacaaaagaacacatattgtgtgactccagttgtatgaaatgtccagaacaggtaaatccatagagacagaaagtagatttgtggctgccaggggctgggagatggaagaaaggggagtgactgttaatgggtgcagagttttatggggagatgatgacaatgttttggaattagatagtactgatggttgaacaattctgtgaatatactaaaagctactgaatatatactctaaaaggctgagcatgcagtctttatggtatgcgaattatatctcaataaatttggaagctcagagaatgtgcaggacattgttttgctgacagagcatcattttctctgacatctcgaggcaggattcacacttttactggtggaatttcatttactctgtggacccaagcccaggcaatcaaagcattaaatcttcctagcaggaagaatggtctagacctggacataactcaggtcagtccaaatgagcctttgttttgggtcatctgtttgtatagttggtgaaagaaatgctgtttccgctggggatgccacaaaaaggatgttgttagactgcttctagcactatctaatcaccatgagagaagagttggcctaagaatggagctaacccaaaagaaagcaaggatgtaagaaggagaaagtaacacggagtcccattgacatcatttgaaccctggatccagccatgcctgaaaccctagacttttaggtccaacagatgataacatttctttttccttaccctagagatgcacttctgtcatttgcaagcaaaagtccaatctagactatttcatttaaatgtttttgaagcatattgtcagactcccagaacagttaaaccaactcatacttccaccagagcatgcatgtccccacagttgaagcagacattgagtcctgtagctctattataggttccaaacagacttccacaaagggtcctccatctcagaatcctcaatttgttttgttttgttttgagatagggtcacctctgtcacccaggctggagtgcagtggcacgatcatagctcactacaacctcaagctcctaggctcaagtgatcctcctacctcaggctcctgagtagctgagcccacaggcatgaattgccacacctggctatttttgtactttttgtagaggtggagtctcaccatgttgcccatggctggtctcaatcctcaattttagaactggacaagagtgcaaggaatcatgtatatgatggttaatttcacttgtcaacttgactgaatcaaggtgccgaaatgtctggacacagcttactctggtgtgtctgtgagggcatttctggacaagaggaacacctgagtcagtggactctggaaagcagactgtcctcctaatgtgggtggacctcatccaatcagtgggaggcctaaatagaacaaaagggagaattctctctccccacctgtctttgaggtgggacattggtcttctctcgcacttggactgtaacttacatcatctgctctcctggttttcgagcctttagactggaacaggaactacaccacctgctttcctggctctccagcttgcagagggcagatcctggaacttctcagcctctgtaatcatgtgagccaattccttacagtcaatctctctctctctctctttttttttttttttttgagacagagtcttgctctgtcgcccagactggcgtacagtggtaccgtcacatgggctcactacggcctcatccttgtgagctcaagtgatcctcccacctcggccttccgagtagctgggactataggcgtgcaccaccacacctggctaatttttaaacatttttttttgtaaagatggaggactcactgtgttgcctaggctggtctcaaactcctgggctcaagcaatcctcctttccttggtctcccaatgtgctgggattataggcatgacccccgcctttctatacatttatctcctaatggttctgtttctctggagaaccctgactaatataatgtgataacttgaacacagagaagaccttgtgcataaagatgttcattaatatttataagagcaaacaatttgaaataatttatatgcatgaaacttgtacagaacagaatatggtacaattgcttaaaataatgtttatgagggttttttcattttaatcaaatggaaaaattattgcacttgtgccatagaaaggccagaatacaaaaatcagatatcctgtaataataataataacactttcattttcctgagcaggaacgaagtgccagacactgccttgggtatattatgtgcatcattgaactaaatgacattctcagcattacattcaaaatatcaagaagaaagatttggaaattataccaaaaagccaacagtgtttgtcttttaaaataaatcggtttttttcccttctttccaccttgttttaccctctttaccacactgagtgtgtattgcttctatatttggaaagaattaaaacaaactgaattttttaaagtaagatggagcctcagtcccatgcctcaacccttcctccaatttgtacaagatcatggtactcatggtggcagccgatgacaggtggtagcatgcccctccccttctcccaggaggctgtcatccctagaatcttcccatgaagttaaatttaaaattattgtataactaatgtatcagtagtgctaccagcagcaacatgatcttatatgcaaatcggttttatttaatcacagcacaagcccagcatagtaattacctatcaagtggtaattacgcttttattatttttttaaactttcattaaaagaaagcattttaaattggaaagaaacaatccatgtcacaagccagttagtcaaaaaatgtttgtctgtttggaggtcccagaatgaacatcgtaatatccacccctgattaaacacttaccatgtagcaggcatctcgaaaagcacttcgcatttcatatctcaatatgtattcctcgctactgtgctgggaggtgcgtcttgttatcacaaaattactgataaagaaacagagactcagagaaatttcaatagcttgtcaagcttaatagaatttaaggcgaggagcatttaacacagaagccaggggaggtcggcagcagtgactcatgcctgcaatcacagcaccttgggaggctgaggcaggaggatcgcttgagcccaggagttcaacaccagcctgggcaacataatgacaccttatctccaataaataaataaataaataaaatattagctggttgtggtggcatatgcctgtagtctcagctatggggaggaggctgaggtgggaggattgcttgaccccaggaggtcaaggctgcagtgagctacgatcacaccactgcactccagccagggggacacatgagaccctgtctcaaaattatagatagatagatagatagatagatagatagatagatagatagatagataatcaatctgactttgtgatgaagcgatgcaatataggatgtataaaagggaagaatgatctgatagtcatccgtggggtgcctcagaggctctttgacttgcgtatttaaagttcctaaaggaagccaggggattttacccactgtgctgctttgcctggaggggtgtggacttcacctccctgctatgctttccacaaaggcatgcagatgcaaatgaaggaggagagaaaggcatgcccgcagtgcccgcagaagagcagtccttcccctggctgggggtcatttgcgtgtctctctgtctcctatcaggctgagagcagtgagagatgaggttctccgtggagttaggcactcctcctagactgcccctttctacccaatccaacaaatcagaaatataccactgggataacatttcctgtctctcaccattcatatcatttggcagattccgtgaccttaatatctttccatgccttctactgttactgatctccactgcagcatcctgttctggatggcttcattgggaagtctatgtattttctctagcttcaggcatagctgtatccaggagttcacaaagtatctccagcctggattcaggatttcaggtacaggctcttaactagctacgaaccttcccatctttttgtgcttctctaacctcaccatcttcccacccttagttccgtctggtttacatcccaacggatgtaaacagagaggtctttctaaaatgaaaatctgatcaccattcctgtgccaaagccatcagtggaaagatgacagttgaacttcctgccttggcatgatctgccatcagcctagctcctcaatctcactatcctccatttcccccatgtgccatataaagaaaatttataccaaacttgggatactgaatgccctttagatgtcataccaaattattgcattgtcttcaagtcagcccaacagtcatctgactctcaaaggcagagcttctccaacttgagtgcacgtcaggatccctggaggacgtgctaaacccggagtactggcctgctcctggtgtatccgattcagtgggcctgaagtcagccccagtatttacctttctcatagcccttgggggctaacgctgccggtccagggaccacactttaagaaccacagctctgagatcttctggggcaagggttagaaagcttcctgaaaagggtcagatggtcaagattttagacttcgtgggcaagacggtttctgttgcagtgactcaactctgctatggtagtgaaaaagcagctatgggcaatatataaacagatgggtatgcctgtgttctaaccttatttataataacaggtagagggccagatttggcccacaggccatagtactttgctgctctagagaaatgtaattttttttgagacagagtcttgctctgttgcctagtctggagtacagtggcgcgatctcggctcactgcagcctctgcctcctgggttcaaacgactttcctgcctcagcctccctagtagctgagattacagggacccactaccacgcccggctaatttttgtactcttagtagaggtggggttttgccatattggccaggctggtctcaaactcctaacctcaggtgatctgcccactttggcctcccaaagtgctgggatcacaggcatgaggcatcatgcccagccaagaaatgtaattttttaaacttactatttacttttaggacctagactctgcaaagttagatgttagctcatagaatattttttgttccatacagatggaaagtatttccatctgaaagaaaagataatttccaatgttgtcattttattgccttgtagggcgttaaccttcttgtgttatacttcacaattttattccagcattctttctttcattaactgtacagaccacctctgacttacaacagtttgacttaacaaatttttgaatttacgatagatttattggggcattaaattcatttttgacttaagatattttcaacttaccattggctttttggaacataaccctattgtaagtcaaggagcatgtgtgtatacttcagtctcttgtatcttcctttggagcaacttgactgccctggtggggctctcattaatgaggtaagtgaatctctgtcatgcgttcactacatattggcatgaaattttttttttttgagtcagggtctcactctgttgcccaggctggagtgcgatggtgtgatcatggctcactgtagcctcaaccttccaggctcaagggatcctcctacctcagccgccccagtagctgggaccacaggtgcataccaccatacccagctaacttttaaattttttgtagagaaaaggttttgctatgttgctcagtctggtcttgaactcctgggctcaagcaattctcctacctcggcttctcaaaatgctgggattacaagcgtgagccacagtgacctggcaacaaccaccatttattatctgtcacaatattgtgggttggctaggctcaactgggcagttcttttctctggagacagctggggttgccatcatctggggtcgtgaccaggctaagcaccttagttctcctctacatggcctctccatgcagctgagggctgggttccacgagggaacatcctgagcacacaagacaaaggcccagccctggagttgacacagcatcacctccactgcacgctattggtcaaagcaagtcacagggctggctcagcttctaggggacagaaaatagactccacctctcaatgccaagagtgtcagagaacaggcagccacttctaatctctcagagacagatcagggctgttaaactcaggaagaaatcttcaaggtgaccttgagtggattgggatcataatcccaaaagacacaatccagaatgccataatcccaaatgttgaaatcccagaagatcaaaatcttgaaaatatcattctgaaaaaaatcataaaacattaggccaggcgcggtggctcctgactgtaatcccagcactttgggaggccgaggttggcagatcacctgaggtcaggagttcgagaccagcctgaccaatatgatgaaaccccgtcgctactaaaaatacaaaaaattaggccgggcatggtcgcaggtgcctgtaatttcagctactagggaggctgaggtgggagaataacttgaacccgggaggcagaggttgcagtgtggcgagattgcaccactgcacttcagcctgggtgacagagagagactctgtctacaaaaaaaaaaaaaaaaaaaaaaaaaaaaaaaaaaattgtaggatatcacacttactaggatgttgctagaatccaggaaagattcaaggtgtctgtcactagctgggtaatctcttcaatctggaaaacctagtttgtcatggggtggggaaagggaatctctactcaggagaaaacataaagatggtttttgagggtatgaagcccattcgcctccttgtccagagactttagctaccattcagatgttctctggggcctcagctcatgattaattcatcaagtattggttgagctctcgtcacatgtcagggatcatgccttgtgttgaggcttacaatggaaagcaagaactacaagagcaagatcatgatcgttagagcagaaccaggaaaccctgtggctttgactcaccagcatgcaacgggaccaaaaaaaaaaaaaaaattcatctcctgtccaatttcatcagcattaagtggcctcctttctgaagagggacagctgttgggaaacccttgcggggtaagatgtaaaatgctcaccatccaccaagtcattgcttatttacttacttaatataataaaatcggggaaagatctgttaagaaataaacacttcacggcagtgctgtcaatgatggtgagatgctggaaacaagctacctgtctaacagtatgtgctgagagcaagcgtgtatatatgtgcattgatatggtttagctgtgtccccacccaaatctcatcttgaattgtagctcccataatccgcatgtgtcgtgggagggatgcagtgggaggtgattgaatcatgggggtaggtttttcctgtgctgttctcatcacagtgaataagtttcctgagatctgatggttttataaggggcagttcccctgcacatgctctcttgcctgccaccatgtaagatgtgcctttgcttctccttcaccttccgccatgcttatgaggcctccccagccatgtggaactgtgagtccattaaacctgttttttttttcttccttccttcctttcttttttttgagatggcatctcactctgttgccaaggctggagtgcagtggcacgatcttggcttactgcaacctctgcctcccgggttcaagcgattctcctgcctcagtctcccgagtagctgggattacaggtgtgtgccaccatgatgcctggctaatttttgtgtttttagtagagacagagtttcgccattttggccaggctggtctcgaactcctgacctcaggtgatcctcccacctcagcctcccaaagtgctgggattagaggcatgagccatcacacccagtctaaacttctttttcttaataaagtacccagtcttaggtatttcttcatagcagtacgaaaatggactaaaacatgcatacagaatctgaatacgtccacatttatatacatactgtgtacattcttagttgaccggcggagattctagtaacatcctactaagtgcaatatcctactgtttcgcccttatccctcccaggctactcttcacacggcagccagagagatcttgttcaaacctacgtctgctcctgtccctcctcattccttagtttacaggctaatccatgttccccccatgtgccttccctccctcctagggcaggttgctgagctgagtttgatgttggtgtttaaggataaacaggtttcagataacacgtctgcacagagggagccataattcagggctcagacggaccacctgaagtctgattcagctctggaggaaaaattgtctgtgctggttttatggcgtgacgtagagacagagccaaacaggaaagaaggcacgtgacaatggagacagatggaagcagtgactcgacaacacaggaattttgttcaacttaccctcacatctttggcatctaatatttccatacagtaggagctcaccacactttttaatttttatttatttatttttatgagatggcctctcgccccgttacccagactggagtgtagtggtgtgatctcagctcactgcaacctccacctcctgggttcaagtgattctcatgcctcagactcctgagtagctgggattacaggcatgcaccaccatacccagctaattttttgtatttttagtagagacagggtttcaccatgttggtcaggctggtcttgaactcctgatctcaagtgatctgcccacttcagcctcccaaagtgctgggattacaggcatgagtccccactcctggcccgttcaccacgcttttgtcaaataaataaatacaggagaaaatgaatgagtgatgcatataaagggtttaatctgagtgcttgacacacggtgctcagtaaatggttcacaatattatgtgaccagaccactgcccaattctccagcgccatctctgccaagactccctcactctcccaggaaactcagctgcgaatccaccctggcaccttggaagtgctgggtgaactatcccggtttttcctggatcacccttctctccattcctcctggatcacccttctctccattcctctatgccacaccctttgaagggacccttggtatcagcttcctggggtagctttgctgatgcttctccatgtacctcagtttaccctaccatagctgatgcacaccgtctcatttaatcctgacagtgacctgtgtgaaaggcatcattacccccatattacaaatgaagtaaaaggtttccaggagcagccttgcccacagcttcctgccgctaagcgggagagctgggaactgagcttggaccctcggactccacagtctattttgtagattcccatcacattcatgttaacaacaagctttaaaaaatcaaacaatcagtgtttgtgctagaatgctggggtcacagattatttttttcttcaaaattgtataattctgttaaaataatcaatcttgcctttagagtagaaaaatatactttttttgtaggctaaagaagattgaaagaatgcttttgttctctgggtggtctggcaaagaagaaaaaacctacatcacaggaaaattgatgaaacagaagaaattcttggatgagtgggaaaaggaagggtttgtaagggtgactggagcaagaaaaatgaaggagcattaaataataatgtcacccacttcaactcattgataatatgaacacattgcagccaatgtatcatttcacatgactgaagttgccaccaccttcatcatctccgttgatctcagtgtctactcaacgaagcatgcaggacaaacagggctttcttccttatgtaggaaccaagttacagaaaattagtgatttctccaaggtcttaagagtgacttggggggctgaattaagactggtacccaggccaggcatagtgactcatgcctgtaatcccagcactttgggaggcctaggtaggtggatcacttgagcccaggagttcaagaccagcggggcaacatagggagaccctgtctccacaaaaagtaaacaaaattaactgggtgtggttctgtgtacctgtagtctcagttgctctggaggttgaggcacgagaattgcttgagcccaggaggcggagattgcagtgagctgagatggcgccactgcactccagcctgggtgacagagtgagaccctatctaaaaaaacaaaaaggaagaatggatcaataatgtgtcttttatttttttcttattgcctttctttagcagttttttctcctggccaaagtctttgaagatgatggtgcctaaatttggcccactgtctggggaggggcagagacacgggaaatgagtataatgtttaagtgaggaactgcattatatagatcctcacttaagaagagacgtcagctatgtgagttctgccaccaaaaataaaagagtaaaagaattagaagaaaaaaaaagtgggtgttctagtccattcaacatgctatcaacgagcaaagagatccgagtgaggctcagatgagaggcagagctctgtgctccctccacgggtcctccctccctcctagggcagattgctgagctgactttgatgttggtgtttaatgataaacagatttcagataacacggcccgcagagcaagctgtaattcagggctccaatggaccacctgaaatttgatccagctttggaggaaaaattgtctgtgttggttttattacatgacagagacagagccaaacagaaaagaaggcaggtgatgactgaggcagagactggagccatgatgctaccagctgaggatcaccaagggtggccggctgcaccagaagctgggagacgggcctgcagcagcgtcctccttggagcctccggagggagcatggccgtgccaacacctgggttttggactctgacctccagagctgtgagaatacatttgtgttgctttaagccttccagtttgtggttgttacagcagccacaggaaacagcgactaggttggttgttttctgggacatacgggacttctcttacgtgcagttgtgtcccaaggactcctgatgaccttgctgaaacttttagaaaactgccctacaggccgggcgcggtggctcacgcctgtaatcccagcactttgggaggccaaggcgggtggatcatgaggtcaggagatcgagaccatcctggctaacacggcgaaaccccgtctctactaaaaatgcaaaaaattagccaggcatggtggcgggcacctgtagtcccagctacttgggaggctgagccaggagaatggcgcgaacctgggaggcggagcttgcagtgagcagagagtgccactgcactccagcctgggcgacagagagagactccgcctcaaaaaaaaaaaaaaagaaaaagaaaaaaaagaagaaaactgccctacagtgaaaccctcttcctcccagccctctgccttcctgctctcctctgcaggggccagccccacactctgccggccaatctcccatctctgcccacccttcctctttccctcctgggccttttccttctccacctcttggtccctgtttctcagaggaccgggactaacaaagacatccatatatcaggttcaacagctaccaagattttgcaacgtttgcttcgtcacttcctttttccttcctgttttgtcctcagatactttaaagcaaatcccatacctcacgtcatttcattccctacatatttcagagcccacttcttaaaaccaggagtattttcttatataaaccacaatgtcatgaccatacctaacacatgtattggtaaatagtttcttggtattttccaggcctcacctacattctctaaattatctcaaaaatgtcttttcatagtacttgatttgactcagttttgaactctgcatttggccaatcttttttatcccaatctgccccacttataagtgacatgatgttaggcaagtcacttgacttttttccatttcccccaccttaaaacggggaaaccaataggatctgccttactgggttttccaagaattaaatgaggtcattccttccttcattcattcaacaaatgttttgtaagcagctgcccaaaatgcctggaactgttctaggtcctgcaaaaatatcagaacacaagaccaagtacctggcttcatggagcttatattttttattattattattattattttgagacagttgctctgttacccatactggagtggagtggtatgatctcggctcactgcaacctccaccccccaggttcaagcaatcctcctgcctcagcctcctgagtagctgggattacaggtacctgccaccatgtccagtggatttttgtattttttagtagagacggacggtgttttgccatgttagccaggctagtcttgaactcctgggcttaagtgatccacctgccttagcctcccaaagtactgggattacaggcatgagccactgcgccaggcctgattctagtggaagaaaaagacaataaacacacaaaattaatatgccatagaatgtcagctagtttccccaaatgtcagctacaagtttccccaaattctaatttttgtttgaaagaaagtttgtgagtgctgtgggaaattaacctggatagcaggagggcacagggtggggcacccattatgggcaaaggagtgaggagggtcctttaggaagagacgaccattaacagaaacctgagtgaatgaagggttgagcctccctggggaaagttccaggcagacagagggcacatttaaagtgggcacttgctggcacgggagagctggagttctcaaacttcttggtcgctgatctcttcacattcttaaaaattattgttggctgacctcctgttggcaaagctaaagaattaaatgagaaaaaaaaaaaaaaaaaaagagccagtgcggtggctcacgcctgtaattccagcactttgggaggccgaggtgggaggatcacgaggtcaggagttcgagaccagcctgaccaacatggtgaaaccctatctctactaaaaatacaaaaactagccgggcgtggtggctcacgcacctgtaatcccagctattcaggaggccgaggcaggagaatcgcttgaacacaggagacagaggttgtatctgttgtggtttaccatattagaagtaaaaactaaaacattacaaaataataacaatttatttaaaatataatactttcattaaatgttaacataaataacatcattttagtgaaaaacaactatactccaaaacaaaacattttggtgagaggagtggcattattttgtatttttacaaatttttaaaaagtctgggccaggagcagtggctcacacctgtaatcccagcactgtgggagactgaggagaaaggattgcttgagctcaggagtttgagaccagcctcggattacaagcattagccattgtgtctggccccactgtcctatcttgtactttgaatggatcttttactcatgtgcaattttataacatcagtcatttggaaaacattgattcgctgagttatgcagatcttccaaatgttgacgcattctattctattttttttttttaattacagacataaagatggcaacaatagacactagcgactactagagggggaagggagggaggggggcaagcgttgaacaactaacagtgggtactatgctcagtacctggggggcgagatcattcctaccccaaatctcagcatcatgcagtatacccaggtaacaaacctgcacatgtacctcctgaatctaaaagttgaaaaaaagttacatttattactatcaccaccaatcttatcagaaaagtctttaagaattgggtagctgtccatctcacaatggtggatacaagtgtctccaaattctaatttttgtttgaaagaaagcttgaattttataattggcaataaatgctgtcaaatgcactgagcccttcctgtgcaaacctcactttcccttctaagaactctgggagtaataatgacaattttcaccatttattaagcccttgctgtatgccggacattttgctaagcaatttgcctctgttatcttattctccttttcacgatatccctgggaggtattatttctcccattttgcagatgaggaaactgaggtccagagacactagttacttgcttaaggccacacagttagtggcactcctatatactttcagagttccagaaaagaactcttgggaaacacctactcatcaagatctagctcaaatgttacctccttggggaagccttatgcccaaactggacaatgagaaaactcacttaccatttgttgaatggtagtttaaaagcaccaggcaccgggcatggtggctcatgcctgtaatctcagcattttgggatgccgaggcgggtggatcacctgaggtcaggagtttgagaccagcctggccaacagagtgaaacgctgtctctactaaaaatacaaaaattagctgggcatggtggtgcatgcctgcaatctcggctacttgggaggctgaggcagaagaatcgtttgaaccctggaggcggaggttgcagcgagctgagatcatgccactgtactccagcctgggcgacaaagtgaaattccgtctcaaaaaaataaaaaaataaaagcaccaggcagcacactccatgtgctagctccattacttcatctcctcctagcaacaggcttatagaacaggtagtgttgcttcccctgtcatagtttcctattgttgctggaacaaaatttaccggcttaaatcaacacaagttttttgttttaaagttctgtagctcagaagactcacggggctaaatcaagctgtaagcaaggctatgttccttctggcagcactagcagaaaatgtttgcccttttccagctcctagaggccacccacattccttggctcgtggcaccagcagcgcagcatcttcaaatctctccctctctctttctgcttctattttcacatctccttgtgacctgactctcttgcccctccttctttccctcataaggacccttgtgattacttgggacccaccagtcatgtcataattaggttatttcccaggataatccatctcaaagcctttaacattaccacatttgcaatgttccttttaccatgtaaagtaatatatccacaggttctgaggttggggcatggacatctttgaggggaggggcattattctgcccatcacaccaccttctacaaaagattcacagaaaatgtaggtaacttgcccaggttcacacagctagtgagtgggggattccagatttgaacttgggcctgtcttgactccaggcctaggccactgtccccagactcatgggagataccaggtgtattagtcggttgtcatgctgctaataaagacatacatacccaagctaggtaatttataaagcaaagaggtttaattgactcacagttccacatggcaagggaggcctcacaatcatggcggaaggcaaatgaggagcaaagtcacgcttaacatggcggcaggcaagagagcttgtgcaggggaactctcatttgtaaaaccattagaggctgggcgtggtggctcacgcctgtattcccagcactttgggaggctgacgtgggcagatcacttgaggtcaggagttcaagaccagcctggccatcatggtgaaaccccatctctactaaaaatacgaaaattagccgggcgtggtgtcacatgcctgtagtcccagctactccagaagctgaggcaggagaatcacttgaacccagaaggcggaggttacggtgagctgagatcctgccactgcactccagcctgggcgacagagcaagactgtctcaaaaacaaaaacaaaaacaaaaacaaaaaaacaaccaaacaaaccaaaaaaaccacacacacacacacacacacacacacacacacaaacattagatcttgtgagacttactcactaccatgagaacagtatggggaaaaccacgccaatgattcaattatcaccacgtggccccactcttgacacgtggggattattacaatccaagatgagatttgggtggggacacagccgaagtatatcaccaggctctgctaagcactgaaggccatagtgcttgttcatagcttccttttaacatctatttccttgtactgaaggtatgtgttcatatctatgtgaattatttgaaaatgaagactgggatcttttttatttatttatttatatatttatttatttgtgagacaaagtctcacttttgtcccccaggctggagtgagatggtgtgatctcagctcactgcaacctccgcctcccgggttcaagcaattttcctgcctaggccccccaggtagctgggattacaggtgcccgccaccatgcccagctaatttttgtatttttagtagagacggggtttcaccatgttggccaggctagtctcgaacttttgacctcaggtgatccacccgcctcagcctcccaaagtgctgggattacaggcgtgagccaccgtgcctggcctgggatcttttgtttattatcacttttatttgttgttcaagcaactgtatgataaaaatcagacaaacaactatatatatatatatatatatatatatatatatatatatatatatatgtttttttttttttttttttttgagacagagtttcactcttgttgtccaggctggagtgcaatggtgccatctcggctcactgcaacctctgcctcccgggttcaagcgattcttctgcctcagcctcctgagtagctgggattacaggcgcctgccaccacgcccgactaatttttgtatttttagtagagacggggcttcaccatgttgatcaggctggtcttgaactcccgacctcaggtgatccacccacctcagccttccaaagtgctgagattacaggtgtgagccaccgcaccgagccagagagacaaccataaatcactagtgagttttcacgtcccccagtttctatccaagtgcagatatcgcttttccatggttaaaattatagcacagacactatattgtattgttttccccaattttttgttataaaaattttcaaacatagagaaaagctgaaatatatagcactacttagagccaacaatagtaaacattttgccatatttgctgtctctccctgaatgtttatgtgtgtacatgattttatcttttgttgaaccattaaacaatagtttacaggcattatggccttcactcctcaactcttcagaatgcatctcctcacaataaggacattctctcagtgagcacagtataattattacactataaaattaccaataattcacgaagatcacccatatccaatccatattcaaatgtctccaattgtcaacaaatagtaaaaccagcttaaaagacatatcaggatccaagcaagatgacacattgtatttggttatgttttctagctcttctattttggaacaacccctccctaccacttatatttttcttttcttttctttctttctttctttctttttttttttttgagacagagactcgctctgtcacccaggctggagtgcagtggcacgatctcggctcaccgcaacctccgtctccggggttcaagtgatcctcccacctcagcctcctgagtagctgggacgcctggtgtgccacactacatcccaccaatttttgtatttttagtagagttggggtttcatcatattagccaggctggtctccaactcctgacttcaagtgatccgcccgcctcggcctcccaatgtgtgggattccgggtgtgagccgctgcgcctggcccacttatatttttcatggcatcccatttatgaagagaccaggctccctattttatgtaacgtgggaatggatcttcctgttcatctcctctgctcagtgtacggtctagcaagagcagactctctgtaggtgtttgttgaataaatgaaaccaatagtaatggttattaataacaatcccagtagccaatttttattgactattctcttggccagtgtgctcacgttaatctaatttgaacctcacagaaatcttacgcgttatgacatatttgtcttattcacaggtgaggaaaccaaggcttagggaaggaaagtcgcttgtctgaaatcacagctagaaaaggggccaaaacccaagggtggacccactggctggaaaacagtgcagttaggcaggggcccctgtttcttaataatgaatgaaccaacgacccccaaggctggtttgcccgtgcacacgcacgcacgtgtgcaacacgtagcacttgctgagtgtttgctacttgccaggcctcatgtcaagcactttacgcgtgcttttatgccctacgttttgtttttgtctgttttgcttttttcccctaatgcctagccaaaggcgtggcccaggcgcccaggcaggacttggggagtgaatgaagagtgaacaaatgaatgaatgcgcggcaacgggatcttcataaaccagaccctcctcggggatctaatgcgaacactcccgaggcccgggcccaggtacgctgagggcggctcgtgggccccaggccgacctcagcccgcgactcccgggctccgggggcccaggtggcccccagtaggtgaggagccgggcccgccggcgccttggcgttgccacctctacctgcctgccctctccccttccggatccacagccaggcctcggcgggctcctggtgtgcagccgcccggccgcttccgcccgagggtcgcggggctcagagtccggcaggctccaggcggggcaggggatgtccgcggcccggcaggcgcacgcccacctgtcggccgcgcaggcgcagcagcgggccggcctccccgcgccccgcggcgcgcggccagtgcgcaggcgcggcggccgatgcgagtgtgtatgtgcgggcgagaagatggcggcggcgggggaagcagcgtgagcagccggaggatcgcggagtcccaatgaaacgggcagccatggccctccacagcccgcaggtagccgccggtctgcgccttcggccggaaggggcccgagccccgggcgggcggacgccgcggcgggcgggcgtccgcgccctgcccggagcgagcgtgtgggagtgggggagggcgctgggacacgctgcccgggcctaggccggagccacccgccgcctccgcgcccgccgcgccttcgtcccctgagccacccggaccccctagtcccggggaggtcgaagggcgggggctccgggccccgcttggggagggcgtggagggcgccgaaggggttaacctccctggggctggaccgcggggcgagcccggggtgtggagtggggccctccccgccgcgccggccgggggaggcggcccgggggctccgggagtcccctggagcgcaggggccccagagcagctcaggttgctgcctctgcctggagcgagcctcagagatttgggggtgccctgttgcccctttgccccaagagcttcctttctcagcttgattgatgatgcgggggttgccgattttctgttttttagatagaagtagcagagtagcggccttgggctgctgttgcaaagaaaactcgaaataagtcgcaaggaccgtactttcacttgcgtttgagtgacatcccttgcacgaatccatcccagccaggctgacaactaacgcaccctgcctgaacagtagctaaagcttgggggccctttacaataatcccgtggtggaaagaaagagctctttttgggagatgtgcgtgtagagttaagctcttattcccctctcccaccccttctctcacatcttctcccccctccgccattataattattctggacaaaaatcggcatgatgtattatttgtcagccttgctttagactgctaatttgttgacatctggtccctataaattgttgcacacttttaaaccatctcattgtgtatttgtattaaatatggggaaatgaaacaaagtagccattcgggaaactgattgcgagtaaaatcataacccttcatgagcaattgggttttgttgcccttctgcagatgaagtcaatctgactacacctcttttgaaacatgattttcggaactattgtaatgaatgcgtgttgtggaatctaaaatgcgaaaactttttaaaaaattagatcttacgacaagcttcaattttgttaaattagctgtagtttagtttgcatcagaatttccccctttaacgttttgttcccttattcatttacttttgtaagtagtgtaggtctttgcgccaaaaaagggatcagtagttgaataatttttacaaatgtatagcccaaagattttaagagatttggtgtatttagctttgtttagacctttctgttaaaaaaaaagatttgatatttgcttttttctcaacttaaatcctaattaactagcttattagaattggtatgaacaagtaaaaggctcattatgaattaatgtgtaatattccttgtgattttgacatgaagaaagcatctttaggcatagctcacttcctttatttaataagcatcaatcacaattcaaggttgattgaaatgttaattaatggggatggataatatgtaaacttaattgtaatttcgtttgcattcattgtcccagtatttacgttttatacaacagtctaaagcgttatacacatctttagaaaattggagtagcaaaagttggcggaacgtaaatgttagcaacactttgggtttattcttttaaagtatgatttaaatgcttttaagttttagcatggagaaagtagcaaaggaaatagtttgatttctcataattttcttcttctttttttttttttttttgagttggaatttggctcttgttgcccaggctggagtgctgtggttattaacctataaacttttttatttattttgagatggagtttcgctcttttttttttttttttttttttttttttgagacgggagtcttgctctgtcgcccaggctggagtgcagtggcatgatctcggcccactgcaacctctgcctcccgggttcaagcgattctcctgcctcagcctcccaagtagctgggattacaggcgcccaccaccatgcctggctaattttttgtatttttattaaagacgggtttcaccatgttgatcaggctggtctcaaactcctgagctcaggtgatccacccgcctcggcctctcaaagtgctgggattataggcgtgagccactactgcgcctggccgatttctcataattttcattttaaaagaatagtaatgcaaacaagtaatggaatcatgtatgacaggatttagttactggttcctgctccagtcattctgagcgttttaataaatttgttttacttggttgcctactgtcctaagagtcttgcagccttaatggccattcattcattcagcaaatactgattgtttatcagatattaagcgtcatggtatgtatattacttgtttatgttgggaataacaactgcaaattgaaggtcttattttaaaattgacttgttaaagttaaatttgtcactgagaataatgggaggtggaaaaagttacagtttaaaaatgtttacaggccagcgcggtggctcgtgcctgtaatcccagcactttgggaggcgcaggtgggtggatcacttgaggtcaggggttcgagatcagcctgaccaatatagtgagaccctgtctctactaaaaatacaaaaattagccgagtgtggtgaagctcgcctgtagtcccaggtacttgggaggctgaggcaggagaatcgcttgaacccgggaggcggaggttgcagtgagccgagatcatgccactgcactccagcctgggcgacagagcaagactcccgtctcaaaaaaaaaaaaaaaaaaaagagcgaaactccatctcaaaataaataaaaaagtttataggttaataaccttatttccaaatattagaaagtgttggttgatccctgttacctgtattgaagtgtaatagtgaagaatttggaaacattttgagaccggtaactcagcattttagcaaagacaaataaatgaactttaacagttgaagtgtaggtccaagtgaatatccttgtcactgaggggaccggttaaattatttggggtaattaatttgaagctattagttttgccttacaccgaaaaaatatttgtgattattgatgtcatttatagtgaaatctccacaataatgcttcctacacccaatttgaatgtcatgcagttggcttctgtccttgtctctgcatagactcaccccagtctcttttttagcttgtaatagcagatcctccacattttacatgatggaaagtcttggattccccctctagcatatggctgaatgttactgtattgctgaatatctgtttctagccaacagctggattagtgttaattcttaaaagagatacatttttattagaatctcaagtaatgagcagctgaagtaaatacaattgtttgaaatgttgacagggcatttggagataacagttttcctttgcatagtgacagcaagctatttaaacatgtcctaagagtagatgttttaagtttgtgagccagtggtcaccttagtggtttgtacagatggcctgagaagtttgtgagccagtggtcgccttagtggtttgtacagatggcctgagcagccgcgccgtaccaggacctcaccatcatgctcttgagcccatctcattgagagcacagcgcactgaaattccagtgaatactaagcgggcctaccacattctaaattcctcactaaagcaaaagttaggacatgtattccagtgttctgttacgtggaactgataggatttaagcagtgattcacataggaaaacttaaaggagaaaaggattacgaagcttaatgattgctgtttaatgccaagcctaagcggcacgttgcactgtgctgtgctcagaatataacattcaagtaattgagaaaagtggtatcatctccaattgaattagttacatcagggtttttgtttcggttttttgtttgtttgtttgtttttaaagatataatttcagacatgtaggtacttcctgttaatggttcctggtattcaggtggcacattaaacgtggttgctgaggacacttattactggtactataccaaaatatgaaacgtagtgggaagagcttgcttttgaatttgtaattaggctgttacttttctatttactgccacacatgcaagaatcaccatcgcacaaaacagataaatctgtttgcaatggaatttgctggccttgggccattggattactgtcatttgtcactttagtgccacttcagcagtgtagatgttcatttccagagacttgtatgtgcttggactgcagttttcctgtttattgaagtgttctcccaaaaggtctttctttgaccatttctgtcaatacaggctggatgaagaattagtgtaggaaaataaaggtagcccttggggtatgtgtatagtatttgtttcaaggatcagaaaatgtagaatttatcataaacctcgatgtagaatcttcagatcctagattttttctgaactggctattttctggctatttgaaagctcctgggccatgatcccattttcatcagatgacttgagaacccagaagctctaccagcactgccattctgtcccgtcttgaaacatcatgccctggttgccctctcctggaatagggcaggtaaggtgttgagatagaaatgtggtttggggctgttacagcctgaattcctcgactttcccttttgggctcacatgagaattgttaggagaatgtgcatgtggagtgcgggcccagcacctgctaccgtctgcgctgtaatggtggctgctcctaagagtcctcagtctcctccccgttgggcttgtgtgtacagccttatcggttgtcattcttcggatccattctcagtttatttttctggtattagctggagggacatctccttaagcctgtactctatggctcaggagtctcaaaaccagtccattttgaagtgagagtatccctaataaaaaggtgagtgtccccactcctgtgccttgttttttttgtttgtttttttttttgagacggagtctcgctctgtcgcccaggctggagtgcattggcggtatcttgtctcactgcaacttctgcctcccgggttcaagtgattctcctgcctcagcctcctgagtagctgggactacaggcacccgccaccatgcccagctaattgtttgtatttttagtagagactgggtttcaccatgttagccaggatggtctccatctcctgacctcacgatccgcccacctcggcctcccaaagtgctgggattataggcgtgagccaccacacccagccactcctgtgccttttgaacctgatttttacatctagctgactcctccctccgtccctttccctctttctttcttcctgatctgatggtgctagatttttgttttcccatttgtctttgttttatgaagatgtgctcctttccatttgtgtatgttgagtacagacataatcatgcccttgcttgcttttttttttttttttttttttttgagacagtcttgctctgttgcccaggctggaatgcagtggtgcgatctgggttcactgcagcctctacctcccagattcaagcgattctcctgcctcagtctctcaagtagctgggattacaggtgcctgctaccacgcccagctaatttttttgtatttttagtagaaacggggtttcaccatgttagtcaggctggtgtggaactcctcacctcaggtgatccacctaccttggcctcccaaagtgctgggattacaggcatgagccactgcccccagcatccctactcattctttgaaaaaaacaatttgttgttgttttgtagagacagggatttgctgtgtttcccaggctggtcttgaactcctggcctcaagggatcccttctgcttcagcttcctaaagtactgggattacaggtgtgagccaccgcgcctagcctccctattcattctgcaagtatcagtctttttacttttgataggacatgttgaagttttggttaaaaatagaagaggatttgaaaatgaagttcaattctagaggttttcgagattcctgcccaatataaaaaacttctgatacattaaaacaatttttttatacttcattttttagagcagttttaggttcacagcaaaattgagagaaaagtacaaagagttcctatataccccttctcttggtattttaagtaataatttcccttacgtggctgcaaagactatatatatatttatatgtatttatttgtatatgtatttatatttatttatatttttatatttatatatatttttatatatatatattttttgagacgaagtcttcctctgtcacccaggctggagtgcagtggcgcaatctcggctcactgcaagctccgcctcccgggttcacgccattctcctgcctcagcctccggagtagctgggaatacaggtgtgcgccaccacgcccagctaattttttgtatttttagtagagacggggtttcacggtgttagccaggatggtctccatctcctgacctcgggatctgcccacctcggcctcccagagtgctgggattacaggcgtgagccaccgcgccgggccaagactatatatatatttattcaagacctgaagtaggctttctgggtagatctgatcattggagaaggagaaacatatttattacgagatactaagcattgtagtagtcatcatttgaagcctataaactctataaactgcatagtttagaaagtgccttagcttgtttgagcctttacagcaactctgtcctgtattattataaccattttacagatgagtaagataagacccagagaggttgtggcttgaggtcaaatggctgctggccatcaggaccttttaaaagcaggtgttttgacttctaaatcctttgctttttctactttgccagactggttttctggaagagactgatgaaggcataatctttcacactgtgacttccccttagtagttcctccataaacatttacagaatgaatgaatgaaatgtgcatttagaaactttaatgttactaattacaaaatttgttactataatatgttactattcactaaagtttgtgtggggtacattttaataaagtcgtttattttattttctagtataaagacatgctatttttaagacacgaaaacagcacagacgtatttaaagtgaaaagtagaagtcattcccttcctctctgatccttaatcgtcagtttggtgtgtgtcttctatgcttttttccactggagtattttgttgttgttgttccgttgtttcataatatggtctgttgtatctagtcactgaactttattgagcaaaccttgttttcaaaattattgaaaacatccactgaagtcagttttcttaggtttacctaattttgccagggaatgaagcagatattctggagattgaagtgacttatcaggatccagtgtgcaggggattgtggaagtgctgccacaacttataacatgttgtccaaacaatttttttttttcttaagaaatattttgggccaggtgcagtgagtgactcacgcctgtaatcccagcactttgggaggctgaggcaggcgaatcactcaagctcaggagtttgggaccagcctgggcaacgtagcaaaactctttctctacaaaaatacaaaaattcactgggcatggtggtgctctcctgtagtcccacctacttgggaggttgaggtgggaggatcgcttgaacctgggaggtggacattgtagtgagtcgagattgtgccactgcacttcagcttgggtgacagagcgagactcttacgtcaaaaaagaaaagataagaaatattttgaagacttccacccccttagtagtagtcatgctgtccggtgttcatagtgtaaaaagaggtctggctgggcgtggtggctcacgcgtgtaatcccagcactttgggaggtcgaggtgggtggatcacctgaggtcaggagtttgagaccatcctggccaacatggtaaaacctcatctctgctaaaaatacaaaaattagccgagtgtggtggcgggcacctttaatcccagctgctccgaaggctgaggcaggagaatagcttgaacccgtgggggcagaggttgctgtgagacaagatcacgccacttcactccagcctggacgaaagagtgaaactccatctcaaaaaacaaaaaaggaggtctgattcacattcagattcttgtccatccattgcctttgcactagatttatgagaggacaaactttttattagttggagattggtaagtcacctgccctagggaataatgagaaactgggtaattcacctgaatttttctccatcttcttcaaaatcatgtttttgtcttctgtcactttgtttcatcagagtactgcaatggcaaaaaacaaaacacttcccaactcaggtcccactcctgagagataaccacatttaagtacttctgacttgtaatagaatgcaaaatcggggcttccaagtgtggtttactattttgtttagaattaatttgtagaatactagacacttttttcagaaccacatatgaaggactttatatcttttgtgattgttcacagattttggtggccggacgttaggagtatagagctgaagagagaattcctgtgctttagaggttcgctgggtagtgagggagagaagcaggctaatggctgggtgcatccagttttagggtggtaattcctgtaacacaagtgtgaacaacatagtcaagaacattcattcattcgtttgttcattcattcagcaaatagttaccgagtggctgctgtgtaccaggcactgaggagggagtgatgagcgaaaacaggcattgtttctctcgcggaggagtttatgggtccattgaggaagacagcttgctaatcagataatcacagttacgtacacgtcactccaaactgagagatgtttcccaaaggaagggaacacaatctgaagtcagagaaccgttcccgtggaagtgacgtgtttacagcatgagacagtggggacagcatgtgtggtggacctttggctggagggaatttggagcactttggagaactcagcaaggagttgtgtgtcttgggcacagagctggaggggagggacagacgcaccatccaaccttgcagcctttgttagatgttactgtctttattctgagaaaagtgtggaagagggggtggtacaacatttgaccatggaacctcataatcacattgccttttgggatcatactctgcccagtgaagaatagactcacggggtcgcagtggccataaggagatcatttagggcagggtccttggacttttgactcggagggtgccgtggaggtggagagaagttgcgtgactcaggagttaggtataaggtgtttcaaaaaaggaggagagtgggactgaatgttgggcaaagctgggaagacgtctcttgtagaacggtgacatttgagctggagtttttcaggcagagaagcacacggacaagggcatgtggaggagactgtgcagaggaactgtctcaaagcctgcagcctgtttgggaaacagataaatttgtggctgaaatggtgtgtagggtgaagtggttagccgggagtctggagaggagagagaaagaatttggtaatccaagctcaggactgagtgaagttggtagcaactctgtgttaagatagctggttgaggccgggtgcgaggctcacgcctgtaatcccagcactttgggagaccgaagtagacggatcacttgaggtaaggagtttgagaccagtctggccaacatgctgaaaccccatctctactaaaaatacaaaaattagccgggcgtggtggcgcatgtctgtaatcccagctacttgagaggcttaggcaagagaatcgcttgaacccgggaggcagaggttgcagtgagccagactgtgccactgcactctagcctgggcaacagagcagactccatctcggaaaaaaaaaaaaaaaaaagattgctgggttgagttgattgtgcaggggtcttacttagatgcttcgaaagttgtcagggatttgattctttaggctctcctccatagctgggactctactctctgctcattttggcatcttaagcctcataactttgaggggaaagaagtagggcatttcttttggggacttttgagacagattaatgtgaggcaggtagcccttcagtgtcctcagtggtaattggatagagtagttagggaaggtcatttagggacatattccctttattttgagggggaggcacctttaaaaacaagcatctgtcccttgattatattcgtagaaaatattaaggaaaacttaggtgacttgttaccttattttaaatgtttcctgtagtacttttggtagtaaactttagaaatttggaatcattggatttaacagcgtttttaggtttgtgatcctcgagtgccctcttctaataccagaatcacctggcaccctgggtgccaccaagagacactgagtaaggatccctgtgagcaggtccccaggccgtctgagccaggctcaggttgcaggtcgtccgcatgggtttgtgtacagctttttttgttttaacttgttgagccctttcgcatgaatagcaataacgaaatcgtattttggacaaagtgttacatctccagtctaggttaggcgtgaacaacaacaaaaatatgaattgtgcccctccctctgagtgtgatactcacttattttagcgccgagtggaatggtggaacagttgtgagcagatgagaaacctgacattttgccactttgaagagctgtcatgtcgtgtcttcagaacgagatttcagtttggcttggcattcattaagtccatgattatgccttttaagcaagcatttacccagtacttgctctgtgccagggcccgtgttgggatttataagttgcaaaaaaacatgtttttaaaaatgtaagtacacatgtgttccccagaaccttaagagctgctctggctgttgctctgcaccccacatcttgaaataggacctttgtggacagcatgggatcagcacactcccccacagctcagtgtaactgtgagcatctgatgtcccagagaactggaactttataattcatcctgaagcctggttgtcaacatctctgaggatgtgtgcatagcattaagccaatttaccatcgggaattcctgctctcttttgctgttgttgctcatggattcgtcaggtgaggaaattctagtctctagtttttcccaaactggtgctgaaataattacgcttggttctctgttgcttcttacctctttgctcttctgtgccacaacaatgtattctaagttaggtgccagcagcagaaacttttcttccacctataactagagttttaggcgtgaggaagggctagcttttttttttttttttttttttgtctgagatggagtcttgttctgtcacccaggcagtggcaagatctcagctcactgcaacctctgcctccggggctcaagtgattctctggcctcagcctcctgagtagctgggattacaggtgcgtgccaccatggctggctaatttttgtatttttagcagagacggggtttcaccatgttggccaggctggtcttgaactcttgacctgaagtgatccgcctgcctcagcctcccaatgtactggggttacaggcatgagccaccgcgcccggtggcttttgctttttaaggtggacagaaacaccttgcagctgtgcttcgttgcccttgctgcttttgggtggaaacatagacttaagttagcatattcatcagttgatctcttttctgtgagaagggaaagaaatcgcagtattttgtgtgtatggcaggctttgagggcccttatactttgattctgtagatgccctgtccttcctcaggaggcagtcagctgtgtacagaggcccttgtggtcctgtcctgagagtagcggaaggaagacatggctctgcctggggagactgtgccttatgcagaggccaacaccacatggatgagccggaagcagccgctggcctggctgctctttcgggtcaggaaggctttcttgagtctggtatggtctggctgccccagtgtccccactgcctagcacagtgggcactcaggtgtttgtctgttggatcggttaattggcagggaccagttgaagcaaacagagaacagctggttgtcattcactgttttcaggactgcttatggttgtttttggtgtttctataatagttctaggcatgaagttcaggaccacagcatgcaagaccccgaggggcagatttgccgtctatagaaatagtaatgagagctgatgaagaagaggtggctgcttcccacagtatcaccttgattgtcatttctgcatttagaatgcatgagtgacccctaagctgctcttcaggttcttcagtgctctctttacctctgttgtgtagtttcttgaatccaggtgactgacccgcacgtcacatataagttatttggttttattccttggtctctttctcagcaagtgtagtctggagatgataggacacttagcaatgcagagagaatgccttcaccagagttaccagcaagtgcttggctgtgggggctccgtgtactaaagctcttccaggattgttagtgggcatgccagtgatctatcttcgcaggcctgcttacagcaaatgcagctgtcccccaaatgcaagaaccatggagcagccagcctttccagtacagggcccaattatgtgtcaccagtgaacatggaaagagcttttcggttggtttgccacagttagtttatctttcccccacctttgtgaccttagatatctcagccaatgccaccattcacccactagttatttattgaactcagctatgtgccaggcattgttggtacagaaatggaggggaacacattgtctgtccccgagaccctctgtctgtagacaggctcgccccctttgtccctgtggtttgctcccctactttcagtgagtctctgtgcctgggccatcttcttacacccactttacccacctttaaaattgcgccctccttcacacttgtcaccctgtctgcttgctccctctccagagcacttcacacctaataccctacatacccgctatcctgacgtgtgtgtctggttcactctctcgtcctcccccaatgtaagctccttgaggccccaatgtaagctccgtgagggcaggggtttttgtttgctttgttcactgctggggcccctagtcctagaatgtggtgagtgctcagtaaatatttattaacaaacaccttcatgaaagacataccacagtggacatattcagaagcccacagtcaggtgtgggaaagaagctagagaatcaactgttaggatccagaattagagagaccatcacaggagagtccccggggacaccttggctcatgtttgtgaggaaaatagttcacaaagatgagcctttggaactgagttctatagtttgcagagtcagccaggccagcagggtcccaagagaagggcgcccaaagcagaaagacctggcgtgtgccgtgtcgctgaagtgcatttgggacgtggagagttgtcggggctgcagcactgggggttggctgggaaggtggatgggtgcgtcttgtaggctctgctagagccttttagcctgaaaagttctgggagactagaaaggcttttcctgggcaccagaatagtaaggttcagttgagagacagctctgtggtggccacatgcagtttggagggtgaggggtgagcacagaggcggaggtagattgttgcagagacccagttgagaagcgtggagggcttgaacagtgcctagaggaggggcaggccttagggtggcgggaggtgggtggctggcgggagccagctcgttgtggtttgttcatggtatagtagtttcttccttaaaatgtggaatgacacttgtttagtaaaatgtttttcccacttcttcctcttttttagagatggggtctggctctggcatccaggctggagtgagtggcacaatcgtagctcactccctgcaccatctaactcctaggcttaggccatcctccctctttagcctcccaaaatgctggggctacagacgtgcgccaccgtgcacggctttgcatttcttatattgttgaatgtttttccattaaatattttcctttgcgattgtttttttttttagatctcaagagccttaacttaatcttcagcattgttttttaaggactgcagcgtattcacaagttatagtttatgcatactaaaaatggtaatgtttggcaggtttttttggtccaatttttagttgttacttgtgaatttatcttatttcctagagcaaattaagcacattattgtaaactggaagatgaacgtccttaattcattgattatttttggggtgaagggagagagatattttgctaagggatattaagaagatacttagtggatatttaaaacatgaatttttttaaattttaaaagtaatatcaaaaacaagttctacatatgaaatgtttgaaaaatatttaaaaagttctgattattattattattattattattttttttttttgagatggagtcttgctctgtcgcccaggctggagtgcagttcgcagtctcggctcactgcaacctctgcctcttgtgctaaagcgattctcctgcctcagcctcctgagtagctgggactacaggcatgcaccaccatgcctagctactttttatattttttagtagagatggggtttcaccatattggccggtctggtctcgacctcctgacctcaagtgatctgcccgcctaggcctcccaaagtgcttggattacaggcgtgaggcaccactcccggcccatttataaaatatcaataagctgacttatgtttggtgaaggccaactatttcagctattgctgtagatatccaggaagataaccaaagcatccttacctttgtgtataatggatagctaaggcataagaaacaactgggcacgttacaagatgtgtaattaagtgctgaattatgtggtgcatgtggcaggttcttttgtagtaattcagagaatgaagatgggtaatgagctagtcttgagaaggaataggatctccgcctcccaaagtgctgggattacaggcatgagccagtgagtccacctgggtgaccttactactttatatgaatcctctggtcactgctgcccaactatccttttatctccctttttgcttaccccatttatgtgttagggtgccctcccttttttttttaaaaaaacaaacaagtagagctcagctttctaactggcttacaccataaactagagatttagtggctcatgtaactagaaattccagaggtagatcaggcttcaaagttggtttaattcagccgtttagttacagttttgaggacgtggcttcttttcattttttcacttttcatttcttcatcttttcattctgcctgtcagtattatcccagggctagtttcccccacgatggcggaatggccacagcagtttcaggcttcacatttgggcacagcctccgtcacaccagcctgaccaagagagtgagtgtgcatcccagaattttaggcagtgtcctgagcttcttgccctttgggtcgtccctcaaccagagcactgtggcgaggagggtggtatgccaagcagggctcccatctggcctgggggtgggggtgtgttgacttctgaactgggtgactactatcccacagggtaggaaggggagctggccagttcgctactgtcccacatgagcgtaatgtctctcccccctctccttttccagatatgccagttcctcctggactcctcagactggaagattgtcctttctccttggcaaatcatctgtactatctgattgcatcttacagtcttctttaaatattattgttccttaactgttaatgtgtctgtgccttgaggtcagcctcaggttccaatcctgttccattttgtttgtggaatctcaggcaaggttggtttctctgaacttttaaagttttttcatcttcattcagcaaatctttattagattctcagtattgtgcttcagtggacgaaatacagactgacacaaggagataacagttcattcacagagacataggtaaatgagaattactatgaaatatgaacagtgctttggcagaaatagggtttagaaacacttcctgaggaggtgatgcctgcgttgagctttgaaggacaagtaggacttcttcagagcatgggggaagagggagctgcctgcacgaaggctgatcagcagaataatgaataaatgcagagttactgggatcttaggtgcacgaccttcggcaaggttggtaggcagagacgcccattacaccaagttgaagagtgaagattctacctttatatacaccttacaattacatggggagtgaccgcatgtcctggtctaaacttatcccagcataattcatcataatgatcctttcactctgagatatgcctctaatttggatgataaatggttacgcaacttaaaatagaagtccagagccatagggacagtcactgtgatagcagtgtgcttgcttcatagtagagcttcgggattacatgagatagagcatagcagtgcttctcaaacttaaaagtccgttgagaatcagctgcgggtcttgtgaatgtgcacatttagattcagtacacctggggtgggccctgtgcgctgtctgagctcctaggtaattcctaggctgctggcctggtgacctcactttgagtagcaggtcgtattgggcttcgggagcttcagagggtctgtgaagttctgaaatcatacgcagaaatgtgtgtacatgcattctttagggggtgggcctaattcccttacatcagtttctcgggaggtctgctgccacccaaaaaagattaggaatcctcccttttagaaattttgtgcagattaaatgaaatatgttgattaaatgcctttaacattgtctagagcataatggacattcagtacacactagctgtatgtcctccttccctgaccccagttctttgaaggcaggacacattgcttaaacattttaaactgctttttaatgtcctttttatgtcattggtgctcaataagtgtcgatttagcttggtgacaagctgtttggtgactgtgagccattctgtcagcatttgctagtctcttaggtgccaagcattttactaggtaggtaggaggaggccactacctaggttattgcagatacccaggcataggtggagtcatcagggcctgtgctggatagtaactgtagagttgaagaggagatgcatcacttcttagtaatcttcctgagttatgtgtgttcaggaaagtgcttctactgcctttgattcattgaggtcctagtctctggtcctcaggtgtatgtgatttcagtacggattaatttactgtaatgcttaatttaattcattcagttgctattcttgccaaatgcagtttttctgaacattttgatattttgttgagatggtcccagaaatttgggattcgtgatcacgttagggtatttgtgatggaaagggtatataatttatggtattttcaaagttccttacctaagagattggaagaacaatgatgagagagagattgggagattacttgtcttatagagttgtagatgcttcagagaacttgactacattgcgaagggaaaatcttggattggaaggttatttttgagaaagtggagtgttggtagtgaaagttagatttcagtgaattaaaagcaaatgagagatgagtttaattacaaaagaaatgtcttttgttcagaagacatttctgaagagttgcttgtgagttcatttattttattgagacaggattgtactctgtgacccaagatagagtgcagtggtgcaatcatggctcactgcagcctcaaagttattggctcaagggatcctcccacctcagcctcctgaggagctgggactgcaagtgtgggccactgtgtttggcaggagtttaatttttctgtcatattacttctaatttagttgcattatagtttttcttctggccgggtgcggtggctcacgcctgtaatcccagcactttgggaggccaaggcgggtggatcacctgtcaggagttcaagaccatcctggccaacatggtaaaaccctgtccctactgaaaatacaaaaattagcccagacatcgtggcacatgcctgtaataccagctactcggaggctgaggcaggagaattgcttgaacccaggagtcggaggttgcagtgaactgagattgcgccactgcactccaggttgggcaacagagcaagactgtctgacaaaaaaacaaaaaaaaagtttttcttcttttagttttgttgttgttgttgtttttgagaaggagtctttctctgtcacccaggctggagtgcagtggtgcagtctcagctcactgcaacctccacctcctgggttcaagcgattctcctgccttagcctcccgagtagctgagattacaggcgcccgccaccgcacccagctaattttcgtattttagtagagacagggtttcactatgtaggtcaagctggtctcgaactcctgacctcaaatgatccacccgtctcggcctcccaaagtgctgggattacaggcatgagccaccgcgcccggccagtttagttgttgttgttgttgttgtttttgcctttattaacttgttaatgatcagtaaacccttaaaagcactaaaagagttcccattttaaagacatctggatgttgttcatcaactttatatagtgagtaattatctcaaattattttataatttcttttttaactgggaggcataactgaatggagaagtagctcccctcatcctcctgttttctgcttagtttctcccacctcctcagttgcctgtagtgatggagcttttacttggatcacgggaatgcccctacacagtgattctaaactccaactgtaagtcagaatcacacaggaagtgtttaaaatgctaaatgaggcctggactccaccctagaccactgaagccagaattgttgcaggtgtggcctgaggatgctctgattctaaggtgtggccaggttcgaggactgttgtcttaggcctttgtccaatatggtttatgctgctcccctgctaggtgagtaccaccgcggattggttacctgcttttatgtggaaaatagaatataggaagccgattgggtggaaaacatctcttctagtgtatgtaggtcccataagggggactttgaagtctggagttaacagttttctaataaaagatttcagaccatatccaggaacttaaatacataattaaagagtggaatgcaaattattaggatttttgctggtaaagcaagctatacttgcataatttaaatctttggagggcatgtttcgacagatcattaggtgaaggttaaactgagacagcaaacagtggattccttccttagctagtataccactttttgcattcttttattttcaacagatagtaattttgcagctttttacttcttcaaccaaaccttctaagtaactttgctttccattaacaacaaagccgctcattaaggtggaagttctgtgcttgatcttaacaccggaaggagaggagtctatttaccagctaatgtaagtacttcttattagacagtcctagattttctaggagatttgaagagtctgctgacagtggccagcaaatcagaggaaaatcatttctgtagctaggttcttttttcatggatgtcctttaagaggaagctctgccgtggcgatgtgcgttccttcctggcgggtggcctccagtagctggccttctgttggtccggttccagcgtattttattaagtgaaaaatcctgtagaacagatggcacttacaagtttctgcccatgtagcactctgtttaatgaaatactatagttttgcttcattgtttttggcagtaattgtctttgtgtggagtttgagtacatggtccgagaagctcggcagtaataaaggttgagccaggcaagaataatctgaagtgactgagtaatgatgggacagaggcttcagagtggtgcacagttaaattgaaaacagatgcagaataaaaagatgatgcccaatttttttttttttttttttttttgagatggagcctcgctgtgttgcccaggctggagtgcagtggtgcgatcttgccttactgcaagctccacctcctgggttcacgccattctcctgcctcagcctcctgagtagttaggactacaggtgcccgccaccacacccagctaattttttgtattttttaatagagacggggtttcaccgtattagcggggatggtctcgatctcctgacctcatgatctgcccacctcgacgtcgcaaagtgctgggattacagtcctgggccaccgcgcccggccaatgatgcacaattttttttttttttttttgggaaggagtctcgctcttttgcccaggctggagtgcagtggcgcgatctcagctcacggcaacctccgcctgccgtattcaagctattttcctgcctcagcctctcgagtagccgggagtacaggtgcccgccaccatgcctgactaatttttgtatttttagtaaagacggggtttcaccactggccaggctggtcttgaactcctgacctcaggtgatccacctgcctgggcctcccaaagtgctgggattacaggtgtgagccaccatgcccggcaatgatgcagaatttttaagatgatgttgtgtagcactgggaggtctttggaccaaggaatgtgaaactaaaaatcccagagtgtggatgcctacaaatagggtgtactgaagaattcttcttccgtagatgagagattaacaaatagagcgtactgaggaattattcttctgtaaatgaaagattacaactgtggccattggtcttcaagagctttgattatggtactgcttcatctgctttacatagattgtgcataacaatttttaaaaagtcaaccttattgaagtataatttaatacaataaatgtacccattttaagtttgcagttcgaggttttttgtctttgtttttcagacgaggtcttgctctgtctcccaggctggagtgcagtggtgtgatcatagctcactgcagccttgacctcctgggttcaagccatcctcctgcctcagccctcccaagtaactgggactacaggcatgtgccaccaagtctggctttgttttgttttgttttgttttagagattgagtcttgctctgttgccaggctggagtgcagtggcgcgatcacagctcactgcaacctccgcctcccgggttcaagcaattctcctgcctcagcctctcgagtagctgggactacaggcacacgccgccacacctggctaattttttgtgttttcatagagacagggtttcaccgtgttgcctaggctgatcttgaactcctctcaagtgatcctctcaccttggcctcccaaagtgctggaattacaggctgggagccatcacgcccagcccagtttgagttttgacagatgtatacaccaaagtagtaactactaccacactccatatatagaacatttccattgctcagagagtttcttcatgcccctttgccatgaatccccaccttgtccaggcagctagtggtctgcttctgtcactataggctaagaaagtttgccttttctagaattacattggcccagaattacacaaactgtactcttttgtttggttaccttcacctgacccaactatttagatttagccatgttgagtgttgagttccagccttttcagtactgggtagtattcctttgtggatgtcccacagtttgcttgtctctttcctcttgatagacatttttgttgttcccactgtttgaatctgctgttcacattcatgtacaagtgtctgtgtggacataggttttcatttcttgtgggtaaaatgtggtaagcgtatattctattctgtaagaaactgcaaggctttttcaaagcggccatgccgttttctatctgcaccagcagtgtatgagaatgcttcttctctgtcctcaccaacatttgatattgtcagtcttctttttttgagacagagtctcactctgtctcccaggctggagtgcagtggtgtgatcttggctcactgaaaccttcacctcccaggtttaagcagttctcctgctagcctcccgagtagctgggattacaggcagactcccccacgcccagctaatttttgtatttttagtagagatggagtttcaccatgttggccagtctcgaactccctaacctcaagtgatttgtccgcctcggcctcccaaagtgctgggattacaggtgtgagccactgcgtccggctcagtcgtcttaattttatagtacatcaatttaaatgataattttttgtccctaggaacatgagttcctgtcattgacagcaaagtgaaactgagtacaaataggtggttcttagtgaaatgtgcccagaaagacagtttgagcagaaaggagggaccaagaaatacaggatgcatgcctgcttcacactggaaaccggtggtcttatttgagggtcaaagatggggggtggggaataaagtcgattttaaaaggattgaccggctccgataccttctgatcacatccagggtttttttttttttggccttttttcccccttatacacttaagattttgaaaagtggtttctctttagcttgggaaatggatcacatggtaattgttaatgatttttctttaggtcaaaataggtgttcctttaaagtgttctgtgaagcttaattcacttacgttgaataagtcttatattttaaaatataagtttaagtgttatactttaaaaataagtgttatttcttgattgtatttatttgaagattatatttgagaatgaaagatgtactcctagctggaacatctctggtgataataaaaacatgagaataaaaaccattcagagtgatcaagttaagactgtcagcccactgacgcctgggaagtcacaatgattgctatgtagtttggagaaattattccttatccttagataagctttttatttgtgtgggttttttcatcttcctcttcctgaattcatttgttcaacaaagctattttgagcacctactctatgccaagtctactgcattaacttctggctaaacaaagatggatctaactcgattcttgtactttaaagaaatcagctttatggaggtataacgtatgtgcggtgaatttcacccatttaaagtgtatatttccatgaattttaacagatgtattcatttgtgtaatcacctccacaatcaagacaccagttctgtcattccccagaatgacattgagcccccttgcagcctcttcttttgttcgtccttggccccagcaaagatagaactgcttctgttacagtttcttttttattggtttcatcttccatttctttttttcttaaggtcagcaccaaggtgattgtaatgaatatgaaagttggtggaatcttgaacttctactagggctatcccagataaagttgactgaatttactccctaatttatctgctgtgtttcatacaatagcaattttacacaggaagttattcaataatgagggctatctatattaccttgctatttagtactagttaagagcaaagcgagttaaaatttaatggccattttgtaatacagttctaatatagacacaggactggaaagttggtaaaagtgggtttctgttaagtgaatcatgttttctaatttggagattcaatctgaattcaatctaaaatttctgaaggaaattttagctcggaatctccatgaaagcacttaatatacagccaacctgttaaaaaccatactttgagaggtaaaatgattactttttgatagcactttaatagtagaaatagaatatacaaacagggaagtagacactcaattgcagtactttgacatttgagtttcaaggagagaggctgcctgtgagagtgactttgtgatagtttgtctactttgttcgcttctcaggacctctttgccccaagaaagtaaagcaaaattttgctatagccctattagtgagggaacaaaacttctcttcctccttcttcctttgtctgcttctgccatttgtaacacttagttcagcttgcagttggcttgcactgtaataaaactgtaaatgtcaccatgccctgacccctgtgtgtgttgtgttcaaagttttactctcgtagtctcgcatagttgagtgtggattgttgatgctcagtgcatattgttaaattggcgaacttcctggtgtgcattcactagttgatgatagtgtcatctccagatgtcctcagaaccacccacaccaccttctgaagttgaaagcacacaatgattgttcagtagatatcagctagcacccataacttactgggctttgattcataaagcctagtaaagaaattaaaatttttattttgatataagtactgaccttttttaaaactttattgagatataattcacatgctgtggagtttgtgtatttgaataaatatgcatttcagtggtttttagtgtattcacaaagttttgcagctaacaccgtagtccattttagaacatttcatcatccccaaaagaaagctcatgttcattagcagtcaccgcctcccgctcccccattctcctctcctcccagcccttggcaaccatgatctttctgtgtctggtaatttgcctattcttggcatttcatatgaatggaagaaacaatttatggctctttgtgtgtggctttaacttagtataatgttttcaaagtcatcctgttgtagcatgcattagtctgatgacattttctttttctttttctctttcttttcttttttcttttttgagacggagttttgctcttgttacccgggctggagtgcaaatggcacgatttccgctcactgcaacctctgcctgctgggttcaagcaattctcctgcctcagcctcctgagtagctgagattagaggcgcctgccaccatgcccggctaatttttttttgtgtttttagtagagacagggtttcaccatgttggcagtctgttctctgactcctgacctcaggtgatccacccgcctcggccccccagagtgctgggattacaggtgtgagccaccgtgcccggcctgtctgacgacattttcaaacccgtgtttcttaatcctttttagatccaagagatccttttggagatgggaagaattttagaagttgtctggtccaacataccttcattttgtagatgagattaaggctttaatcatgccaaacagtctattgctcttttcatgtttccccaaattgagcttatttggatcaggagaagagggagaatactttatacttctcagcttcttgtgtatttgactgtgacctggttataccatttgccactgtgaggcttagctgtgcatctgtgaatgggagattgttcttagagattggtcatagttgtccacctgcctcggaaactgcaggtacaaatgcagcagcaaagtatttacattcttacttcagggctgatctcctatttctatcagtccttttgaaggcagagaatgttaatttggaacaacctgcatatttattcaaatttccagagagatgaaactttcagaatgctgtgctgcagcgccccctagtgccgtgctgtactgatagtccccagcgtctcctgaagccgaaagtggcgtttcccgcagttccggcgggagagctgtagccagcaggttgtgcaagtgaacattagacatcttttctccttctcgccttccttgggctgagatggaggaatgtgtctttattgctgagggcaaggtctttgtttttcctttagcaggaacactggttttcccacttcgtctaaacctttgcccagggtttctcaactcaggccccctgagggccgtagtggcctccacacacctccagaaggtaaactgagccagcttagccaacaggctatgcttcagggaggaaggtgtcttttgttcccatccctgctgtggtgtgggcttgccccccttttctcgaagtgtttcttgtatatttttttccacatcctcttgagaaaggatcagaaagtaaagatgtgaacagtgagagttttgaaagcccgggatggaggccggatgggatatgaggggaagtggtggaggggaataaatagcttctctagttcacagtcttacttcccctaaaaaggggaagaaatgcctgaagcccttgtactttgctcccccgaatcgcaggcatttctgtgccgtcccgcccctgggcatttcctatgcaaccacaggacgcgggaaaggagcgtttgttactgctttctgatacctccttttgaccccagtgttctgactctggcagagttgctgaaaccttagggggcttcccagtctttcctgatggtatttggtgtagctgtgggaagggcagagttagccgcagcagtgtcacagtttctgtggtgtggcatggctgacagggcctccaggtacctgcttttattttaatgacagccaccaatatgtcctaagctctgcactttctttgaaattacaagaaacgatgaacttactcgtgctttttagtctcccgtgtgaactgaattgttctgtattttatcttgctctgttatgggcaaaactaattcatgtcatcagtggcatttccctcttcactaggttgtaaatcctgtgaagtcagacacagcgttattttcatctttattttacccaaacacctacaattttcccccctcatgtgacagcctttgaaataagttaatcttccagaggagagaaaacactaaacagtcaaacataaggagagggtaaaggttttcctcataacctcacaattttcagtgttagctttaaaaaaacaaacaaacaaacaaacaaacaaacaaaaactctttatttgcaaatagtttgaaacttgaaaagttgcggaaagaaaaatagtacaaagaatccccagatggtcctttacccagatccacctgttgttaagattaaatccatttgcttaatcatttgtgtgtgctggaattctctgtctgcaaatacacactcatacggatacacatacagacacacagacatgggctaacaaatgcaaatatacagacatacaatatttttccaaaccctttgagatttcagggaagattacatacactgtagccacttaatcctaaattcttgaatgtgtatttcctaagaataggcatattctcttaaataaccacagtaatacgttaccactttcacaaatttacattgatgcagtacttttttctaacctgtccatattctaattttgggagttgaccatataatgtcctttctagaattttcccttccagcacaggatccagtctagggtcaggaaatgtatttagttatcatgtctctagctttttgtagtctggaagtttcccacagcctttcaggatattgacttttttgaacagcagtttctcctcccctcttttgataacattcctcattttaccaaacacctaaaataacatttgattggaagttaggaaggcttttggagaaggagatggtgaaaccagaacattttaatagcagttggctgtcctgaatttctgtgataaactttttggtgtcacaaacatgccttgcttcaacatttagtcagatatcattttagttaaataattgtcactcactggtatttgctataaatatattgaataaattgaataaataattgaaatatattgaataaatatttggccttttttactttttttttttctcgctgttgcccaggctggagttcagtggtgcgatctcggctcactgcaacctctgcctccccggttcaagcgattcccctgcctcagcctcccgggtagctgggactacaagcatgtgccaccacgcccggctaatttttgtatttttaatagagacggggtttagccaggatggtctcaatctcctgacctcgtgatccgcctgcctcggcctcccaaagtgctgggattacaggcgtgagccaccgtgtccggcctccttttgtagttttatcaaaattataatttatgtccgtccactcactggtatttgctactgaataagtatttggccattttccctttttgtagttttatcagcatatgcaaaaattaccttttttcctcccaataaagttgtcatattctgttttataagcagcacctcttcttttttcttttttttgagacggagtcttcctctgtcattcaggctggagtgtagtggcaccatcttggctcactgcagcctccgccttccaggttcacgtaattcttctgcatcagcctcccaagtagctgggattacaggcacccaccaccatgcctggctaatttttgtatttttagtggaggtggatttcaccattttggctgggctggtcttgaactcctgaagtcaagtgatctgctcgcctcggcttctggaagtgacgagattacaagcgtgagccaccgtgtctggccaagcaacactttgtcttttggaatagtgttgataataaatgcttcttcattgtagtgctttgaatgatgcatatgattttgttaaatacaaaaatgatgtcttaaccttcacatttgtatggattattttatcacatcattcataatccatgtttgaatggttaccatgccagcttactttgccaagaaagaaatatttatcgtttttcaaaatgtgcattgcaattctaagaaattccgttttattcttaggattcccctagcttgtgatatcgatgacttgtcttttactgacatttgatagttaactccccaaatagaggattcctttatatgtggttattgggttgtatcagaattcctgcttgagtataagttatatttgtattgacacataggaaaaagatacatgtagtttatctgccatgagcatatggggaatactcattgtatgggagatggaaattctaatcaagttccccgggaggctgagcgccttgcagagatgctcttaaacccttggcactgacttcttagcccgttcctttatttcagttataaaatcgaaaggaccggttttaaatattgctgaagtgtaactgctcacttttaaaagctcatgcatttaaggattaaaatgtgattcacgtgtattttgatggagttgttttttgagctatgtgagccagtgttaaggaaattaagttggagttcaaaacagccgtggctagtgatttgtcaagtgttaaatgatagttcagtgttgcatagctggtaatcagcagttacttatggtgtatttttttgcgtgacatgttttcatcaagtcctaagctgttgtcaatgagctcttgaaactaacatgcttatgaaattatgtctgtgcaaaatgggtgtatttgaagagttgtaaggtgatttctgttgtgtttactttttatgattaatgttttgaataaagtatgtagtcccctcccaagaaaaccctccaaaaaacgtgctaggaaatcccctccactcctgtctgcgtccactcagcgtccactcagtgctactgtcccaaaggtgaagggccacattttttcttgttgatctttccagtgtctctttatgcagacacaaatatctatattattaacaaacacaaatatgttattatatagcaacacagatactctattttcctaccttttttacaccgagagtgctttcttcttttaatagtattttgaagatctctcgctgtctgtacctaaagttcttcctcattttcccctagttaattctgtaatttgattgaaggtacatatctgtggagaaattattgacatgaagttataataaaaacacgcttaaaatctataacattttctcagatactttaaaaataattaagtaaaactaataaatttgaaaataataggagaaaaaaaactcagtgaaccgtttctgagcgttccagctcatgacttgagggtgtttgccgctgactcatgctgaagccacttggtgtctgcgtttgaaacaggaagtgtgtgttagtggcttggaatcttgttttctcctcctctcctcctctgctgccaagatttttatcaaatcatttggatttgtagtgttcttactggattgaccagctctaaaaactttaggctgtatatgaactgaaataagaaagtgtgcttagaagtatgatttaaataaacatttttattttccattgtctaggaagaaaaccttcctaaagaaaatacctgataatcctgcagaacattctgatttcttatccttaggtatcttccccacattctgaagtaaaaggcctttcttgttagtcataagataaaatggataacttttaatatatagcatttctaccttttttttttttttttttttttgacacggaatctctctctgtcagcaggctggagtgcagtggctcattctcggcttgctgcaacctccacctcccgggttcaagcgattctcctgcatcagcctcctgagtagctgggactacaggtgcatgccaccatgcccggctaattttttgtatttttagtagagacggggtttcaccgtgttagccaggatggtctcgatcttctgacctcatgatccgcccacctcggcctcccagagtgctgggattacaggtgtgagccaccgctcccggcctctactttttttttttttttaactgctcgttgcagagcagggctacgccataggcaatgtgcacagagtagccacgtttctactattgatattaaacaaaacagcatgattttagtttatttattcttaatatttgcattaaacttcacagctgccgtgtgtttcttgtattttacttctttatcattcttgtatttctcgaattcattttctggaattcttaagcagtttcctttcctccccccaagaaaaaggtgtatgtgacagaaagtgttctttctcttttgcacttgaaaagtagtttatagaattctatgaaaaaatactctggcattctaggaacaaaatccttttttctcgaaactttcaaaatgttgccccattgccttccatagccttgttgattttgctattaagacgttctgttgagttttttaatttagtgatttaaaattagtaattaatttccgcgaacactttcatgatctctgatagctcttttttttttgtgatagtctgtgctaattttttctgcttccttttagcctatagaattttcccttccattgctttgagggtttcttagtgaaattcatatcatcttttcccagtgttggtgatgagaagaaggtgtaaccttctatattcttcactgaaaagtgacagtatttcagaagatcatttctgaaccattttgaggctctgtttattttcactgttactgtcaatacataatttctttgttgacttttgcaagtatatgtaaatattatatgaaaacttttttgttcttaatgtatatttatagttttggtagatgttgtcaaagagctctccagaaacgttttccctgtgcattcttaccaggagggtattacatttagtggccatttattcacatttacaataataatgagtattattcatttatgtaatatttagttactggttatttttgaatcacttggcttgtaaatttccctggaagctactagactgtttagttccattagaacagaggaaccacactctgcttaccatttttatacccagtactgatcatacgtgggcatttgtaggttctaaataattattgattaaatgaatgaatcattgcttctccgttgtggaaattgctaattcttctcaatgacttcttcttcttcttttttttttttttctttttgagatggagtctggctctgtcgccccggctggggtgcggtggcgcgatctcagctcactgcaacctcggcctccctggttcaagcaattctcctggctcagcctcccgagcagccgggactacaggtacacgccaccacgcctggctaatttttgtatttttagtaaagatgggggtttcaccatgttggccaggctggtctcgaattcctgaccttaagtgattcgcccatgtcagcctcccagagtgctgggattataggcgtgagctactgcgccaggcctcaatgacttgtttcttgaagctccatggagaatatgaactggtaggcacttgccagactcacatccgtgcagtttaaccacttcgttttccagaaaatcacattctgaattccgtgaaatcaggcttgcaacaagggctgtgtctgtctgataatatgtgtatctgtgtatcctatggaaatgcatttttaaactaagaagttatatagatatttttaaagatcattaatcaggatcattaacattttccttttttggatttccttgtcttcccatttgaaccacgttttctgcttttctttagtatgtttggcagagaaagcggaaatggaggtagtggcatgagtcagcagaaaggtaaatggaacaactggcagtatttgtgaaccaataaaaatctcctgcaagcaggactcgacaagtttggcatacaaaattgatttgtttcaaaataagctttatcagtttcatagtgttctttgacaatttgtaggaaaggttcagtagtatttcttttatataaacaacctagaactctgagttgcagatcctctgtttaattgagaaaggatcttgggggttatggcccaaatgttgcataggattgttaaaatatgtagcattttttctgaaagtatataatttgtatattttatgtgatcagtgactctcttattttttttcagtatatttttggagattttagccctgatgaattcaatcaattctttgtgactcctcgatcttcagttgaggtaagacaaaactttgttttagtgagtccgtgggtagatacaattaatagttatgtttctattttaatttgtttttttaaataaagaattccaatgtagagaaaagtatggagactaatatgagaaatgcctcaacccaccaactagatttgactgacatttgatttgacattttgctgtatttactttattaggctttgaaaagcaaataaaacattacagatgcaactgaagcctcctttggacctctctcccatctctccccagaagtaactactctgctgaaattgggaaatattggtcctgactggttttcaccttttatcatatacgtgtatatcaccatagtcaatcgtagtgttttatgtgctttaaagtgtcacgtaaatggtatactatattcagtttgtcgtttattttaagctaacgttgtattctttatgctaagaaatttgtccttgttctttgatttccagtgctcagtaccactgattgaacacactgcaatttacttacatattttcctgtcgagggccatttaggtctctagttcagccgttaaaaatattgcactcaatgtattttatcatgtctcctggtgcccctctgtgggctcctccgggacacagacctgggaatggaattactgggttctgtggaccgagcctctttagtttcactagagactgctcgtttgctatctaggattttaacagtcttcattcccatcagcagtgcatgggagttttcttgctcgtattaaaaaaaaaatcttgctaactcttggtgttggcatatttaaaattttgtgaatctgatgtgtgtagtaaatggactctcattgttttaatttacatctcccagattacaaacagctgggtactatttcattctcttcacgtctgctggcaatacggatgtcctctgctgtgaattacttggtttatatcccttgtccatatttttaaatcaagtagcttgtctttttcttactgattttaggattaatctttggttttacaggcatctgttcctagcatgagggctttaagcttcacatgttaggtgaaccctttttggggttgggtttttttgttgttgttgttggataagaggagtacactttcaactttaatgtcaactgaattgatttttttttccttatagtttgtggatttttagttttaaaaatatctttaggaaattcttcccatcctttagataacgaagatatttgtctgttttcttctaaaagttttcagattttgttttcacgcttcagtgtgtaataagctgaaattgaggcactgaattttgtatatgtgtgaggtggcatcgaactccctgcccctgtggccctggcaggtgcctcctcaccattcattgggaactcggcccttagctgtcctgtcagccccgttgggcagtgcatctcccctggttccgagtgtgctattctgtgggcctattgcttatctctgtataaacaccacacgttttattttatttttttatttctattttttcttttcttttctttttttcgagacagggtctcactctgcccaggctggagtgcagagtgcaatcacaattcactgcaactttgaccccccgccccgcctcaggggggttctcatgcttcagcccctgaatagctgggattacaggtgtgtgctgccaggcccgggtggtgtgtgtgtgtgtgtgtgtgtgtgtgtgtgtgtgtgtgtggtgtgtgtgtttttaagtaaggggattttgtattttttcccacatcacactgatgtaaccatacgttttagttgctacaggttttctcaagtgtgtacacatgtggatgggtgggtacctgtttgcaagtgagtagacaaaaacttgagttttcatgtgataggaaagtgaaaagtgcaccgtatttcaagtctgaaggcctggggtcgcttcagttctgccacttccacaggctcggagggtttgggcacgttctttccttttgggcctcccatttcttttctctttcttttgttttttaaattgaaaaaatgcagaatgcttattcacgtcacagaaatgttgggaaatcagctaatgtatggtccgataactagtgagtaacagatgttagtagaaatggatgaaaagggtacagatggtaagttatgccaaaccttttattcacagaagacgtgactgtgtctcatgaaaatgagctcaagcttcagaactcgtagtgtgtgtgggcttatttgggcttttctgtttttcttattttttaacatacggtgaagtttggaggggtataaaaagagtttatcaaaatcacagtaacctgcaaaagggaaatgcaggctaattaacataatcggatggagttgttttccccaatcttcaggaatctgaattataatagcacatgattacacaggaactcactttcatggggcggcatgtggttgggcctgtgggtgtgtgagtggcgagggcgtgtcacttggacctgtgggtgtgtgagtggcgagggcgtgtcacttggacctgtgggtgtgtgagtggcgagggcgtgtcacttggacctgtgggtgtgtgagtggcgaggggagggcgtgtcacttctacagcacagtttggccttttatctctcaggtaacataattgccgctcaaacatgcagtgtttctaccatgtggctgtggcatgagttacaatctagtcgaatttttcatatgctttttctccgttgttaggagcttgataaaatattgttttctctacttggggccatgaattgaaaaaccaaaattaagaaatgtgggatgttaagatgaaagagcattctgccttcctgcagaagcgcctcctgccagcggagggctgctttgtcttttagtttgcttgcttggcagcttgccactggcaagataaggtggctagtaatttagtggcatcaggagaaacgaattcaggtgaaaggtagctggcatcttttctagagttgtgctccagtgatttaaaaattattttctccagtggaaaaaatgcagtcaccttatttaataagcatgtttaaacctcagtcgtaatcctgttatttatgttcagaaagaaagagaaaatgctcaccattctttagtttccagaatctcagctttggaagtagcacacatcccaaccatgactgagtcaataagcccccgatgacatagtgttggcagtgggcagtgtgtgtggtgtgggtgtgtgtgggtactcatggagagtagagagtagagacagttcttaatttggtgtgttttcttttttgagagggagtctcgctctctcgcccaggctggactgcaggggcgtgatctcggctcactgcaagctccgcctcccgggttcacaccattctcctgcctcagcctcccgagtagctgggactacaggcgtccgccacctcgcccggctaattttttgtggttttagtagaggcggggtttcaccgggttagccaggatggtcttgatctcctgacctcgtggtctgcccgcctcggcttcccaaagtgctgggattacaggcgtgagccaccacgcccggcctaatttggtatcttaatgggattttaaaggagggctttgtggttcaggagagtctttgagacggaaagcagaacacacaggtagcccagagggagacttcagaacatgaccttcctatagccacgggcccaggtatccttttcacaaggccgcagcactgttttcacactgtgcgtttagcataactattaatagatgacagttttttcccttgctcactttgcatttgtctagggaattttatgtctttgctttgatttttgaactttgtattcttacaaatagttatatagttaatgagtgaacttcgaaccatcctggcacttttattctgttgtgtatttagatacccagttaccacagactaagtgcatctgatgtgtgagggaggtttgctgaatgaaaggtgctgtgtgcctgtggaataaaacacacacatttccacagtgccacaacccatctggcattcctgcaggtgcgctcttttatcagcttagcaaatcaaagtaagtgtgttgagcatgcttactgaaggtggcagtgtcatctgggagtttgctggtggtcgtctcaccagatccctgctgtgcctcttactggcagtgtcacctgctggcactgtcacctggcttcctcatctgaagctggcagtgtcgcctggcttcctcatctgtcagagggccacagtaacaggacctcctccccagagttgttgaggagcaggatgtgtgcctggcacaccctgagtgcccagtcagtgccacctggtgtcactggtccagcctttccagcctctccaccctcagtcagcgccacctggcattaccggccccgcctctccacttggcttgtcctcagcgtcatctgtgtatttttcccgattgctggggttttcttctgcatgttgtgggagtggctgggagttgagtgagtgttcacaccccgtggttgaatgttgaggaaggggacagccggaagatggtgagcagggttctaacagctctctgccttgtgaagtggatgggtgaagaggtcccttctctgaattgtgcgtcttcccagcctgctgcagtctctcgggtctggaggtttccttcagcattctctcttccccgagcagaacagaatactgggaagtgtgaagagaacattgatataatagtgatgaaactgttttgactcagaaaaagatgatttcttgatgttacaataaattttgtgtaaaaatagagtgattcaaaacacttttcatgcctcaaaataacacagctttctgtcaccagggggcatcctagtgtcattaacagaaaaagagggcattctatgtatcagtttctaaactgtcttctttgaccacagagggttttgaacgagatggaggcttcctgagacacacatggccgctgtgtccactgcccttatagacccacctctctgctccaggtgcctgccagcatcaatgctggtgtgtggaatggtctttgccttgcgggtgccaaggctagtgtagcccatctcagcatacagaatgctttcttctgggtgtcaacgtgatgcgtactaggttgccccctggtggtggagataagtgcagctgtcaactcctgaaggtgttggcttcttttgaattgccctgtgttttcctgtttgtcataattctctgggaagagaacttactgcgttactagcagagagaagcttttattgctgtgattattgaattggtgtgctgagatctcattggagaactcagctgaggaagccaatcaagcagcagctctcatacagtattgggcatgagacttacctaggagcctctgaactttgcggccctagggccgttcctgcactggcctttgtactgcagtgaacagactttgggaagtgctgcaccagaatgtctttttgttcttttgttctgccctcaggtagcagtttatctctctgcttaccttaccccttttcttcctaaaccttttttttttttttgagacagagtcttgtgctgttgcccaggctggagtgcagtggcactatctcggctcactgcaagctccgcctcccgggttcacgccattctcctgcctcagcctcctgagtagctgggactacaggcacccaccaccatgcccggctaattttttgtattttttagtagagacagggtttgttttttttttgttttgttttgttttggtttttgagacaaagtcttgctctattgcccaggctggagtgcagtggcgcgatctcggctcactgcaacctccatcccccaggttcaaacgattctcctgccttagcctcccaagtagctgggattacaggtgcctgccaccacgcccagctgattttttgtatttttagtagagatggggtttcaccatgttggccagactggtctagaactcctgacctcaagtgattcacccacctcagcctccctcattgctgggattacaggcatgagccaccatgccctgccccttcctaaactttcttacacccaatgtgtccattggaagcatttccaactcttaaataaatgttatggaatagctaggaagaagaaaaatttaagttatttttgagataacctttcagctttttacaaagaagtcagacagttcccattctgctttctgtctgccaaacaaggaatgtgacttctagctgttaatgtagttaattaaggcactgtgttaaaaagggagctgcagtcaccaggctttttgtttatagtgcgctttcctctgctctccgaccatggacctggtcccagcctctactggctgtgttgcaatgtagtgatcgtgaataagaggtgcagtcaggaagagtcatcttcgctagtgcacaaacaaaagtgtctgtggtctggatggtcagtcactgacatcctgtggaaagaaggatgtatcataagcatttcattgtagctgatttacatgtccattggagttcatttttattccttttggcttcattttcggatctgtttaatagtgataaatatttgaaagcatttctattgtgtttttttcgttaaatgaagatgatttagattgcactgactcttcatgtatgttattctgctagaagtaacggcatgcaaagttgtatggattaagagttttaatgaattgttgccttaattaaatggtaagcgttggttttaacattttgttgaattaaaatttgttttctgattccttgtgcagcttcctccatacagtggaacagttctgtgtggcacacaggctgtggataaactacctgatggtaagctagttctctccttatttccctgaagggaatttggccatacgtgctgggtgggcaggctacctgtaaacattgtttcccatttgaataaacatttctttgtagcttgaagtttttgctgtaaactgtaatgtatttaattgctgaatcactttgactagtgaattggttttaaagcgtatcctgtgcttcggagtgccagccatgtaagatttagtttaggaaatggttgttgagttctttttttcctaacagttctgagtgcaacaggtatgttactcttcatcagcacatgctggagttgaagcgaactttgggtcttgttgctaagcagcctgctggctccagcgccagctagcttctgagcctgtgttctttgtaaactaaggggcagctggcatctgttgttcttgcagttcacattcatgtcctggtctgtcgctgactcttgggaactcaggtcaactcttcacctcctggtctgttacttttttgggtctccatcacaggcactaagctgattgccagagatggtgcttatggagatgcaatgattttgtattgcttaagtacccagcgttggaataccaacaaggttgtttaattattgattgcaggctgcccttgcacaattcaaacttgtcgagatcatttttcaatctgaatcactttaaaggcccttactggcctccaggaaactgatgccaaactttttctttgagagttagaggtttggattccctgttcagttagcatggtcagacttatgaaaggggttttaattacaatttaggcttcaatagaagccttgaaaagactaaccaaacgttttatctccagtaacatcagggagtgattatatctaaaattttagatttataagaaatgtgggagaccataagggaaagagcagatctaacaatagcttaggacaagtaataaaatgaatgaagcttgagggaccgggaagccgggctgctcagcctcctgagccaccttttaattggctgatgtcaacctctcagacatctgagtcagtgggacttcctctgtcactgtgtgctttgcacgtggtgagcatgctgctcatgttgaaccagtgcttacaaatgccccatgatgttcccatgcacatcacttctttgagttcaccctcctccctgtgcagtgggcaccaccagctcccccagcctctggagttctgcttccccctccctccttccagcctgcctgcccttttcagtgactgcttcttggccctttttctccattctttactctgttccctctaagtcctgccttttttctgccaaaaacacgactggaatcttgccaccagtttgcacagttagtgacaggcctgcttttctctgcagcctttctgggtatcttgtgtttccatgacattagtttctcttccagtgcctgttcgactgtacagagcctgtgggcactgtcatggacctgcctctctttccagcctgctcagctgctgatggcaggatccatttctctgtgtctgtcactgcgcctgtagtatctggaatgttgtaagccctcagtacatttgttggatgaatggtttaggatgctttattctgctccctcccactacctccagctgcagcaagccctttgcagaggcacctcatcgtggcttcccttttagatctcggccttttctatttttgtgttttttaatttttttatattttaatttttgtaggtacataataggtgtatatatgtatggggtacatgagatattttcatacaggcatacaacaagtaataatcacatcaaggtgaatggttgtccttcacctcaagcactgcctgttttagatgttcctaaagcttgagataccactccttcaccctgcccttagcaattcagtgatccatcaagttccactgacctctctagtttctgatagaagttgatcactgtttcctgcatccagaagaatcctttttctaaagctattcacagctttctctcccctccctccatgttttcattctcagttgtttgtatttgtctccctaataaatgtgaactctctgagcagggcccttgtgtcactaatctctgtatatttccctccctcgccccctgccttgtagtccagtcctctctactgcatgtactgcagtgagcagccttggagaaatgctgtgttaggattcgtggttttaagagcctctgcctgcattacctgagtattgagtttccatcttcctaatgtattgattgggttgttgaagccaagcgtgcaggccgtcctgcacttcgtctgcctggcacattgggctctgagctctctgccatgcggtgcaaggcacatggcgtccattgtgagtgttcctccataagaagaggaactgtgctggctaggaatctgccttctagtgagatgatcaaacatggtattgagtaaatgtttgatactaattataacatactgaaatggttctgttcacgttacatcacattctagaatgttttatgttctgataagattgagaattgagatgtgtacagcacatctgtgtcttagaaataatcagtcttgcataagctgaatgacacaacacgttctagtttctaatgtgatttcacagccttcaaagggcaggctccacatggagccttccgccccaggcacacccgtttcaatctggggagccttgacggccccagaacatcagggaataggggatgtatggaaccaaaatgaacagccagcccctacatatgataataaattcatttccccttgatattcttttcaaagtaaggaaacaaaaaataaatagtagccaaaggaattagatggtcgtgacttcatgcataaacttgctgttaggtgtaatcgtcatcagtgttcttttccaggaactttctcttgttggggcaggattgtgctgccaccacccttcaccccccacagtcgggggctgtgattctaaagcatacgaagattcaggaggcctcgggaggctgtgtagctccagcctcctgcacactcacttgcacgtaactggcccctctcagcgtctgtattttttcttctacaaaaagatttctaggggtcctttcaaggtaaaatatattcagttctccgcagtagaacaccgttctttgggtattagtttcttttcttaagatagatgccttgaaaaaaaaattggccccttaatgctagcctggaagaaatcttcatgcattaaagatgaaatataaggcatgtgtccttcccttaacttcaaaatgtgtaactttttatcaaatataaggtgacattgatgcttgatttctgttgaaagacacaattgattctaaaacttaacctgatttcagaggtgtaaactataaaaatacgtctgtcttagcaggaatgaattatgtggattgtggttaactgggaaggaagtattgaaggcttcccaagagatatttaaaagttcacaattctaactttttcttttggtatttttggaaggctttaccacccatggggttaatccagtgtgaatttatttagaggacgtttgcatgtgttcatgtcagggccatttttcagacttaattgaaggttaccagcggaggagaccaagagatagagaattcagaagagtgctctgaagtgcgcttttatatataggattctttgttgttgttgttgttgttgttgaatctttttttgacatcttttttttttgtttttaaatttatactttctaatttctcctatccagtatgtataggattctttgcgtagttcatgtttttggaattaatcaaatcacgttaactacagaagctgatttaaccatgttttaagtccctaagttagttgtcatgatcttttaaaatttaagttgtccaaaatacatattcctttatctcaggcataaggcagctataagaaagtcagattccactggggggtatttttaaaattggcaaaatattacttgctttttattacaaatttattttaatttctaccttctgaaagccttccttagctagaaagataagtacaggcttctgcttttcatatccccaaattaaataataattttatagttgtttcattttccgcaaattgttcagcgtaagtaaaggacgtaatagatttgttgattaggaagagaacttaaggtttttattttcaaagagaaagtgagtaattactggtacttagagtttgtagaactgggttcttaactaatagttttctttctaaacaggacaagaatatcagagaattgagtttggtgtcgatgaagtcattgaacccagtgacactttgccgagaacccccagctacagtatttcaagcacactgaaccctcaggcccctgaatttattctcggttgtacagcttccaaaataacccctgatggtatcactaaagaagcaagctatggctccatcgactgccagtacccaggctctgccctcgctttggatggaagttctaatgtggaggcggaagttttggaaaatgatggtgtctcaggtggtcttggacaaagggagcgtaaaaagaagaaaaagcggccacctggatattacagctatttgaaagatggtggcgatgatagtatctccacagaagccctggtcaatggccatgccaattcagcagtcccgaacagtgtcagtgcagaggatgcagaatttatgggtgacatgcccccgtcagttacgcccaggacttgtaacagcccccagaactccacagactctgtcagtgacattgtgcctgacagtcctttccccggagcactcggcagtgacaccaggactgcagggcagccagaggggggccccggggctgattttggtcagtcctgcttccctgcagaggctggcagagacaccctgtcaaggacagctggggctcagccctgcgttggtaccgatactactgaaaaccttggagttgctaatggacaaatacttgaatcctcgggtgagggcacagctaccaacggggtggagttgcacaccacggaaagcatagacttggacccaaccaaacccgagagtgcatcacctcctgctgacggcacgggctctgcatcaggcacccttcctgtcagccagcccaagtcctgggccagcctctttcatgattctaagccctcttcctcctcgccggtggcctatgtggaaactaagtattcccctcccgccatatctcccctggtttctgaaaagcaggttgaagtcaaagaagggcttgttccggtttcagaggatcctgtagccataaagattgcaggtatagttgaaaagatacaaatctagagtgaagatgggagcagacctcatcaactgggcttatagactgtggtgttacccataacaatggcagattacctgtgtgttaatagcaacgtctgaaggatgcctatgtcttaaatgttctctaaaagtaagataatatagaaacaaatgggaggagagggttgtcgtaactttatgttaagtgaaagatccatgtctgttagcagttcttttctgttgacaagttacatttccatttcttgccttttgttcaagtaattctgctccacggtatgaatgtataatggactttttctgtgatatacctttggtatgataatcctgatttgtactcactgtgtgctccttttttatatttcttaagatacaagaaatcattttgtgaaataacatggttttttttttttggattgagtaaatggattttattcagaattttgatacaccaaggtcagctcttgaagagaaaaaaaatgttaagggttcagcccaaagttaatgttttattttagagtgctaaggctccaaagtagaaacaattcacaataaaaatagaaagctgcataattcacagattgtttttaaaaagttacagtaggaagtcagaaatgcagcagggtatgaaagaggtatgtgtcctcacatagccacgtgttgcttaactaagatggatatgtgttccgagatgtgcgtgttaacatcagagagtactacacaaatacaggtggtagagccttaggctggtggtgcagcctattactcccgggctgcaaacctgtccagcgtgttactactgaatactgtaggcagttgtaacacagtgctaagtatttgtgtgcctgaacacatttagacatagaaaaaatatagtacagatatggtataaaggatgaaaagtgcttcacctgtatagagcactcaccgtgaatggagcttgcaagactggagtggctctggatgggtcagtgatgagtgctgagtgaatgtgaaggcccaggacagtactgagcaaagccgagttttataaacagtcaacacttaggctgtactacgttgatttacaaatttttcctcaataagaaattaaccttaacctactgtaacttttttacgttttattttacttttaaattaaaaattctaaactttttgactctttcatgagaacatttagcttaaaacacacactacagctatacaaaaatattttcttcctttttattcttactttcctataagctttttcatattaaaaattgtttttaactttttaaacttaaaaagtaagacacaaacattagcctgggcctgcacagggtcaggagcatcaagacgccactaggcggcaggacgtttcagttccactagaatcttgtgggaccatcatacgtgcggctcattgttgaccgaaatgttacgccgcgcgtgactgtacgtacctaagaagcagaagctgtgtcatcaggttggattccaccaagcctggtgaccagatcttcagattgtcaccctagtagccaagttaaaataagctgtttggtttaggctttctgtaatactttctgatgtgaccttttggaacacctgacacccttcattaccaggatgtagcagcaagctgccaaatgcacacccttcgatggatggtcagaattgtgtaaaaaataaaacacattctttgggtggcaatagggtgatagcaagcaatgtatatatatttttaagagtattttattccttatacaaaatacattatctcaggtactcttgttgttctgaagttctcttaaatgagcaaatgataggccagacgtcgttattttgggcttcatatatattttttaaagccaggtgattttttttttttttttttttttttttgagatgcagtctcactctgttgctcaggctgtagtgcaggaggcacgatcttggctcactacaacctccgcctcctgggttcaagtgattctcctgcctcggcctcccaagtagctgggattacaggcacatgccacaatgtctggctatctttttttgtatttttagtagaaatggggtttcaccatgctgcccaggctggcctcaaactcctgacctcaagtgatctgctcgcttcagcctcccaaagtgttgggattccaggtgtgggccaccgcactcaggccaggcgatttcttgaatacagctttcagaatgtatttattgcaaggactgatactgtaggtggatgacaaggtcaggagatcgagaccatcctggctaacacggtgaaaccccgtctctactaaaaaaaacctaaaaatcagccaggcgtggtggcgggcgcctgtagtcccagctactcaggaggctgagacaggagaatggcgtgaacctgggaggcggagcttgcagtgagccgagatggcgccagtgcactccagcctgggcgacagagccagactccatctcaaaaaaaaaaaaaaaaaaaaaaaagatagattgtgtaagcctttatatagattactaagttaaaagtttatttttaacctataatgagaaatgcatggtggggtcctgttaaaaatgtgcattctaagttcgaagtcatgagaattttattttcttttctttatttttgagagggggtctcactctgtcgcccaggccggaatgcagtggcgcaatctcggctcactgcaaccttctcctcctgggttcaggcaattctcctgcctcagcctccctagtagctgggactacaggtgcctggcaccacgccaggctaatttttgtatttttagtagagaccgagtttcaccatgttggccaggctggtcttgagctcctgacctcaagtgatcctcctgcctcagcctctcaaagtgctgagattacaggcgtgagccaccgcgcccagctgagaatattatagtttcgtttctaaaattgctccacaaaggaaaacctcccatcttagggagattttctctatctttatttaaaataaccaagaaaagcttcatttaaaatgttttagaacattctacttagtcatatgactttaaatatagtttgataaatagtttgttatgttctgtatatgttaaagtctaattgaagtagctttgtcaaacactgaaagtaagggcctcttaatgactggtagtagaggaaagccttgccacacacagtccacgtaattatttttgtgtggacatattgtaaacccctaccaaacagattatttttttaatcctatttggttaggtcagttatgaagatgttttaattttctgagcaaaagtgtagtttctttaaaaatatataattcttttcagcctgtttgttgaggcttcgatagacagaacgtagttgttgacagtttcaggagtctcgtgagatagtagagcaatagagtcacattgaataacccttgggatcatatagggcttagggagaatggcattgtttgaaattttttttgttgttttattctcctacttagggatttactttataaaagtggtaaaacatactcagtttgttacaagtcagatccactaccacaaattccctttagtgggcacacttttaagtgtaggcccacttattttaagcagcgtttaactgagtgaaagtctagtttcattaaaagatctgttgatgtgggttataatagagtttgacttgcattagtatctaactgtttctactgagacagtggtatttgtgttattaacttttgggaaagagggagtagggaatgatttagacattaaatgtattcctttctgccaggcatgatagtgtggagattgaggcttgaggctcgataacttgagcccgggagttcgaggccagcctgggcaacatactgagaccccatctttaaaaaaaaaaaaaattatacacacacaaaatgcttggaataatttgtgtattttttatctcaagtttgtttcaaatactcacatttctggactatttcccctattgttaagtctgcttaataaatgccagctagtttttatgccatcagaagtgaaattaagaaggcagatggactaaaagaatcacgtataagggattttgaagtgaaatacattaaactcttgattactcttaaactatccactttaacgggttctacttggaccttcttggtggcaaggccatctcctcggtgtaggttatgtgtcaacattttgttccattggctgtttttcaagtgtgaactgttatttgaaaggagaaggacacgccaggggagagcgtgtgaactgaatactcagtgatttcctttagccccaagggaaggatgtatctaaacacaaaagccctgtcttgccgagggttggagagggatctgtgtttcagtgactggtctgagaggagatggttgccatttatcagtaggagtcaacaaaaggaaacttaatacagcccggcacagtggctcacgcctgtaatcccagcactttcggaggttgaggtgggtggatcccttgaggccaggagttcaagaccagcctggccaacatagggaaatcccatctttactaaaaataaaaaaattagatggacgtggtggctcatggctgtaatcctagctactgaggaggctgtgtcaggagaatagcttgaaccggggaggtggaggttcagtgagcccagatcgtgccactgcactccagcctgggccacagagtgagactgtctcaaaaaaaaaaaaaaaaacccaaaacttaatagcttgtgtttgaaagtagttgcaaaacgcgacacccttgttaagagtgagtatggcagacacgtggggagtgcctttgctgctgcttccctcattagcacagatactttggagttgacgaacatgtgacgtttgaaattgaacgtatgctttcattgaacattgtacttttcctgggtctttactaaggaacattcctcatatactagacgaaattgtatcagatgctttcacatcacaaatagagccattttgtatttgatgttttgctttcaaaattatgcaacagtatattttgttttaacagaatataaataatgctgggtaagaagagtggccaactgcccgataagttaaaattccagtgagagagaactaggaaaactgagctcttgaacagctctgaaaacattgcgttgaggtatctagcaatgtcatttattatgaattgttagtcaaaacctgtttatatgatttttcacagtggttttatacctaaaaggcattggatcaagaaacaaagttattacaatttgggtcttctctaatgaattaccctgtccgtgtttatttaagtgtaaatgaacatacagttatgtgctgctttaatgatgtttcagtcaacaacagaccgcatgtacgacagtggtcccataagattataatggagctaaacaatttctagtgaccagtgagttgtgttacagttgcctacggtattcagtacacaacatgctgtacgggtttgtagcttaggagcaataggctctagcatatggcccaggtgtgtagttggctataccatctaggcatgtgatcccacaatgacaaaattgcctaatgccacatttctcagaacatatccccatcattaagcatggctgtgtatcctaaaactgatctttattttggcagtttataaatcatgcatatatttccccccgctccttgggggaaatggtttctcagatattttgcacttcctcttcaaactctgaagtacacaggcagtggtcatgcggcgtgatctaagttaaaaaggcgtggcacctgtttaccgggatccacccttgtggactgagagtttagtccacatctgattcgatgtttgtagcctcacatttattatacatctttccacttcagaaacataagttgatctgtagtcaatgggtagtggtacattttggtcactttgctgtcctccacctggttagataaccaagatagtgtgtgttcttccaaattgatggtaatgaggaaaagaaaagcacttggagaatgttctggacagttagaatgatgacagaaaagcaggtcaacaacaccagaatgtcgattacgggccagttattgagccctaagaatcagagttctgtaccttgcattttcagggattttcaatgttaatatgacccctaagtcctaattttaggaaaacagaatttgatgtgtaaaatatgtgtaagaataatcatagcttatgatgacataaaagtttacgatgctggtattgcctttgagttgataaacaatttcagtgggctgatttgtggcagcccttgtgagctaccatctagcatgtatgtcttaaaatttgaaaaaaggctattaagcaactccatttttctgtatgtcagcagatttcataagagtgaaatttcagttcagccttttcatgtgagttattacaaaagtgaactacaggtttcaattttgtgtcttttatgagtcattctggcattttgtgccttttctcacacattgttctaggcagccccaccaactcctgtgacaaagatggactgggggaggccatcttcctaaagttgctgtctgaacagttaagtagtaaattataccaaccatgatgaattgaaaagaaggcttctggggaaagtttgttattagagccaacttctattatatgcccttaaagaaggtaaaatagatacaccaatggcaatgactttggaatgcaggtcaagtttcaacctagaagttgcctgccctctatccttggtggcccgccttcctcatttttattcttttagcctccataattggaatgcgtattggactttaggctaggaataacattgtaaatgaaaatgttgatgttgaaagaggaatttaaatagagcgaagagtgatattagaaatttggaagtggtattagttctggcttgtccgtaagacctgacttttgcatgataacaataggattcattcacttgaacataattcggtctggtcttaggaggaattagaactgcttttgcacccctgtttttttcactgcgaggaagaagaggagctcacgaacttcataaagcgttagtgtctcctccagttgatggttatcgaaatgagtcaggatggaaggcttagtgtacgtgtgagatgttacaaaagtggaccttaaatgtttcttgagtgtttggatcttaagagaaaatctttgacaataagtatttaatcttcatttcttacaatcattcctcttaaaatggagctttattttttaaaaacgtattttttttttcttaagaaacagggtcttgctcattcattcaggctggagtgctgtggcatgatcatagctcactgcagccttgatctctcaggcgcaggtggtcttcctgccccagcttcctgagtagttgggactataggcaggcaccaccatgtacagctaatttttttattttttattttttatttttcatagcaacagagtctcactgtgtggcccaggctgatcttggaactcctggactcaagtgatcttcctgccatagcctcccaaagtgttgcctgaaatagaactttattaatatatctttaatatgtcaagatgtttaaaacttgtcaagattttaaggaagttgggctaacatttcctcttgggatgctgaaagttgttggttttctcagactctcacataaattcatttgcttttcccttctccttccacctctattagctctttattttctaggggggattctgatgtctgtattgagctggccgtcatgccgggagtggtctgcttatgtatttacatgcgtgctcatctttgctatagctgagcgtggtgcagctccttacctgttccaggtgcggagtgatctgccgcacaatgaatgaagtggcagagccagggcgcgaacccccgtcttcctggtttgtgtgcctgggcccttgccctttactgtgcgtcttctcaggagctgtcatttagactttctggaccaggagctaaatgacctttaaagtctgttgagtcatttctaacaaatatgagtggagtcatttgccgtaaccaacaactttaatctccagatgtttaattgatcctgtattactgtctaatgagaacttactgtatgccatgcactgtctagttggagtaatgattggccttgccttcagggtagtctaaggcataagatcagaaaggaacagatggcagctgtttgtagggagaagtgatcattggcagaggggtgttgaggggagaaagcaaggaggggaggcctcatgcagctagtagggatggcagtaacaggctgaggacacaaaaggccaccaagtcctgttaccttagatggtgcggactttgttgagcagttgaagtgtgagagtcttgtctttaaggagcctcctgtccagagaaggaggcacacagcactaatatcaggtaggcagtgatgaggtcagctactgtggagacagtgtggagaatcttgagtgccttctgtcggtcttactctgagattaggatttaggatcattataagagattaataacagaatgatacggtattttagtttatgaaagacttgccactagataaaatttttctacagtaacagaataatcattaagaaaaatctaggttgttcgtgtctcttctgtattttccaagtctgaaaaggtttattctgcgtttaacgacgtcgtaccagaatggcctttcaaagactgtcaaaggcttgaaggaaagcttggtggagtacatttcctagtacacgtcccaagggcccgtacgtatgttctgctgttgcagaggttgtgctcgttcgcttttgtaggttccttgcagttattgaacaaaccactgggtggtgctagaagacttgattttaatactgtgcaagaaaaactgaaactgctttttaacctgcctgcgcctcaaaataagcaaactggaagctggtatcgatttaagggaatggctgatgtagaaactaaaggtttctgtctgactagttcatgctgtctcacaaataaatgctgggaaaaaagtcggtttatagttgatttatgtatcctttgattgcatagagattgaatggtcaagcctccaggccatgcagattattctgggcccctaactcagttaagaacatgaaaggaggccaggcacagtggctcacacctgtaatcccagcactttgggaatccaaggcaggcggattgcttgaggccaggagttcgagaccagcctggccaatgtggcaaaaccctgtctctagactttgtcccagaaaaaaaaaaaaaggagctgtgttttcagacagagcttagtgcagccagttcttgatggctgtgcaatgctttccttttaagagtggagttagcctcgtcataaagcgtgtttttgagtctgttcgaacgggtcaacaacgaagggaagtttcaggcagatcttgtatgcctggccctggtggctgctttcatttccttccagtatcagtgctaaacaggaatgaacatgttcaagccccgtctcacccacctctggcatcttcgccctaactctgccctagaagacctttccttccgtatcgtcaagaaaactgaagttgctgtttcactccttctcccacccagaaacttcgctgcatcttcctggatccctagctccttgcacccatgatcctgtctccttcctcagcccggcttctggctgagcagcctgcacttgctgtcttcactcctacacgctgcccccactcctacacgctgcccctgcgtgcttctcacttctctacccttccagccctgcactctggggacctgtgcgtatgtttgtgtgattatcaatctgttgaacccaggaggtcgaggctgcagtgaggcataatcacgccactgcactccagcctgggtaatagagcaagatcctgtctttaaaataataattatgattgggtatggtggcacacatctgtagtcccagctactcgggaggctgaggcacaagaattgcttgagacccagaggcggaggttggagtgagctaggatggtgccactgcattccagcctgggcggcagagtgagactgtctcaaaaaaaaaaaaaaaaatcagtcacttgctggtcttttaatatacatatacgatttactggtgtcatctgggtatcttttactaacatctctaaaactgagctcattaccacactaaacaaaaaataacctgctcatctgttgtattcctcctctagttggatagcactgctgccccagtcagtgagaaccttctagtatatctgttcttcctcagcttccatttggtggcttcaacccctgaccttcccagagtttctgcagcccttggattgggctaagcatccttccccaccccccgccccccatctcccaacaccccttcagcttagcctgtacagtgtgtgtttggagccagggacatcacagttcgtcccttcactggtctgcgagcttgcctagggcaggaccaccttgcattcatctctgtgccttccttacccggtgcctaggcagggctcagcaggggtttactcgccttcagcgaaaggcagcatgttatttaacaaaggtttcagccacacaccatggctcatgcctgtaatccaagcactttgggagaccaaggcaggtggatcacttgaactcaggagttcaagaccagcctggccaacatggtgaaatcctgtctctcctaaaaatacaaaaattagccgggcgtggtggtgcacgtctgtaatcccagctacatgggaggctgaggcaggaaaatcacttgaacccaggacacagaggttgcagtgagccaagattgcaccactgcactccagcctgggtgacagagcaagacttgtctcaaaaaaacaaaggtttctatgttagaaagatagcaggctttgagtcttaaggttaggtttaaaaaaaaaagtcatttgatataaaaatactatggcaaagccttgttggaatcatgctggagttttcatttgagacactatgcctttacgtcattgatggttatttgaaaatgcacctttttaacactgcaatgacattagttgctgttctgtggcacacactagaaatgatagactgttgtgatgatatggtttaaagacaaatgtaaaaatccactgtcaatagactttaagcctgtggggaaaagtaagtatctgaaaccttggaataaaagggatttttaagtgaagccccttatatattgaggaaagggctcaacctcttgagtcaggtggacccaggttcacaggtcatttcagctgttatgtgacctcagttttctcatctgtaaaatggggttggtaactatctctgacagtagggttatgataattatgaataatatacacaaagcttctagcacagtgtccctcacatgacaggtgctatctctgctgggtgtcatcacatgcaggcttggggttcagttcgtaactgatccattattcatttatttcaaggcccagttcggtattccatattaagagagagaggagctttgcaaacttagtctaattaaacagattccacagaatctgtaatattttactttctacagaagaagagctagcagaaattattccctacgcttcttcagttagaaggaagaggacatttattcataggaaggagggaatgagaggggtgggggtgtgtgtgtgtgtgtgtgtgtgtgtgtgtgtgtgtgtgtgtgttttgaattttgtaaattaattttttcatttgattagtgccgaagtctgggatctgccagtacaatgtagtttagaaaagaaaagcttatttttgagcgatgccttagatggatgctactatcaaatgtatgtatgccattttggtttttctttcctatatacaatttgtttatttattatactttatttttaaatgaatttttgatttttgttggtacatagtaggtgtatctatttgtgggttatatgattagtatacaatttaaaagtaaaggagacagtgtggattggctgcagattatggagttgaggccctggctatgctacctggctcctgtgtgatcacaggtgagttagtcagtctttgggagcctcattttccttattggtgaaagggtcaaagtggtggtactcctagattactaaggattaagtccagccaattaacatttgtcaattgtaaagaacgtgctaagtgtagaagggtttataaattgtagccatcaccattagaagattcatagtgggacagggggagaccttgtcttgttttcaagcatttctgatggttaattctataaagatggcattcacagctgttttaatacacagaaagagtgatgtccactcagggtgaacctgaggctgagcagcgtgtttgtaaatggaataagggaattacagtttataaaacagttgctaaattggatttctagtggacggtttaatttgtaggagaccgctgtctctgaaaggagtatttttactcactgaacagccattgaacacacacagtgatgtgtagggtcagcattagatgctggggatgcagagaggaatgagacgtgggttctgcaagatatctttctatctagtgtctgaggcgccttgctgctgatgagacacacctggctaatggtgtttaaggaagaaaggctgtatctctcaaatctattctctaataatgatactgtgttaacatttttttgtttctcattaaaataggtagttcttgtgttccctaattctgttccccccaggaagattaaatgttgctatttgagggaaaagattagtttcaaaaatgttctaattgaataatgtacttgatgttgaactgaatgaagccttaacagtatgcattttctttggctgtgtgttttactgaagggattttaaatgctgtcccagagtagagcatgtgaaatgatttgaatgttcttcactagatgtcatcaatttctgaaatatgcttcttcactctttcagagttgctggagaatgtaaccctaatccataaaccagtgtcgttgcaaccccgtgggctgatcaataaagggaactggtgctacattaatgctgtatccttcctggacgccgtccgcaaggccagcttgttgcagctgtccctcctttgggtgcatgtgacttagctcagcttccgtgggccatctagctctccatttgaatccctaagtctggtttattacttggtctgcctaccttgcttataaacaggattattcctgaccccagtccatctccctctaaaagagaggatatgttggcacgtgaatgagggctgcagacaagctggctctcattagaatagtcacaaataatagggcagagcaaccacttacaactggaaatttggttttaactgattgaactgtcttggttaggtcaagttcttgaatacaaacgactgactgcttcgtagatccttatatggacatcacaggacacttaccctagtaactatttggtttattccttttcgtggtgacatatctaagtagttcaacgtccttagcttccttgtgtttttataaacattcttgtgcttcatgtgccttcaggaaatgtggtgtgtctgttcatttcctttacgcttccttactgccactacatagacactgcaggcattggttgcttgcccgccgatgtaccacctgatgaagttcattcctctgtattccaaagtgcaaaggccttgtacgtcaacacccatgatagacagcttgtaagtaaggtggtgaaagatgtgttaagtggtggggtttttcccgtctgataattagaattgaaatagtttagtaaagctcttgatttcctgcaaatgagtcctataattctgtctttttttaaaaatagactgttggcgattttatatggaagttaaccagaaatggaattggagcattgatgatctgtgttctttagattcagtagaaaatattttagcgtttaccagcatatatcacttgaaatagaccaaaaatgcatatagaagagacttgagttcactagctgttacagcattggttacctaaaatctactatactcgtatagctgatattctacttagccatcaaagctctttagtaaaagtatatattgtttaaaactgcactatttaacattttttccccatgtttagtgttcggctaatgaatgagttcactaatatgccagtacctccaaaaccccgacaaggttagtaaaaatgagttttgttgatgctattacatattgggagttatggagacagatgacttaaatttggtaaattcagtcttgttgggaagatagtgtctttacacctatgccattctcaacattcagccaggtgggaggtgggggagttttgatgatgttgcttttttcatcatttatgagttcattgtagttaggaaaacctgtgtcctctttccattgcagctcttggagataaaatcgtgagggatattcgccctggagctgcctttgagcccacatatatttacagactcctgacagttaacaagtcaagcctgtctgaaaaggtttgagacttctctgttgtcactagtatcaagtgttgccttttgttccagtgtttgtgtggtaactgttgcttattgatatttgccctctgtctccagcgctataagtagatgtaggtttataagagtccattgcttggatgatatggtgcaccaagcactgctctcagtactttacatatattaacttagttgactctgaataaagtatgattatggtctccttgttacggttaagagaagtgaagccactgtctgaggtcaggtagctaatgtacatggcagaacccagctttcaagtcagttctcttaaccactgcactatatgccactggggtagaatggagtgcactgggcctggaatgatggcagtattcagaagagcttatgtcttcatcatacttacaggctttagtagctatttgatgtacttgattcctttacctaatttttttttaatcacatactttgttactaaaggcatgagaccaaggggccagggagcccttataaaaggccctggggctgttgagagtgacttgggccgcccttagcaccgttaactggagcatttctttcctcccagattgagtttgtgatgaatcagtacaagcagttgaaatgatgcttagggaaatgtattcagagagaaaaatagttgagaaaatgccatttaagtcaagtttacttgaagcttcattgctttgaagaagagtgaatgtcgagggcatcgttgcaggataccaccaggggtagcatagggtcttaagctttttaaatgcttataatgcagcttttggtattggcttggaatttgcacttcccaagtaatgggaacatggtgttagggatgcagaaatggaatgaagtgcgccctctgccctcagtgagggaatgagttaatgaatagtcaacaagagaagcacaaagatacagagatgccttagaacccagaggggcccacctagcacaggtggaggcaaaataaagtgggtgctcaggaacccctcttggatcgtgcacagagataatgctatgaacaaaagcatcttctaaaggttacattaataggggatgtgttgggctccccaagaccaccctgaggttgggtgattcactggaagaactcagaaaatgcagaagctggtatacccgtggctatggttgctgacagcaaaagcatgcggagcagagtcaggaagggaaaggacaggtgaggcagggcctaaaggaaacttccagactcctctcccagtggggccacaaggctacgcgtaactactccagcaccagactgtgaccacacgtgaaatgctgccaaccagggaaggtcattacagactccgtgtccagagtttttactgagggctggtcccataggtaccatctgcctggcttgaaccaaaagtccaaactcccaaaacaaaagcaaagtgttcagcagaaagcacattgcttgcgcaaacggtttaggcagaatcccgtatcagttattggaccgatgggaacctttctgaaatccaaattcccagacaccagccaaggggcaaccttgcaagcaggcctttccaaggagagccacccaggcctgctatgaaaagtcttcagcacactttggctgtgccagtttttgcccttttctgcacacgtgcagagcatgcactcacgtgaacagctgctgtccacgtctactatctggagagggcaagtaaactttgcagtttacctagatgcttcaaacagaacaatttgcagggccttggaataggcagttgtgctgtgaagaatgaaatatgaactgatgataagtaacagaatcaaacactcgtgatgtgggattattaaactcttgggtgactcgtctgtgaatgattttgctgatgtatgtgtaacacagctaacgctctaaatcagtggagtttttccacatgtagtttgagttctttcccatgtagttgtccatcatcaaagacagacagaagcagacatagggctgcttagctcattgctcgagtggtgacccttgcagttgaacagtgaactggccctagacatctagttcttcgtcttctattttgtttacccaagacagaaacttttttttaaataacttttttgtgataaaggtaatgtggccaggtgtggtggctcatgcctgtaatcccagcactttgggaagccaaggcaggcaggtcacctgaggtcaggagtttgagaccagcctggccgacatggtgaaaccccgtctctactaaaaatacaaagattagccaggcatggtggcacacacctggagtcccagctactcgggaggctgaggcaggagaatcgcttgaacccgggagctggaggttgcactgagctgagattgcaccactgcactccagcctgggtgacggaatgagactttgtctcaaaaaaaaaaaaaagtatatttattgaagaaaatttcaaaaatacagaaagtataaataataaaaatccccattagtccacccatttagagatatgtgtttagtcagtttctccttttcctcctactcttgggatttcagctatgcaagggaaacccatgtcatcatgtcattgtttggaaatactttacatcttccatttcagaggaggcatggttggactttgcaagtactgcatgtcctgcaggcctttgacagtgatcagttcacagtaacgtgattatatttgaccttttcagggtcgacaagaagatgctgaggaatacttaggcttcattctaaatggacttcatgaggaaatgttgaacctaaagaagcttctctcaccaagtaatgaaagtaggttatggtccacttgccgcagagttgtgcaagagttcgctgtaaacaggtgttgcatactcatatgttatgttgcttccctgcccctcagtcgttttcctttcaaatagcatttattccctacgataacttacaccatcgagaaggttatatttaggtaaattacagtttatcccgaacctctgccattttcctttaacttttaattaggaaaatgatcaagcctataaaaaagctgaaagaatcgtttgatgaatacctttataattgccgagtgtacagttttaaacatattttctgatgctatacacacactgtgtatatatatatatgtcttatctgtccatccatatatacatacatacgcatacattttccctgaatgattcaaagttaagttgcagctaacagtttagttcatctcaggtgctaaagcatctcctgcgtaaccacagtcccttatctaactgagaaaaacaactgtaatgacacggtaataccgactttgcagagcatcttcaaatttcgccagttgtcccagggatgtcatttctaggagtttatgtaaacaaggatccagtggtggtgcacctgttgcgattggttgccgtggatcaagtggcattgcaatgggttgcagtggatccagtggcattgcgcctgttgtgattggttgccgtggatccagtgacgttgcacctgttgcgattggttgccgtggatccagtgacgttgtgcctgttgggattggttgccatggatccagtgacgttgcacctgttgcgattggttgccgtggatccagtgacattgtgcctgttgcgattggccgtggatccagtgacgttgctcctgttgcgattggttgccgtggctcctaatgtagaccacaccctgatttcatttttaaaactgcaatcgacagatctgtgccttttttttttttgctgttcttgtcgtaaatagtagtgtaagcagatgctctccttttcagaacttacgatttccaacggccccaaaaaccactcggtcaatgaagaagagcaggaagaacaaggtgaaggaagcgaggatgaatgggaacaagtgggcccccggaacaagacttccgtcacccgccaggcggattttgttcagactccaatcaccggcatttttggtggacacatcaggtttgtgcttttctggaataacttaatatttgccttttctagggttttgccatgttggtgaagggggaaggtgtgaggcttgttttgagacttcttggacgtaatggtttgcatcttgctcccctgcctgctcttctcttgcacttcctgatgcttcccttgtcagcccccgtggcttattctctccctgctggcgcatgtctgcaggggacagggagctcctcccttctactctgtcaagttcagctgctcactgctagggagtaagagaaaagccagctaattggccatacgcggtggttcatgcctgtaatcccaggactttgggaggccaaggcgggtggatcacctgaggttagaagttcgagatcaacctgatcaacatggtgaaaccccgtctctactaaaaatacaaaaatcaaccaggtgtggtgacaggcacctgtaatcccagctattagggaggctgaggcaggagaatcgcttgaacccaggaggcagaggttgcagtggcccagatagcgccattgcactccagcatgggtgacagagtgagactctgtctcaagaaaaaaaaaagaaaaagatacaggagaatgtcatcatgacttaggggtaggcaaaggtttcataagataggtcataaacaataaccacgagagagagagaaaaaaaaatatatatatatatattagacttcatctgcatttaaaacttgcaacataaaaccacctccgggaggcagaggttgcagtgagccaagattacaccactgcactccagcctgggtgacagagcaagactgtcttcaaaaaaaaaaaccagctaaccaaaccatgtgttttggtaagagaagacagtgtatctggaggaattttatttatgttaataaattgtgtatatttaaagtatacacagatgttatgaaatagagatagtaaaatagttgctacagtgaagcagataaacatattccccatcacagttacccttgtgtgtgtgtgtgtgcacatggcaagagcagctgcagttttactcatttcacaaaagtcccaaatacagtgcactatgagtagctcttgtccgatgttccacatcagatctctagacctgttcgcctgtgtggctgcccttggtgtccttcgaccgacatcttccattcccactcgccacccctaggaaccactcttttccctatctctgtagtttcgtcttttttttttttttaataaagattccatgtataagtgagaccatgcaatatttttctttctgtgtctgacttctttaacttagtataatgttccccaggttcattcctgttgtggcaaatggcagggtctttattacagctgaatagtgttcccttgtctatatatacacaccacagtttctttatccattggcccatccacagacagttgtttccctgtcttggctgttgtgaactgattggaagcaggtgaggtagaaagtgaagagagtgtgaagggaggtcttttttacacagacagacccgtgactgggctggagtccctgggcacctggctgtgtgccagttcccttaagcagctttttgctcattcacaaagtccttcggaaaggtttttctttatttacctgagagcttttcagtaccactgtgatgtggaattcagcaaaacttgtaccatctccaagaaggtttacccatcgaaagtactgaagaggcctcattggagcctaatttcctttctgaggccttgcggcataacccccaggctggtatttcagtgacactcttagtctgttgttgtcccaaatgctgcgtacctgaaagaaagagcaccccttttgaggcatcaagacttgattcagtctcagttctgagactgaatcaacaactttcaacaggtgaataataagaacctcagaaacctgcgctgacgccctcagaagctggtttcccgtcctctgtggaagtggatttagaagccagttgagcagccatgtgaccttgaacaagtcacttctgtgttctgcactgtgagctctattccactggcccctttctattctggtgctctgtggagtgtccacggcagctgggtggtcagttgtcacctgggaaacacccagccctgaccactgtctgtggttccttgggacacgtcgtgttgggagggagacgctgaggtccaggttggcgcgcagcagcgagggaaggctgtgccctttgctccttcagcccagcagcctggtttaggattgtgaggacaccccctcgggatgggagagaaagatgaatggacagctcaaatggaggcatcgggaacatggtttttgtgcagaggccgggtatcagaatttcaaggccacagagggtcagcatactcaaagatcccaaatttgtctaagagtaaccagtggaaaataccagcgtccatttggaggacttgctggctcagattgaacagctctgtcacagctgctagccacatcctctgaggggtctctgtgttgaaattggttgttgatgtttctttttgaaaaacggtaaagcaaagatagggaattcttacaacgtaggaacttcttttcagccattgttaagcatgattctttattcacaccaattgaaagatttacttctaaaactcagcctcttcagatgtttttcagtttccccaggaagacttccccgcctttcttccccggtgccacctttgctaaaacacaggaccactgaatcaagagggcttcttgattctccaccagctctcatgagcggtttccccactactgtatccctctccagaaccaggggaactgttgtcactgaagtcttcaaactgtaaaggagcatggagatgcgtaattaaaccctggacagaaaagcttttagcgagctcttcaccgcatctgttctggaaagcctgagtacctgtccacacccattttattccgttgagaaactaggtcaccgagactgcagaaatagaagcccttgttgaacccctggaatgtttccttgctgaggctaaatgagagatgggccgaacacacaatttttactcagaaaaacttagaaaaaggaaaaaaaaaatgaaatgaaaaaccagctaagaaaacaaggtcaaattggcgcccttcttggaagggtggcagccttttttcctggaatgttaacttgttttttattctacacaccctactccccttcttctttttgtaagacatctttataggaggaaaatgccattaaaaatcctctatttaccttgggatttcctctattttattagaacaggctatgatacttggagaaaatggaaagcagcagcgttttgaggccatggcagggtggctgcctttatgaaccggtgcagtaaataacagtgtggagaggaagtgaaagaatttggaaaatgaaatatgttttcttccagagcactggcgttgggaacatttatcaactggtagatttagttgttagaaatactaaggaggtgctattcagcagaattattattattttttttaatttatttttttattgataattcttgggtgtttctcacagagggggatttggcagggtcatgggacaatagtggagggaaggtcagcagacaaacaagtgaacaaaggtctctggttttcctaggcagaggaccctgcggccttccgcagtgtttgtgtccctgattacttgagatcagggattggtgatgactcttaacgagcatgctgccttcaagcatctgtttaacaaagcacatcttcagcagaattatttttaaattcagtatatttttggcttttctctgtggtcttttgaaagtgatattgaataatcttattttcagtgtttattcccttggttaatcttaagggaaagtggcaaggagtggtctcttaatttttttgtttttgctttcaattcttaggtctgtggtttaccagcagagttcaaaagaatctgccactttgcagccatttttcacgttgcagttggatatccagtcagacaagatacgcacagtccaggatgcactggagagcttggtggcaagagaatctgtccaaggttataccacaaaaaccaaacaagaggtatgttcacacttgattttgaacctttctactaaggtgctctggtttggtggaaagaacacaaaattaggaatgaggggaaatgggtttgagttatgcctcttaaatcagttgcttaaccattttgtactgaaagtttttatggttttacaatgaaatggttgaaacgtgatcccaagggcctcttttagctctaaatcatattacacaaggtaatgatctccttttggattgtttatcttgagctacatttaattttctggcaatctaatgatgatatcacaacatcaatactacctctgacagaggccaaatagcttatttatgttcatgataccgtagggtacaactgtcattagattagttaggatgtcagagagattccagacacatctgttttgcatttgattgtagatcttccaggtcattgtaaatataatatagtcattgtaaatataatatagtcattgttctgatgcttgttactctttgatttgatctggaaaaggtaagattcttgagtctttcagtcttcatgaatttaagagtatcacattatagcttggtggagtccttgtcaactcagttgggcgagacggatagcattctgccctgtgagagcttattagttcctggctgtccagatgtgccagcttatagctattttgtactctgcagcagagagtgtcttctctgttatatatcttaggttgtggcagtgaattcataaaaatgcactggggagatgaatgcaggctgataattatggacggtccatagcattcctgcaaagcgatatttgaataatgggcagtggatggcagctacaaggtaaaataaggtgccccaacgtagaagacctgtcatcacattgcatgactgggatggatctatccttggcttatcttgtgtgctctgagtcagaaagagcaaagtaggacatagggacccttagcaccttcggggtgtcctgctgtggactggttcacccaggctctggggggatcagtagaagttatgcctaatcttctaccgtatttgcagacttgcatctcatgggtgattttgtttaaaaaatagaagcagtaggagccagaggcagaaacttggtagttgacttcagtgaatgagctaagaagagtctggcggtggacctcgtggaagagagagagggaaaaagtggtatttgtgttggggaggttggttgggtggttcagttgtgcattgtgggtgactgtcggcttggctcacttctgtggcagctgcaactccagagatagctccctggccctggctgctggtgcactctgcttatgctgtttcttgagccagctatgggagtctttggccacccatgctgttggggaggtggtcagcctttccatgggctgcctagggaagacccttttgtgatgtgtctgtttttctcttttgcttctgctgcaattacagtttgactttgctggggtgggctggtaggggtggcggtgtgggggcaggggttgaggcgcaggtagttgttagcctgttgttagacggtagtgaagaaagaatggtttatcctaaatagcaggtttggatgaaggcttccagaaagaaggcgggccaggtgtggtggctcacgcccttagtcccagcactttgggaggctgaggcaggaggattgcctgagcccaacagttggaggctgcagtgagctatgatcacgccactgcactccagcctgtgcgatagtgaaaccgtgtctctaaaacataagaagaaataaaaataaaggaaagctggcattttggtggactccggaagataaaaaggatgctgccagccgttctgggtgcgtggttgtggtggtgtgttaccagatgaggccaggaccactttcaacagcagatgtttcaggaagatttgggacagcttgtatggaagtatctataaggagcaaattacatattttcttgaatgtgtttttttttaagtttttaaaatgccacctttaactttattatgttttagatcagaagtatttttctgtgggaacatgtgaaggttttggggaaaataggattatatgaaatatttgctatatagaaaatgtctgcctttgttgagtgattagaaattaagcctcagttggctgggcgaggtggctcacacctgtaatcccagcactttgggaggccaaggcgggtggatcacgaggtcaggagatcgagaccatcctggctaacacggtgaaaccccgtctctactaaaaatacaaaaagttagccgggcatggtggcaggcgcctgtaatcccagctactcaggaggctgaggcaggagaatggcgtgaacctgggaggcggagcttgcagtgagccgagatagcgccactgcagtccggcctgggcgacagagcgagactccgtccccaaaaaaaaaaaaaaaaaatctccagtggctgatgcctgtaatcccagcattttcggaggctgaggcaggcggatcacaaagtcaagagatcgagaccatcctggccaacatgttgaaaccccatctctactaaaaatacaaaaattaactgggcatggtggtgtgcacatgtagtcccagcctctcaggaggctgaatcacttgaaccctggaggtggaggttgcagtgagctgagatcgcaccactgcactccagcctcgatgacagagcgagactgtctcaaaaaaaaaaaaaaaagtgttatccaaatgaatatgggaagcatcaaagactttgtaagtacagagaatgataaagggattgttatttgtaaagatgcatcttagtgacaaaaaacctggctttatttaaaagcagcattcatcagacctgtgaaagtacttcaggaacagattacattgataaaactcatgattagaataaatagctttaaaggttatttaaaacatctaattggcctggaatcccagcacggtgggagactgaggcgagcaggttgcttaagtctaggagttcaagaccagctgggctcatggctgtagtcccagctacttgggaggctgaggtgggagaatcacctgagcccaggaagtcaaggctgcagtgagtcctcatcatgccactgcactccagcatgggcaaccagagtgagatcctgtcttaaaaaaacaaacaaacaaaaaaacccacctaatcctactggtatcagttttatcaatactatcagagttattttaaaatgggtcaatactaggcctagcgtggtggctcacgcctgtaatctcagcactttgggaggctgaggcaggtggatcacctgaggtcaggagttcaagaccagcctggccaacatggtgaaaccccttctttactaaaaatacaaaattagccagatgtggtggtgggagcctgtaatcccagctactcaggaggctgaggcaggagaatcgtttgaacccgggagacggatgttgcagtgagcgcagatcgtaccactgtactccagcctgggcgacagagtgagaactccctccccccaaaaaaggcgggggagtcagtacataaataaggtggtactaagttagctttttaatttttatgctaatttgtcagtaatgccacagagtaaagttcttaactttgagtttacgactggacttcagggacccaagaggctctctgcagttgtgcttatgggaacgtatgcatttttcttcttcttttttctttttttctgagacaagatctcgctgtgttgcccaggctggggtacagtggcgcgaacttagctcactgcaacgtctacctcctgggttcaagggattctcttgcctctgccacccaggtagctggggttacaggcgcccaccaccacgcctggctaattttgtatttttagtagagacgggatttcaccatgttggccaggctggtctcaaactcttgacctcaggtgatccgcctgtctcagcctcccaaagtgctgggattaatgggcatgagccactgcatctgggtatgtgcattttcttaagaggagcattggtagatctcagagcttctgtggggcaggaaaagccatgaagtcctgccacaggactcttgggcctcacctctcagaggacgtctttgagcggaaggtggatgtggtgttagctgttgcaagtaagacagggacggtgtgtcctggtgtgctttgtgtcttaggttgagataagtcgaagagtgactctggaaaaactccctcctgtcctcgtgctgcacctgaaacgattcgtttatgagaagactggtgggtgccagaagcttatcaaaaatattgaatatcctgtggacttggaaattagtaaaggtaatgcatacataaggtcgggagtgttcgtggtgacacactcctgcacatcagaagctcaaccctgtagcatttctttatgatgtcaagagtgaggacattctcttgctggacgtggacttgttttaagtttcttgacttgtaatagaccttaatactaaaattctcatgaaaatggcctgttgaaaatagaggcaaaaataactaaactctataatcttactagattagaaaaatagcagcttttgtctatcaaaaagaacatcacttttctgtgaatatttcagggatgaatggtgcagtttgccttccaccgagtattaacagctgtgttgactagcccagttaagtggtttttagtgaagtaagaatgatttctcataggcagtgagagtcccttctaacctctagttgtggtggcgcacaaataagacgtggcacttaccagcctcaagtctctgtcaggtcacgggctcggcactttttgaaagcaattttaaagagccccaggttaaaggcatcttgctaaaagcacagcttcaagaagacttttcttgaaagctttagaatttgtgaaaacgtatagtacaacactgaggcttgattgggactgtgattagctagagaggattctcagaatatcgaggtgtttgggaagcagaaaagaggacactgggcctcactcctgggtcctgcagaggaacaaacctgaaccgagagtcctcttctctccgtcccctggcacagcaaccccacctcatacctccttccatatagatgacccaggaactgtgggcatggctggcttctagccggctccctgtctaccctaggggcgccctataccttcccgtgaagactcagacactgtctctcccaggcctgcacacaagagctgtgctttctgctgacgggcttggctgctgtgccgggtttagtgtccgttgctcctctcacacttctagctgccttatcactcatcagccgattgctttttaatcccatttgaggaccagcaagaggaagaaagatgccagtgagaatcatgtaacagatcctcctccccattttattctatccatcgggaaacctggaatgccggctaagtcaaagaaggcatcctcggcctctgctcctgcatcttcactcgcctccagatcagctgtctgagctgacttggatgttttgctacagtgattttatttttatatcttttcttgcttgctgtatttttatatccgctgccacctccaatacattatcaaaatatgacataaatgggggctgggcgcagtggctcacacctgtaatcccagcactttgggaggccgaggcaggcagatcacctgaggtcaggagttcgagaccagcctgaccaacgtggtgaaaccccaactcttctaaaaacacaaaaattagcctagcatggtggtgggtgcctgtaatcctagctacttgggaggctgaggcaggagaatcgcttgaacctgggaagcagaggttgctgagatcatgccactgcactccagcctgggcaacagagcaagactccatctcaaaaaaataaataaataacataaatgggggacaagaggacctcacttgggtcatgggtcagaagtacagatggctgcctcgaacagcatgcctccgacggactcttgtgtcggtgtaagtggtacttctgcgcacagtaagagcagggagttcccgcctcgtagcagctggtagactggttcctatttggagaaatcatgttactgttctgtaactgaagttttgttttgttttttttttgtttgtttgtttttttcttgctctgtcacccaggctggagtgcagtggcgcgatctcggctcgctgcaacctctgcctcccgggttcaagtgattctcctgcctcagcctcccgagtagctgagactacagccgcgtgccaccacgcccgggtaattttttgtatttttaatagagacgtggtttcactgtattagccaggatggtctcgatctcctgacctcgtgatcgcccgtctcagcctcccaaagtgctgggattacaggcgtgagccaccgtgcctggcctgtaattgaagttttatgatctgacgcatatgtaaaattttaattcttgccttggatttttcacaactgtttttgtttttaagtcagcagcttttttcttttccattttgtagagcacctgtttttaaggggcctcccacaggagcatcacagcctcggccgttgctcctgtttctttagtgagctggctgcacattttgtgtcctattacgtcacatggctcatttccttcatgagtcaatttttgtgcaactgaagggatagagtgttgttttgttcctggtctgacaggcagtttacttgctggggagaatgttgttagccattttctgctgctgttaccctgaacctttctaaaagtgcttcaagccattgatattttgttttccagaactgctttctccaggggttaaaaataagaattttaaatgccaccgaacctatcggctctttgcaggtgagtaaatttgtacgacattacttcttcattaaaacactgatgaaggggtttacagctgggcacaggtttgctgcaacttagcatagcgaccagatgctgtactcaggtatccctgtggccttgtgagtcggggagtcacgtgagagttttacctgaaactctgcgtagatgacggattatcatcttggccctgaggacagataacagaagaccttgctcaaagcgaacatttctgtctttgagtcagaggagggagtttcaggctcccaggctggctgtttgagaatgtgacctctcccggctgtgcttgtggcacctgtgggtgacagtgctgtggagtttccacgacacctggtcacccagccaggttgggtgagcgcgcccccagccggtgatccctgcgtcctcccccacaggtattgttagggctgcttgagagggtgggcccgattacacaagctcctcggctgccaggccctcagtcagtcatgagaaatctcccaacagggtgaatggcaccccctgttccctcatgggtggaccttgagacctcttctgtctcctggcttaggctccctgcagtatcattttttctgccacatcatcttccctttcctttctgccttcccttttatccttctttctcttttatagcgtcatcttttatgcctctgagtctttacctctttggattgttgctgtttgccgcacttttgtttgcttcccaggctgtttttactacatgtttctagcttctgtgtcttccctcctctggtgtggcctttggtgaacctgtttgtatcgtaacataacactgccatttattgaccttcacacatgtattgaacctcttcccaagatattctttcatttccttacatgtgtcctaggagatgggaggtgggatccctgttttataaaagaataaaccagaactcaaggaagaaaactcaccactctggcctgcagtggcagagcagggcttcaagctcctgtccacctcagctcacgcccgatgttttaggaagtttggcgagtgggtgagggcccagggatgggggcccaggggtgagggcctagcggtgggggcccaggggtgagggcccagtgggtgaggcccagagccacactgcaaggtgccaggcttccctctcttcctctcactattcattgttccttttgactctcttcttttctccccccgatcacaattcctcctcaacttgctgggcctcagatgggacggccatgggcaccacgcgcttgtgggtgtctccagccctgtctggaatggaaggtctgagtcctcagactctgcagccagccattatcctgcctggctccttggagtgtggcacccaggtcccagtgggtggccagcagtttctccgccttctccctgcacctcttcccctggaggctcttgcgggggacatcactgggcaggggcaggggctagggattgctcctctcctggtcagggccccagtgtgagcacacacacccctccccgactctgcaacctgcctcgccccgggacctgggcctgggttgctctcccctgccctcctgaatcctcatcccctaacccattatttttttgagatagagttttgctctgtcgcccaggctggagtgcagtggcacagtctccattcactgcaacctctgcctcccaggttcaagtgattcttgtgcctcagccccccgagtagctgggattacagctgtgcaccaccacatccagctaatttttgtattttgaatagagacgaggtttcgcccttttggccaggctggaagcctattctgatcttggaaatgaggtcaccggactggttagaattacctgtagagtgagcaaaggaacactttttaagaactgctgtgattgtggggcctgggagaagcaatctcgcgcacaagcttttcaggcggttctcagcgctcctgtcaggggggcttgcaggtgtgagtgacacacggctcagcccagggtagttaactgggctgctgcttatgaaactagaatggtgacatgcagtcccccttgacattttagaatggagatgtcttgtgggaaagacaagttagtaaaacccccaggccctgcagattctactgatggtcgctttgaagcaaaactcttagcccagtcagttaggtctgtgaggtgaagatctaggacagaagtctcaaagtgaacttgggatccaggggacatgctgctgtcatgggtgcttcctgccctttcacaagatggctgtgacttgtgcagcacaggatgaagctatgcccttggattggctgtgtccctggctctccgaagtacgggccccacagtcttgctgtccctatgctgttcagtctcctccggggtccctgcacagaggatttctttgtgcagagcccaggagtctgactggtggcctcagtcataagcactgtcctctagccagccaaggtccctggcccagagaggactgaggcctcctgctgtcatttagcccctccacgtgacaactgcgactagaacctggtgatgtttggtcttgttttagtgctgaaattccctaccagccaagtcttgcatctctcctggttccttttcttttgtgccactgatggtgggcgcagcttagcaggctgccctgtcattccccgcggaatgctgccggacagccgccttcccgaggctggtgtctgctgctggccaggcagacctgtgcccctctgctccatagaagtggaggatgtgttctgtggctgtcttaatgttttcatgacatcttctacagattttttgttttaggcctttgactaaggcttcttggttataggattttttttttaagtaaataactgtgtgtgtgtgtgtgtgtgtgtgtgttttgttctgttaaaacatagaaaaatgggtaattttttttaaaggcaaatgcgtaactaccagcaccatctccgcagtgccccaccacagctccacgctcaagcaaccgtggttagcagtcccagggtccctcctgccatgtgggccggcaccgggagattgtgtcccgtgtctttaggatagatgggccacagaaggcctaaggaccttgttttctcatttaatataccataagcgtattcccgcatcaccattcttaatctattccacgaaaaaataaattgtgttattttaatataatttactcatcagtcatttcttctagtggctattgaggttttccgttttttcactgttataaatgacatcataatctctgtccaagattcagataatctcttcaggacagtctagaagtagagtcagccacatccaagggcatgagccaggtctgtaggcctgtacagctgatggctgtgtaggagtgtctgtgtgaggcgtgggacattttaaatatgtggttaatatgcgtacatgcacacatgtacctatctgacttacccttaccttgcagttatagaaaagtttttattatggattgcttgcgtgtttgagttgaaatagcattggtttgtgtgatgacatctctctgtcccacctgctttggagaggggttttacacataggatgcatccctggagggaagtcggcggagacctgtaatgattcgtgtgcagtgctgttctcactctgctgcctgctgggctctcttccagtggtctaccatcacggcaacagtgcgacgggcggccattacactacagacgtcttccagatcggtctgaatggctggctgcgcatcgatgaccagacagtcaaggtgatcaaccagtaccaggtggtgaaaccaactgctgaacgcacagcctacctcctgtattaccgccgagtggacctgctgtaaaccctgtgtgcgctgtgtgtgcgcccagtgcccgcttcgtaggacaccacctcacactcacttcccgcctctctttagtggctctttagagagaaactctttctccctttgcaaaaatgggctagaatgaaaaggagatgccttggggttcgtgcacaacacagcttctgttgactctaacttccaaatcaaaatcatttggttgaaacagactgttgcttgattttagaaaatacacaaaaacccatatttctgaaataatgctgattcctgagataagaaagtggatttgatccccagtctcattgcttagtagaataaatcctgcaccagcaacaacacttgtaaatttgtgaaaatgaattttatctttccttaaaaaagaaattttttaatccatcacacttttcttccctaccctttagtttttgataaatgataaaaatgagccagttatcaaagaagaactagttcttacttcaaaagaaaaataaacataaaaaataagttgctggttcctaacaggaaaaattttaataattgtactgagagaaactgcttacgtacacattgcagatcaaatatttggagttaaaatgttagtctacatagatgggtgattgtaactttattgccattaaaagatttcaaattgcattcatgcttctgtgtacacataatgaaaaatgggcaaataatgaagatctctccttcagtctgctctgtttaattctgctgtctgctcttctctaatgctgcgtccctaattgtacacagtttagtgatatctaggagtataaagttgtcgcccatcaataaaaatcacaaagttggtttaaaggtgtgtgcgtgtttctttgaatgcgaatgccttttcgggtaactgaaattcatgggggcatgagtttgcctgcagaattaaaatctgcccttcgatcagctcgacgtgtttgtggaagctgaaccaccactcaggttatgcttgtttagtattttcaaatggattagtgatttgggtacacgaagtttttgactcttcgattggcagaaaggaggaggttttctccccttcccctcctcatcccttgtttctatagcccaccgttttcagtatcaccaaaatagttgctgtaggtcaaggctaaatgctcttcagttgagtgccactggggcggctgagcggtgcctccagacgccaccctcagtagtgggaaggaagccttctgagacggaagacatggagagagggatgtcacgtgcaagggtgcccgtgccccggcttctggccctgtgtggatgattgtggtgtcctgagatctacagagaaggggttttaacgtggtctgagcctttctctcaagttcttgctcttaccatctggtatttctgattgtagcctggtgccatctggggttcagagcttcctaaactttctgtacaagtgttgtccgtctaacctacttaccctttgtaattctattgtgatttgcttggctgaattataactcatattgagaggtgaagccagctggacttcctgggtcaagtggggacttggagaacttttctgtcctctaagaggatggtaaaatgcaccaatcagcactttgtagctaggattgtaaaacgcaccaaccagcactctgtagctagcaagaggtttgtaaaatgcaccaatcggttcttaaaacgcaccaatcagcaggagtctaaaagcagccaatcacagggaggactgaaaaaagagcactctgataggacaaaaacagaacatgggaggggacaaataagggaataaaagctggccgccccagccagcagtggcaacccgtttgggtccccttccacactggaagctttgttcttttgctcttcacaataaatcttgctgctgctcatagaaagatgcaagctagtgctagcgagacagcctgcaaaacccctgtgttgttttgggctgttaaccatagtctgagtggcttagacaacaaacatttatttctcacagttctagaggctagaagtccaagagcagatgccagcagacctgtctggggaaggcctgcttcttggcctggagacagccgcttgctcactatgtcttcacagggcagagtgaaccctggtctgtttctcttacaaggacactcatcccactgtgggcctccacctttgtgatttcatctatacctaaaaggccccacttcctagtattccgccgggggttcaggcttcaaagatgaatactgggggcgacacaaacggagcccataacctcatgccgcctgactcctgaggctgtattcgtgatgaacgtgtggctgcccaagttttgttttgctcaggcaggatcagcacacacccagccacagacagggaagcccagagcagggcagaatatggtccctcaagtgaataattggcccagggatacagaattaggtgattctagcaaatccagacattttctagggtgccagtgaattttgggtctgtccctgttagctgttcttgagattttgcactcaacttgcgatggttaatacggagtgtcaacttgattggattgaaggatgcaaagtattgtttctgggtgtgtctgtgagggtgttgccaaaggagattaacatttgtgtcagtgggctgggaaaggcagacccaccctcaatctgggtgggcaccatctaatcagctgccagcgtggccggaataaaagcaggcaggagaatgtggaaagactagactagtcttgtggcctccatctttctcctgtgctggatgcttcctgcccttgaacatcggactccaagttcttccgttttgggacttggattagcttccttgctcctcagcctgcagacggcctactgtgggaccccttcttgtaagtcaatactccttaataaactcccctttatatatacatctacctataggttctgtccctctagagaaccctaacgcacaacgtttccattttatgttgcaacgtttaatgtttttgtaagtttcatagtacggtctcctaactttaggttatttacttcgggaactttgctcattaaccttggtgctgaggctacagacttagtgattttccttcattatcatttaacatgcctttgtaggtggcatttaaagcagtgaatggttacatttttagtatgttatagggagattttcctcgcatttgtcagttgttgacaacaagacttggaagttctcttacagggaagatgtcatgaagtttacctggttggtatgttatttgtccactagccaaggaagcgcaagccactgtgtgtttgaggcaggatggagaatggaggtcattctggcctccactggtgtaactatggttcagccacccaagtggctcacagtggcattctgctttcatttctctctctctctcttttttttttttttttttttgagatggagttttgccctcgttgcccaggctggagtgcagcggtgcgatctcaggtcaccgcaacctccaccacccaggttcaagcgattgttctgcatgtgccaccacacccggctaattttgtatttttagtagagacgaggtttcaccatgttggtcaagcttgtctcgaactcctgacctcaggtgatccagctgcctcggcctcccaacatgctgggattacaggcgtgaggcaccgtgcccagcccctgctttcattgcttgatgtcattggtcataccatcctagtctaatgtgtgggcaacgtgagcaggaactttgcagtcagcaaaggcatcatcttagaatgtcttttatttggtgacgtttctgattattgctgtcatagactgcttatacttgaccaggccaactggttacaaagtgacaagcatagtccaagtcagtggcttttgaactatgggaaataacccaataaaccagtgagctagtattgtacagccaactcacgttcatgagtcaatgagaatgagcaagttgtagcagtgtggacacagcagtctcttggcttcatttctcttgggaagtgctgagtgcatcaaaagaactaaaaacagcaagagacagaagactcacagtttttctggtacttctctggctcaagaaggaaaaatatcttgactgagcctagtgaagacagtatctctataccaatttcctgagggtcagtggacttaaaagagattagaccaaaatgttagtgtttttaaaatccgtgtctagcaaggccaagtggtaatagccaactctacacgaagtgttttgtgtttcctttattgttttttgtttgttcgtttgtttgtttgttttctgagacagtcttgctcttgttgtccaggctggaatgcaatggcataatctcaactcattgcaaccttcacctcctgggttcaagtgactctcctacctcagcctctcgagtagctgggattataggcacctgccaccacaccagataatttttgtatttttggtagagacggggtttcgccatgttggccagactggtcttgaactcctgacctcgtgatccatacacctcggcctcccaaagtgctgggattacaggcatgagccaacacgcccggcatgtttttcctttaaaatcagtcacagcaaaagtcaccgagcagacactgttctgccttcttcagacattttctctggcttcctaggaattggggttttttttgttgtttttgtttgtttgtttgtttgtttgttttagtgttattcatcttttagactggccgttcccatcttatttgcaccttttggggaaaagttaacttgctcgaaaatgaaatgcacccgatggcatctgctggctttacctcatggtgatgttcctttatgaactagtgaccaaatgcttcattctcttttctgattgtttccctccctttgctcatcccccacctcagtaagacatgttacatcattttaatgagcaagtgtacatttttttccagtgggactcaaattgtacgtttgcttcttggtcgtacatgcattttgtttcacggatttagttgtgtctcctgttgttctgtggtcaggatacgggatcatttgctaggcactgatttgctgaacacagtagtatttcgttgagtggcccttccttggaaacaactggcaagtaagcaaacctggaaatcactgttctgtgctgtattttcagtaaagggaatttacacagcgcttgctgctgtgggatttgcaaactattttattttgactctaggatttcacacagtgatatgcttaagatattttttataattttttttttttttttttttttttgacagagtcccactctgtagcccaggctggagtgcggtggtgtggtcttggctcactgcaacctccgcctaccgggttcaagcgattctccctcctcagcctccctagtagccgggattagaggtgcacgccaccacacccagctaatttttgtattgttagtagagatagggtttcaccatgttggccaggatggtcttgaacacctggcctcaagggatccacccacctcgaattcccaaagtgctgggatcacaggtgtgagccaccgcggacgacctataaaaacttttatccctttcattttctcatagactcccgtttaagttcttgctctgttttgggggaaagtgtttattgtttgattttctaataacgaaaacattagagtagcttcatttatgctgcctgtttcaagccaatacactgctcagttgtgtttgtgtatttgaaaagtcccctgataggaactttctgaggggtgcctgtgttgttggcacatttgagaactagacaaaatctaactctgtgtcttttttctttctttttcccctattatttggttttgtttttttaacaacccctctggagtgtgttttggttcatgggatcaggccacgtgccctggttttcgaggtatagccttggctttcttgggtcgggtctaataaccctgaccttggacttcccacgtgtccttcaaagaaagcaattatttttgcctattttctgagtatgatggtattctccatttgatttaacaaaaaaattcttcctctgctttaaaagactgaaagcctccctgtaaggtgctgattgccttccagatctgaggaccccgtctctgcctcattcctcctgtttccatcagaagacacaggtctgggactcagcgcagctgacctgtctgtccctctctgcacaggtaaccacttatttattgctgcttaaagtagagcttctgatacccatggggctggcaagagaccctgacattcttgtcttattttatcacatacagtttactcctgggctctgcagagagaagtcagtgcctcaattttccattgaaatatgcacccttggcatcctggcaggtgagcggcgcccccttagggctaatacagtgacataaaatgtgtcatatttttggctgtgtggtggctcatgcctgtgatccccacactttgggtggctgaggcaggctgactgcctgaactcgggagttggagaccagcctggccaacatggtgaaaccccatctctactaaaaatacaaaaattagccaggcatggtggcatgcacctgtagtcccagctacttgggagactgaggcaggaaaatcccttgaacccgggaggcagaggttgcagtgatctgagattgcgccactgcactccagcctgggcgaccgagtgacacttggtctcaaaaaaaaattaattgtcatatttttgaaaaagtatattagctttgcaatgagtaaagttcactctctaggaagatgtccctgtttcctgtggctacaaatgctccctgccacactgggaggccgcacctcactgcgccggagtgcagtcttcagtggggtcctctgctgtgaccgaaagaagggtgcagccgggcctgcttccaaggctagggtctgagacctggagtgtgtccatggatatcagatgttgagctacaggggaccggcagcccacagcagcaccctcggtggctaccttagggtgttcctgtgggcctccccccaccagcacctccctccagctttcctgcctccatcccccctccaggacacttcctcctctggctaaaggtttggcacctttcatttgagagagattaacagcaaacacacagggctttctgcaggccagggctgctgctgagcttttgccaggcatttggtcctctgccaagcccatgcatagtttctgtctacattgtgcagttggggacttggcacctgcccagcacctatgcttggggcccctcctctgtgctgcaggcgggtgttcacaccctttcatacccgctgtcatctccctgcagcccaccctgcttgacgaggtcatcactggtgcttaggagtaaactggaatggcagacagagcccagtggatattgcagaggaacagaaggaaaaagatgtgcatgacgcctcagtgcttgcagcattaaagcaaaaaaaaaaaaaagagcaaagtagcacagtgattaaatagtcgggtgcctgcattccatcctcacctgctgtgaaccagccacatgaccttggacaggtggcctggtgcctcctctgggtagtggctgggagtggcactgtcacctaggccctgtcacctaggcccaggggcaggagtaagcaaggtagcaggtgtgatccattagcacagctgatgctcagtcacggtggccctggcactcctcagagggcccctgccatgcctgggggaggaggggctgcagtccgtgcccagtgaatgtaccacctgcctgacatcgcagcgtccactctggcagatgcgacaccacgcctagtgaggtctgaacagggaccctcagcagtgcgcccacaggtgcacatgagtgatgaccatagctgcccgctggttgtgccctcctgggcaggaagcacaccagggagccctggcagagcaggcccttagggagcacccaggagggcctggggctggggcctcgattctgggcagccagccttcgggaccttggtcacgcgcctacctggacctctgcccctgcctgccctatccctcattagaatcccagccctcctggctgttctgggtactctgatcaagccagacagtgctagttcagcactgagagagtgtgtcctgtctggtcagggaccaccagggtagacagacattcactcctaagttcccaccgaaaaacagcacgagggtatattgggcaaccaggtgaagactgttccagagccagttatcccagaggagctaggaagcctttccctctgctgtcttccttttactcagacacgtcctccagagctggctgcatgtgcattccctctgctttcctggaagtcccctcctttccatctacaatgggacttttaaaaatactcacagtcactagtgcacaagaagaaccattcaaagccggcatccaacctcagatttgcagcaacctaagatttgtttgcaaaggaatagaacgataaagcttcaacccacccacgtttataactgagaagaaaacacacacttcatttggtaaatacagcaaacaactgaaagtatgctttgactctgtattgaggccagttaggggatggaaagggtgaggctaagcaggtaaaggaaatggaagagaaggtcaggagaaggaaaatgtgagctaggcaggcggctcatgcctgtaatcccaacactctgggagcccaaggcaggaggatcatttgagtccaggagtttgaccccagcctgggtgaaataatgagactttgtctctactaaaaaaaaaaaaaaaaaaaaagttaaaaacagtaataaaaggaaaatgtagaggggagaagcaactgagaagagaggggagagtgagaaggaatgagcagggaggtggagggcgtgggggtggctttgttttggcctcatctttccagggagacagccctgtggcgatggccaggccacgatgctaggctgctcttggtcattaccagcccctgaaatcagcgtcctcaaccctagccctgtcatctctgctgggagtgggtctctatttcttttctgcaatttacatttaaagcagagtttaccctggaattctgaaggtttcggtgttgaggtatggtttgcattttagaaattcattttggaaatgtgaagatgtcttctatgcggcttgaaagcccgtctgacgttcacaagctgtatggctcaggtcttcagtgcctgaaggttatacagcaaacccaccttgactttgacttcggagtcttttcctcctgaagccaaatctgtttcagcattctggtctcgttaattctcatggtgacagtatattaatatgagccaaagagaaaataaaattcactgaaagaaaataaggctgagcctcattacgcctgtaatcccagcactttgggaggccgaggcgggtggatcatctgaggtcaggagttcaagaccagcctggccaacatggtgaaacccccgtctctacgaaaaatacaaaaattagccaggagtggtggcacacgcctgtaatcccagctactctggtggctgaggcaggaaaatctcttgaacctgggaggctgaggttgcagtgagctgagattgcgccactgcactccagcctgggcgacagagtgagactccatctcaaaaaaaaaaaaaaagagagaaaatgagaataaataagcagccattccacctcttgggtcaaagcttccaaatttgctttttctccaaggagtggcagccacagcaaaacatcttctgcagcgtctggccagggcgttactccagcccagttttgccctggactagattgagtcaggtcgtgcatggaacgcaagcacaaaccacggtcagctcctcgagactgacccactggcccactgagcagaggagcccctgggtctctggacgctgcccagttgttgacatcctgaggcaggtttgcggctgatggagcaacagggacgggctgggcccggcacctttttcacggaaatgatgagctctggacagcagtgatgccagggcccataaagcctcaggcgcccgtcattgctgctgcctgcgtgtgctcgctcaccgcgacggcggcgggctggaggaagctgtgcaagagccaagtgtctaccatgagtctgcatgttcatatggttcagatttgccttggaatccccgcgagccaaactctttcatttcacttagtaaaagggatgcattgactcagatgttctgtcctatttaaatgagaggggcgcgggaggtgatggaacacaaaaccatgagccatggctttgctggggaatgctgtggatctggtgtgtgatagagagagagtgtgtgtgcgtgtgtgtgtgtgtatggcaaagtgcacaaatcgcacgtgtacacctcagtggctttttacacatttagacgtgtgtaagtgtatagagcatttccacaccccagaggccccgagctcactccctcccgctctccccatccctgacgctaacctgatgcctgttgtcgtacatcagcttctcaacctcggcactattgattgccatttggggccaataattctagggggtggtggctgtggtgggcactgtaggatgtttcctgtgtccctggccctgacctactagatactagatgcacccaccctctccatcgtgacaaccaaacgtctccagacattgctaaatacaccctggggacacagtcaccctggctgagaaccagagcgtgggtcactgtgacttccgcgcttcctctccatggcatcgcacggtgccatgtgtcctgccctccgtgttcttctctctacgctgcttctctgaaatccctccagcggtggcgggtgccaggagttagttttgctttctcactttggagtaatgttgcattttatggatgtgccacgatgtgcttgtctgttccactgcggatggcatctcttgttgcagttggggctgttaagagtgttctcagtgtgccttgtggagggcttgtgtcctttctcttgggtgcatcctcctgagtaggactgcagggtcccaggcaggcgcctattagcaggagtggccaccattgcacagtgctcccaattccattcccacaggccacctgagagtcagggagcttctgtcacaattttaagtgctgcaggattaatgcaaactttctgatgtgcttcaagttgctttgtgttgaaatggactagaggggatttaagctcacagacatatatccagagcatgcccactttgataatgctatcttcactaataaattattctcaaaacagcaggtacttgcagttctgaactagataaagccctttcctttccatctactcactgagtcatcaggtgcctggctgacagctgacgctaagtcttcacaattaaccaagtctctgggcgcccctcaggctttaacatgaggacacatggcagattaatcacgaagccccacctctcatttcagctgccatgaatggcaattcccaaaatgcagggggagaaaaagactggaaggaaatgtcgtggtctaaaatatcaccaaaagttgtctttgttttatttatttatttatttatttattttgtttgagacagagtctcactctcccaggctggagtgcaatggcccaatatcagctcactgcaacctccgcctctcaggttcaaatgattctgctgcctcagcctccggagtagctgggattgcaggtgtccgccaccacgcctggctaatttttgtaattttagtagagacagggtttcaccatgttggccaggctggtctcaaactcgtgacctcaagtgatctgcctgcttcggcctcccaaagtgctgggattacaagtgtgagcttggcctccaagggttgtctttgtgggattgtttgccctccatctgtttgtctgtgtattcccagttttctgcaatggacagtttttacgtttcaaacgggaaactcttttctccttccgtgtctccatgcaagcccagagacgccagcatcatgtctgtctcccatcctccacttctctgacgaccaaaggtcctgggttctctgaggcctgcgcctgggccttgttacaacccagcaggcttatcttgattccagtaattgagaggcacatttgccaagtttatataccctcttgaaactcaagtactggtttgtggattaatgcgagattcagttgcatgcatttgaaatgcaagcgtctaattccgcgtgtaaaatacggggccacagacctcttgggcattgcacaccattccattcagatgagcgcagcaaaagcaaactgtaacccctaggattaaattctcctttaaatactcacgggtttttagcttcgggggaaaatatgtctgggaaaaatatcttggggtttcatcaaacacttggaaaataatctgaaaacatttttccaaaccctccatgcctccagcctgaatcctaattgatagttaataactacatcgacagaagccttctcactctatcacgattactggaaggctaaagagacatctgtctggagtactgggagtgaagcaaggatctcaggatcaccaaggatcttgtctggccaaggtctttaccacacaaacaagctttttttcacccccggaaatacttgccccgagtccactgtcaaccattaccagaatcagatctcggaccaatcgcaagtgtatttatgtattcattcatcaaacacttattgagccccaactctgtgccaggcattgcctgtacttgcagggagatcaaaaatgaaaggaggtgagcattttgacagctcttgtcttagagagtttgcagccagtgggagaaagcaagacatcggtaactgggaaaaggcaggggtgctccgagtcacagaacagagcccgtggctggcagagcccggaggagggtctggctgggcagtagatgttgaattctatttttttcaaaatcatttttttctattccagatcctttgcttttccacatcaatttttactatctacaaaaagtcatgctggaattttgacttgaattgtgttaaacctccacatcaatttggggataatttacagcatagttacatttgagccctccaatccataaacacagtatatctctgtttttaggcctttgatttcttttgtgagcattttgataaagcatacagatcatcctcaagtttcgtcagatttatacctgagtatttcatttttggagagctgttgtaaatgggtttaacatttttatcatttatgtatttttcattgctagtatatagaaatatgatttttttttgtctgttggccttatgtcctgagatcttgttaaactcattatttcaataagcttttttgtttgttcatttggacagcgtcttgcttgagcctcggagtttgaggccacagtgagtggtgccattgcactccagcctgggcaagagagtgagactctgtctctaaaaaaacaagtaaaacataaaatacatttataaaaataaaaaaaatcgatcaatgtaatccatcatattaacaatctgtcacccaggctggagtgcaatggtgcaatcacagctggctgcagcctcgactttccgggttcaagcagtcctcccacctcagcctcctgagtaggtgagaccacaggcatgcaccaccatgctcagctaattttttttttggcagagatgggggtctcaccatgttgcccaggctggtctcgaactcctgagctcaagtaatccaccaccttggcatcccgaagtgctgggattacaggtgtgagcccccacactcggtccagcctaagctttttaaatagtttccttaagattttctacatagagaattatgttatatgcaaatatggacagttttattctttcctttcaggtccatgtgccttggatttcttttttcttgttgtagttcattggctgggcctccagaaaagatgttgactgggaatggcaagagtttataaattgtcttttcatgacctcaagggaagcattctctttgcccatgaagtcagtccgttgctagctgtggagtttttatggataccctttataagattatggaagccgggcacggtgattcaggcctgtaatcccagcactttgggaggccaaggcaggtggatcacctgaggtcaggagttcaagaccagcctggccaatatggtgagaccctgtgtctgctaaattacaaaaaattagccgggtgtggtggcgggcgcctgtaatcccagctactcaggaggctgaggcaggagaattgcttgaacctgggaggcagaggttgcagtgagctgagatcatgtcattgcactccagcctgggcaacaagagtgaaactctgtctcaaaaaaaaaagattaaggaagtggccttctgctcttgttctaccctggttttctgagagttttttttttttttttttatcatgaatggatgttgaactttgtcagacttttttctgcgtcagttggtatgatcatgtggtttttcttatttagtctgttaatatgatggattaattgatagtttttttattgttataaatttatttttaaatttttctttagagacagagtctcactctgtcgctcagactggagtgcagtggcaccactcactgcagcctcgagcacctgggctcaaggaatcctccagcctcagccccccaagtacctgggactacaggtacatgccaagctcacttttaaaatttttttgtagagatggggtcttgctgtgttgcccaggctggtctcaaactcctggccacaagtgatcctcccacatcagcttcccaaaatgctgggattacaggtgtgagctactgcacgcaagtttgattgatttttaaaaaatgttccaccagccttgccttccccaaataaaccccacttggtcatggggttgtatgacctatgaccaaaatattagcaaatatatatattattgaatacaacttgctagtagattggtgaagattttcatgtctatgttcctgatggacattggtctgcatgcatttcttttcttggactgtctttgtgtggttttggtatcagggtaatgctgtcctcataagatgaatggggaagtatcctcttctcttttattatctgggagacattgtgtagatttggttgtttcttctttagctgtttggtggaatttgccagggaaagcatctgggcctgaagatgctctttgggaaggtttccagctgcgttgaggtttaggctgggagggaagagcctgggagctccgaaggctgggaggtacccgagttctgctgccttccccaatctgtctgctgcgtgtactctccagaggccctcgatggcagctcccgcactctcttcagggttttggttgcattcagtggcagatgcagggtgagcaggacaggacaggcttatctattctgtggagccaaacctccatagtttttattttcataacaccaacctgtgtgggagccagtggctgagagcattgcagggctcagcacatcctgacatcacagggacccgggaaggcagccgacctccatgcaggaacttcctcctctacagcgtcacacaggagtcccctccaaggcctcagctctccgaggcacatgcgtgctcctcaccttccatttccatttcgcgtgttttgctggcgtcagtgctgctctccgttggaaatgcgggagccgcccctagccatgttacacgtggagaagctgcggtgccgggaggaagaaggcggcgttaagtgggcagagctgagagtcactcctggactcctgcgcttggggcaccacgcactgatctgagtggaaccccagccagcccgaacaatgctgggagggcactggggctctcggtcagcagggccccactcatccagggagtcaaagtgcttgggtgaagcgcgcacagccaagaatctatattctaaatattaatatttaatattaataataacaataacaagagctcctatggattaaacgcttgcacactgaccattaagcacttagcatttatgaagcacttcctacgacctctccttcatctcgctgcggccctgcgaggccgatagtgtttattattctcatttacagaggaggaaggtgagtcctggaggagggaacagactcccggggacacacggcaaggattccagcctgggcccattttggtagcgctccctcacggtgacagatccagccagtgcgccagcagacgcccttcacggaaacctcacgtaaaggctgagttagtgctgtctcagacgactgcagcggcgtggtgggaaacgtcagtaaagaacggtttccttgaaaagtctgcacatttatagtgtgttgttttgattaggaattctgggaaggcagagacgtccttctgcgtggacagctgccatccctcccgctctgcaacgctggctcctcctgaagatggagcaggattgcgtcactcatgggaactttctaaccttctcttcagctgacctcctctgtgctttgggaagccagactgactcagagagttccgtgtccccaccccttccttggtgctggaaaggaggtggaaactcctcaacttcctgtcattaggattcatctcggaaatctgccacacagggctaccccgggaccctatccaggcaggggggtgcgtcagaagcacttcacccctgcaggtgcaggcacacttactctcttattggagacactgccttgccttgtcacccaggctggagtgcagtggcactatcagggctcattgcagcctccatctcccaggctcaagtgatcctcccactacagcctcccgagtagctgggattacaggcgtgcaccaccacacccagctgatttttgtctttttggtagagatggggtttcaccatgttggccaggctggtctcgaactcctgacctcaagtgatccacccgccttggcctacccaaagtgctgggattccaggtgtgagccaccacacctggccaattcctgtacccattaaaaactcaagaaatctttgcctaacccaagctcacaaatgttcttctgtgttttctactagaagttttatagtgttagcctttacatttaggtatctgatttgactgagttaacttttgtgtgggaggaggtagagatcgaaggtaattttttgcatatgaatgatatccggttcttccacgtgttgaaaatactctcctgtccccattgaatttgcctctgcgccttgcgaaaaaattgaccatgtgggtctatttctagactctgtattctttttgttttgttttgtttttgagacagtcttgctccgtcaccgaggctggagtgcaatggtatgatctcagttcactgcaacatccgcttcctgagttcaagaaattctcctgcctcaacctcccaaatagctgggattacaggcactcgccaccacgcccagctaatttttttttttttttttttttttttttgtatttttagtacagacgagactttgccatgttggccagcctggtcttgaactcctgacctcaggtgatccactcaccccagcctcccaaagtgctgggattacagtcatgagtcactgtgcccagcctcctttttcttttttttttttgagatggagcctcgctctgtcgccccaactggagtgcagctgtgtgatctcggctcactgcaacctccacctcccgggttcgagctattcttctgcctcagcctctggagtagctggtactacaggttttgctaccacgcccagataatttttgtatttttagtagagacagggtttcaccatgttggccaggctggtctcaaactcctgacctcaggtgatccacctgccttggcctcccaaagtggtgggattacaggcttgagccaccgcgcccggcctaacagctttacagtatgtaaagaaaaaactgatagaactgaaaggagaaatacacaaatccaaatgacagttggatatttcaacactcctttctcactaattgatgaaataagaagacggaaaaccagtaagattatagaaagcttaaacaaacttaccaactaactgacctaattaacctttatacaatagtccacccagtattctagaatatacattcttttcaaatgcataagataatcacttggaccataatctgaaccaaaaactgtatctcaacaaattttaagagatcaaaatattataaaatattttcttggccaggtgcggtggctcatgccttaatcccagcactttgggaggccaaggctggtggatcacctgaggtcaggagtttgagatcagcctggccaacatggtgaaaccctatctctactaaaaatacaaaaattatctgggcgtggtggcacaaacctgtagtaccagctactagggaggctgaggcaggagaattgatcatgcctggaatcccagtatgttggggggccggggagggaggatcacctgagggtgggtgttcgagaccagcctagccaacatggtaaaatcccatctctactaaaaatacaaaaattagcagggcatggtggcaggcacctgtagtcccacatacgtggcaggccgaggcagaagaatctcttgaacccaggaggcagaggttgcaatgagctgagatcatgccactgcactccagcctgggcaacagagcgagactctgtctcaaaaacaaaacaaaacaaaataattagattataaccctaggaggattcaggaactctcttagctagctttgtaactgttctgtaaaacctaaaattattccaagtttaaaagtttaccaaaatcagtcaacataattcatgatataaacagactaaagaagagccatgtaatcatttcaatagattcagcttttgacaaaattcagcatccattcatgagataagctcgccacaaactagagagggaaggaaactgcttcaacctaacaaaggacatttataaaaaaaaaatccacagctaacatcataattgatggtgagagactgcacgctcccacccatgtctggagcaaggtaaggacgtccactccaccactactactcaatgctgtaatggagcctccagctagtgtaataggcaagaaaaagaaataaaaggcattcagatgggaaagagagaagtaggactctccttatttgcaggcaacatgaaaacctaggtagaaaatcttgtggaatctacaaaaaagctccctgaactaagaagtgagtgtaggctgggcatggtggctcacatctgtaatcccggcactttgggaggccaaggtgggaggattgcttgaggccaggaattcgagactacactggccaacacagcaagaccccgtctctattttttttaatttaaaaatgttttaaaaagtgagtgtactaagcttgccagataaaagatcaatacacaataatcaattgtgtttgcatatgccaaaaaagaacaattgtaaaataggattttaacaataccatttacaatagtataaaaatatgaaatccttgggctcaaatctgacgaatcagcgtaagacctgtacattgaaaactacaaacatacctgaatgaaaggaaagacccaagtaaacggataaatacactgtattcaacaagccaggatttgagggtctccccagagtgatctatagagtcaatgcaatcccaatcaaaatcccagcagctttttttttttttctggtagaaattaagtggattctaaaatacctatggaaatatgaaaaaataaaacacagtcgaaacaactttaaagcatgaccgaagttagaagatttacagtccccttcaaaattgttataaaacttagcaacaccgcatggtacttgtattgaggtcgataaatagatcaataatatagaatgctggccaggcacgaggcgggcggatcacaaggtcaggagatcgagaccatcctagctaacagggtgaaactccgtctctactaaaaatacaaaaaattagccaggcgtggtggcgggcgcctgtagtcacagctgcttgggaggctgaggcaggagaatggtgcgaacccgggaggtggagcttgcagtgagccaagattgcaccactgcactccagcctgggcgacagagcaagactccgtatcaaaaaaaaaaaaaagctgtattatttggcatgtatacatttaggaattttctatatccttgatgagttggcctttttgtaattatgacaaacccatctttatccctggaaatattcctttgtctaatattaatatcaccactccagctttcatttggtgagtataagcatgttgcatggtatacatttttccatctctttacttttaacctatttatgtctttgtagttaaagttggtttcttgtagacagcataccgttgggccttgctttttcatacaatctgacaaccttacattatgttggaatgtttagaacatttacatttaacataaatcaatatagttgggttaaaacctgctatcatgctatttgattttcaatttgtcttatctcttctttgttactttctccccattttcttgtcttcttttagattagttgcattgcctgtctgattccaatttatctatattatttgcttgcagatatgtaaaaagttgaagtttcattagggatatacataaaatagatgatttttctaaaataatgaggccaatcatgagatgactcattaaggaaaagatcaattgaaaaatgcatgtttggaaaaaaattgcatgtttggacttaccttcagttatcattaggaaacagaataaaacctagaccagaagttaagtattttttttttcctaagctcacaattatagtttctatgatttgaatcatcagaagagcaaacttgataatcctggaaatttaggagacatgaggtcatggaaggtcgtggaaggtcctgaaggtgagtattctgtcaggaacggtgtgttcgccttccttatgctcctgctaagccctctctctaaagttgtgtattctgctcgaaaacttcccttgccagaggatacttttcatgaataaatgctctccagttcttgtcattgctaagtacagttcttgggttactttgcatgtctctccaatatcaatttgatggagtgtcttcgaggaactggcaacgtgccaaacactatatgcagggatttgcctacattcaatcatttaatcctcccaacaacactgtgagactgacaagattcttagctcccctccatggctgatgaagtggcatctcagtgaactgaaggaagttgctggaattccaacctgtgctgtccaattaccaggcctatgatcttggcccctaagctatctttgggagggcctgccagtgcttggatttcctgtttctgtctctttccctgctggctgaagttaacaatcagtatttcacagggccctctgaaatttccttccccttcaaatatcagccttatgctggtactggggatacccagggagtgagacgtggtctccagcttatagatgctcgaagtaaaagaggagatggaacaattgtcacagttacctattgccacggtgatgctgagtaacaaaccacctgtaactctgtggctttattcttgctctctgtctgcaaatcatctgggaaaatggggtggggtggggtcacctgatctatgctgggctcaagctacaggatggatccaattctactggacactttgttctgtgacccgtggattgcctggggcattttctccttgtggccatggcggaagcccatcaatcaaagcaagtcacatggctaagctcaaagtcaagaggtggaaagtactctttgcccaccacgaggccatggtagaccccaaggccattgggctgtagaacagacagcagagtggagaaccagaaccgataattcaattcacctcatttattttaacaggtgagcaaagcaatttgcatgacagcaagatgttgctaaggaagacaaaagatagaagcaactgcctaccttgccaaccacatgccttcacagaggaggtgatgtcggtgctgggtcttgaaaggtggggtttcccaggtggagagagagcatgtgcaaaggtccagtggcacaaaaggcccctgtgggctcagagagaaggaaaa

SEQ ID NO: 24 - DNA, 160204 bp, Homo sapiens
gaattctcacatcgacccgaggagatgctgcaactgttcccccaacacagatgaaggaacccaggcctcaagacaggaaggcacctccgcatgtctgaacatttttgaacccagggtcttggcctctacaccaagaagtagcgtttggggaccttgacattgaaccagggtggctcactacatgtgccctgaagcaactgaaaaatctgtgccggctttttaagaacctggtttttgcatggactttatttctttcattgcaaaaacctcacagactctttaaggtcagcgtcctggtttccactttttctttcgggctaccaattaaaaaaaaaaaaaaaaaaaaaaaacaacacctgagctgtaattggagcctgggaataaaacataaccctgaaacttgcttttctcagcaaggtagttgtcattctgaagcaggtgtcttacacgaaatggctatttatagaaaatgatatttatgcaatctgtgctgatctcactgactgtcaaatctctgaaaaggggctcgcaggaacagtggaagatgcagatgtggagcccctgaatgagggagtgtcaaacggcactcttgagtgctcctccccaggcaccacgacctggggcttcagcctccagtgaggaagggcagggaggggtcacaggtagcccaggtcgcttagccaggaagtgtgctccaatggttaggggctagggcagctgctcacccaaaccctggctctgccatacccctgagctccagttttctcttctgtgaatggagcatctctcatggagggtttttattttttgaggatcacagtaaaaaattcatgtaaacatatgtaatgatagcaggtgttttaagcgctagcttcccaaaccagtatatctgtatgcaacttcccaaacctgtatatctgtattcaactacattaccgaaagtagcacgccatgctagacttcaccctggaaaacagaaactatcaactatataaaagtaggaggccgggcgcggtggctcacgcctgtaatgccaacactctgggaggccgaggcaggcagatcacttgaggtcaggagttcaagaccagcctgttcaacatggtgaaacccccatctctactaaaaatacaaaaattagccaggcatgatggcaagcacctgtaattccagctactcgggaggctgatgcaggataatcatttgaacctgggaggcggaggttgcagtgagcctagattgcaccactgcactccagcctgggcaatagagcaagagtctatctcaaaaaacaaacaaacaaaactaggaaaaaatgaatgcaaggtattggcattggctacatcagggacaagcaagctgaaaagctgagcaggttggtgaagccccccaagactggccacagcacagagattagcaaatgaccctcagccagaagaacaggggaaggaggggggaccctggagaccaggacctagcgtcacccagggattgctggagtgcagagctgtggctgctggagatttgctccagagagaggttgaaatacccccgccttttcttccttcctgccctccagccgggagccactgaccagggacttaggaacacagcctgaaagggtgacacctccccacccctccacctccccaccgcagaccccagcatcacagcaattcccagcagagcaggctgggcaagggggaggagcaggtctaacaagccctatagcgggactcacaccccaaacaagggtgctgtaccgtaagctgctgaaccacactttgcggcaagagagagctcctcagaaacgggagacggttctcaggtctcagggcctcaggaagcctctcttctgcacgataaacccacacccatagcttctcctcccctcctaagcccgctctgtgtcagctaagtccccgcttaagcacatcagaacacaattcccaaagtgtggtccatgagacctgagaaccgtctccccattcctgaggcgctctctcttgccgcagatggtcatcttcctgcatgaacctctggagagcagaacaaaaccagttacagagagacagtgttggggtcaacataaagaaggtctttccaattgagaccaaatacactcctctgtgaggtagtgagttcccggtgagagcaaagggctctgagaattttatttatgtatttatttatttatttatttatttatttatttatttttacttctaatagtactttgctttttttttctttttttttttttgagactgcgtctcactctgtcacccaggctggagtgcaatggtgtgatctgggctcactgcaacctccacgtcctgggttcaagggattctcctaccttagtctcccaagtagctgggactacagacatgtgccaccacgcccggctaatttttgtatttttagtagagacaggtttcaccgtgttggccaggctggtctgaaactcctgacctgaagtgatccgcccaccttggcctcctaaagtgctgcgattacaggatgagccactgcgcccagcctctaatagtactttggaaagaatttttttttaaaacagggtctcactgtgttgcccaggctggagtgcagtggcgtcatcatggctcatggcagcctcgaactcccaggctcaggtgatcttcccacctcggccttccaggcgtgcaccaccacacccagctaattgtttgtattctttgtagggacgaggtttcaccatgttgcccaggctggcctcgaactcccaggctcgagcaattcacccaccttggcctcccggaatgctgggattacaggtgtgagccacggcacccagccaggagtcaattcttgacttagtggctgtggccattctgaactggtttctccttttgctggatcaaagaagttacggtgacacaaaggatcttgtatcattcattgagtttttacacttgctttgtaaaaactctctgttctatttcccactaccaggctgtaagtttcccgcagacagacttgtttatctgtgtgactttaggcaaaaaaaaaaaaaaaaaaaaaaagcaagagagaaagaaaatctgaggttttggttttaccaaaaccacacaaatgtaccgcagaagtcctttaaacagtaatttttcccagaacaataaaaatataattttaggttcatacgtgtttgtttctgaaacacttactacatgctgaaggagaaagtattacactggggaggcccacagagaggaagaaattaatgtgagcaacgtgcaaataaaaggccacaattatctgcagcatttgctaaagtgagcgagcatgcctttggctctaaagtaagcctgcccttgactgtaagcctataacagcggcatgcagtaggtaaagaagtattgtttaagttaattaacacagaataccccatttaattcagtaaatataataaattaatgatctttagttccatatttgggcataggtagagaaaatagcagagaaaagagagaaagaaattgaaagaataggagcaaagacaagacagaccttcagaaagatgtggggccaggtacagtggctcacacctgtaatcccagccctatggaaggccaagaaaggcagaccgcttgaactcaggagctcgagaccatcctggtcaacatggtgaaatcccgtctctacaaaaaatacaaaaattagccaggtgtgatggtgtccgcctgtagtcccagctacttaggggtctgaggtgggaggattgcttgaaccccagaggtggaggttgcagtgagccgagattgcaccactgcactccagtctgggtgacaaagtgagaccctgtctcaaaacaaaacaaaacaaaacagaaagatgtggaagccttcttgtcctgtgaaatcaggactttggtcagtcagctaattgtgaatctaaaaagtcagttaagtcagggagacaccttaaattcatttatatcgtatatctttttcttgccctagtatttatgagtgtgtcctttctttgagagcggcctggctgaaataggcgttgtgtctctcttctcccatagaccacaaccgtaacccttctgctacaatttcccacttcctattctttacacaaagacactttcaaaatcatatatgtgcagaatcattccagggttcacaattccctccacccagccttccccagtttctgcaattaattcggtatcagttgtcttagttacatcttgaagtcatccaaagtttcatctgagttttatagcgattatattccttctgtttatcctcatgttcccacaacttaagtcacatttaattaaatcaattaatgaccataatcaacacaactgccacgaacagttttgggagcaaacgcggctagttctagataagcacagagcccgggtggttagggaagatgctcaggaggaggcttcagcacactgtgtgcagctgctggcatgtttcacaggagaaatgggacaagtctgttaatctagtgagtgagttcagcagaagttggttaagacagcgtgttaaataaaggcttaataattaaaatttgattagacattagaagttagaggtgtctttcatgcattggctaatttcattcaatcatccattcattctttttgcttgtttttgtttttgacacacagtctcattgtcacccaggctagagtgcagtggtgcaatcacggctcacagcagcctcgacctcccaggctcaagtgatcctcccacctcagcctccgaagtctctaggacaacaggtacatgccactatgcccagctaattttcgtatttttgtagagacaagatcaccctgtattgcctaggctggtctcgaattcctgggctcaagtgatcctcctgcctcagcctcccaaactgctgagattacaggcctgcaccactgcgcctggcccatctattcatttttttcattcaacaaatatccccttggggacctcacaacactagacacagtgcttgctgcaggctgattggcagggtcagtattgctgtgcccattttattggtggtaagactaaggctcggccatttgttcattgtcacacacatggtaagtaaaagcaggctgggtgcggtggctcatgcctataatcccagcactttgggaggctgaggcgggtggatcacctgaggtcaggagttcaagactagcccggccaacatgctgaaacctcgtctatactaaaaatacaaaaattagccaggcatgatggtgcatgccagtgatcccagctacttgggaggctgaaccaggagaatcactcgaactcaggaggcggaggttgcagtgagctgagattgtgccattccactccaaactgggtgacagagcaagactccatctcaaaaataaataaataaataaataaagtaagaaaaatagtaagtaaaagtgccagcccctgaagccaggactcctgattgtagatcctgatacgctctctatgaaatgttgtgggttcagattgaccttccctttagaacagaagttcaggctctccaagttgacacctagaaaacaggccatcctggcagccgttccggagaatgacagataaatggattgaaagtcaaagtgtccagtgtagagagtcaggatgctgaaaccaagcagaaggcatatcgggtggaattctgaagggactgtaaacaagggactgtttagagaactgggttagaagagccaacaagagcaattgagacacccaggggagcaagaatgggcgctgttcccacgctaggcaggacagatcaggaggaaagcctgtgcctggagcctgcggagctggagtcgcgggggagggattgtctggaccaaagtcaagttcctcagagcctgcctctccactcggccttgaccttggacccatccagtctttggtctgctgagtcccgttttagtaaagaatcctgctaagtcagttcagggacgatgccccaacccttgatatctgatcacatcccccatcctccccacccttgctgtttaagttcttggtctgtctgtagcaagaatcctgtgaagtcggtttagcaggactcccctcgccccaatgtcttcccttagtgacttctcatccactcacccctcactctgctcaccagctaccaatctccgctgtctttgctacatttgtttttgagctcagtctctctcccccattgcaatagttttgaataaagcatcagaataatttgtctgttagaagatcgcccagcaggagcagtggtcatggaaggatgtggccacgggctgacctcagcccgaagcagggagtgtgctggggagaaatgccccaacctctctcctgccggcctccagtctccttccggtgcctcccagtggctgaacccaaccagaagtcataggaggagcagcccaggtgatgccatccttcaaagtcagacaaggtcagagaaagtggaaaatggggagtgaacagggaatactagcccacaccgcttgccaaagagtggtgtaagctgcttaataaatagagtcaggtttctttcttttttttttttttttcccaggctggagtgcagcggcgcgatctcggctcactgcaacctccgcctcccgggttcaagcaattctcctgtctcagcctcctgagtagctgggattacaggcgcccgccaccatgcctgactaattttttgtatttttagtagagacagagtttcaccattttgaccaggctggtctcgaactcctgacaggtgatctgcctgcctcggcctcccagagtgctaggattacaggcgtgaaccgccgtgcccggcctcttttttttttcttaaaatgtgaagaattctctgagactgacccaagagacatggcaggggcaggaggaggacatgccagccagggcagtaccactattggtgccagtactctcagccggtcagcggcagtgggcagggtcagggaactaattcacaaatctaggaatgttcttaatggtgacacctagacaagagaagagactgaaggtcaagaaggcacacgaggggatggcagagatgaccctacagttcccaacctgattcaaggcagtcccagtaggcatgggactgtgatcgtcaatctgttagatgagacacagtgtcctggcgaaacacacatccttcgcatcttcctcctgtcgccgcacagctagcggctctgagcaggcctcgatattttgtgcaagggcaaaatggcagggaccaccagccagggccaccgaactcttgttttctgccccaggacttcccagaccccatggcgtgcaactgtgaagagctctccagggacttatacatgcacaaccagaggatgacagggctgggcccttgaccaatgggagtgtgaaagccgttaatcaaatgtgtccccctttcttcgggaggccaaggcgggcggatcacttgaggtcagcagttctagaccagcctagccaacatggtgaaatcctgtcactactaaaaatacaaaaattagccaggcatggtggcgggtgcctgtagtcccagctactcgggaggctgaggctggagaatcgctcgaacctgggaggcgcaggttgcagtgagcagagatcgtgccactgccctccagcctgggtgacagagtgagactgcatctcaaaaacaaaacaaagcaaacgaataaaaaacacgaatatgtccccctttcctctcctggttggacagttctgagatgcatttcactccccaggagctcccacaggattgaccactcggtcacccgaacactggatggcatgacagtgcatcccagactggattccccagtaccctgttccacacccacatcccgcattccaagttacacgtgttatgtaacttggaaaagaaaaatacaaagcatgccagtttccttccgggaatcaacagcatggaaatggcgtggactggcctcaagtacacagatccataactcagggctctcagcagacaaatatgtcttaatccctgaaatactgccacttctgagtttgggggattaaaatatcattagatcctccatttgtcaggacgcacttgtcacaattgagagaaacagaagctacgtcagcttaagccaacagttttggggagcagggggaagatgggggatttactggcacaggtaaacaccccatagaaaggagaggtacagagagacctggggacttgagcaacatcatcttcaccctctctctccctctgtcttgttcatctctcagtcctgtttctctgtgttggtcacatttttcttttctttttttttttttttcttgaaaccgagtctcactctgttgcccaggctagagtgcagtggcacaatcttggctcactgtaacccccgcctcccaggttcaagcgattctcctgcctcagcctcccgtgtaggtgggattacaggcatgcaccaccacgcccggctaatttttgtatttttagtatagatggggtttcaccatattggccaagctggtcttgaactcctaacctcaggtgatccacctgcctcagcctcccaaagtcctggaattacaggcatgagccactgcgcccggcctcatattcacttttttttttttttttttttttttgagacggagactcgctctgtcgcccaggctggagtgcagcagcgcgatctcggctcactgccagctccgtctcccgggttcacgccattctcctgcctcagcctcccgagtagctgggactacaggcgccggcaaccacgcctggctaatttttttgtatttttaatagagacggggtttcaccgtgttagccaggatggtctccatctcctgacctcgtaatctgcccgcctcagcctcccaaagtgctgggattacaggcgtgagccaccgtgcccggccacattcacttctactacagatgacctacagttctcttccatgcagagaactttgagcttacctcactcccagtcagtgacagatggaaagaagaggtctgtctcccaacaactatatacaaatcctagggaaggattctgattggccctgctgggactacatgtccattctttgggccaatcactgtagccaaggaataggcgcctatgattggctggacctggccatgtgcccatgggggtgtgttatgaggggttctcagatggacagcttcaacagagattagcagctgcaacagaaacttctggaaaggcattgaggagaaagagctccctaaagggaggtgcagctgttgatccataccccttaggctttaatctttggctgccagtatctgcgactctgggcctgagggcttttccccaaaatcacggaagatcgctctcccaattatccagcaggttgcaagtgggggctaattaatacctgtgagcagctgtcagccaatactgccaggatggatgtgtgagtaccccgacgcccccctgggtgggatggctcttctctatggtatgaggcccctgttaccctcatcagtgacacgctttatcatgcctttaggatccattctctcccctgtctcacttcccctcccaatcagtgcttccggcactttccaaattaactactcaaacttgaggcccaacttcaggggcggctttagggggagcctagactaaggaaaactggattggtgggagcaggggtcaccgctctgcgggaaggaagacagaaccagtcactgtcagccccagccccgcctactcattcagtcactcatttgtggcatcctaagtcagctttctcttcctttccttttcttttcttctcttctttcctctcctctcctctcctctcttctcttcttttcttttccctttcttttcccctcctctcttctcctctcctctcctcttttctttttttctgagacagattctcactctgtggcccaagctatagtgcagtgatgcagccactgctcactgcagccttgacctcaagtgatcctcccacctcagcctcctgagtagctgggactgcaggcacatgccacctcgcctggctaatttttatattttttgtagagatggggtttcaccatgttgcccaggctggtctccaactcctaggccaaagcgatccatctgccagggcttcccaaagcgctgggcttgcaggcatgagccaccgtgtcctgccaggccaggtttctaagaagcgggacctgagatatggattcctgtgcagtggtttattgaggaggggctctcaggagacatgtatagggagaagagggaaatagggcatgacaaggcagggagaaagcctggcacagacgcgtcgctgcaggatcctggcctcagcctgatccccagggagctgtggagcatggctagggccacacgcttgacctctctaccttgaggcaagggagccagacctttataccctgctgatggccagtcacggctgcacgctgccctcggcaaccagggagcgaggctggaagctttcaggcactttcagtattctcctacccaaggggctggaaagtcccagcaggcaggagatgggtgcaggggtccagaactagggatgtgggtgaggcctggacagcatcctctgcttgtggcttgcaagtgataagaaaaaggagcctctcagctgctgagatttttaagcagacaacaaatgtatattgaatgtgacaaagagttagaatatgtgagtttcatctttacaaagtttacaatctacttgtggagtttaaaatacagctactggctggttgtagtggctcatatctgtaatcccagcactttgggaggctgaggcaggaggatcacttgagcccaggagtttgagaccaacctgggcaacatggcgagacctcttctctgcaagaaattaaaaaattaggggacgttgggcggagggagagagcagaaaagataactattgggtactgggcttaatacctgggtgatgaaatatgtataacaaacccctgtgacatgtgtttgcctgtgtaacaaaccttcacatgtacccccaaacctaaaataacaatttaaaaaataaaattaaagttaaaattaaaaattagccaggtgtggtggtgtgcacttgtagtcccagctactcgggaggctgaggtgggaggatcacttaagccagggaggtcgagactgtagtgagctctgatcataccattgcactccagcctgggggacagagagcaactctgtctcaaaaaaaaataaaaataaaaattgatatggtttagctgtgtccccacccaaatcccatcttgaatcatagctcgcataattctcacacgttgtgggagggacctggtgggagataattgaatcatgggggcagtttcccccatactgttctcatggtagtgaataaatctcacaagatctgatggtttttataaggggaaacccctttcgcttgactctcattctctctttacctgccaccatgtaagatgtgcctttgctcctccttgccttccactgtgatcgtgaggcctccccagccacagggaagtgtgagtctattaaacctcattttctttattaattacccaatctcagatatgtctttatcagcagcatgataacagactaatacaaaaatacaataaaatatagctactttaatcaccccatccagacacccaactcagtgctgagtggtttctgctctcatggaatccaaggtctgctgcttccgccccatttcccaccattccctgcaagcatattgtggtccagacagtctgggctcttcatgggctcagaatgttgcttcgttcttccaggcctttgcacatgctcttcccttcacctggatcccttctctccctcatctgcagggtgatcccccacttacactttcaaataccattccaacaactctcctcaatgtttatacatcatgagtaaattcaccttatcccagggattccaggaaagtgtagggtttctttttaaagttagtagaatttaccatccccagagcaaaacagaaaagtctccaggaggcagagatgtgtgtgtgactgacagcagcagcaagcctgtatcagtcacttgtttatggcacctcagtcaccgtgctgagatctatgtcataacttgctaaatcctccctgcaacacttgaggtaggccctattgtaacccttacctcacagaggaggaaagggaggcacagagaggctttgtaacttgcccaagctcacacagctggcaagcggcagaagcaagggtcgatctcagaccatctttacaccagcatgctgtactgaatgaatgactgaattaatgcaaccagcaacaccaaaatgatgcaagatctagagagaagagagccctactgagccagttcctgcagcgtgagagaaggtcctggatggccagttaaagggtctggctacagatggcagagatggcagtcgaggatgggcacctgctgtgtgaagcaggctcccagggccctgcagtcctccttcgcttgggttcccatggccaaaggccagcctctgccttcctatatctcacgatactgcaattgcatgttcatgcgcctgcctctcccacttcagacgcagggccagggttccactcagccctttcagccaggactgtttgcctcgcctagaaacaacccatttttctttctttctttcttttgagatggagtttcgctcttgtcacccaggctggagtgcaatggcgcaatctcagctcactgtaaccgccacctccagggctcaagcgattctcctgcctcagcctcccaagtagttgggattataggcacccaccaccatgcccagctaatttttgtatttttaatagagacggggtttcaccgtgttggccagactggtctccaactcctgacctcaggcgatctgcctgccgcggcctcccaaagtgtgggattacaggtgtgagacatcacgctaggccccatttttcttttgcccaggctggagtgcagtggtacgatctcggctcactgcaacccctgcctcccgagtagctgggattacaggcatgcaccaccacgcccagctaattttattttatttttatttttgtatttttagtagagacagggtttcaccgtgttggtcaggctggtctcgaactcctggccccgtgatctgcccaccttggcctcccaaagtgttgggattacaggcatgagccactgtgcctggcccccatttttcttaaataaaggagagaacaggattcaagactttaggagccctggtgagaacacagccagatccactccagaggcagccgagcaagaagccacttcctgtcaccaggtcagtgtcagagcagctgctcagctgacgaggaactgaccgtgcacttgctatttccctaaggagaggtaggcctggcctggacttccagcttgaactctgcagacaggacctaaggggtcccagcctccagagttgtgtgggacaggcagcttgtcagggaaggtgatgcaggaggtgacgttgaagagggtgactgtgagttctgagaggatgtgtctgttattgctgcctgctgctctgctcctagaatcccatggggacctctgagcttggggtctgctgtgatcaactaacaatggcttccatgggcatgggatggagagtgaaggcatgcatgttaactgtcccccatcctgagtagcagagccatgggagaagggagctgggtaaattactagcaatcagcagcgtattaagcacttagaatgtactaggcaccatgttaaatgcttttcctgctctatctcatttaatccttaaactaaccctaggagaggaatgctattattattcctcctttagaaggtcagcaccatgaggaacataattttctaatctgcactattaatgctgtgttgtcagcacctaaaatagtacctagcacatggcagacactcaataagtatttgctggcaaatagattaactctcattttgcagatgaggaaactgaggcccagagttgtacgtaacttactatctcagagcaaaacagaaaagtttccaggatacagagatgtgtgtgtgtgactggcagtggcagcaagtaaccagcaagttgcaagcagctgcgtgtgtgcccttcctgcggcaacaatgctgggagggctttgatctgagttgctttgttttatatatgagagatttgacgggtccaaaggaaacgaggctcacacagggttacctgctgagcctggggtccagccaggtttgcaaccttgaaatcctaagtccctgagccacttcatttctatagttgtcagagagacatgcaatcaggtccagcgtgccttggaggaacaggttgtgggcaatgccagcctggctggggacctcagtgaccattctgtttgagagtaattctgacccaacagaccccacgacaagagtcagctcaggcaaaactgtgatgcacaggaagcctcctacctgtttccctccctccttctccatcactctgtctggggggctggtgtcttcctttcattccaatcaaacatgatctctaaaaagtgcctgaacctgatgaacgctatggtataaatgactacgaaaaggtattcatttttgaatcatttctattttaacaggaatcaaaggctcaagacaaagaatacctctctaaatggcagaaaaagtgtccatttccaaatgatttctgttttagcaggaatcaaagcctcgagagaaagaacacctctctaaatagcagagtgtctaccaccatcagcaaaagctacagtgtacagggctttacgtaccaggcactgttcaaagtagtcagcctgtattcattcacgtaattctcacgacggctccatgagagaggaataagcgcttcatttagagatggagaaactgaggcacaacggagctaagttgctggcccagttcacacagctgggagtagccaggtcaggactccaatccaggcaaagcagagagaaaaatactggtgaggaggagggaggaggaagtgggacgttccagctgaggagaggtcttttttccttaatctgatgttaggggccacccaagcactggggccagacgcccaccatggctctgcgcatttgctggtttggtgatctgaggacatctgttgcttcttgtcctctggtttaacagttacaagtgtacaggagcatgtgggccaagcatcccgcgtgcggacgtgatctggcttggcctgcaggcctgctctttcatgccaggctgcaattttttgagattactcaaccttcggaagggaagctgggccaaggacagacctttggtgagaagcagggggagtttagagaatcagccctcctcctcctcctcctcccagcctcctcccccaggagactcggacttggaaacacccagcagggaaaattgctgcagcagcaggtagcagttattatgggacctggaccgccccttccaggcccagctgttctctgggaaagcctggcggcagctctcacaccctcttccaaatggtcttcagagggagacggagatgctcctcgccccgcctgttgatcttcaccactgcaacctcctgtgtcccaggcatggtcagcttgcagccctgggggcggcttctggtgttctggtgaactggttaactgggcactggcatagatagcctgggtttctcatcctggttcacgtgcttaccagctgtgtgatatcgggtgagtcatctaatcattcagaacctcagtttcctcatctgtaaagtggggagaacaatagcattgaccataggttactgtgaggattagacaggggagggagcagagcagttagcacagggcctgtgcatgaattatgatcaaactaggcctaacttgcccaggccccgccccatgtttttgctattctgggcttccagatggtgtgcctctttcactgggtactcttctgtgacatttgtttctgcacagaggtattgaggatggagataacctaagcctggagtggtcgtctttggtgacagtggcaattgttccacccaggaaagaaaggaagaaagaaagaaagaaagaaagaaagaaagaaagaaagaaagaaagaaagaaagaaagaaagaaagagagagagagagagagaaagaaagaaagaaagaaacgaaggaaggaaggaaaagaaagaggaaagaaggaaggaaggaagaagggaaggaaggaaagaaggaaggaaggaaagaaggaaggagagagaaaggaagaaaaaaggaaaaaaggcaccatgttggggagagagtgtgcaaaagaaaggaacaagcttttctcctgcttttttggaacaaaaggtggcccacattttcatcctgcactgggccatgcaaaacatatagctggctggctccatcggatggtgcctgaatctcagaagtgacagtgttgagctgctgttgggggcaccaattaggacaggctttcaggggagaggcatggtttagggtcttacaaatatgcagacctttggagccagcaattccccttcactgtcagagatgtgcatatggatgtgtgagcaaggatgttcaccacggcatgattcataatagagacaccagctggatgcccaacaatggggggaggtcaagggcacaatccatactgaaggatcaggcacagccattaaacatcatgtcatcaacgaggacttactgacatgtgaaaaactcatgacatttgcaaaatggggaaaaagtcagctaccaaggagtgtgcaccataggatctcatttgcataggcgtgcagggaatatatgcaggagaaaaatattgagctggtttatccttaaatgccaatagctgttctcctcaggtgggttatgttttcctcttctgggcctgttttccaactgtctgcactgagcacacatcactgtcatcagtgcactgaggtactgttgggcagtggccaaggctagggctgcagacactggaggcagactccctgggttcaaagcccagctctgctccttacgagttctgggaccttgagcaagggatttaacttctccaggactcagcttccccatctgcaaacagggaaagtaatgataccttcctcaaaggatcaaggtattaactcaccatgatagggtcatggctgattgacttgtttggctgtcttcctaaaacccctgaaattttcttctttatatccctggcacctaccacagtgccaggcttacagcaggtgttcctgaaaagtctgctgaatgaacgaaggagggagtgcatgaattcatgtaaggatggagatccacatcccagggtacagagatagtatcaaatgagttaatacatgcagagggcttacagcactgcctagtgcttagaaaactggaattatcattatggcaaagaaattgtgtaagaggaaaatgttgagagaacaatatgaaccaatttttttgaatgatgtagaaatgagtgtttgttttattttgttttgtttttgagacaaggtcttgctctgttacccaggctggagtacagtggcacaaccacagctcactgcaacctcgacctcgtgggctcaagcaatcctcccaccttagcctcccaagtagctgggactacaaatgcatgcagccatgactggctgatgtttaatttttttttgtacagacgagagtcttgctatgttgcccaggatggtctcgaactcctgagctcaagtgatcctttttcctcccaaagtgctggaattaccggcatgagccactacacatggctgtttggttttttgttttgaacttttctgtattgagagtagctgagtaaagcatgcattacttttataatttgggaggacacaaaacgttactgaaagaaaaagactgagagagtggttcacaaagtgctgttggggaacgcagggtgaagccaagttagccgagtccacaccgttttcatgtcaaggtcatgtgtggatgagcttgtcttaggcccttactccggcccccatacaccaggttgcacgtcttctcattcatgatgaacacaacacccggaaggccgatgttcatgctgagttataggctctacagcgaaatctcttgttagataaatagatagatagatagatagatagcatagatacccatatatagaggtgcatgtatccatttatctatataagagttataggctcttaaaatatctacagctaaatctcttgttagacagataaatagatatgatagatacccatatatagaggggcatgtatctatttatctacctatatctatttatcaagagaatctttaactctagctgtaaaaaagaatatgtccaactcttggtgctccgtgtattgccccaacacagtactcaccacgctaggaccattgctgattgacttgttttcctgtcttcctaagagccctgaaagtttcttctttgtatccctggcacctactacagtgccggccacacagcaggtgttcctgaaaagtctgttggatgaatgagaggcagtgcatgaattcatgtcagaacagagatccatccacatgtcggtatggagacagaataacaggaggattagctttgtctggggtagggacaggtccaggaagggtcaaagacaggcaagtaaggcttggcagggtgaatgtgtacagtccccaaagaaaaggggagagagagagagagagatgggggacagcaatccagtcagtgagaacatcatttaaagatccttggctcacacctgtaatcccagcactttgggagcctgaggcaggcagatcacccgaggtcagcagtttgagaccatcctggccaatatggtgaaccccatctctactaaaaatacaaaaattagccaggcgtggtggtgggcgcctgtaatcccagctactcaggaggctgaggcaggagaatcgcttgaatccaggaagtggagatttcagtgagttgagattgagccgttgcactctagccggggtgacagaaagactctgtctcaaaaaaataaataaccatcccggctaacacggtgaaaccccgtctctactaaaaatacaaaaaattagccgggcgaggtggtggacgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaagaaaaaaaataaataaataaataaataaaataaataaataaataattaaaaaataaagatcctgtaagtgggctgggtgtgctggctcacacatgtcatcccagcactttgggataccgaggcacgaggatcgcttgagcccaggggttcaagaccagcttggacaacaaactgaaaccctgtctctataaaaatcaaagaaaaaaaaatagccaggtgtggcagccggcacctgtggtctcagctgcatgaaagactgaggcaggaggatcacttgagcctgggaggtggaggctgtagtgagcactacacaaaagaaatcgctgatccttcagcagccatttcccactccagcaactccccgcccctggcaaccactcatctactttctgtctctatggattggcttgttccggacatttcacatacacggaatcatacagtgtgtggtcttttgtgtctggcttctttcactaagtattacatctccaaggttcatcccgctgtagcatgagcgaagtgtgacaattgatagatggatcgatgaaggttacattcattcattccatacacatttactgagcacctactgtgtgccagtcttggcgacgacccagtcaggaatagaactaacagtaaaccctgccctggagggcttctggtagggaggagagacaataaaccgaataaactagtacattatttggaatattagacgctgataagagctcaagtgaagcatggggttggaagttgggtgcagagagaggggctgtgacttcgagcagagcggtcagcaaaggcctcgccgcagggtggccgcagggacgctcccgctcagcccggaaggaggcgagaggcgcggtgcccgtcccggcgactctgggccagcaaagagctcccagcgcacgcgtcggtgcctcgaggcccgggaccctgcgtgtctggtccccgccgtggccctgcgtccgtgacggtgggtggcaccagggagcatttcgcgcggcggggctggggcctgcctttgaagggacggagtcgggcgtcgtggtggggtggacaccggggatccccggggcgcggacgaggggggcgtccaccctgcgagctcaccccacggcccccgcgtcccgccctcagccgcaggccccgccccgcgccgcccggccccgcctccccgcggccgccgccattggccgcgcgcgccgcctccgccctcggcctcgcacttcctggcggagccatggctgcgcagcgggctggccgggggtctcctgaacccgggccccgccgccccgaccgcccggccccgccgccggggctgtccccgccgcgtccgtagcgcgtcctgccaggtgggcctccgcgcgcgcccaccctccagcccgggaccgccaggaagccgcgcccggccggggcggggagctggcggagatcgggagggtccccggccaccgcgagccgcgacccccctgcgccccttggtgccggggcgggcgggtgggcgagtgggggcgccgcggccgggggaggggccgccgcccccgcaggtgacacaggtgcggcctgtgcggaccgccccgcgcgtggcaggtgagtggcccccgccccgggccgtcccgactccgcctcctcgccgccggctggagcctgctgggcggccgttgcgctgagttccgcctgggctgcggggtccgagcgaacgacagcggcgtccccggagaccccgccggcgagccggtgtcagcagcgtcgctttctccaacgctgaggtcgggagggagcttggggaggaggcgctctgggaaacccccggccggacggggcctgcggtcccatgtttactggaagaccttttccagtgacctgggattgtcactgtgcttgggggtggccttgacccttcacctgcttccaaaaagcgtcggaggccgctgacgtccaacacgggtggaaatcagaccccacccccacgcacttgcaggagacagcagggagcctccggccccgcgaactctctctaggtatcttggcctagaaaataaagcgttgagcgttagaaggcctggttgattctgggcaggctgcctggggcggtggagagagagggcacctgctgcttgctgttctgtgaccttgggcaaccccccctggggcacccgagcgccaggtctcactgtgggaacgacggtgtcacctctcagcgtgaaggtggaatgaagtcgagtccgcggtgggcaccgcaccaacgctgggtttcttctcttccctctctgggctctccagcatcctaggggagggccggggtgggaacagcttgtcattgtcacaaagtttctagtttgtcgagaggaatccagttgccccttctctccctaggggagttgcacgggacggactgtgcccgaattcattccttccatgggaacactggagtgccctccctgtgtccccagttatctaagaacagtgctgacttcttgtcacattgttctttattagtgaagactatttgttcaataggtaacaaactcttctcatgaactcaaatagcgggggaaaaaaatcctctttaaaaccttcgtctcagtatgtgacttgtgctaatattagttggcaaagtcccttctctgtgttcccttccatctttgaagcacctgcccctccccctgcctcccccgccccccacacaccaaagcttaactctgtctgcagtgatcccccacccaagagccaggcagtgtagcctaagagttaagagcatgggcgcttccctgagctggaatcccaattctgccagttcccagctgtgtgacgccgggcagcttatttcacctcactgctctcagcatcctccagtcacagtgctggcctcatggggttgcagtggggactaagtgaagatgcagagaagcacttggggacagtgtgtgtctagaatgtactgtgtacatggtagtcatcactgtaccacatcctcatctgcatcatgatatttttaaagtgtgatactctcgaacccgggcctcattcagcagcgtgtcatggtgatggatccaggttttgaagctggacagaccgaggcgtgattctcggccgtttactagctttgtgaccatgagatcaatatcctcatctgtgaaatgaaataagtgatatcagcctggccaagtataatctttgtgggggttaaatgagatggcacacttaagtcacttagcttggttcgagggctgtagtctgggctccgaaatgataacttatcattataaccttgatgtagccaaaaggtaattatttgtaggaagtgaaccaaatgacatgatatcagattttagatgataaaggaatgggagttaaatgttctgtccaattctaacaacccgatgatttctcaactcggtgtaaaagagttctttgtagtgcacggtcctccctccctccttcttccgtgtgactgttttcactgtcatccttggtatctgctagcagggcctgaaattaatgaatgacctagagttatgactgcatgctcagaaatcctgttcttctcctagggctgaaatctctttaatgatggagggaagcaggcagacgcgagtgtctcggccatacaagatcagcgaatcatcaaaggtctgtgaatgttcactcaccacctatgcaaattgcctaagaagtgtgatcctttttctgattcactcatttctaatcacagactgatttttttgtcattggtgttgtcagtctccttaatgacaagtaaaggtggaaacgggcaaggagcagaaattgtcataaaatcagacagtgggaagtatgagggatggtagagacgctatggccagatgtcttcatttttccatgtgacattccggagctttctttttgtgacaacttgactcattcgttaacccaaggaggtggatgggacaggaagaaaactgggattcccatgcctgcttgggggctcaaaaactccaaggacaggtccattgagaacccagccttctaccttagggtgagggcaacacaccgtgtacccggaccccaagggcctggagtcgtcttccctggtcatgattccctgcgacctaagagcaagtgagggcaagttccccagagccaggctactgggggagttctaattagaaatatgtagcctgttcccaccagccacattaaaatccaagagccagacccggctgctatactttccacaaactcctgtccccacagctgctgttggtaaagagtgggggagccattggtatgaggttcctggtaacctgtttccccgttataaatattcgtaatgccctctgttctttagaggtatcccttttggagattaaatcttatggttacctcagatcatggattctcaatgagtatgatattgccctgaagtgggagaaaattggttctcgggagggtggaaggaattttactccttttatgcataagacacaattatacatacagtacatgagcagacatacagtgcatctgtgatgttaagattttgctggggaggctattagggaaaaaaatcttaaaagccttcttgtggggcaataatgaaaaaagatacagaaacacttctttagatgaagggagctggcagcagcctatagagttgagaaaaagggggaaagagattctacagattctaaaagaaaaactggctgtcattttcaagagaggttggctctcttgagatatgacctcctgttctcacgtgagttccccaagaaggttcctgccaagcccagctttatcgattgtgaaaacccagagaggtctcgccgctcgctcacaagggctttgtttgggagcttagcttgggagacactgctgctttctaagtttgacagcactggaagtctttgtccattaatgccaggaccctgagtttgtttctgtctgaactgaatctcttaggactaggcttctgtatcactggatgatgtttctaactttttttttttttcgagacagggtcttgctctgtcacttaggttggagtacagtggtgcgatcatagctcactgcagcctctacctcctgggctcaagtgagcctcccacctcagcctcctgaggagctgggaatacaggtgcatgccaccatgcccagctaatttttgtatttttagtagagacggggtttcaccatgttggccaggatggtcttgatctcttgacctcgtgacccgccagccttggcctcccaaagtgctgggattacaggcgcgagccaccatgactggcctgtttctaactttttatttttaaaaagtgtacccattaatttctagacattaaacacacctatgttgccagcacccagatgggtaaaaaacagaatactaccaaaccctcccagttgttacactcaagatagtcgctgtcccaaccccaccgctgtggtttgatctgcttttgaactttgtctaaacgggatccgaggtcgggtactcttgtgtgtggtttcttttgtgcaacattgtgcctctgagcctcacccgtgttgctgcatgtagttggtagtggtaggttttgctttctcagcatgttggtgtcttcccactgtgtggccacagtgtctgttcacctgtctgccctaagatgtgttgctcagccaggcacagtggctcacgcctgtaatcccagcaccctgggaggccgaggcgggaggatctcgtaagctcggagtttgagaccagcttggacaacacggctaaacctcatctctacaaaagatacaaaaattagccgagcctggtggcatacacctgtagtcccagctcctcaggaggccgaggtgggaggctcacttgagcccaggaggtagaggttgcagtgagctatgatcgcaccactgtactccaacctaagtgacagagcgagaccctgtctcaaaaaaaaaaagtgttgttcctttttgatgctaaattctttttccacgtctaatacctggtacctgccgcctcctcccaggtgtaagcccccgacaacctgagtttctccctctacttggccttgcatctgattaaggcactgaaataggaaataaagaaatgaacaagactcatatcatcagagaatgctgtggattggagcttctaagttacctgaaatgcggaaactctgttaccaatgtccctttataattgggaaataggccaggcgcagtggctcacgcctggaatcctagaactttgggaggctgaggtggatggatcacttgaagtcaggagttcgaggccaacatggtgaaaccccgtctctactgatatatgtatatatgccgggagtggtggcacctgaggtcaggagtttaagaccagcctggccaaaatggcaaaaccctgtctctactaaaaagacaaaattagctgggcatggtggtacatgccggtagtcccagctactcaggaggctgaggcaggagaatcgcctgaacctgggaggcggaggttgcagtgagccgagatcgagccactgcactccagcctgggcaacagagggaggctctgtatccaaaaaaaaaaaaaaaaaaagggaactcgtgtgcctgtgtttttggaaagttgtctatgcagctgtgctaaaacaccagaagcagattgcagctgattgtacccgggtacagcatcactccagcccacttagagcagaaacccagttttggaaacaacactgctcttgccccctgccccagctcactggagctggtgtctcccctcggcagccgttcactggggctttccccagtcctgccccctgggctctttcccttttgacactgcagtctggggttgtgtgtatctccgtctaagcatggtagggccagcaccctcaccagcgtggagacagccagggtccccgggtggcagatagccgcctcatgccctcatatgcgtctctcaggccgctaagcctgtactatgacttgatcaccgccactgtagtactttttaatttccttccttcagctcacacccaagaggggcctccagtcaatgtctgtagaagcactgaccattcctgcataattagaagctgaggcctagcacggtggcttatacctgtaatcccagcacattgggaggctgaggcaggaggatcgtttgaactcaggagctgaagaccagcctgggcaatgtagtgagaccccatttctacaaaaaataaaagtaaaaaatagctggatatggtggcacacacctgtagtcccagctgccaaggaagctgaagtggagggattgcttgagactagttttgttttgttttgttttgttttgttttgttttgttttgttttgttttgttttgtttttgagatggcgttttgttcgtgttgcccaggctggagtgcagtggctcactgcaacctccgcctccggagtgcaagtgattctcctgcgtcagcctcctgagtagctaggatgacaggcgcccgccaccacaaccagctaattttgtatttttactagagacggggtttcaccatgttggtcaggctggtctcgaactcctgacctcaggtgacctgcccacctcggcctcccaaagtactgggattccaggcatgagccaccacgcccggctgagcctaggagtttcaggccgcagtgatctctgatctactgttgcatgccagcctgggaaacagagcaagaccctgtttctaaaaatgagaaaaaatttaaaagcccggtgtaggccagcctggctctctttgtgggtaaccaggataaatagagatctccacgtgtgtgacctgtgaactgaaaagccagcctggaatggaagagcgggagagcccgtcctctgaactcagaaggaaatgccaagtcggatctgtctggcatcctccacaggctgtgagaatgtggcctgctcctgtagcatggacagagaagttgctgttggaattgactggatgtggaaataccacagggaaataaagtgtctcaatgacaaacgcatgtatggcaacaaaaagaagatttgaaagggaagaaaaaaataaaacccactgctgtaggacacatgttaagaagcaacttttaagaattcagagcctgggcagtttagggagacgttgtccctgcaaattataaaaatcagacaggcgtggtagcgtgtgcctgtagtcccagttactcaggaggctaaggcggaagaatcacttgagcccaggaggtcaagggcgacatagtgagacctcgtctctacaaaaaaattttaaaattagccaggcatggtggcacacacccgtagtcccagctactcaggaggctgaggtgggagaatcacttgagcccaggaggtcaagggtgcagtgagccgagattgtgccactgcactccagcctgggcaacagagtgagaccctgtctcaaaaaaaaaaaaaaaaaagtcgaaccacatagctgctaatacctaatagccctcggtcagttttcttcctccaaccacatttcccctcttcaggctagtgcccagccagttcttcacctcagtcaccctggaatagaccagctatctatgtgatagttttcagttacctgtttctccctatgttgaattcatttatttatttatttagagacagggtttctttttgtcgtccaggctggagtgcagtggcacaatcatggctcactgcagcctcaagctcctgggcttgagcgatcctcctgcctcagcctcctgagcagctgggactacaggcgaatgccaccacgcccacctaatttttaaatattttgttaagacaggaatctcgctatgttgcccaggttggtctcgaacttcctggcctcaagtgattctcccgtctcagtctcacaaagcattgagattacaggcatgagccaccatgcctggcttgaattgttgtgttgtttggttttgggtttttttggtttgttttttgttttttcttgtttgttttgttttgtttgtttgttttttgttttttgagacggagttcttgctctgtctcccaggctggagtgtagtggtgtgctcttggctcactgcaacctccatctcctgggttcaagcaattctcctgcctcagcctcctgagtagctaggattacaggcacacgccaccatgcctggctaaattttgtatttttagtagagacagggtttcaccatgttggccaggctgctctcaaactccagtagccgggctgtcgtcccagctactcaggaggctgaggcaggagaatcacttgaacccgggaggcagaggttgcagtgagctgaggttgtgccactgcactccagcctgggcgacagagcaaggctctgtgtcaaaaaaaaaaaaagaaagaaagaaagaaagaagttatattaataagagaaggaaaaaaaaaaccacgatacacaggcatactcagaaacacctgtacttcctgcagtgccctctgatgcagcattttatttcctgttttcttcagtttcattttgttgaaaatgctggtcaggacccactgggttggaccagggccgagcaggctgctgcgccgtttctaatgtgtcttctctgtccaggtataccgctgggccgaccactcaagcacggtgctgcagcggctgaacgagcagcgtctccgcgggctcttctgcgacgtcgtcctggtggccgatgagcagcgtgtgccagcccatcgcaacctgctggccgtgtgcagcgactacttcaactccatgttcaccatcggcatgcgggaagctttccagaaggaggtggagctgatcggcgcctcctacattgggctcaaggccgtggtggacttcctgtacggcggggagctggtgctggatggcggcaacattgactacgtcctggagacggctcacctgctgcagatctggacggtggtagacttctgctgtgagtacctggagcaggaggtgagcgaggacaactacctgtacctgcaggagctggcctccatctacagcctcaagcggcttgatgccttcatcgatggcttcatcctgaaccacttcggcacgctgtcctttacgcccgacttcctgcagaacgtctccatgcagaagctgtgtgtctacctgagcagcagcgaggtgcagcgggagtgtgagcacgacctcctgcaggccgccctgcagtggctgacgcagcagcccgagcgcgaggcccacgcccgccaggtgctggagaacatccacttcccgctcatccccaagaacgacctgctgcaccgcgtcaagccggccgtgtgctcgctgctgcccaaggaggccaactgcgagggcttcatcgaggaggccgtgcgctaccacaacaacctggcggcccagcccgtcatgcagaccaagcgcacggcgctgcgcaccaaccaggagcgcctgctgtttgtgggcggcgaggtctccgagcggtgtctggagctcagtgacgacacctgctacctggacgccaagagcgagcagtgggtcaaagagacgccgctgcccgcccggcggagccaccactgtgtcgcggtgctggggggcttcatcttcatcgccggcggcagcttctcacgggacaacggaggggatgcggcctccaatcttctttataggtatgacccccgctgtaaacagtggatcaaggtgagattaaagccagattatttcttttctcttgaggactctctcggtttccttaacctagccttgactttccttacctctctggggccttgacaactatcctgcttctgaatgaggtgtgatgataaagtgacgagcagaataccccggggcctacatcctggacagggagagggagagccgacccaccccttcgaggggtccgtcatcgttcagagcagcactgcctggcggggctttctgtgcagatggaagggtctgtctgtacttcccgatacggtagccacagccgcatgtggcgactgagcacttgaaatgtggccagtgcgactgaagaagtcaattttcaattttatttcactttaaccgattgacgtgtaagtgtatgtggccgcacgaggcgtggctaccctattggacagtagcatgggtctagatgtttgatccatggttcaacatccccaggtcctggagtctctgtggggctcctctggaagcattttgggagatagtttaaggagaccactagtgctcacgcctggcccttgggcatgtattgtgtcctgattctgggaagagcgtgggccttgatgtcagacctgaggtctcatcccagcctggctaagtcatagctaggaaatttcagattcttgtcctctccacattttggattccccttctgggaatacgtgggggacagggagtgcagtagctcatgttgactggcaagcccctggcgtagggaaggtgtctcctttctgctgggagcgctctccagccactcggtccccgggacagtccatctcagcctctatactcacacctcagcgtcgcgcccagctcagtgctgttctcagctcaaaacccagtcagaatggactccagctgaccttttgattttactctcagaaatctgagactgccctccaaggtcgaagtgtcaccactggaaagggtccctggctttggagcctcctcccgaagcctggcagcagtggcagcagtgtgtttgccttggattcgtttaaaaaaagaaaaaaaaaagttggctcttctactttttgtgtgtgtgtgtgtgagacagagttgttctgtcacccaagctggagtgcagtggcacgatctcggctaattgcaacctctgcctcccaggttcaaacaattctggcgcctcaacctactgagtagctggaattacaggcgcctgccaccacgcccggctaatttttgtattttcagtagagacggggtttcaccatgttggccaggctggtctcgaactccgtgacctcaggtaatccacccaccttggcttcccaaagtgccaggattacaggcgtgagccaccgcgcccagcctcttctgtttaatttcctgtcgaatgccacgtcctgctctgttaacacggagtggcagagcagcactaactttacaaatctgatgtggggagaggaaagatgaatttttatttcataaagccactagatcagcaattctgacccctgtgaccacagagttcccatccacgcggctaacgacatgaccagagaagttcgggggttcagagcatctccatcccccttttggggactcagagcgtctccatcccacttttggggattcagagcatcttggtgaaacctcgggggctcagagctcccacctgaagaagccctctttattcaggtgcagttccctttcccaaacattctccggggttgtgcattccgcagacacatttgggaaccgcagcgccagatgttgatgctgtcccgggttcggggaagggaaggtacaggtatctcaactccacaggtggcctccatgaaccagcgccgtgtggatttctaccttgcctccatcgaagacatgctggtggccatcggcggccggaatgagaacggagcgctctcttcagtagagacgtacagtcccaagactgactcctggtcctatgtggccggcttgccaaggtgatctggggcttggtggaaggttctccaaatgggatgtttttaagggacatagttcagtccacgtgcctcactttctgggcatgttggcctccaattccaggaatgaaatcttccggcttgtcaggaagagtgggtacaccatgaggggcggagggcgtgacggtgcacagtccgggctccggtttcagacttagggcaagggtcagctctgccgccatgacggacatccctccatggctgagtgtgtgcagttgctgagcttcagagggtgaggcctgacctgaggatctccctgagcttgggcaggaggagttcaaagagatgggggtatatgtgctagatctaagcctcaggcatgggtcttcaccccgctcggcctttagttcctcatctgtagaggtagacgataatgatacccaccccacagcactgttgtgcagagcagatgcagtgctgcttgtgaaacctgcatccacatgcagggagtgccccagggtggccgcctcaccctcctcagtctcccctgcgttccgatgtgcatgtatcgagcatttattatctccatgggattagcagaaggtgcacaccattttttccaccagttccctgttgccgcacccagcagtgcactttctgaaccagtctttgctgtggaatacatccaggtgtccgtaagagttagaagtgtgtggggtaagcgctcgtatttttgtttttctgagagagagtctctctctgtcacccaggctggagtgcagtggcgcgatctcggctcactgcaatctctgcctcctgaactcaagcagttctcctgcctcagccttctgagtagctgggactgcaggcgcctgccaccacacccagctaagttttgtatttttggtagagacaggatttcatcatgttagccaggctggtcttgaactcctagcctcaagagatccacccacctcaccctcacaaagtgctgggattacaggcatgagccactgcacctggccatattgatcctttcttattcactaaaggccctggtttacatcagggttcccacttcctggcacagttgtgtgggttttgaggaacacaaagcaacatgaatccaccattacagcatcacgcagaatcatttcactgccctaaagcccactgtgtgcgtgctgtccatccctccctcccctctccccacagtcctggcagccactgattttgctgtctctatggttttaggcaaaacttttcccgagtgccagcacagttagaattggactgtatgtcgtatttcctctttgatgtgtgattcatcgggtgcatgtgtgcctgctagctcattgttctagtcgtttccagccattgtgaaaagggtgatggtcctgtgattattcccatttcccagatggggcaagggagactcagagagagtgaagctgggttctggcccaggcggcctgactgcaaagctgtccacttccccgccctgccctgccatttctttgctaatgacggctactgtctatagagtgttcatggggtgcccactccctatattcttaaatcctcatggccctctaagacggcaggctgttccccggctcggagggggtaagcctggcacagccctgagctctccctctgtctctgcccgtcgaccctgcaggttcacgtacggccacgcgggcaccatctacaaagacttcgtgtacatctcggggggccacgactaccaaattggcccctaccgcaagaacctgctatgctacgaccaccggacagacgtgtgggaggagcggcggcccatgaccacggcgcgcggctggcacagcatgtgcagcctgggtgacagcatctactccatcgggggcagcgatgacaacatcgagtccatggagcgcttcgacgtgctgggcgtggaggcctacagcccgcagtgcaaccagtggacccgcgtggcgccgctgctgcacgccaacagcgagtcgggcgtggcagtgtgggagggccgcatctacatcctgggcggctacagctgggagaacactgccttctccaagaccgtgcaggtgtacgaccgcgaggccgacaagtggagcaggggcgtcgacctgcccaaggccatcgctggcgggtccgcctgtgtctgcgccctggagccacggccagaggacaagaagaagaaaggcaaaggcaagaggcaccaggaccggggccagtgaccctagctgcgcctcttgggaccatcctcaccgtcacctcccagggctctgtagaccagcagcaacttcttagtattccggaaacattatgtacaacttagcagctttttttacttttatgattcttggtatttctatgatatcacagtaaccaattaaatactatctgtaactttacatatcttgcttgaataactaaccctgggcccaggcagtgagcaaccccttgtatcttcacaggtctttgccccgtgttatgattcctcatgggtccttgctgactgtccccctgagagtagctggcacgtgggtaacacagaaatttctgtagtgaagcttgggcctcaaagggttctcttaggccacctagtccaagcctccccaaacctggctgaacttttaagaatacagatgcgtgagccccgctcagaattatggaatccaaaaccaccaggaacggggaggaggtggtgcccagaagctgtattttaactagttcttggaattctgggtattagtcacatctgggaatcactggcaaggtccagtgtgtttgttttataaatgagtgcacagagaccacccatgagggtgagtgagtgagtgaccaggggccacgcagctcgctagactgtcagatgagacatgatgacttcccgctggggagctgttctccgtatcaggtgaacgctgtttctgaataattccgtctttcctcattggaaaccttcttgaattctaaaacgttacaggtaaccaaaaacgaaaaaaggtatgaagctctttatacatatttttttgtaatttgtgcatttttttccttttttttttttctgaacccactgtcttttatattactgatgtactgagctcccaaatctgtttatttctcaggaaagaaaaagtgagtgctatggaatttgccatcgttctctgtgactctatcttgaggcgctgttgaaagttcctgcacagaggagcacatgtggatccctgagaaggcagtggagggctccctaactcccacgccaggtcctgccccagttttctgcttctaagtagtttcgtgctgctgggcaaattctcgaacaagtccgtgtgttccctcatccaccccgcttagccacaggattagatggaataccctccaggctcctcccgggtgatagggccattcagcctctgagctgttcgtacccggatggcatccccttcaggatgtggagctggcctgcactgactcctgcaaacagttcctaaagcaggtgtcagggtcgcttgccctttaagagggctcttagctgcccgagtggatgagaaacgtgcagaactatgggaggataggagtgtgatgggttttaagcatgagccaaggaaggcatgaatgagctgtacctcacccagcatccgatggcagagatcagtaaacttcaagatgtgcttcatcttcaatcctagtctaacaccagtcttcctgcagacagttccgagagcaggtctcgatgtcacttgccctttaagagggctctcagctgctcgagtggatgaggatcaatgtgttaagattgatattagactaggaaaaaaatcttagttaactttaatttccatttcttctgcttctttgctgcccctcctttcccttcccttcagggtttactgtggttctcactggtctgtttatgtagccatccagaagagatgagagcattttggggactgaaagcttcaatagccaacttactgccctctgtggttagtgaggagggcagtctgcatgttcagctagctagttatttgcatgtgaagtccctggaggcttacaaactgttgagaggttctgcgaggcatacaaacaaacagaccaaaaggctggaaactctgcttggagctctgcagcattccggtgtatgaaaggttccgagaagtctcaacccagcatttccaaacttctttgagcctaaaagtcgtttgtctcatacctagtcccagacccccacaaaacatgttttgcagaacttctgccaactttgggatagcttacccccttcctattcgggaaaggttttattgcttgtagacccctcagaaggcagggtagggtgtacgtgggctgttctccccatctcagcctgggtcatgaacaaacgggcagttgtttggcctgaatctcggggcaagttggggagagcacatagaaagactctgtgagtgatttggggagtgggatagctttgaccttggagagaggagagccattggttttcagcctaagccagctcttttatgttttgcttctgggacttgtccctggaaatgtgtgagcttctggcctctattctgattttcttgtgcctcatgagttacatacgacgtcctgcgcttcatattttgtggtgtctctcctgatactatgaaggtggtttgtaattgacatggctttgaccctaatattactaaggttgggaccacccttttaaagggaggataaacaagtttcatcttgtgggtcaacttctaatatttgatggtggctacactgtgacaagaaaggtttttgagcttgttggggtcagtggatgggcacaagggcacccagtggtggtgcccgggccaggtttttgttacttgtctttttaagttgaaaattcaccctactgtgcatgaaaatggaactgaaaatggaagagaccatgcctgggcaacatggcaaaaccccatctctacaaaaaaattacaaaagattagccagggatggtggggcatgcagtagtcccagctgcttaggaggctgaggtgggagaatcacctgagcctgggaggttgaggctgcagtgagctatgaccacaccactgcactctaacctgggtgacggagtgagaccctgtctcaaaagaataaaatgttttttaactcagatgggcagagtttgggctgtgcttatgcagtggccatttgaaccgcacagtcacgaatgtggggttttaaactagagtgatgaaggcacaggtgcttgcaggctgccattttgagagggaaacagccacacatgtcatcatgttaaactttcagtgtttcaagctattctgcttgaattttgaagacacctggatctttttttttttttaacatttcaaaataagcatggcaggcttctattgaggtttggacttctctcatttctaaagaattagagttgtaacttcatattagttgtaagtttggggtttggtcctcacccaagttggaaagctgtttgcttaagacatagatgtattataataatagaagggagggagtagaaagctgatgaacccttgttacttatagcaaacttcctgctgttttaaatgcacagagattattttatcaactgtggttagcacgcaattggtatttttattgttctgccattttattgaggctatcaagtgggacttcagacctggctctgagcaggaccacacgtgtgtatttatattgagtgccctcactcatgataaggtgacttcatggagacccagaaactcaccctaaggggtgttcacctttgaggtgggcatccagatgctgaggggaagtggggtccatcctctgaggtccaggggcctactttgtgagctcagttgtgttcacctgtggttcagtgtacctcggcccctaagccaagtgatcgttcagtgacttgcagcaatgtgggaagtgaggggacccctgccacaccccccaccaccccctgtagagtcactgaccttcatccttcaccctggtcctccatggtgcagcagcatctcatgggccttgtggctgtcagagcccgtggttggaaccccgtccactggtcccaaacctggaggggcagctgcagatgaggtttagacctcctggtgtctccgtggattctgagtgcccaggaggggaggggagggggtggcatcctggcctctaggataaatgcctggagtatagggcagcgccacgggcacttggagaccctgtcctgcgcatctgccaagcctggcagtttttagagttttttgaaatgttttgatactttttgatacaatttgctaataactgttttgtagaatgcctgccggggttttccacctcatccctttcctccggccccttgatttgtgctggacaacaaatggcagcaccaggacctcgcctcatgtggctttgtcttggatcttgcccttctccatcgctgatgtgatacagctctagaatttcgtgaagttgcatgcaaagttgcatgcagcccgtgggtatgactgtctcaggcccccagctcatttgccaagaggaaaccttaacccccctgagagggtctgcgtttcttctagagctcctacctcagtggtgtgcacagagttggagacacctgagggctggtccacgtctcacctttgccatacgggtcatttcttgatcaaatatatgactggggtcctggtttactcccgcccaccctttcttttaaagtattcttaacatgaaatccacaaaagcggaaacaatgaaccattcttgcactttacagaatcattgtccttagctttagaggttgttaatttcttgtttttaacatgaacagaatgtgtggttctgaaggtgtgtgggggtctcaagaaattgtcctttggggccgggcgcagtggctcacgcctgtactcccagcactctgggaggccaagggggacggatcacctgaggtcaagagtttgagaccaccctgaccaacatggtgaaaccccgtctctactaaaatacaaaaattaggcagtcgtggtcgcctgtaatctcagctcttccggaggctgaggcaggagaatcgcttgaacccaggaggcagaggttgcagtgagccgaggttgcgccactgcactccagcctgggtgaccgagtaagactgtctcaaaaaaaaaaaaaaaaaagaaaagaaattgtcctttggttgccttagttaccagagttgaatgaatgtacacatttcggtagtgggggggcagagcggataaccccttccttgtctgtttcctttgagaaaggacactccaccttttcaaaggtacttaaagccatctttacagattgcttgtaatgtaaggaaagagtcatgtcctttggattgattgaggttaaatcatcaaccactagccccctttcaaaatcagcgagatatttgatgattaagtgattcattgggtatgttctggctactgatgttactgaaatctgcaatcgtgtatgttttttaatttgttgcttttgtatttgtaattttatgacatttcgaagtttctgtgtcttaactctttttaattaattttctgcacgttgcttttttctctttgtttttaattccatacagagtattcaattcttgaaacacattaaaataatttgcttgctagggtatggtttattttataattacattcctagtcttgtgtggttattgtaatgatgtctggtcctaatttctctgcccgtatgaaaaagaaccccttgcctgttgatcctaaatataatttggaaattaaccagacttccttttggtgttgtggggaggctgggacatttcaattctgctttcattgtgtttctaattactgtattttgccaggaatttcattcagttccttgattgcagggctaagtccccgtgacctgaaatgaaactatttgcttaaatgtgtgtcaactggggtaatttgattagaaaagaaacacagaaaccaagggaaacagcttatgacaagcagtgtgctatctttatcagaaaaaatgcaatcacaatactctaagaaccagctctgttttccttcgggcgctcccctgccttgctggggttttgcaaggccaccagcagagaagcccaggcacggttgtgcaccctttccttgtcccttcggcaggtcagcatcgggagggttggggaggggtgtctgcgcagccatcatacctgataaggtggttagaatttgcctctgagccagtgagccccaaacgggacccgctgcccggtgccgacttcctcacctgggttctttcgcatccgcttcagaagcatctcaggttaggttgatagtctcccgattttccaggtgaagaatccaaagctcaggttaattaccttaccccaactgtattgtcttccccgcccagccagtcagtcgttgccttggtttgagttctcttcaacgcagaaccttagacaaggacttggacacaggtagggcagagaggtggtccccgggaagccagaatgccatgaagaaggagagaaggcccacgagaaggtgctttattgccgagtaaccccaagccacggcttccaacaatatcatggcggaccactctgcaggttgactgggcttggctcagaggctctcccctgaggctcctgcacggtcacatggtcatggacaggtagtggctcttgaaggcgtgagtgagaacacacagctcctccagcatctccctctccctttcttctctctccctctctccctgccttctcatttccccttctcttccccgcccccccagtctctttctctctctctccttgttcactttggtctggctctctctggtctcttcacacggcctcacctagatttcttacatggcagccaaaggctcccagagcaaacgtcccaggtgtgatgagcagaggccacgtggcttctgccagaacctcctgggaagtcagggagtcagtttgctgcatttcacctcttgaggccatcagaaaactcccccaggttgctggccctgcgagaggtgtcagccgtgtcccgtccctgaccctggaaccctatctgcaaaccatgggaggagctgggtgtgatggctcacacctgtaattccagcacttttagagacctaggcaggaggattgcttgggcccaggagtctgagaccagccggggcaacatagggagacctctgactctacaaaaaaaaaaattttttttttttttttttgagacagagtcttgctctgtcacccaggctggaatacagtggcaggatctcggctcactacaacctccacctcctgggttcaagcgattctcctgtctcagcctcccgagtagctgagattacaggcatgcgccaccacacccagctaatttttgtatttttttagtagagatgggttttcaccatgttggccaggctggtcttgaactcctgacctcaggtgatctgctcatctcggctcccaaagtgttgggattacgggcgtgagccaccgtgcctggctttttttttttttttaacagggtcttgctctgttgcccaggctggagtacagtggcgtgatcttggctcactgcagcctcctaggttcaagtgactctcctgcctcagcctcccgagtagctgggactacaggcgtgtgccaccatgcccagctaattattattattttttttaatagagatggggtttcaccatgttggccagactggtctcgaactcctgacttcaggccatctgcccacctcggcctcccaaagtgctgggattacaggtgtgagccaccgtgcccagccaaaatttttttaaaaaaaattattcaagcatagtagctcacacctgtaatcccaacactttgggaggccaaggcaagaagatcacttgaagccaggatttcaagaccagcttgggtaacacagtgagacctgatttccacaaaaaaaatggaaaatcagccaggcatggtggtgcatcgttgtagttctagctgcttgggaggctgaggcaggaggattgcttgagcctgtgaggttcaggctgcagtgagctatgatcacaccactgcactccaggctgggctacagagcaagaccctgttctttaaaagaaaaaaaaaaaagccctcagtggaaggaaggtatgttcctaaggccactgcctcagacggcaggggtttgatgttgctgggcccgcatgctgtcggttggagaggagagcatttatggggcctgcgctgctcagtgagggctgctcccagaggccttggcgcacttcagctcctggctgccgtgcacacacagagccaaccaacagccaagcagggcctgagtggccatgggacggaagtgcagtgtgtgatggaggggacaccgtcagcacgtggccaccccgagcctgcactgggtgcccagcgccgctgtggctagaatcagcagagggccaagggcctgcactaggacaccaggggtagctgctcagcaggggcagatgttaacccaggtctgccagctaagaccacatttttttttgtttgagacagaatctcactctgtagcccatgctggagtgcagtggcacaatgtcagctcgttgcaacctccgcctcctgggttccagcgattctcctgcctcagcctcccgagtagctgggattataggtatgcaccaccacgcccagctaatttttgtatttttagtagagacagggcttccccatattggccaggctggtcttaaactcctgacctcaagtgatccgcctgcctcggcctcccgaaatgctgggattacaggcgtgagccaccgcgcctggccatattttttaacaactctaaaacaaccaccaccagagtctctgtatagggttcagaattgtgtccccaaaggctccactacaatgcaaatgtgtgagtggagaggttaaccagggaagccctggacttccacaaaaccatcggcagagatttctgttacctcacccaaagggaacagagaggcagtggataccggacagggcgtcttcgtggggtcaggggagggcggagggaggacccgcacagaccccatcgttgctacctgttggctgaggcctgggccactctctcaaggacctgcccacagccttaaatcaagaccgattagaactcactttcccgctggagcacgatagttctgaatgaactctgcgttcactctcaacacacgtactcatcaagcctccactctgtgccagacaggcgctgtactagatgctggggatcgggtggtggacaaagaagcaggctgcctgcccccaggggcagaaacagaccaacaagatacataggtcaggtggggataagtgatatgaatgtactaaaacccgctgtgttgtatacttttttttttttttttttttgagacagagtctccctctgtcgcccagtctggagtgcagtagcacgatctctgctcactgcaacctccacctctcaggttcaagtgattctcatgcctcagcctcccgagtagctgggattacaggcaccggacaccacacctggctaatttttgtatttttagtagagacggggtttcaccatgttggccaggatggtctcgaactcctgatctcaagtgatccacccccttggcctcccaaagtgctggacaggcgtgagccatagtgcctggcctacattgtatactttcaatgtatacaagtcagtggattttagtacattagtttgtgaatctcaaactacaactttttttaaaaagctctgcaggggaaggatgtgcagcaagttagaggagcaaagtgctgaaaatgtgagaaatgggagctggcgcatcacagaaggctgtgagctcgggaaggaggtgatctgattcgttttcaaaggagagcttcggcagctgctgggtgtgtgtttgtgtgtgtccaagtctatgaattttaacaaataaccaattattcacaaaaatcaaagcccattaatggatgcatggataaacacaatctggtctgtccctgcaacggactattatccagtccgtaatacagaattaaattctgatccacgctacaacatggatgaaccttggaaacgtgatgctgagtgaaagaagccagacacaaaaggccacatgttgtatgattccatttctgtgaaatgtccagaattcgtcagaataggcaaattcatagagacaaagtagattcgtggatgcttagggctggggtggggacgaggaaggatggggagcaacagctcaagggcacggtatttatctttgtggtgatgaaaatgttctaaaactgggtgatggtcgcacgcatctgtgactgtacaaaaaatggaatcgtacactttgaatgggtgaaatgtatggtatgtgaatgatatctcaagttgtttaaaatattagagcaatatttccctccattctcggagttctgtgtattggtctcctagacagtacaggttgagaggcagaattcaacctccctgcttagattctaaaacgggttaaaacggtgagactagaggcaacattcatctcaagtctgcgtgagagcagagctcagggcatcctccagggggcgcgctagagcagcagtcctgaaaatgcggtccctagaccagcagcggccgtgacagtgggaacttagcaatgcaaactgccaggtccacccccagaccagctgaatcagccactcctgggctgggggcctgccaatgcgtgtgtttacaatgtttacaagccctcccagtgattcttttttttttttttttttttgagacggagtcttgccctgttgcccaggctggagtgcggtggcgtgatttctgctccctgcaacctccacctccacctcccaggttcaagcgattctcctgcttcagccttccaagtagctgggattacaggcgtgcgccaccgcgcccagccaatttttgtatttttagtagagacgtggaggggaggggtgggtgaggtgggattcaccaagttggccaggctggtcttgaactcctgacctcaagtgatccacccaccttggcctcccagagtgctgggattacaggcgcgagccaccgtgcctggccctctcctggtgattctgatgcctgctcaagtcggagaaccactgttctccaaaggtatctgtctccattctccacccacagacctacctaagctatgagtccctgcccatagccaacagctgtgcctggcttgctccggccgaaacctgaaccaaggggcagctttcagattaagcacagccgggtctgaatcttctgccttgggaagtctgggaaaggccttggagtcagcctctgcaggggcatgcacctgttgcctccctgagaaagtcacctcctctgtgcccttcctgttgatggcagcaggaaggctgtggcatggcccaaccctttaactggtgtccagcatccgctggctgtgtgctcagagcatgctcagagcctcatgctctgttcggatgggatccttttaccaggtatgctgcaatagtgtgattcatccccccaggggccccagccccactcttgcaggcatctaaaggtgctaaaaatacataactcctaagtgcggttctgtatttctgactgtaccagtgttgtgggcctttttatgctccaagctgaaattcaagaggcctggattccaatataaggcccatgattaatgggcctccagcaaggcctcactcagcatctcctgtatttagatggggcctaaagcatgtctctgtgatgtggaccaagcacggggctataagtcagggagtgtgagttgcagccttggctctgtcacgtgcacctgggccagggcttcatcttgttcaatttcagttcctcacactatgggataagatggttggagattagcgctcctctgggtgtgatctgcagagccctggtctgcctaaaggacctgcctgaggtcctttaagcagctgcctaaaggagtttgtggtcaggaaacatttggggagctctggagatacattccccctctgggagactcaacattagagaacacgttcatatttcttttattttcttttttctttctttttcagatggagtcctgctctgtcacccaggttagagtgcactgcaacctccacctcctgggttcaagtgattctcctgcctcaacctcccgagtagctgggactataggcgcctgccaccatgccaggctaatttttgtatttttagtagagacgagatttcaccatgttggccaggctggtctcaaactcccgacctcaagtgatcggccctcctcggcctcccaaagtgctgggattacaggtgtgagccacggagcccagcccaaggcctggcttttgattttgcagatctaaaatcttgatttggttcatgcatctgtagtggttaagtttgcttgtaacttggctgggccgtggcacacggctgtgtgtttgaacattattgtagatgtttctgtgaaagtgtttttggatgggattaacatttaaactgatggattttgagattgccctccagtatgtgggtgggccttttccaatcggttgtaggccgtaagagaataaactctgagtttcctgagcaagagggagcagcagacagccttcagacatcagctgcaacatcagctcttccctgggtctccagcctgccagctgacttaaagtcattctctctgtctctccctctcactgtgtgtgtgcatgtgtgtgtgcgcgcatctggccatggtggcctgtgcctatagtcctagctactccggaggctgaggtggaaggatcgcttgagcccaggagttgaaggctatagtgagctgtgattgagccactgcactccagcttgtacgacggagccttgctccatctctcaactatctatctatctgtatataaacacgcacacaattgatccttgaataatatgcgtatgaactgcgtggtccacttttacacgaattttcttttgtttctgtcgcccctgagacagcaaaaccaacccctcctcttccttcttctcctcagtctatgcaacatgaaggcaaccaagatgaagaccttcgtgatgatccatttctacttaatgaataataaatatattttctctttctttttttttaagagatagagtcaggctggagtgcagtggtgtaatcacagctcactgtagctgcaaactcctaggctcaagtgatcctcccacctcagccacccgagtacctgggactacaggcacacaccatcacacctggctaattttaaaacatttttgtagagatggggtctcactatgttgcccagactggtctcagactcctggactcaagcgatcctcccaccctggccttccaaagcgttgggattacaggcatgagccaccgtgccttatgattttcttaataatgtttcttttctctgggtcactttattgtaagaatacagtatataatacatgtcacatataaaacgtgttaatcgactgtttatgttattggttagacttctggtcaacagtaggctattagtagttaagttttgggggagccaaaagtcatactaaaatttttgactgtgcagggggtcagtgccccaacccctgcatcgttcaagagttgtccacgtgcacacgcatgcgcgcacacacacacacacacaaacacaggcatgcacacacatgcacacacatgcaaacacacaggcatgcacgcacacacacgcatgcacacacgcacacatgcacacacattttattggtctgtttctctggagaaatctgactagtacaacttccacagaacagactcagggaacacacaacaggaactggaccgaaccctagaagacagcagtgagggcagctcctcccaagaggcagggctttgcctcacatacctgctcacccactttacatggagagagaagtgagttgagattagaacatatatatacatgtacatatacatatgtacatgcatatgcatacacacaaaatacacacatatacatataatacacatgcacatatatgtatgcatacatacatatatacatacacgtgcacatatgcatatacatacacatgcatgcacatgcacatatataaatgcatgcacacatacacatatccatatccatacacatatccatacacatacacatatgcaggcacatatacataaagccatgcacacatacacatatgcatacagttacacgtaaatatgtacatagatccatgggcagggccaatggcttttctgcttggtcagaaacctggaagaaaaacagtgtctaggacagggaggactggagaagagacatgtggatgggctcactcacatgggcccggagtgtgaagatctttgaatccgtgttaatgttcactggagaacattcaccatgcaagaagcactcagcgactaagtaagcaggatgattttgcccatagatgtcagccagcctctgaaattaccaccccactgctggtacagtgggcacatgaacagaatagccgaggtagcagggatgggggctgtgcccgggctcagcagcacacgcaccacggctcacctaactgctcccacccccaacacagagcaatgctgagctgcccatatggcaccattcctcgagacccacctgccactcggtggccagttggttccactgggccccttctaccctgtaaggctcagcagatcatgttgccccgaactgacactgttccaggtatagtttgcccttgcccacagggtctctgcagaacctctagctgatggctttcacagcgtttaattcactgacgtgggatcctgcgtaacaacaccttgggacaagagacccactttacagaagagaaggtatggccgggtgctgctggctcacacctacaatcccagcacttgggaggctgaggcaggaggatcccttgagcccagtctgggctgagttcaagaccagcctgggcaacatggtgaaaccctgtctatacaggaaaaaaaaaaaaaaaaaaaaagcagcagcagaagaggaggaggagataagaaggtgatcatataaccttgggattcccggtcccatcactctaccgcctagaagctgccagtgtgataaggtgatagaaagatcttttgaaagcacagtaaacgtggcagcctagagacattccaacttgtacaacagatcaaagccccgtctctaaactatctgtctatatataaacacacacacaactgaaccttaaacagtgtggttgtgaactgtgtggtctacttttacacgaattttcttttgtttctgagactttggggcaccacctcctgaaatgtaacataccccctaaatcaacgaccaacatagcatgcggtgttcctaaaatggagaaagcattagtctaggaacaaagggatggccggaggtgcggccctgctgagtgtgttctcgatgaccacgtaggaggtgtgcctcccactcctgccaccttcgctctggaggtctaaagatgcagtttctccgaagagttcatgtttccaccaagagatgcagagaggtcccattcaacttgaagctctgcttcctcctggtcacttctggctcctcatggaagcagtctgcaggctgggatgcagcagcaggaggcagcagggctgctattacacacagaacggggggggctctctcagacctcctctgcttagcttccgtagagattgcaacagcagcagccacagcctgcaaaaggcatgatggccaggggttcagaccctccaaggatgagaatctgagtcaccccccagttccaggttaccctgctgggaccaacagagggcctgggtcagggtgaggggaccctagtagaggatggagaagaatatcagctgtggcccccagacagctgggttggttccatgaactttctttcctctagtaaatttcccagccgggatcctggagggactgtgtatttgtttcccggggctgccataacaaagcatgacagactgggaggcttaaacaacggaaacctattttctcacatttctggagcctggatgtgtgagatcaaggtcggcgtggttggtttctctccttggcttgcagatggccgtcttctccccgtgtcctcacgtggtcttccctctgtgtgtgtctgtgtcctaatcgcctcttcttgtaaggacaccggttgtattggattagggctcatgtgacctcattctcatttaatcacctccttaaagaccctatgttcaaatgcaggcacatttctgaggtcctgggagttagaacttcatttgaaatgtgcagggaacaaaaaattcagctcataacaagctgtttccatgtaggttgaacttagtgtattaaacaagtgatctaacagtgcaaggggtggacagtacagaacccaggggcatcgtccctgcccccacccttcaagactgcagtgcatggccaggcacggtggcttatgcctgtaatcctggcactttgggaggctgaagtgcgcagatcatttgaggtcaggagttcgagaccagcctggccaacatggtgaaaccccgtctctactaaaaatacaaaaattagccgggcatggcggctcatgcctgtagtccgagcaactcgggaggctgaggcacaagcatcgcttgaacccaggaggcagaggttgcagtgaaccgagattgtgccactgcactccggcctgggcaacagagcgagactggctccaggaaaaaaaaaaaaaaaaaaaaaaagactgcagtgctcattctcccagctgccgggaacattgcccctgacagtttgtggctgagtctctcactgggcatttcccctggccaaaggaactgccttacccagggatgccctcctcccagggaaagctcccatgccatgtctggccaacacgggagttcagagctcagcctcttttctccaatatgtgacacctctgagggccatcccaggttcagggctgtccataaaacctcagtttaccttctccctctgctcaatcctgttccccgcagccctggcaggtgttgattctcagagcacattccccaaccaattccctgcatgcaatctcatagtctgtttttgggagatacaattgctatgggtctaaaagtttgtgtcctcccccaaattcctaggttgaaatcctaacccccgaggtgatggtgtaaagaggtggagcctttgccaggtgattagggcatgagactggagccctcatcatgggattagtgcccttataagaaaggcctgagggccgggcacagtggctcaagcctgtaatcccagcactttgggaggccgaggtgggaggatggcttgagcccaggagtttgagaccaacttgggcaatatagcaagaccccatttctaaaaaaaaaaaaaaaaactatatatatatatatagttttttttttaattagttgggtgtggctgggtgcggtagctcacgcctgtaatcccagcactttgggaggccgaggcaggcagatcacctgaggtcaggagtttgagaccagcctggccaacatggtgaaaccccatctctactaaaaatacaaaaattagccaggtatggtggcaggtgcctataatcccagctactcaggagcctgaggcaggaggatcacttgaacccgggaggcagaggttgcagtgagctgagatttcgccactgcactccagcctaggcaacaagagggaaattctgactcaaaaaaaaaaaaaattagttgggtgtggtggcacatgcccgcagtcccagtagtcccagctactcgggagccagagactggaggattgcttgagcctgggaggccagggctgcagtgagccgtgtgtgcgcccctgcactccagcctgggcaacagagcaagactttctcactttctctctctttctctctctctctctctgtatatatatgcctgagagagaccccttaacctccaaccatgtgagcacatagaaagatggagccatctatgaaccagaaagccctcacctgaatttcctggagccttgatcttggacttccagcctccagagctgtgagtaataaatttctgttgtttataagctactcagcttatggcgttttgttgcagacaccagtctagggcaaatccttgtgcactgaagtcactagggtcaaattctcactattggctgtgcacaaaagccagcacatacgcataaaccgagactcatgtgcagggctttatcccaactttagccgtcaccaggcaggaaaaggaaagtcccaggctgttattagggaaaggcaaatgaaaccacaataagagaccacgtcacagggactaggagggctagaaccaaagatagataatagcaagtgttggtgaggatgtggagaaattggaacccgtctgctctgttcatcggaatgtaatgggaacagtggtgcggccgctgggggagacagtctggcagctcctcaaaaaggccaacaatgcgttaccctaccacccagttattccattcctagggatatgctcaagggaaatgaaaatgcatgtccacaaaaaaactgtacacaaatgttcataacagcattattcacagtagacaaaagtgggagaaaacaaaatgtccatcaatttgatgaatagacaacaaaaatgtggtctctccatacaataaaatattattgcatcatgagaaggaaggaagttctgatacacgctacaaaccaggaaccttggaagtatcatactaagcgaaagaagccagacacaaaagaacacatattgtgtgactccagttgtatgaaatgtccagaacaggtaaatccatagagacagaaagtagatttgtggctgccaggggctgggagatggaagaaaggggagtgactgttaatgggtgcagagttttatggggagatgatgacaatgttttggaattagatagtactgatggttgaacaattctgtgaatatactaaaagctactgaatatatactctaaaaggctgagcatgcagtctttatggtatgcgaattatatctcaataaatttggaagctcagagaatgtgcaggacattgttttgctgacagagcatcattttctctgacatctcgaggcaggattcacacttttactggtggaatttcatttactctgtggacccaagcccaggcaatcaaagcattaaatcttcctagcaggaagaatggtctagacctggacataactcaggtcagtccaaatgagcctttgttttgggtcatctgtttgtatagttggtgaaagaaatgctgtttccgctggggatgccacaaaaaggatgttgttagactgcttctagcactatctaatcaccatgagagaagagttggcctaagaatggagctaacccaaaagaaagcaaggatgtaagaaggagaaagtaacacggagtcccattgacatcatttgaaccctggatccagccatgcctgaaaccctagacttttaggtccaacagatgataacatttctttttccttaccctagagatgcacttctgtcatttgcaagcaaaagtccaatctagactatttcatttaaatgtttttgaagcatattgtcagactcccagaacagttaaaccaactcatacttccaccagagcatgcatgtccccacagttgaagcagacattgagtcctgtagctctattataggttccaaacagacttccacaaagggtcctccatctcagaatcctcaatttgttttgttttgttttgagatagggtcacctctgtcacccaggctggagtgcagtggcacgatcatagctcactacaacctcaagctcctaggctcaagtgatcctcctacctcaggctcctgagtagctgagcccacaggcatgaattgccacacctggctatttttgtactttttgtagaggtggagtctcaccatgttgcccatggctggtctcaatcctcaattttagaactggacaagagtgcaaggaatcatgtatatgatggttaatttcacttgtcaacttgactgaatcaaggtgccgaaatgtctggacacagcttactctggtgtgtctgtgagggcatttctggacaagaggaacacctgagtcagtggactctggaaagcagactgtcctcctaatgtgggtggacctcatccaatcagtgggaggcctaaatagaacaaaagggagaattctctctccccacctgtctttgaggtgggacattggtcttctctcgcacttggactgtaacttacatcatctgctctcctggttttcgagcctttagactggaacaggaactacaccacctgctttcctggctctccagcttgcagagggcagatcctggaacttctcagcctctgtaatcatgtgagccaattccttacagtcaatctctctctctctctctttttttttttttttttgagacagagtcttgctctgtcgcccagactggcgtacagtggtaccgtcacatgggctcactacggcctcatccttgtgagctcaagtgatcctcccacctcggccttccgagtagctgggactataggcgtgcaccaccacacctggctaatttttaaacatttttttttgtaaagatggaggactcactgtgttgcctaggctggtctcaaactcctgggctcaagcaatcctcctttccttggtctcccaatgtgctgggattataggcatgacccccgcctttctatacatttatctcctaatggttctgtttctctggagaaccctgactaatataatgtgataacttgaacacagagaagaccttgtgcataaagatgttcattaatatttataagagcaaacaatttgaaataatttatatgcatgaaacttgtacagaacagaatatggtacaattgcttaaaataatgtttatgagggttttttcattttaatcaaatggaaaaattattgcacttgtgccatagaaaggccagaatacaaaaatcagatatcctgtaataataataataacactttcattttcctgagcaggaacgaagtgccagacactgccttgggtatattatgtgcatcattgaactaaatgacattctcagcattacattcaaaatatcaagaagaaagatttggaaattataccaaaaagccaacagtgtttgtcttttaaaataaatcggtttttttcccttctttccaccttgttttaccctctttaccacactgagtgtgtattgcttctatatttggaaagaattaaaacaaactgaattttttaaagtaagatggagcctcagtcccatgcctcaacccttcctccaatttgtacaagatcatggtactcatggtggcagccgatgacaggtggtagcatgcccctccccttctcccaggaggctgtcatccctagaatcttcccatgaagttaaatttaaaattattgtataactaatgtatcagtagtgctaccagcagcaacatgatcttatatgcaaatcggttttatttaatcacagcacaagcccagcatagtaattacctatcaagtggtaattacgcttttattatttttttaaactttcattaaaagaaagcattttaaattggaaagaaacaatccatgtcacaagccagttagtcaaaaaatgtttgtctgtttggaggtcccagaatgaacatcgtaatatccacccctgattaaacacttaccatgtagcaggcatctcgaaaagcacttcgcatttcatatctcaatatgtattcctcgctactgtgctgggaggtgcgtcttgttatcacaaaattactgataaagaaacagagactcagagaaatttcaatagcttgtcaagcttaatagaatttaaggcgaggagcatttaacacagaagccaggggaggtcggcagcagtgactcatgcctgcaatcacagcaccttgggaggctgaggcaggaggatcgcttgagcccaggagttcaacaccagcctgggcaacataatgacaccttatctccaataaataaataaataaataaaatattagctggttgtggtggcatatgcctgtagtctcagctatggggaggaggctgaggtgggaggattgcttgaccccaggaggtcaaggctgcagtgagctacgatcacaccactgcactccagccagggggacacatgagaccctgtctcaaaattatagatagatagatagatagatagatagatagatagatagatagatagataatcaatctgactttgtgatgaagcgatgcaatataggatgtataaaagggaagaatgatctgatagtcatccgtggggtgcctcagaggctctttgacttgcgtatttaaagttcctaaaggaagccaggggattttacccactgtgctgctttgcctggaggggtgtggacttcacctccctgctatgctttccacaaaggcatgcagatgcaaatgaaggaggagagaaaggcatgcccgcagtgcccgcagaagagcagtccttcccctggctgggggtcatttgcgtgtctctctgtctcctatcaggctgagagcagtgagagatgaggttctccgtggagttaggcactcctcctagactgcccctttctacccaatccaacaaatcagaaatataccactgggataacatttcctgtctctcaccattcatatcatttggcagattccgtgaccttaatatctttccatgccttctactgttactgatctccactgcagcatcctgttctggatggcttcattgggaagtctatgtattttctctagcttcaggcatagctgtatccaggagttcacaaagtatctccagcctggattcaggatttcaggtacaggctcttaactagctacgaaccttcccatctttttgtgcttctctaacctcaccatcttcccacccttagttccgtctggtttacatcccaacggatgtaaacagagaggtctttctaaaatgaaaatctgatcaccattcctgtgccaaagccatcagtggaaagatgacagttgaacttcctgccttggcatgatctgccatcagcctagctcctcaatctcactatcctccatttcccccatgtgccatataaagaaaatttataccaaacttgggatactgaatgccctttagatgtcataccaaattattgcattgtcttcaagtcagcccaacagtcatctgactctcaaaggcagagcttctccaacttgagtgcacgtcaggatccctggaggacgtgctaaacccggagtactggcctgctcctggtgtatccgattcagtgggcctgaagtcagccccagtatttacctttctcatagcccttgggggctaacgctgccggtccagggaccacactttaagaaccacagctctgagatcttctggggcaagggttagaaagcttcctgaaaagggtcagatggtcaagattttagacttcgtgggcaagacggtttctgttgcagtgactcaactctgctatggtagtgaaaaagcagctatgggcaatatataaacagatgggtatgcctgtgttctaaccttatttataataacaggtagagggccagatttggcccacaggccatagtactttgctgctctagagaaatgtaattttttttgagacagagtcttgctctgttgcctagtctggagtacagtggcgcgatctcggctcactgcagcctctgcctcctgggttcaaacgactttcctgcctcagcctccctagtagctgagattacagggacccactaccacgcccggctaatttttgtactcttagtagaggtggggttttgccatattggccaggctggtctcaaactcctaacctcaggtgatctgcccactttggcctcccaaagtgctgggatcacaggcatgaggcatcatgcccagccaagaaatgtaattttttaaacttactatttacttttaggacctagactctgcaaagttagatgttagctcatagaatattttttgttccatacagatggaaagtatttccatctgaaagaaaagataatttccaatgttgtcattttattgccttgtagggcgttaaccttcttgtgttatacttcacaattttattccagcattctttctttcattaactgtacagaccacctctgacttacaacagtttgacttaacaaatttttgaatttacgatagatttattggggcattaaattcatttttgacttaagatattttcaacttaccattggctttttggaacataaccctattgtaagtcaaggagcatgtgtgtatacttcagtctcttgtatcttcctttggagcaacttgactgccctggtggggctctcattaatgaggtaagtgaatctctgtcatgcgttcactacatattggcatgaaattttttttttttgagtcagggtctcactctgttgcccaggctggagtgcgatggtgtgatcatggctcactgtagcctcaaccttccaggctcaagggatcctcctacctcagccgccccagtagctgggaccacaggtgcataccaccatacccagctaacttttaaattttttgtagagaaaaggttttgctatgttgctcagtctggtcttgaactcctgggctcaagcaattctcctacctcggcttctcaaaatgctgggattacaagcgtgagccacagtgacctggcaacaaccaccatttattatctgtcacaatattgtgggttggctaggctcaactgggcagttcttttctctggagacagctggggttgccatcatctggggtcgtgaccaggctaagcaccttagttctcctctacatggcctctccatgcagctgagggctgggttccacgagggaacatcctgagcacacaagacaaaggcccagccctggagttgacacagcatcacctccactgcacgctattggtcaaagcaagtcacagggctggctcagcttctaggggacagaaaatagactccacctctcaatgccaagagtgtcagagaacaggcagccacttctaatctctcagagacagatcagggctgttaaactcaggaagaaatcttcaaggtgaccttgagtggattgggatcataatcccaaaagacacaatccagaatgccataatcccaaatgttgaaatcccagaagatcaaaatcttgaaaatatcattctgaaaaaaatcataaaacattaggccaggcgcggtggctcctgactgtaatcccagcactttgggaggccgaggttggcagatcacctgaggtcaggagttcgagaccagcctgaccaatatgatgaaaccccgtcgctactaaaaatacaaaaaattaggccgggcatggtcgcaggtgcctgtaatttcagctactagggaggctgaggtgggagaataacttgaacccgggaggcagaggttgcagtgtggcgagattgcaccactgcacttcagcctgggtgacagagagagactctgtctacaaaaaaaaaaaaaaaaaaaaaaaaaaaaaaaaaaattgtaggatatcacacttactaggatgttgctagaatccaggaaagattcaaggtgtctgtcactagctgggtaatctcttcaatctggaaaacctagtttgtcatggggtggggaaagggaatctctactcaggagaaaacataaagatggtttttgagggtatgaagcccattcgcctccttgtccagagactttagctaccattcagatgttctctggggcctcagctcatgattaattcatcaagtattggttgagctctcgtcacatgtcagggatcatgccttgtgttgaggcttacaatggaaagcaagaactacaagagcaagatcatgatcgttagagcagaaccaggaaaccctgtggctttgactcaccagcatgcaacgggaccaaaaaaaaaaaaaaaattcatctcctgtccaatttcatcagcattaagtggcctcctttctgaagagggacagctgttgggaaacccttgcggggtaagatgtaaaatgctcaccatccaccaagtcattgcttatttacttacttaatataataaaatcggggaaagatctgttaagaaataaacacttcacggcagtgctgtcaatgatggtgagatgctggaaacaagctacctgtctaacagtatgtgctgagagcaagcgtgtatatatgtgcattgatatggtttagctgtgtccccacccaaatctcatcttgaattgtagctcccataatccgcatgtgtcgtgggagggatgcagtgggaggtgattgaatcatgggggtaggtttttcctgtgctgttctcatcacagtgaataagtttcctgagatctgatggttttataaggggcagttcccctgcacatgctctcttgcctgccaccatgtaagatgtgcctttgcttctccttcaccttccgccatgcttatgaggcctccccagccatgtggaactgtgagtccattaaacctgttttttttttcttccttccttcctttcttttttttgagatggcatctcactctgttgccaaggctggagtgcagtggcacgatcttggcttactgcaacctctgcctcccgggttcaagcgattctcctgcctcagtctcccgagtagctgggattacaggtgtgtgccaccatgatgcctggctaatttttgtgtttttagtagagacagagtttcgccattttggccaggctggtctcgaactcctgacctcaggtgatcctcccacctcagcctcccaaagtgctgggattagaggcatgagccatcacacccagtctaaacttctttttcttaataaagtacccagtcttaggtatttcttcatagcagtacgaaaatggactaaaacatgcatacagaatctgaatacgtccacatttatatacatactgtgtacattcttagttgaccggcggagattctagtaacatcctactaagtgcaatatcctactgtttcgcccttatccctcccaggctactcttcacacggcagccagagagatcttgttcaaacctacgtctgctcctgtccctcctcattccttagtttacaggctaatccatgttccccccatgtgccttccctccctcctagggcaggttgctgagctgagtttgatgttggtgtttaaggataaacaggtttcagataacacgtctgcacagagggagccataattcagggctcagacggaccacctgaagtctgattcagctctggaggaaaaattgtctgtgctggttttatggcgtgacgtagagacagagccaaacaggaaagaaggcacgtgacaatggagacagatggaagcagtgactcgacaacacaggaattttgttcaacttaccctcacatctttggcatctaatatttccatacagtaggagctcaccacactttttaatttttatttatttatttttatgagatggcctctcgccccgttacccagactggagtgtagtggtgtgatctcagctcactgcaacctccacctcctgggttcaagtgattctcatgcctcagactcctgagtagctgggattacaggcatgcaccaccatacccagctaattttttgtatttttagtagagacagggtttcaccatgttggtcaggctggtcttgaactcctgatctcaagtgatctgcccacttcagcctcccaaagtgctgggattacaggcatgagtccccactcctggcccgttcaccacgcttttgtcaaataaataaatacaggagaaaatgaatgagtgatgcatataaagggtttaatctgagtgcttgacacacggtgctcagtaaatggttcacaatattatgtgaccagaccactgcccaattctccagcgccatctctgccaagactccctcactctcccaggaaactcagctgcgaatccaccctggcaccttggaagtgctgggtgaactatcccggtttttcctggatcacccttctctccattcctcctggatcacccttctctccattcctctatgccacaccctttgaagggacccttggtatcagcttcctggggtagctttgctgatgcttctccatgtacctcagtttaccctaccatagctgatgcacaccgtctcatttaatcctgacagtgacctgtgtgaaaggcatcattacccccatattacaaatgaagtaaaaggtttccaggagcagccttgcccacagcttcctgccgctaagcgggagagctgggaactgagcttggaccctcggactccacagtctattttgtagattcccatcacattcatgttaacaacaagctttaaaaaatcaaacaatcagtgtttgtgctagaatgctggggtcacagattatttttttcttcaaaattgtataattctgttaaaataatcaatcttgcctttagagtagaaaaatatactttttttgtaggctaaagaagattgaaagaatgcttttgttctctgggtggtctggcaaagaagaaaaaacctacatcacaggaaaattgatgaaacagaagaaattcttggatgagtgggaaaaggaagggtttgtaagggtgactggagcaagaaaaatgaaggagcattaaataataatgtcacccacttcaactcattgataatatgaacacattgcagccaatgtatcatttcacatgactgaagttgccaccaccttcatcatctccgttgatctcagtgtctactcaacgaagcatgcaggacaaacagggctttcttccttatgtaggaaccaagttacagaaaattagtgatttctccaaggtcttaagagtgacttggggggctgaattaagactggtacccaggccaggcatagtgactcatgcctgtaatcccagcactttgggaggcctaggtaggtggatcacttgagcccaggagttcaagaccagcggggcaacatagggagaccctgtctccacaaaaagtaaacaaaattaactgggtgtggttctgtgtacctgtagtctcagttgctctggaggttgaggcacgagaattgcttgagcccaggaggcggagattgcagtgagctgagatggcgccactgcactccagcctgggtgacagagtgagaccctatctaaaaaaacaaaaaggaagaatggatcaataatgtgtcttttatttttttcttattgcctttctttagcagttttttctcctggccaaagtctttgaagatgatggtgcctaaatttggcccactgtctggggaggggcagagacacgggaaatgagtataatgtttaagtgaggaactgcattatatagatcctcacttaagaagagacgtcagctatgtgagttctgccaccaaaaataaaagagtaaaagaattagaagaaaaaaaaagtgggtgttctagtccattcaacatgctatcaacgagcaaagagatccgagtgaggctcagatgagaggcagagctctgtgctccctccacgggtcctccctccctcctagggcagattgctgagctgactttgatgttggtgtttaatgataaacagatttcagataacacggcccgcagagcaagctgtaattcagggctccaatggaccacctgaaatttgatccagctttggaggaaaaattgtctgtgttggttttattacatgacagagacagagccaaacagaaaagaaggcaggtgatgactgaggcagagactggagccatgatgctaccagctgaggatcaccaagggtggccggctgcaccagaagctgggagacgggcctgcagcagcgtcctccttggagcctccggagggagcatggccgtgccaacacctgggttttggactctgacctccagagctgtgagaatacatttgtgttgctttaagccttccagtttgtggttgttacagcagccacaggaaacagcgactaggttggttgttttctgggacatacgggacttctcttacgtgcagttgtgtcccaaggactcctgatgaccttgctgaaacttttagaaaactgccctacaggccgggcgcggtggctcacgcctgtaatcccagcactttgggaggccaaggcgggtggatcatgaggtcaggagatcgagaccatcctggctaacacggcgaaaccccgtctctactaaaaatgcaaaaaattagccaggcatggtggcgggcacctgtagtcccagctacttgggaggctgagccaggagaatggcgcgaacctgggaggcggagcttgcagtgagcagagagtgccactgcactccagcctgggcgacagagagagactccgcctcaaaaaaaaaaaaaaagaaaaagaaaaaaaagaagaaaactgccctacagtgaaaccctcttcctcccagccctctgccttcctgctctcctctgcaggggccagccccacactctgccggccaatctcccatctctgcccacccttcctctttccctcctgggccttttccttctccacctcttggtccctgtttctcagaggaccgggactaacaaagacatccatatatcaggttcaacagctaccaagattttgcaacgtttgcttcgtcacttcctttttccttcctgttttgtcctcagatactttaaagcaaatcccatacctcacgtcatttcattccctacatatttcagagcccacttcttaaaaccaggagtattttcttatataaaccacaatgtcatgaccatacctaacacatgtattggtaaatagtttcttggtattttccaggcctcacctacattctctaaattatctcaaaaatgtcttttcatagtacttgatttgactcagttttgaactctgcatttggccaatcttttttatcccaatctgccccacttataagtgacatgatgttaggcaagtcacttgacttttttccatttcccccaccttaaaacggggaaaccaataggatctgccttactgggttttccaagaattaaatgaggtcattccttccttcattcattcaacaaatgttttgtaagcagctgcccaaaatgcctggaactgttctaggtcctgcaaaaatatcagaacacaagaccaagtacctggcttcatggagcttatattttttattattattattattattttgagacagttgctctgttacccatactggagtggagtggtatgatctcggctcactgcaacctccaccccccaggttcaagcaatcctcctgcctcagcctcctgagtagctgggattacaggtacctgccaccatgtccagtggatttttgtattttttagtagagacggacggtgttttgccatgttagccaggctagtcttgaactcctgggcttaagtgatccacctgccttagcctcccaaagtactgggattacaggcatgagccactgcgccaggcctgattctagtggaagaaaaagacaataaacacacaaaattaatatgccatagaatgtcagctagtttccccaaatgtcagctacaagtttccccaaattctaatttttgtttgaaagaaagtttgtgagtgctgtgggaaattaacctggatagcaggagggcacagggtggggcacccattatgggcaaaggagtgaggagggtcctttaggaagagacgaccattaacagaaacctgagtgaatgaagggttgagcctccctggggaaagttccaggcagacagagggcacatttaaagtgggcacttgctggcacgggagagctggagttctcaaacttcttggtcgctgatctcttcacattcttaaaaattattgttggctgacctcctgttggcaaagctaaagaattaaatgagaaaaaaaaaaaaaaaaaaagagccagtgcggtggctcacgcctgtaattccagcactttgggaggccgaggtgggaggatcacgaggtcaggagttcgagaccagcctgaccaacatggtgaaaccctatctctactaaaaatacaaaaactagccgggcgtggtggctcacgcacctgtaatcccagctattcaggaggccgaggcaggagaatcgcttgaacacaggagacagaggttgtatctgttgtggtttaccatattagaagtaaaaactaaaacattacaaaataataacaatttatttaaaatataatactttcattaaatgttaacataaataacatcattttagtgaaaaacaactatactccaaaacaaaacattttggtgagaggagtggcattattttgtatttttacaaatttttaaaaagtctgggccaggagcagtggctcacacctgtaatcccagcactgtgggagactgaggagaaaggattgcttgagctcaggagtttgagaccagcctcggattacaagcattagccattgtgtctggccccactgtcctatcttgtactttgaatggatcttttactcatgtgcaattttataacatcagtcatttggaaaacattgattcgctgagttatgcagatcttccaaatgttgacgcattctattctattttttttttttaattacagacataaagatggcaacaatagacactagcgactactagagggggaagggagggaggggggcaagcgttgaacaactaacagtgggtactatgctcagtacctggggggcgagatcattcctaccccaaatctcagcatcatgcagtatacccaggtaacaaacctgcacatgtacctcctgaatctaaaagttgaaaaaaagttacatttattactatcaccaccaatcttatcagaaaagtctttaagaattgggtagctgtccatctcacaatggtggatacaagtgtctccaaattctaatttttgtttgaaagaaagcttgaattttataattggcaataaatgctgtcaaatgcactgagcccttcctgtgcaaacctcactttcccttctaagaactctgggagtaataatgacaattttcaccatttattaagcccttgctgtatgccggacattttgctaagcaatttgcctctgttatcttattctccttttcacgatatccctgggaggtattatttctcccattttgcagatgaggaaactgaggtccagagacactagttacttgcttaaggccacacagttagtggcactcctatatactttcagagttccagaaaagaactcttgggaaacacctactcatcaagatctagctcaaatgttacctccttggggaagccttatgcccaaactggacaatgagaaaactcacttaccatttgttgaatggtagtttaaaagcaccaggcaccgggcatggtggctcatgcctgtaatctcagcattttgggatgccgaggcgggtggatcacctgaggtcaggagtttgagaccagcctggccaacagagtgaaacgctgtctctactaaaaatacaaaaattagctgggcatggtggtgcatgcctgcaatctcggctacttgggaggctgaggcagaagaatcgtttgaaccctggaggcggaggttgcagcgagctgagatcatgccactgtactccagcctgggcgacaaagtgaaattccgtctcaaaaaaataaaaaaataaaagcaccaggcagcacactccatgtgctagctccattacttcatctcctcctagcaacaggcttatagaacaggtagtgttgcttcccctgtcatagtttcctattgttgctggaacaaaatttaccggcttaaatcaacacaagttttttgttttaaagttctgtagctcagaagactcacggggctaaatcaagctgtaagcaaggctatgttccttctggcagcactagcagaaaatgtttgcccttttccagctcctagaggccacccacattccttggctcgtggcaccagcagcgcagcatcttcaaatctctccctctctctttctgcttctattttcacatctccttgtgacctgactctcttgcccctccttctttccctcataaggacccttgtgattacttgggacccaccagtcatgtcataattaggttatttcccaggataatccatctcaaagcctttaacattaccacatttgcaatgttccttttaccatgtaaagtaatatatccacaggttctgaggttggggcatggacatctttgaggggaggggcattattctgcccatcacaccaccttctacaaaagattcacagaaaatgtaggtaacttgcccaggttcacacagctagtgagtgggggattccagatttgaacttgggcctgtcttgactccaggcctaggccactgtccccagactcatgggagataccaggtgtattagtcggttgtcatgctgctaataaagacatacatacccaagctaggtaatttataaagcaaagaggtttaattgactcacagttccacatggcaagggaggcctcacaatcatggcggaaggcaaatgaggagcaaagtcacgcttaacatggcggcaggcaagagagcttgtgcaggggaactctcatttgtaaaaccattagaggctgggcgtggtggctcacgcctgtattcccagcactttgggaggctgacgtgggcagatcacttgaggtcaggagttcaagaccagcctggccatcatggtgaaaccccatctctactaaaaatacgaaaattagccgggcgtggtgtcacatgcctgtagtcccagctactccagaagctgaggcaggagaatcacttgaacccagaaggcggaggttacggtgagctgagatcctgccactgcactccagcctgggcgacagagcaagactgtctcaaaaacaaaaacaaaaacaaaaacaaaaaaacaaccaaacaaaccaaaaaaaccacacacacacacacacacacacacacacacacaaacattagatcttgtgagacttactcactaccatgagaacagtatggggaaaaccacgccaatgattcaattatcaccacgtggccccactcttgacacgtggggattattacaatccaagatgagatttgggtggggacacagccgaagtatatcaccaggctctgctaagcactgaaggccatagtgcttgttcatagcttccttttaacatctatttccttgtactgaaggtatgtgttcatatctatgtgaattatttgaaaatgaagactgggatcttttttatttatttatttatatatttatttatttgtgagacaaagtctcacttttgtcccccaggctggagtgagatggtgtgatctcagctcactgcaacctccgcctcccgggttcaagcaattttcctgcctaggccccccaggtagctgggattacaggtgcccgccaccatgcccagctaatttttgtatttttagtagagacggggtttcaccatgttggccaggctagtctcgaacttttgacctcaggtgatccacccgcctcagcctcccaaagtgctgggattacaggcgtgagccaccgtgcctggcctgggatcttttgtttattatcacttttatttgttgttcaagcaactgtatgataaaaatcagacaaacaactatatatatatatatatatatatatatatatatatatatatatatatgtttttttttttttttttttttgagacagagtttcactcttgttgtccaggctggagtgcaatggtgccatctcggctcactgcaacctctgcctcccgggttcaagcgattcttctgcctcagcctcctgagtagctgggattacaggcgcctgccaccacgcccgactaatttttgtatttttagtagagacggggcttcaccatgttgatcaggctggtcttgaactcccgacctcaggtgatccacccacctcagccttccaaagtgctgagattacaggtgtgagccaccgcaccgagccagagagacaaccataaatcactagtgagttttcacgtcccccagtttctatccaagtgcagatatcgcttttccatggttaaaattatagcacagacactatattgtattgttttccccaattttttgttataaaaattttcaaacatagagaaaagctgaaatatatagcactacttagagccaacaatagtaaacattttgccatatttgctgtctctccctgaatgtttatgtgtgtacatgattttatcttttgttgaaccattaaacaatagtttacaggcattatggccttcactcctcaactcttcagaatgcatctcctcacaataaggacattctctcagtgagcacagtataattattacactataaaattaccaataattcacgaagatcacccatatccaatccatattcaaatgtctccaattgtcaacaaatagtaaaaccagcttaaaagacatatcaggatccaagcaagatgacacattgtatttggttatgttttctagctcttctattttggaacaacccctccctaccacttatatttttcttttcttttctttctttctttctttctttttttttttttgagacagagactcgctctgtcacccaggctggagtgcagtggcacgatctcggctcaccgcaacctccgtctccggggttcaagtgatcctcccacctcagcctcctgagtagctgggacgcctggtgtgccacactacatcccaccaatttttgtatttttagtagagttggggtttcatcatattagccaggctggtctccaactcctgacttcaagtgatccgcccgcctcggcctcccaatgtgtgggattccgggtgtgagccgctgcgcctggcccacttatatttttcatggcatcccatttatgaagagaccaggctccctattttatgtaacgtgggaatggatcttcctgttcatctcctctgctcagtgtacggtctagcaagagcagactctctgtaggtgtttgttgaataaatgaaaccaatagtaatggttattaataacaatcccagtagccaatttttattgactattctcttggccagtgtgctcacgttaatctaatttgaacctcacagaaatcttacgcgttatgacatatttgtcttattcacaggtgaggaaaccaaggcttagggaaggaaagtcgcttgtctgaaatcacagctagaaaaggggccaaaacccaagggtggacccactggctggaaaacagtgcagttaggcaggggcccctgtttcttaataatgaatgaaccaacgacccccaaggctggtttgcccgtgcacacgcacgcacgtgtgcaacacgtagcacttgctgagtgtttgctacttgccaggcctcatgtcaagcactttacgcgtgcttttatgccctacgttttgtttttgtctgttttgcttttttcccctaatgcctagccaaaggcgtggcccaggcgcccaggcaggacttggggagtgaatgaagagtgaacaaatgaatgaatgcgcggcaacgggatcttcataaaccagaccctcctcggggatctaatgcgaacactcccgaggcccgggcccaggtacgctgagggcggctcgtgggccccaggccgacctcagcccgcgactcccgggctccgggggcccaggtggcccccagtaggtgaggagccgggcccgccggcgccttggcgttgccacctctacctgcctgccctctccccttccggatccacagccaggcctcggcgggctcctggtgtgcagccgcccggccgcttccgcccgagggtcgcggggctcagagtccggcaggctccaggcggggcaggggatgtccgcggcccggcaggcgcacgcccacctgtcggccgcgcaggcgcagcagcgggccggcctccccgcgccccgcggcgcgcggccagtgcgcaggcgcggcggccgatgcgagtgtgtatgtgcgggcgagaagatggcggcggcgggggaagcagcgtgagcagccggaggatcgcggagtcccaatgaaacgggcagccatggccctccacagcccgcaggtagccgccggtctgcgccttcggccggaaggggcccgagccccgggcgggcggacgccgcggcgggcgggcgtccgcgccctgcccggagcgagcgtgtgggagtgggggagggcgctgggacacgctgcccgggcctaggccggagccacccgccgcctccgcgcccgccgcgccttcgtcccctgagccacccggaccccctagtcccggggaggtcgaagggcgggggctccgggccccgcttggggagggcgtggagggcgccgaaggggttaacctccctggggctggaccgcggggcgagcccggggtgtggagtggggccctccccgccgcgccggccgggggaggcggcccgggggctccgggagtcccctggagcgcaggggccccagagcagctcaggttgctgcctctgcctggagcgagcctcagagatttgggggtgccctgttgcccctttgccccaagagcttcctttctcagcttgattgatgatgcgggggttgccgattttctgttttttagatagaagtagcagagtagcggccttgggctgctgttgcaaagaaaactcgaaataagtcgcaaggaccgtactttcacttgcgtttgagtgacatcccttgcacgaatccatcccagccaggctgacaactaacgcaccctgcctgaacagtagctaaagcttgggggccctttacaataatcccgtggtggaaagaaagagctctttttgggagatgtgcgtgtagagttaagctcttattcccctctcccaccccttctctcacatcttctcccccctccgccattataattattctggacaaaaatcggcatgatgtattatttgtcagccttgctttagactgctaatttgttgacatctggtccctataaattgttgcacacttttaaaccatctcattgtgtatttgtattaaatatggggaaatgaaacaaagtagccattcgggaaactgattgcgagtaaaatcataacccttcatgagcaattgggttttgttgcccttctgcagatgaagtcaatctgactacacctcttttgaaacatgattttcggaactattgtaatgaatgcgtgttgtggaatctaaaatgcgaaaactttttaaaaaattagatcttacgacaagcttcaattttgttaaattagctgtagtttagtttgcatcagaatttccccctttaacgttttgttcccttattcatttacttttgtaagtagtgtaggtctttgcgccaaaaaagggatcagtagttgaataatttttacaaatgtatagcccaaagattttaagagatttggtgtatttagctttgtttagacctttctgttaaaaaaaaagatttgatatttgcttttttctcaacttaaatcctaattaactagcttattagaattggtatgaacaagtaaaaggctcattatgaattaatgtgtaatattccttgtgattttgacatgaagaaagcatctttaggcatagctcacttcctttatttaataagcatcaatcacaattcaaggttgattgaaatgttaattaatggggatggataatatgtaaacttaattgtaatttcgtttgcattcattgtcccagtatttacgttttatacaacagtctaaagcgttatacacatctttagaaaattggagtagcaaaagttggcggaacgtaaatgttagcaacactttgggtttattcttttaaagtatgatttaaatgcttttaagttttagcatggagaaagtagcaaaggaaatagtttgatttctcataattttcttcttctttttttttttttttttgagttggaatttggctcttgttgcccaggctggagtgctgtggttattaacctataaacttttttatttattttgagatggagtttcgctcttttttttttttttttttttttttttttgagacgggagtcttgctctgtcgcccaggctggagtgcagtggcatgatctcggcccactgcaacctctgcctcccgggttcaagcgattctcctgcctcagcctcccaagtagctgggattacaggcgcccaccaccatgcctggctaattttttgtatttttattaaagacgggtttcaccatgttgatcaggctggtctcaaactcctgagctcaggtgatccacccgcctcggcctctcaaagtgctgggattataggcgtgagccactactgcgcctggccgatttctcataattttcattttaaaagaatagtaatgcaaacaagtaatggaatcatgtatgacaggatttagttactggttcctgctccagtcattctgagcgttttaataaatttgttttacttggttgcctactgtcctaagagtcttgcagccttaatggccattcattcattcagcaaatactgattgtttatcagatattaagcgtcatggtatgtatattacttgtttatgttgggaataacaactgcaaattgaaggtcttattttaaaattgacttgttaaagttaaatttgtcactgagaataatgggaggtggaaaaagttacagtttaaaaatgtttacaggccagcgcggtggctcgtgcctgtaatcccagcactttgggaggcgcaggtgggtggatcacttgaggtcaggggttcgagatcagcctgaccaatatagtgagaccctgtctctactaaaaatacaaaaattagccgagtgtggtgaagctcgcctgtagtcccaggtacttgggaggctgaggcaggagaatcgcttgaacccgggaggcggaggttgcagtgagccgagatcatgccactgcactccagcctgggcgacagagcaagactcccgtctcaaaaaaaaaaaaaaaaaaaagagcgaaactccatctcaaaataaataaaaaagtttataggttaataaccttatttccaaatattagaaagtgttggttgatccctgttacctgtattgaagtgtaatagtgaagaatttggaaacattttgagaccggtaactcagcattttagcaaagacaaataaatgaactttaacagttgaagtgtaggtccaagtgaatatccttgtcactgaggggaccggttaaattatttggggtaattaatttgaagctattagttttgccttacaccgaaaaaatatttgtgattattgatgtcatttatagtgaaatctccacaataatgcttcctacacccaatttgaatgtcatgcagttggcttctgtccttgtctctgcatagactcaccccagtctcttttttagcttgtaatagcagatcctccacattttacatgatggaaagtcttggattccccctctagcatatggctgaatgttactgtattgctgaatatctgtttctagccaacagctggattagtgttaattcttaaaagagatacatttttattagaatctcaagtaatgagcagctgaagtaaatacaattgtttgaaatgttgacagggcatttggagataacagttttcctttgcatagtgacagcaagctatttaaacatgtcctaagagtagatgttttaagtttgtgagccagtggtcaccttagtggtttgtacagatggcctgagaagtttgtgagccagtggtcgccttagtggtttgtacagatggcctgagcagccgcgccgtaccaggacctcaccatcatgctcttgagcccatctcattgagagcacagcgcactgaaattccagtgaatactaagcgggcctaccacattctaaattcctcactaaagcaaaagttaggacatgtattccagtgttctgttacgtggaactgataggatttaagcagtgattcacataggaaaacttaaaggagaaaaggattacgaagcttaatgattgctgtttaatgccaagcctaagcggcacgttgcactgtgctgtgctcagaatataacattcaagtaattgagaaaagtggtatcatctccaattgaattagttacatcagggtttttgtttcggttttttgtttgtttgtttgtttttaaagatataatttcagacatgtaggtacttcctgttaatggttcctggtattcaggtggcacattaaacgtggttgctgaggacacttattactggtactataccaaaatatgaaacgtagtgggaagagcttgcttttgaatttgtaattaggctgttacttttctatttactgccacacatgcaagaatcaccatcgcacaaaacagataaatctgtttgcaatggaatttgctggccttgggccattggattactgtcatttgtcactttagtgccacttcagcagtgtagatgttcatttccagagacttgtatgtgcttggactgcagttttcctgtttattgaagtgttctcccaaaaggtctttctttgaccatttctgtcaatacaggctggatgaagaattagtgtaggaaaataaaggtagcccttggggtatgtgtatagtatttgtttcaaggatcagaaaatgtagaatttatcataaacctcgatgtagaatcttcagatcctagattttttctgaactggctattttctggctatttgaaagctcctgggccatgatcccattttcatcagatgacttgagaacccagaagctctaccagcactgccattctgtcccgtcttgaaacatcatgccctggttgccctctcctggaatagggcaggtaaggtgttgagatagaaatgtggtttggggctgttacagcctgaattcctcgactttcccttttgggctcacatgagaattgttaggagaatgtgcatgtggagtgcgggcccagcacctgctaccgtctgcgctgtaatggtggctgctcctaagagtcctcagtctcctccccgttgggcttgtgtgtacagccttatcggttgtcattcttcggatccattctcagtttatttttctggtattagctggagggacatctccttaagcctgtactctatggctcaggagtctcaaaaccagtccattttgaagtgagagtatccctaataaaaaggtgagtgtccccactcctgtgccttgttttttttgtttgtttttttttttgagacggagtctcgctctgtcgcccaggctggagtgcattggcggtatcttgtctcactgcaacttctgcctcccgggttcaagtgattctcctgcctcagcctcctgagtagctgggactacaggcacccgccaccatgcccagctaattgtttgtatttttagtagagactgggtttcaccatgttagccaggatggtctccatctcctgacctcacgatccgcccacctcggcctcccaaagtgctgggattataggcgtgagccaccacacccagccactcctgtgccttttgaacctgatttttacatctagctgactcctccctccgtccctttccctctttctttcttcctgatctgatggtgctagatttttgttttcccatttgtctttgttttatgaagatgtgctcctttccatttgtgtatgttgagtacagacataatcatgcccttgcttgcttttttttttttttttttttttttgagacagtcttgctctgttgcccaggctggaatgcagtggtgcgatctgggttcactgcagcctctacctcccagattcaagcgattctcctgcctcagtctctcaagtagctgggattacaggtgcctgctaccacgcccagctaatttttttgtatttttagtagaaacggggtttcaccatgttagtcaggctggtgtggaactcctcacctcaggtgatccacctaccttggcctcccaaagtgctgggattacaggcatgagccactgcccccagcatccctactcattctttgaaaaaaacaatttgttgttgttttgtagagacagggatttgctgtgtttcccaggctggtcttgaactcctggcctcaagggatcccttctgcttcagcttcctaaagtactgggattacaggtgtgagccaccgcgcctagcctccctattcattctgcaagtatcagtctttttacttttgataggacatgttgaagttttggttaaaaatagaagaggatttgaaaatgaagttcaattctagaggttttcgagattcctgcccaatataaaaaacttctgatacattaaaacaatttttttatacttcattttttagagcagttttaggttcacagcaaaattgagagaaaagtacaaagagttcctatataccccttctcttggtattttaagtaataatttcccttacgtggctgcaaagactatatatatatttatatgtatttatttgtatatgtatttatatttatttatatttttatatttatatatatttttatatatatatattttttgagacgaagtcttcctctgtcacccaggctggagtgcagtggcgcaatctcggctcactgcaagctccgcctcccgggttcacgccattctcctgcctcagcctccggagtagctgggaatacaggtgtgcgccaccacgcccagctaattttttgtatttttagtagagacggggtttcacggtgttagccaggatggtctccatctcctgacctcgggatctgcccacctcggcctcccagagtgctgggattacaggcgtgagccaccgcgccgggccaagactatatatatatttattcaagacctgaagtaggctttctgggtagatctgatcattggagaaggagaaacatatttattacgagatactaagcattgtagtagtcatcatttgaagcctataaactctataaactgcatagtttagaaagtgccttagcttgtttgagcctttacagcaactctgtcctgtattattataaccattttacagatgagtaagataagacccagagaggttgtggcttgaggtcaaatggctgctggccatcaggaccttttaaaagcaggtgttttgacttctaaatcctttgctttttctactttgccagactggttttctggaagagactgatgaaggcataatctttcacactgtgacttccccttagtagttcctccataaacatttacagaatgaatgaatgaaatgtgcatttagaaactttaatgttactaattacaaaatttgttactataatatgttactattcactaaagtttgtgtggggtacattttaataaagtcgtttattttattttctagtataaagacatgctatttttaagacacgaaaacagcacagacgtatttaaagtgaaaagtagaagtcattcccttcctctctgatccttaatcgtcagtttggtgtgtgtcttctatgcttttttccactggagtattttgttgttgttgttccgttgtttcataatatggtctgttgtatctagtcactgaactttattgagcaaaccttgttttcaaaattattgaaaacatccactgaagtcagttttcttaggtttacctaattttgccagggaatgaagcagatattctggagattgaagtgacttatcaggatccagtgtgcaggggattgtggaagtgctgccacaacttataacatgttgtccaaacaatttttttttttcttaagaaatattttgggccaggtgcagtgagtgactcacgcctgtaatcccagcactttgggaggctgaggcaggcgaatcactcaagctcaggagtttgggaccagcctgggcaacgtagcaaaactctttctctacaaaaatacaaaaattcactgggcatggtggtgctctcctgtagtcccacctacttgggaggttgaggtgggaggatcgcttgaacctgggaggtggacattgtagtgagtcgagattgtgccactgcacttcagcttgggtgacagagcgagactcttacgtcaaaaaagaaaagataagaaatattttgaagacttccacccccttagtagtagtcatgctgtccggtgttcatagtgtaaaaagaggtctggctgggcgtggtggctcacgcgtgtaatcccagcactttgggaggtcgaggtgggtggatcacctgaggtcaggagtttgagaccatcctggccaacatggtaaaacctcatctctgctaaaaatacaaaaattagccgagtgtggtggcgggcacctttaatcccagctgctccgaaggctgaggcaggagaatagcttgaacccgtgggggcagaggttgctgtgagacaagatcacgccacttcactccagcctggacgaaagagtgaaactccatctcaaaaaacaaaaaaggaggtctgattcacattcagattcttgtccatccattgcctttgcactagatttatgagaggacaaactttttattagttggagattggtaagtcacctgccctagggaataatgagaaactgggtaattcacctgaatttttctccatcttcttcaaaatcatgtttttgtcttctgtcactttgtttcatcagagtactgcaatggcaaaaaacaaaacacttcccaactcaggtcccactcctgagagataaccacatttaagtacttctgacttgtaatagaatgcaaaatcggggcttccaagtgtggtttactattttgtttagaattaatttgtagaatactagacacttttttcagaaccacatatgaaggactttatatcttttgtgattgttcacagattttggtggccggacgttaggagtatagagctgaagagagaattcctgtgctttagaggttcgctgggtagtgagggagagaagcaggctaatggctgggtgcatccagttttagggtggtaattcctgtaacacaagtgtgaacaacatagtcaagaacattcattcattcgtttgttcattcattcagcaaatagttaccgagtggctgctgtgtaccaggcactgaggagggagtgatgagcgaaaacaggcattgtttctctcgcggaggagtttatgggtccattgaggaagacagcttgctaatcagataatcacagttacgtacacgtcactccaaactgagagatgtttcccaaaggaagggaacacaatctgaagtcagagaaccgttcccgtggaagtgacgtgtttacagcatgagacagtggggacagcatgtgtggtggacctttggctggagggaatttggagcactttggagaactcagcaaggagttgtgtgtcttgggcacagagctggaggggagggacagacgcaccatccaaccttgcagcctttgttagatgttactgtctttattctgagaaaagtgtggaagagggggtggtacaacatttgaccatggaacctcataatcacattgccttttgggatcatactctgcccagtgaagaatagactcacggggtcgcagtggccataaggagatcatttagggcagggtccttggacttttgactcggagggtgccgtggaggtggagagaagttgcgtgactcaggagttaggtataaggtgtttcaaaaaaggaggagagtgggactgaatgttgggcaaagctgggaagacgtctcttgtagaacggtgacatttgagctggagtttttcaggcagagaagcacacggacaagggcatgtggaggagactgtgcagaggaactgtctcaaagcctgcagcctgtttgggaaacagataaatttgtggctgaaatggtgtgtagggtgaagtggttagccgggagtctggagaggagagagaaagaatttggtaatccaagctcaggactgagtgaagttggtagcaactctgtgttaagatagctggttgaggccgggtgcgaggctcacgcctgtaatcccagcactttgggagaccgaagtagacggatcacttgaggtaaggagtttgagaccagtctggccaacatgctgaaaccccatctctactaaaaatacaaaaattagccgggcgtggtggcgcatgtctgtaatcccagctacttgagaggcttaggcaagagaatcgcttgaacccgggaggcagaggttgcagtgagccagactgtgccactgcactctagcctgggcaacagagcagactccatctcggaaaaaaaaaaaaaaaaaagattgctgggttgagttgattgtgcaggggtcttacttagatgcttcgaaagttgtcagggatttgattctttaggctctcctccatagctgggactctactctctgctcattttggcatcttaagcctcataactttgaggggaaagaagtagggcatttcttttggggacttttgagacagattaatgtgaggcaggtagcccttcagtgtcctcagtggtaattggatagagtagttagggaaggtcatttagggacatattccctttattttgagggggaggcacctttaaaaacaagcatctgtcccttgattatattcgtagaaaatattaaggaaaacttaggtgacttgttaccttattttaaatgtttcctgtagtacttttggtagtaaactttagaaatttggaatcattggatttaacagcgtttttaggtttgtgatcctcgagtgccctcttctaataccagaatcacctggcaccctgggtgccaccaagagacactgagtaaggatccctgtgagcaggtccccaggccgtctgagccaggctcaggttgcaggtcgtccgcatgggtttgtgtacagctttttttgttttaacttgttgagccctttcgcatgaatagcaataacgaaatcgtattttggacaaagtgttacatctccagtctaggttaggcgtgaacaacaacaaaaatatgaattgtgcccctccctctgagtgtgatactcacttattttagcgccgagtggaatggtggaacagttgtgagcagatgagaaacctgacattttgccactttgaagagctgtcatgtcgtgtcttcagaacgagatttcagtttggcttggcattcattaagtccatgattatgccttttaagcaagcatttacccagtacttgctctgtgccagggcccgtgttgggatttataagttgcaaaaaaacatgtttttaaaaatgtaagtacacatgtgttccccagaaccttaagagctgctctggctgttgctctgcaccccacatcttgaaataggacctttgtggacagcatgggatcagcacactcccccacagctcagtgtaactgtgagcatctgatgtcccagagaactggaactttataattcatcctgaagcctggttgtcaacatctctgaggatgtgtgcatagcattaagccaatttaccatcgggaattcctgctctcttttgctgttgttgctcatggattcgtcaggtgaggaaattctagtctctagtttttcccaaactggtgctgaaataattacgcttggttctctgttgcttcttacctctttgctcttctgtgccacaacaatgtattctaagttaggtgccagcagcagaaacttttcttccacctataactagagttttaggcgtgaggaagggctagcttttttttttttttttttttttgtctgagatggagtcttgttctgtcacccaggcagtggcaagatctcagctcactgcaacctctgcctccggggctcaagtgattctctggcctcagcctcctgagtagctgggattacaggtgcgtgccaccatggctggctaatttttgtatttttagcagagacggggtttcaccatgttggccaggctggtcttgaactcttgacctgaagtgatccgcctgcctcagcctcccaatgtactggggttacaggcatgagccaccgcgcccggtggcttttgctttttaaggtggacagaaacaccttgcagctgtgcttcgttgcccttgctgcttttgggtggaaacatagacttaagttagcatattcatcagttgatctcttttctgtgagaagggaaagaaatcgcagtattttgtgtgtatggcaggctttgagggcccttatactttgattctgtagatgccctgtccttcctcaggaggcagtcagctgtgtacagaggcccttgtggtcctgtcctgagagtagcggaaggaagacatggctctgcctggggagactgtgccttatgcagaggccaacaccacatggatgagccggaagcagccgctggcctggctgctctttcgggtcaggaaggctttcttgagtctggtatggtctggctgccccagtgtccccactgcctagcacagtgggcactcaggtgtttgtctgttggatcggttaattggcagggaccagttgaagcaaacagagaacagctggttgtcattcactgttttcaggactgcttatggttgtttttggtgtttctataatagttctaggcatgaagttcaggaccacagcatgcaagaccccgaggggcagatttgccgtctatagaaatagtaatgagagctgatgaagaagaggtggctgcttcccacagtatcaccttgattgtcatttctgcatttagaatgcatgagtgacccctaagctgctcttcaggttcttcagtgctctctttacctctgttgtgtagtttcttgaatccaggtgactgacccgcacgtcacatataagttatttggttttattccttggtctctttctcagcaagtgtagtctggagatgataggacacttagcaatgcagagagaatgccttcaccagagttaccagcaagtgcttggctgtgggggctccgtgtactaaagctcttccaggattgttagtgggcatgccagtgatctatcttcgcaggcctgcttacagcaaatgcagctgtcccccaaatgcaagaaccatggagcagccagcctttccagtacagggcccaattatgtgtcaccagtgaacatggaaagagcttttcggttggtttgccacagttagtttatctttcccccacctttgtgaccttagatatctcagccaatgccaccattcacccactagttatttattgaactcagctatgtgccaggcattgttggtacagaaatggaggggaacacattgtctgtccccgagaccctctgtctgtagacaggctcgccccctttgtccctgtggtttgctcccctactttcagtgagtctctgtgcctgggccatcttcttacacccactttacccacctttaaaattgcgccctccttcacacttgtcaccctgtctgcttgctccctctccagagcacttcacacctaataccctacatacccgctatcctgacgtgtgtgtctggttcactctctcgtcctcccccaatgtaagctccttgaggccccaatgtaagctccgtgagggcaggggtttttgtttgctttgttcactgctggggcccctagtcctagaatgtggtgagtgctcagtaaatatttattaacaaacaccttcatgaaagacataccacagtggacatattcagaagcccacagtcaggtgtgggaaagaagctagagaatcaactgttaggatccagaattagagagaccatcacaggagagtccccggggacaccttggctcatgtttgtgaggaaaatagttcacaaagatgagcctttggaactgagttctatagtttgcagagtcagccaggccagcagggtcccaagagaagggcgcccaaagcagaaagacctggcgtgtgccgtgtcgctgaagtgcatttgggacgtggagagttgtcggggctgcagcactgggggttggctgggaaggtggatgggtgcgtcttgtaggctctgctagagccttttagcctgaaaagttctgggagactagaaaggcttttcctgggcaccagaatagtaaggttcagttgagagacagctctgtggtggccacatgcagtttggagggtgaggggtgagcacagaggcggaggtagattgttgcagagacccagttgagaagcgtggagggcttgaacagtgcctagaggaggggcaggccttagggtggcgggaggtgggtggctggcgggagccagctcgttgtggtttgttcatggtatagtagtttcttccttaaaatgtggaatgacacttgtttagtaaaatgtttttcccacttcttcctcttttttagagatggggtctggctctggcatccaggctggagtgagtggcacaatcgtagctcactccctgcaccatctaactcctaggcttaggccatcctccctctttagcctcccaaaatgctggggctacagacgtgcgccaccgtgcacggctttgcatttcttatattgttgaatgtttttccattaaatattttcctttgcgattgtttttttttttagatctcaagagccttaacttaatcttcagcattgttttttaaggactgcagcgtattcacaagttatagtttatgcatactaaaaatggtaatgtttggcaggtttttttggtccaatttttagttgttacttgtgaatttatcttatttcctagagcaaattaagcacattattgtaaactggaagatgaacgtccttaattcattgattatttttggggtgaagggagagagatattttgctaagggatattaagaagatacttagtggatatttaaaacatgaatttttttaaattttaaaagtaatatcaaaaacaagttctacatatgaaatgtttgaaaaatatttaaaaagttctgattattattattattattattattttttttttttgagatggagtcttgctctgtcgcccaggctggagtgcagttcgcagtctcggctcactgcaacctctgcctcttgtgctaaagcgattctcctgcctcagcctcctgagtagctgggactacaggcatgcaccaccatgcctagctactttttatattttttagtagagatggggtttcaccatattggccggtctggtctcgacctcctgacctcaagtgatctgcccgcctaggcctcccaaagtgcttggattacaggcgtgaggcaccactcccggcccatttataaaatatcaataagctgacttatgtttggtgaaggccaactatttcagctattgctgtagatatccaggaagataaccaaagcatccttacctttgtgtataatggatagctaaggcataagaaacaactgggcacgttacaagatgtgtaattaagtgctgaattatgtggtgcatgtggcaggttcttttgtagtaattcagagaatgaagatgggtaatgagctagtcttgagaaggaataggatctccgcctcccaaagtgctgggattacaggcatgagccagtgagtccacctgggtgaccttactactttatatgaatcctctggtcactgctgcccaactatccttttatctccctttttgcttaccccatttatgtgttagggtgccctcccttttttttttaaaaaaacaaacaagtagagctcagctttctaactggcttacaccataaactagagatttagtggctcatgtaactagaaattccagaggtagatcaggcttcaaagttggtttaattcagccgtttagttacagttttgaggacgtggcttcttttcattttttcacttttcatttcttcatcttttcattctgcctgtcagtattatcccagggctagtttcccccacgatggcggaatggccacagcagtttcaggcttcacatttgggcacagcctccgtcacaccagcctgaccaagagagtgagtgtgcatcccagaattttaggcagtgtcctgagcttcttgccctttgggtcgtccctcaaccagagcactgtggcgaggagggtggtatgccaagcagggctcccatctggcctgggggtgggggtgtgttgacttctgaactgggtgactactatcccacagggtaggaaggggagctggccagttcgctactgtcccacatgagcgtaatgtctctcccccctctccttttccagatatgccagttcctcctggactcctcagactggaagattgtcctttctccttggcaaatcatctgtactatctgattgcatcttacagtcttctttaaatattattgttccttaactgttaatgtgtctgtgccttgaggtcagcctcaggttccaatcctgttccattttgtttgtggaatctcaggcaaggttggtttctctgaacttttaaagttttttcatcttcattcagcaaatctttattagattctcagtattgtgcttcagtggacgaaatacagactgacacaaggagataacagttcattcacagagacataggtaaatgagaattactatgaaatatgaacagtgctttggcagaaatagggtttagaaacacttcctgaggaggtgatgcctgcgttgagctttgaaggacaagtaggacttcttcagagcatgggggaagagggagctgcctgcacgaaggctgatcagcagaataatgaataaatgcagagttactgggatcttaggtgcacgaccttcggcaaggttggtaggcagagacgcccattacaccaagttgaagagtgaagattctacctttatatacaccttacaattacatggggagtgaccgcatgtcctggtctaaacttatcccagcataattcatcataatgatcctttcactctgagatatgcctctaatttggatgataaatggttacgcaacttaaaatagaagtccagagccatagggacagtcactgtgatagcagtgtgcttgcttcatagtagagcttcgggattacatgagatagagcatagcagtgcttctcaaacttaaaagtccgttgagaatcagctgcgggtcttgtgaatgtgcacatttagattcagtacacctggggtgggccctgtgcgctgtctgagctcctaggtaattcctaggctgctggcctggtgacctcactttgagtagcaggtcgtattgggcttcgggagcttcagagggtctgtgaagttctgaaatcatacgcagaaatgtgtgtacatgcattctttagggggtgggcctaattcccttacatcagtttctcgggaggtctgctgccacccaaaaaagattaggaatcctcccttttagaaattttgtgcagattaaatgaaatatgttgattaaatgcctttaacattgtctagagcataatggacattcagtacacactagctgtatgtcctccttccctgaccccagttctttgaaggcaggacacattgcttaaacattttaaactgctttttaatgtcctttttatgtcattggtgctcaataagtgtcgatttagcttggtgacaagctgtttggtgactgtgagccattctgtcagcatttgctagtctcttaggtgccaagcattttactaggtaggtaggaggaggccactacctaggttattgcagatacccaggcataggtggagtcatcagggcctgtgctggatagtaactgtagagttgaagaggagatgcatcacttcttagtaatcttcctgagttatgtgtgttcaggaaagtgcttctactgcctttgattcattgaggtcctagtctctggtcctcaggtgtatgtgatttcagtacggattaatttactgtaatgcttaatttaattcattcagttgctattcttgccaaatgcagtttttctgaacattttgatattttgttgagatggtcccagaaatttgggattcgtgatcacgttagggtatttgtgatggaaagggtatataatttatggtattttcaaagttccttacctaagagattggaagaacaatgatgagagagagattgggagattacttgtcttatagagttgtagatgcttcagagaacttgactacattgcgaagggaaaatcttggattggaaggttatttttgagaaagtggagtgttggtagtgaaagttagatttcagtgaattaaaagcaaatgagagatgagtttaattacaaaagaaatgtcttttgttcagaagacatttctgaagagttgcttgtgagttcatttattttattgagacaggattgtactctgtgacccaagatagagtgcagtggtgcaatcatggctcactgcagcctcaaagttattggctcaagggatcctcccacctcagcctcctgaggagctgggactgcaagtgtgggccactgtgtttggcaggagtttaatttttctgtcatattacttctaatttagttgcattatagtttttcttctggccgggtgcggtggctcacgcctgtaatcccagcactttgggaggccaaggcgggtggatcacctgtcaggagttcaagaccatcctggccaacatggtaaaaccctgtccctactgaaaatacaaaaattagcccagacatcgtggcacatgcctgtaataccagctactcggaggctgaggcaggagaattgcttgaacccaggagtcggaggttgcagtgaactgagattgcgccactgcactccaggttgggcaacagagcaagactgtctgacaaaaaaacaaaaaaaaagtttttcttcttttagttttgttgttgttgttgtttttgagaaggagtctttctctgtcacccaggctggagtgcagtggtgcagtctcagctcactgcaacctccacctcctgggttcaagcgattctcctgccttagcctcccgagtagctgagattacaggcgcccgccaccgcacccagctaattttcgtattttagtagagacagggtttcactatgtaggtcaagctggtctcgaactcctgacctcaaatgatccacccgtctcggcctcccaaagtgctgggattacaggcatgagccaccgcgcccggccagtttagttgttgttgttgttgttgtttttgcctttattaacttgttaatgatcagtaaacccttaaaagcactaaaagagttcccattttaaagacatctggatgttgttcatcaactttatatagtgagtaattatctcaaattattttataatttcttttttaactgggaggcataactgaatggagaagtagctcccctcatcctcctgttttctgcttagtttctcccacctcctcagttgcctgtagtgatggagcttttacttggatcacgggaatgcccctacacagtgattctaaactccaactgtaagtcagaatcacacaggaagtgtttaaaatgctaaatgaggcctggactccaccctagaccactgaagccagaattgttgcaggtgtggcctgaggatgctctgattctaaggtgtggccaggttcgaggactgttgtcttaggcctttgtccaatatggtttatgctgctcccctgctaggtgagtaccaccgcggattggttacctgcttttatgtggaaaatagaatataggaagccgattgggtggaaaacatctcttctagtgtatgtaggtcccataagggggactttgaagtctggagttaacagttttctaataaaagatttcagaccatatccaggaacttaaatacataattaaagagtggaatgcaaattattaggatttttgctggtaaagcaagctatacttgcataatttaaatctttggagggcatgtttcgacagatcattaggtgaaggttaaactgagacagcaaacagtggattccttccttagctagtataccactttttgcattcttttattttcaacagatagtaattttgcagctttttacttcttcaaccaaaccttctaagtaactttgctttccattaacaacaaagccgctcattaaggtggaagttctgtgcttgatcttaacaccggaaggagaggagtctatttaccagctaatgtaagtacttcttattagacagtcctagattttctaggagatttgaagagtctgctgacagtggccagcaaatcagaggaaaatcatttctgtagctaggttcttttttcatggatgtcctttaagaggaagctctgccgtggcgatgtgcgttccttcctggcgggtggcctccagtagctggccttctgttggtccggttccagcgtattttattaagtgaaaaatcctgtagaacagatggcacttacaagtttctgcccatgtagcactctgtttaatgaaatactatagttttgcttcattgtttttggcagtaattgtctttgtgtggagtttgagtacatggtccgagaagctcggcagtaataaaggttgagccaggcaagaataatctgaagtgactgagtaatgatgggacagaggcttcagagtggtgcacagttaaattgaaaacagatgcagaataaaaagatgatgcccaatttttttttttttttttttttttgagatggagcctcgctgtgttgcccaggctggagtgcagtggtgcgatcttgccttactgcaagctccacctcctgggttcacgccattctcctgcctcagcctcctgagtagttaggactacaggtgcccgccaccacacccagctaattttttgtattttttaatagagacggggtttcaccgtattagcggggatggtctcgatctcctgacctcatgatctgcccacctcgacgtcgcaaagtgctgggattacagtcctgggccaccgcgcccggccaatgatgcacaattttttttttttttttttgggaaggagtctcgctcttttgcccaggctggagtgcagtggcgcgatctcagctcacggcaacctccgcctgccgtattcaagctattttcctgcctcagcctctcgagtagccgggagtacaggtgcccgccaccatgcctgactaatttttgtatttttagtaaagacggggtttcaccactggccaggctggtcttgaactcctgacctcaggtgatccacctgcctgggcctcccaaagtgctgggattacaggtgtgagccaccatgcccggcaatgatgcagaatttttaagatgatgttgtgtagcactgggaggtctttggaccaaggaatgtgaaactaaaaatcccagagtgtggatgcctacaaatagggtgtactgaagaattcttcttccgtagatgagagattaacaaatagagcgtactgaggaattattcttctgtaaatgaaagattacaactgtggccattggtcttcaagagctttgattatggtactgcttcatctgctttacatagattgtgcataacaatttttaaaaagtcaaccttattgaagtataatttaatacaataaatgtacccattttaagtttgcagttcgaggttttttgtctttgtttttcagacgaggtcttgctctgtctcccaggctggagtgcagtggtgtgatcatagctcactgcagccttgacctcctgggttcaagccatcctcctgcctcagccctcccaagtaactgggactacaggcatgtgccaccaagtctggctttgttttgttttgttttgttttagagattgagtcttgctctgttgccaggctggagtgcagtggcgcgatcacagctcactgcaacctccgcctcccgggttcaagcaattctcctgcctcagcctctcgagtagctgggactacaggcacacgccgccacacctggctaattttttgtgttttcatagagacagggtttcaccgtgttgcctaggctgatcttgaactcctctcaagtgatcctctcaccttggcctcccaaagtgctggaattacaggctgggagccatcacgcccagcccagtttgagttttgacagatgtatacaccaaagtagtaactactaccacactccatatatagaacatttccattgctcagagagtttcttcatgcccctttgccatgaatccccaccttgtccaggcagctagtggtctgcttctgtcactataggctaagaaagtttgccttttctagaattacattggcccagaattacacaaactgtactcttttgtttggttaccttcacctgacccaactatttagatttagccatgttgagtgttgagttccagccttttcagtactgggtagtattcctttgtggatgtcccacagtttgcttgtctctttcctcttgatagacatttttgttgttcccactgtttgaatctgctgttcacattcatgtacaagtgtctgtgtggacataggttttcatttcttgtgggtaaaatgtggtaagcgtatattctattctgtaagaaactgcaaggctttttcaaagcggccatgccgttttctatctgcaccagcagtgtatgagaatgcttcttctctgtcctcaccaacatttgatattgtcagtcttctttttttgagacagagtctcactctgtctcccaggctggagtgcagtggtgtgatcttggctcactgaaaccttcacctcccaggtttaagcagttctcctgctagcctcccgagtagctgggattacaggcagactcccccacgcccagctaatttttgtatttttagtagagatggagtttcaccatgttggccagtctcgaactccctaacctcaagtgatttgtccgcctcggcctcccaaagtgctgggattacaggtgtgagccactgcgtccggctcagtcgtcttaattttatagtacatcaatttaaatgataattttttgtccctaggaacatgagttcctgtcattgacagcaaagtgaaactgagtacaaataggtggttcttagtgaaatgtgcccagaaagacagtttgagcagaaaggagggaccaagaaatacaggatgcatgcctgcttcacactggaaaccggtggtcttatttgagggtcaaagatggggggtggggaataaagtcgattttaaaaggattgaccggctccgataccttctgatcacatccagggtttttttttttttggccttttttcccccttatacacttaagattttgaaaagtggtttctctttagcttgggaaatggatcacatggtaattgttaatgatttttctttaggtcaaaataggtgttcctttaaagtgttctgtgaagcttaattcacttacgttgaataagtcttatattttaaaatataagtttaagtgttatactttaaaaataagtgttatttcttgattgtatttatttgaagattatatttgagaatgaaagatgtactcctagctggaacatctctggtgataataaaaacatgagaataaaaaccattcagagtgatcaagttaagactgtcagcccactgacgcctgggaagtcacaatgattgctatgtagtttggagaaattattccttatccttagataagctttttatttgtgtgggttttttcatcttcctcttcctgaattcatttgttcaacaaagctattttgagcacctactctatgccaagtctactgcattaacttctggctaaacaaagatggatctaactcgattcttgtactttaaagaaatcagctttatggaggtataacgtatgtgcggtgaatttcacccatttaaagtgtatatttccatgaattttaacagatgtattcatttgtgtaatcacctccacaatcaagacaccagttctgtcattccccagaatgacattgagcccccttgcagcctcttcttttgttcgtccttggccccagcaaagatagaactgcttctgttacagtttcttttttattggtttcatcttccatttctttttttcttaaggtcagcaccaaggtgattgtaatgaatatgaaagttggtggaatcttgaacttctactagggctatcccagataaagttgactgaatttactccctaatttatctgctgtgtttcatacaatagcaattttacacaggaagttattcaataatgagggctatctatattaccttgctatttagtactagttaagagcaaagcgagttaaaatttaatggccattttgtaatacagttctaatatagacacaggactggaaagttggtaaaagtgggtttctgttaagtgaatcatgttttctaatttggagattcaatctgaattcaatctaaaatttctgaaggaaattttagctcggaatctccatgaaagcacttaatatacagccaacctgttaaaaaccatactttgagaggtaaaatgattactttttgatagcactttaatagtagaaatagaatatacaaacagggaagtagacactcaattgcagtactttgacatttgagtttcaaggagagaggctgcctgtgagagtgactttgtgatagtttgtctactttgttcgcttctcaggacctctttgccccaagaaagtaaagcaaaattttgctatagccctattagtgagggaacaaaacttctcttcctccttcttcctttgtctgcttctgccatttgtaacacttagttcagcttgcagttggcttgcactgtaataaaactgtaaatgtcaccatgccctgacccctgtgtgtgttgtgttcaaagttttactctcgtagtctcgcatagttgagtgtggattgttgatgctcagtgcatattgttaaattggcgaacttcctggtgtgcattcactagttgatgatagtgtcatctccagatgtcctcagaaccacccacaccaccttctgaagttgaaagcacacaatgattgttcagtagatatcagctagcacccataacttactgggctttgattcataaagcctagtaaagaaattaaaatttttattttgatataagtactgaccttttttaaaactttattgagatataattcacatgctgtggagtttgtgtatttgaataaatatgcatttcagtggtttttagtgtattcacaaagttttgcagctaacaccgtagtccattttagaacatttcatcatccccaaaagaaagctcatgttcattagcagtcaccgcctcccgctcccccattctcctctcctcccagcccttggcaaccatgatctttctgtgtctggtaatttgcctattcttggcatttcatatgaatggaagaaacaatttatggctctttgtgtgtggctttaacttagtataatgttttcaaagtcatcctgttgtagcatgcattagtctgatgacattttctttttctttttctctttcttttcttttttcttttttgagacggagttttgctcttgttacccgggctggagtgcaaatggcacgatttccgctcactgcaacctctgcctgctgggttcaagcaattctcctgcctcagcctcctgagtagctgagattagaggcgcctgccaccatgcccggctaatttttttttgtgtttttagtagagacagggtttcaccatgttggcagtctgttctctgactcctgacctcaggtgatccacccgcctcggccccccagagtgctgggattacaggtgtgagccaccgtgcccggcctgtctgacgacattttcaaacccgtgtttcttaatcctttttagatccaagagatccttttggagatgggaagaattttagaagttgtctggtccaacataccttcattttgtagatgagattaaggctttaatcatgccaaacagtctattgctcttttcatgtttccccaaattgagcttatttggatcaggagaagagggagaatactttatacttctcagcttcttgtgtatttgactgtgacctggttataccatttgccactgtgaggcttagctgtgcatctgtgaatgggagattgttcttagagattggtcatagttgtccacctgcctcggaaactgcaggtacaaatgcagcagcaaagtatttacattcttacttcagggctgatctcctatttctatcagtccttttgaaggcagagaatgttaatttggaacaacctgcatatttattcaaatttccagagagatgaaactttcagaatgctgtgctgcagcgccccctagtgccgtgctgtactgatagtccccagcgtctcctgaagccgaaagtggcgtttcccgcagttccggcgggagagctgtagccagcaggttgtgcaagtgaacattagacatcttttctccttctcgccttccttgggctgagatggaggaatgtgtctttattgctgagggcaaggtctttgtttttcctttagcaggaacactggttttcccacttcgtctaaacctttgcccagggtttctcaactcaggccccctgagggccgtagtggcctccacacacctccagaaggtaaactgagccagcttagccaacaggctatgcttcagggaggaaggtgtcttttgttcccatccctgctgtggtgtgggcttgccccccttttctcgaagtgtttcttgtatatttttttccacatcctcttgagaaaggatcagaaagtaaagatgtgaacagtgagagttttgaaagcccgggatggaggccggatgggatatgaggggaagtggtggaggggaataaatagcttctctagttcacagtcttacttcccctaaaaaggggaagaaatgcctgaagcccttgtactttgctcccccgaatcgcaggcatttctgtgccgtcccgcccctgggcatttcctatgcaaccacaggacgcgggaaaggagcgtttgttactgctttctgatacctccttttgaccccagtgttctgactctggcagagttgctgaaaccttagggggcttcccagtctttcctgatggtatttggtgtagctgtgggaagggcagagttagccgcagcagtgtcacagtttctgtggtgtggcatggctgacagggcctccaggtacctgcttttattttaatgacagccaccaatatgtcctaagctctgcactttctttgaaattacaagaaacgatgaacttactcgtgctttttagtctcccgtgtgaactgaattgttctgtattttatcttgctctgttatgggcaaaactaattcatgtcatcagtggcatttccctcttcactaggttgtaaatcctgtgaagtcagacacagcgttattttcatctttattttacccaaacacctacaattttcccccctcatgtgacagcctttgaaataagttaatcttccagaggagagaaaacactaaacagtcaaacataaggagagggtaaaggttttcctcataacctcacaattttcagtgttagctttaaaaaaacaaacaaacaaacaaacaaacaaacaaaaactctttatttgcaaatagtttgaaacttgaaaagttgcggaaagaaaaatagtacaaagaatccccagatggtcctttacccagatccacctgttgttaagattaaatccatttgcttaatcatttgtgtgtgctggaattctctgtctgcaaatacacactcatacggatacacatacagacacacagacatgggctaacaaatgcaaatatacagacatacaatatttttccaaaccctttgagatttcagggaagattacatacactgtagccacttaatcctaaattcttgaatgtgtatttcctaagaataggcatattctcttaaataaccacagtaatacgttaccactttcacaaatttacattgatgcagtacttttttctaacctgtccatattctaattttgggagttgaccatataatgtcctttctagaattttcccttccagcacaggatccagtctagggtcaggaaatgtatttagttatcatgtctctagctttttgtagtctggaagtttcccacagcctttcaggatattgacttttttgaacagcagtttctcctcccctcttttgataacattcctcattttaccaaacacctaaaataacatttgattggaagttaggaaggcttttggagaaggagatggtgaaaccagaacattttaatagcagttggctgtcctgaatttctgtgataaactttttggtgtcacaaacatgccttgcttcaacatttagtcagatatcattttagttaaataattgtcactcactggtatttgctataaatatattgaataaattgaataaataattgaaatatattgaataaatatttggccttttttactttttttttttctcgctgttgcccaggctggagttcagtggtgcgatctcggctcactgcaacctctgcctccccggttcaagcgattcccctgcctcagcctcccgggtagctgggactacaagcatgtgccaccacgcccggctaatttttgtatttttaatagagacggggtttagccaggatggtctcaatctcctgacctcgtgatccgcctgcctcggcctcccaaagtgctgggattacaggcgtgagccaccgtgtccggcctccttttgtagttttatcaaaattataatttatgtccgtccactcactggtatttgctactgaataagtatttggccattttccctttttgtagttttatcagcatatgcaaaaattaccttttttcctcccaataaagttgtcatattctgttttataagcagcacctcttcttttttcttttttttgagacggagtcttcctctgtcattcaggctggagtgtagtggcaccatcttggctcactgcagcctccgccttccaggttcacgtaattcttctgcatcagcctcccaagtagctgggattacaggcacccaccaccatgcctggctaatttttgtatttttagtggaggtggatttcaccattttggctgggctggtcttgaactcctgaagtcaagtgatctgctcgcctcggcttctggaagtgacgagattacaagcgtgagccaccgtgtctggccaagcaacactttgtcttttggaatagtgttgataataaatgcttcttcattgtagtgctttgaatgatgcatatgattttgttaaatacaaaaatgatgtcttaaccttcacatttgtatggattattttatcacatcattcataatccatgtttgaatggttaccatgccagcttactttgccaagaaagaaatatttatcgtttttcaaaatgtgcattgcaattctaagaaattccgttttattcttaggattcccctagcttgtgatatcgatgacttgtcttttactgacatttgatagttaactccccaaatagaggattcctttatatgtggttattgggttgtatcagaattcctgcttgagtataagttatatttgtattgacacataggaaaaagatacatgtagtttatctgccatgagcatatggggaatactcattgtatgggagatggaaattctaatcaagttccccgggaggctgagcgccttgcagagatgctcttaaacccttggcactgacttcttagcccgttcctttatttcagttataaaatcgaaaggaccggttttaaatattgctgaagtgtaactgctcacttttaaaagctcatgcatttaaggattaaaatgtgattcacgtgtattttgatggagttgttttttgagctatgtgagccagtgttaaggaaattaagttggagttcaaaacagccgtggctagtgatttgtcaagtgttaaatgatagttcagtgttgcatagctggtaatcagcagttacttatggtgtatttttttgcgtgacatgttttcatcaagtcctaagctgttgtcaatgagctcttgaaactaacatgcttatgaaattatgtctgtgcaaaatgggtgtatttgaagagttgtaaggtgatttctgttgtgtttactttttatgattaatgttttgaataaagtatgtagtcccctcccaagaaaaccctccaaaaaacgtgctaggaaatcccctccactcctgtctgcgtccactcagcgtccactcagtgctactgtcccaaaggtgaagggccacattttttcttgttgatctttccagtgtctctttatgcagacacaaatatctatattattaacaaacacaaatatgttattatatagcaacacagatactctattttcctaccttttttacaccgagagtgctttcttcttttaatagtattttgaagatctctcgctgtctgtacctaaagttcttcctcattttcccctagttaattctgtaatttgattgaaggtacatatctgtggagaaattattgacatgaagttataataaaaacacgcttaaaatctataacattttctcagatactttaaaaataattaagtaaaactaataaatttgaaaataataggagaaaaaaaactcagtgaaccgtttctgagcgttccagctcatgacttgagggtgtttgccgctgactcatgctgaagccacttggtgtctgcgtttgaaacaggaagtgtgtgttagtggcttggaatcttgttttctcctcctctcctcctctgctgccaagatttttatcaaatcatttggatttgtagtgttcttactggattgaccagctctaaaaactttaggctgtatatgaactgaaataagaaagtgtgcttagaagtatgatttaaataaacatttttattttccattgtctaggaagaaaaccttcctaaagaaaatacctgataatcctgcagaacattctgatttcttatccttaggtatcttccccacattctgaagtaaaaggcctttcttgttagtcataagataaaatggataacttttaatatatagcatttctaccttttttttttttttttttttttgacacggaatctctctctgtcagcaggctggagtgcagtggctcattctcggcttgctgcaacctccacctcccgggttcaagcgattctcctgcatcagcctcctgagtagctgggactacaggtgcatgccaccatgcccggctaattttttgtatttttagtagagacggggtttcaccgtgttagccaggatggtctcgatcttctgacctcatgatccgcccacctcggcctcccagagtgctgggattacaggtgtgagccaccgctcccggcctctactttttttttttttttaactgctcgttgcagagcagggctacgccataggcaatgtgcacagagtagccacgtttctactattgatattaaacaaaacagcatgattttagtttatttattcttaatatttgcattaaacttcacagctgccgtgtgtttcttgtattttacttctttatcattcttgtatttctcgaattcattttctggaattcttaagcagtttcctttcctccccccaagaaaaaggtgtatgtgacagaaagtgttctttctcttttgcacttgaaaagtagtttatagaattctatgaaaaaatactctggcattctaggaacaaaatccttttttctcgaaactttcaaaatgttgccccattgccttccatagccttgttgattttgctattaagacgttctgttgagttttttaatttagtgatttaaaattagtaattaatttccgcgaacactttcatgatctctgatagctcttttttttttgtgatagtctgtgctaattttttctgcttccttttagcctatagaattttcccttccattgctttgagggtttcttagtgaaattcatatcatcttttcccagtgttggtgatgagaagaaggtgtaaccttctatattcttcactgaaaagtgacagtatttcagaagatcatttctgaaccattttgaggctctgtttattttcactgttactgtcaatacataatttctttgttgacttttgcaagtatatgtaaatattatatgaaaacttttttgttcttaatgtatatttatagttttggtagatgttgtcaaagagctctccagaaacgttttccctgtgcattcttaccaggagggtattacatttagtggccatttattcacatttacaataataatgagtattattcatttatgtaatatttagttactggttatttttgaatcacttggcttgtaaatttccctggaagctactagactgtttagttccattagaacagaggaaccacactctgcttaccatttttatacccagtactgatcatacgtgggcatttgtaggttctaaataattattgattaaatgaatgaatcattgcttctccgttgtggaaattgctaattcttctcaatgacttcttcttcttcttttttttttttttctttttgagatggagtctggctctgtcgccccggctggggtgcggtggcgcgatctcagctcactgcaacctcggcctccctggttcaagcaattctcctggctcagcctcccgagcagccgggactacaggtacacgccaccacgcctggctaatttttgtatttttagtaaagatgggggtttcaccatgttggccaggctggtctcgaattcctgaccttaagtgattcgcccatgtcagcctcccagagtgctgggattataggcgtgagctactgcgccaggcctcaatgacttgtttcttgaagctccatggagaatatgaactggtaggcacttgccagactcacatccgtgcagtttaaccacttcgttttccagaaaatcacattctgaattccgtgaaatcaggcttgcaacaagggctgtgtctgtctgataatatgtgtatctgtgtatcctatggaaatgcatttttaaactaagaagttatatagatatttttaaagatcattaatcaggatcattaacattttccttttttggatttccttgtcttcccatttgaaccacgttttctgcttttctttagtatgtttggcagagaaagcggaaatggaggtagtggcatgagtcagcagaaaggtaaatggaacaactggcagtatttgtgaaccaataaaaatctcctgcaagcaggactcgacaagtttggcatacaaaattgatttgtttcaaaataagctttatcagtttcatagtgttctttgacaatttgtaggaaaggttcagtagtatttcttttatataaacaacctagaactctgagttgcagatcctctgtttaattgagaaaggatcttgggggttatggcccaaatgttgcataggattgttaaaatatgtagcattttttctgaaagtatataatttgtatattttatgtgatcagtgactctcttattttttttcagtatatttttggagattttagccctgatgaattcaatcaattctttgtgactcctcgatcttcagttgaggtaagacaaaactttgttttagtgagtccgtgggtagatacaattaatagttatgtttctattttaatttgtttttttaaataaagaattccaatgtagagaaaagtatggagactaatatgagaaatgcctcaacccaccaactagatttgactgacatttgatttgacattttgctgtatttactttattaggctttgaaaagcaaataaaacattacagatgcaactgaagcctcctttggacctctctcccatctctccccagaagtaactactctgctgaaattgggaaatattggtcctgactggttttcaccttttatcatatacgtgtatatcaccatagtcaatcgtagtgttttatgtgctttaaagtgtcacgtaaatggtatactatattcagtttgtcgtttattttaagctaacgttgtattctttatgctaagaaatttgtccttgttctttgatttccagtgctcagtaccactgattgaacacactgcaatttacttacatattttcctgtcgagggccatttaggtctctagttcagccgttaaaaatattgcactcaatgtattttatcatgtctcctggtgcccctctgtgggctcctccgggacacagacctgggaatggaattactgggttctgtggaccgagcctctttagtttcactagagactgctcgtttgctatctaggattttaacagtcttcattcccatcagcagtgcatgggagttttcttgctcgtattaaaaaaaaaatcttgctaactcttggtgttggcatatttaaaattttgtgaatctgatgtgtgtagtaaatggactctcattgttttaatttacatctcccagattacaaacagctgggtactatttcattctcttcacgtctgctggcaatacggatgtcctctgctgtgaattacttggtttatatcccttgtccatatttttaaatcaagtagcttgtctttttcttactgattttaggattaatctttggttttacaggcatctgttcctagcatgagggctttaagcttcacatgttaggtgaaccctttttggggttgggtttttttgttgttgttgttggataagaggagtacactttcaactttaatgtcaactgaattgatttttttttccttatagtttgtggatttttagttttaaaaatatctttaggaaattcttcccatcctttagataacgaagatatttgtctgttttcttctaaaagttttcagattttgttttcacgcttcagtgtgtaataagctgaaattgaggcactgaattttgtatatgtgtgaggtggcatcgaactccctgcccctgtggccctggcaggtgcctcctcaccattcattgggaactcggcccttagctgtcctgtcagccccgttgggcagtgcatctcccctggttccgagtgtgctattctgtgggcctattgcttatctctgtataaacaccacacgttttattttatttttttatttctattttttcttttcttttctttttttcgagacagggtctcactctgcccaggctggagtgcagagtgcaatcacaattcactgcaactttgaccccccgccccgcctcaggggggttctcatgcttcagcccctgaatagctgggattacaggtgtgtgctgccaggcccgggtggtgtgtgtgtgtgtgtgtgtgtgtgtgtgtgtgtgtgtgtggtgtgtgtgtttttaagtaaggggattttgtattttttcccacatcacactgatgtaaccatacgttttagttgctacaggttttctcaagtgtgtacacatgtggatgggtgggtacctgtttgcaagtgagtagacaaaaacttgagttttcatgtgataggaaagtgaaaagtgcaccgtatttcaagtctgaaggcctggggtcgcttcagttctgccacttccacaggctcggagggtttgggcacgttctttccttttgggcctcccatttcttttctctttcttttgttttttaaattgaaaaaatgcagaatgcttattcacgtcacagaaatgttgggaaatcagctaatgtatggtccgataactagtgagtaacagatgttagtagaaatggatgaaaagggtacagatggtaagttatgccaaaccttttattcacagaagacgtgactgtgtctcatgaaaatgagctcaagcttcagaactcgtagtgtgtgtgggcttatttgggcttttctgtttttcttattttttaacatacggtgaagtttggaggggtataaaaagagtttatcaaaatcacagtaacctgcaaaagggaaatgcaggctaattaacataatcggatggagttgttttccccaatcttcaggaatctgaattataatagcacatgattacacaggaactcactttcatggggcggcatgtggttgggcctgtgggtgtgtgagtggcgagggcgtgtcacttggacctgtgggtgtgtgagtggcgagggcgtgtcacttggacctgtgggtgtgtgagtggcgagggcgtgtcacttggacctgtgggtgtgtgagtggcgaggggagggcgtgtcacttctacagcacagtttggccttttatctctcaggtaacataattgccgctcaaacatgcagtgtttctaccatgtggctgtggcatgagttacaatctagtcgaatttttcatatgctttttctccgttgttaggagcttgataaaatattgttttctctacttggggccatgaattgaaaaaccaaaattaagaaatgtgggatgttaagatgaaagagcattctgccttcctgcagaagcgcctcctgccagcggagggctgctttgtcttttagtttgcttgcttggcagcttgccactggcaagataaggtggctagtaatttagtggcatcaggagaaacgaattcaggtgaaaggtagctggcatcttttctagagttgtgctccagtgatttaaaaattattttctccagtggaaaaaatgcagtcaccttatttaataagcatgtttaaacctcagtcgtaatcctgttatttatgttcagaaagaaagagaaaatgctcaccattctttagtttccagaatctcagctttggaagtagcacacatcccaaccatgactgagtcaataagcccccgatgacatagtgttggcagtgggcagtgtgtgtggtgtgggtgtgtgtgggtactcatggagagtagagagtagagacagttcttaatttggtgtgttttcttttttgagagggagtctcgctctctcgcccaggctggactgcaggggcgtgatctcggctcactgcaagctccgcctcccgggttcacaccattctcctgcctcagcctcccgagtagctgggactacaggcgtccgccacctcgcccggctaattttttgtggttttagtagaggcggggtttcaccgggttagccaggatggtcttgatctcctgacctcgtggtctgcccgcctcggcttcccaaagtgctgggattacaggcgtgagccaccacgcccggcctaatttggtatcttaatgggattttaaaggagggctttgtggttcaggagagtctttgagacggaaagcagaacacacaggtagcccagagggagacttcagaacatgaccttcctatagccacgggcccaggtatccttttcacaaggccgcagcactgttttcacactgtgcgtttagcataactattaatagatgacagttttttcccttgctcactttgcatttgtctagggaattttatgtctttgctttgatttttgaactttgtattcttacaaatagttatatagttaatgagtgaacttcgaaccatcctggcacttttattctgttgtgtatttagatacccagttaccacagactaagtgcatctgatgtgtgagggaggtttgctgaatgaaaggtgctgtgtgcctgtggaataaaacacacacatttccacagtgccacaacccatctggcattcctgcaggtgcgctcttttatcagcttagcaaatcaaagtaagtgtgttgagcatgcttactgaaggtggcagtgtcatctgggagtttgctggtggtcgtctcaccagatccctgctgtgcctcttactggcagtgtcacctgctggcactgtcacctggcttcctcatctgaagctggcagtgtcgcctggcttcctcatctgtcagagggccacagtaacaggacctcctccccagagttgttgaggagcaggatgtgtgcctggcacaccctgagtgcccagtcagtgccacctggtgtcactggtccagcctttccagcctctccaccctcagtcagcgccacctggcattaccggccccgcctctccacttggcttgtcctcagcgtcatctgtgtatttttcccgattgctggggttttcttctgcatgttgtgggagtggctgggagttgagtgagtgttcacaccccgtggttgaatgttgaggaaggggacagccggaagatggtgagcagggttctaacagctctctgccttgtgaagtggatgggtgaagaggtcccttctctgaattgtgcgtcttcccagcctgctgcagtctctcgggtctggaggtttccttcagcattctctcttccccgagcagaacagaatactgggaagtgtgaagagaacattgatataatagtgatgaaactgttttgactcagaaaaagatgatttcttgatgttacaataaattttgtgtaaaaatagagtgattcaaaacacttttcatgcctcaaaataacacagctttctgtcaccagggggcatcctagtgtcattaacagaaaaagagggcattctatgtatcagtttctaaactgtcttctttgaccacagagggttttgaacgagatggaggcttcctgagacacacatggccgctgtgtccactgcccttatagacccacctctctgctccaggtgcctgccagcatcaatgctggtgtgtggaatggtctttgccttgcgggtgccaaggctagtgtagcccatctcagcatacagaatgctttcttctgggtgtcaacgtgatgcgtactaggttgccccctggtggtggagataagtgcagctgtcaactcctgaaggtgttggcttcttttgaattgccctgtgttttcctgtttgtcataattctctgggaagagaacttactgcgttactagcagagagaagcttttattgctgtgattattgaattggtgtgctgagatctcattggagaactcagctgaggaagccaatcaagcagcagctctcatacagtattgggcatgagacttacctaggagcctctgaactttgcggccctagggccgttcctgcactggcctttgtactgcagtgaacagactttgggaagtgctgcaccagaatgtctttttgttcttttgttctgccctcaggtagcagtttatctctctgcttaccttaccccttttcttcctaaaccttttttttttttttgagacagagtcttgtgctgttgcccaggctggagtgcagtggcactatctcggctcactgcaagctccgcctcccgggttcacgccattctcctgcctcagcctcctgagtagctgggactacaggcacccaccaccatgcccggctaattttttgtattttttagtagagacagggtttgttttttttttgttttgttttgttttggtttttgagacaaagtcttgctctattgcccaggctggagtgcagtggcgcgatctcggctcactgcaacctccatcccccaggttcaaacgattctcctgccttagcctcccaagtagctgggattacaggtgcctgccaccacgcccagctgattttttgtatttttagtagagatggggtttcaccatgttggccagactggtctagaactcctgacctcaagtgattcacccacctcagcctccctcattgctgggattacaggcatgagccaccatgccctgccccttcctaaactttcttacacccaatgtgtccattggaagcatttccaactcttaaataaatgttatggaatagctaggaagaagaaaaatttaagttatttttgagataacctttcagctttttacaaagaagtcagacagttcccattctgctttctgtctgccaaacaaggaatgtgacttctagctgttaatgtagttaattaaggcactgtgttaaaaagggagctgcagtcaccaggctttttgtttatagtgcgctttcctctgctctccgaccatggacctggtcccagcctctactggctgtgttgcaatgtagtgatcgtgaataagaggtgcagtcaggaagagtcatcttcgctagtgcacaaacaaaagtgtctgtggtctggatggtcagtcactgacatcctgtggaaagaaggatgtatcataagcatttcattgtagctgatttacatgtccattggagttcatttttattccttttggcttcattttcggatctgtttaatagtgataaatatttgaaagcatttctattgtgtttttttcgttaaatgaagatgatttagattgcactgactcttcatgtatgttattctgctagaagtaacggcatgcaaagttgtatggattaagagttttaatgaattgttgccttaattaaatggtaagcgttggttttaacattttgttgaattaaaatttgttttctgattccttgtgcagcttcctccatacagtggaacagttctgtgtggcacacaggctgtggataaactacctgatggtaagctagttctctccttatttccctgaagggaatttggccatacgtgctgggtgggcaggctacctgtaaacattgtttcccatttgaataaacatttctttgtagcttgaagtttttgctgtaaactgtaatgtatttaattgctgaatcactttgactagtgaattggttttaaagcgtatcctgtgcttcggagtgccagccatgtaagatttagtttaggaaatggttgttgagttctttttttcctaacagttctgagtgcaacaggtatgttactcttcatcagcacatgctggagttgaagcgaactttgggtcttgttgctaagcagcctgctggctccagcgccagctagcttctgagcctgtgttctttgtaaactaaggggcagctggcatctgttgttcttgcagttcacattcatgtcctggtctgtcgctgactcttgggaactcaggtcaactcttcacctcctggtctgttacttttttgggtctccatcacaggcactaagctgattgccagagatggtgcttatggagatgcaatgattttgtattgcttaagtacccagcgttggaataccaacaaggttgtttaattattgattgcaggctgcccttgcacaattcaaacttgtcgagatcatttttcaatctgaatcactttaaaggcccttactggcctccaggaaactgatgccaaactttttctttgagagttagaggtttggattccctgttcagttagcatggtcagacttatgaaaggggttttaattacaatttaggcttcaatagaagccttgaaaagactaaccaaacgttttatctccagtaacatcagggagtgattatatctaaaattttagatttataagaaatgtgggagaccataagggaaagagcagatctaacaatagcttaggacaagtaataaaatgaatgaagcttgagggaccgggaagccgggctgctcagcctcctgagccaccttttaattggctgatgtcaacctctcagacatctgagtcagtgggacttcctctgtcactgtgtgctttgcacgtggtgagcatgctgctcatgttgaaccagtgcttacaaatgccccatgatgttcccatgcacatcacttctttgagttcaccctcctccctgtgcagtgggcaccaccagctcccccagcctctggagttctgcttccccctccctccttccagcctgcctgcccttttcagtgactgcttcttggccctttttctccattctttactctgttccctctaagtcctgccttttttctgccaaaaacacgactggaatcttgccaccagtttgcacagttagtgacaggcctgcttttctctgcagcctttctgggtatcttgtgtttccatgacattagtttctcttccagtgcctgttcgactgtacagagcctgtgggcactgtcatggacctgcctctctttccagcctgctcagctgctgatggcaggatccatttctctgtgtctgtcactgcgcctgtagtatctggaatgttgtaagccctcagtacatttgttggatgaatggtttaggatgctttattctgctccctcccactacctccagctgcagcaagccctttgcagaggcacctcatcgtggcttcccttttagatctcggccttttctatttttgtgttttttaatttttttatattttaatttttgtaggtacataataggtgtatatatgtatggggtacatgagatattttcatacaggcatacaacaagtaataatcacatcaaggtgaatggttgtccttcacctcaagcactgcctgttttagatgttcctaaagcttgagataccactccttcaccctgcccttagcaattcagtgatccatcaagttccactgacctctctagtttctgatagaagttgatcactgtttcctgcatccagaagaatcctttttctaaagctattcacagctttctctcccctccctccatgttttcattctcagttgtttgtatttgtctccctaataaatgtgaactctctgagcagggcccttgtgtcactaatctctgtatatttccctccctcgccccctgccttgtagtccagtcctctctactgcatgtactgcagtgagcagccttggagaaatgctgtgttaggattcgtggttttaagagcctctgcctgcattacctgagtattgagtttccatcttcctaatgtattgattgggttgttgaagccaagcgtgcaggccgtcctgcacttcgtctgcctggcacattgggctctgagctctctgccatgcggtgcaaggcacatggcgtccattgtgagtgttcctccataagaagaggaactgtgctggctaggaatctgccttctagtgagatgatcaaacatggtattgagtaaatgtttgatactaattataacatactgaaatggttctgttcacgttacatcacattctagaatgttttatgttctgataagattgagaattgagatgtgtacagcacatctgtgtcttagaaataatcagtcttgcataagctgaatgacacaacacgttctagtttctaatgtgatttcacagccttcaaagggcaggctccacatggagccttccgccccaggcacacccgtttcaatctggggagccttgacggccccagaacatcagggaataggggatgtatggaaccaaaatgaacagccagcccctacatatgataataaattcatttccccttgatattcttttcaaagtaaggaaacaaaaaataaatagtagccaaaggaattagatggtcgtgacttcatgcataaacttgctgttaggtgtaatcgtcatcagtgttcttttccaggaactttctcttgttggggcaggattgtgctgccaccacccttcaccccccacagtcgggggctgtgattctaaagcatacgaagattcaggaggcctcgggaggctgtgtagctccagcctcctgcacactcacttgcacgtaactggcccctctcagcgtctgtattttttcttctacaaaaagatttctaggggtcctttcaaggtaaaatatattcagttctccgcagtagaacaccgttctttgggtattagtttcttttcttaagatagatgccttgaaaaaaaaattggccccttaatgctagcctggaagaaatcttcatgcattaaagatgaaatataaggcatgtgtccttcccttaacttcaaaatgtgtaactttttatcaaatataaggtgacattgatgcttgatttctgttgaaagacacaattgattctaaaacttaacctgatttcagaggtgtaaactataaaaatacgtctgtcttagcaggaatgaattatgtggattgtggttaactgggaaggaagtattgaaggcttcccaagagatatttaaaagttcacaattctaactttttcttttggtatttttggaaggctttaccacccatggggttaatccagtgtgaatttatttagaggacgtttgcatgtgttcatgtcagggccatttttcagacttaattgaaggttaccagcggaggagaccaagagatagagaattcagaagagtgctctgaagtgcgcttttatatataggattctttgttgttgttgttgttgttgttgaatctttttttgacatcttttttttttgtttttaaatttatactttctaatttctcctatccagtatgtataggattctttgcgtagttcatgtttttggaattaatcaaatcacgttaactacagaagctgatttaaccatgttttaagtccctaagttagttgtcatgatcttttaaaatttaagttgtccaaaatacatattcctttatctcaggcataaggcagctataagaaagtcagattccactggggggtatttttaaaattggcaaaatattacttgctttttattacaaatttattttaatttctaccttctgaaagccttccttagctagaaagataagtacaggcttctgcttttcatatccccaaattaaataataattttatagttgtttcattttccgcaaattgttcagcgtaagtaaaggacgtaatagatttgttgattaggaagagaacttaaggtttttattttcaaagagaaagtgagtaattactggtacttagagtttgtagaactgggttcttaactaatagttttctttctaaacaggacaagaatatcagagaattgagtttggtgtcgatgaagtcattgaacccagtgacactttgccgagaacccccagctacagtatttcaagcacactgaaccctcaggcccctgaatttattctcggttgtacagcttccaaaataacccctgatggtatcactaaagaagcaagctatggctccatcgactgccagtacccaggctctgccctcgctttggatggaagttctaatgtggaggcggaagttttggaaaatgatggtgtctcaggtggtcttggacaaagggagcgtaaaaagaagaaaaagcggccacctggatattacagctatttgaaagatggtggcgatgatagtatctccacagaagccctggtcaatggccatgccaattcagcagtcccgaacagtgtcagtgcagaggatgcagaatttatgggtgacatgcccccgtcagttacgcccaggacttgtaacagcccccagaactccacagactctgtcagtgacattgtgcctgacagtcctttccccggagcactcggcagtgacaccaggactgcagggcagccagaggggggccccggggctgattttggtcagtcctgcttccctgcagaggctggcagagacaccctgtcaaggacagctggggctcagccctgcgttggtaccgatactactgaaaaccttggagttgctaatggacaaatacttgaatcctcgggtgagggcacagctaccaacggggtggagttgcacaccacggaaagcatagacttggacccaaccaaacccgagagtgcatcacctcctgctgacggcacgggctctgcatcaggcacccttcctgtcagccagcccaagtcctgggccagcctctttcatgattctaagccctcttcctcctcgccggtggcctatgtggaaactaagtattcccctcccgccatatctcccctggtttctgaaaagcaggttgaagtcaaagaagggcttgttccggtttcagaggatcctgtagccataaagattgcaggtatagttgaaaagatacaaatctagagtgaagatgggagcagacctcatcaactgggcttatagactgtggtgttacccataacaatggcagattacctgtgtgttaatagcaacgtctgaaggatgcctatgtcttaaatgttctctaaaagtaagataatatagaaacaaatgggaggagagggttgtcgtaactttatgttaagtgaaagatccatgtctgttagcagttcttttctgttgacaagttacatttccatttcttgccttttgttcaagtaattctgctccacggtatgaatgtataatggactttttctgtgatatacctttggtatgataatcctgatttgtactcactgtgtgctccttttttatatttcttaagatacaagaaatcattttgtgaaataacatggttttttttttttggattgagtaaatggattttattcagaattttgatacaccaaggtcagctcttgaagagaaaaaaaatgttaagggttcagcccaaagttaatgttttattttagagtgctaaggctccaaagtagaaacaattcacaataaaaatagaaagctgcataattcacagattgtttttaaaaagttacagtaggaagtcagaaatgcagcagggtatgaaagaggtatgtgtcctcacatagccacgtgttgcttaactaagatggatatgtgttccgagatgtgcgtgttaacatcagagagtactacacaaatacaggtggtagagccttaggctggtggtgcagcctattactcccgggctgcaaacctgtccagcgtgttactactgaatactgtaggcagttgtaacacagtgctaagtatttgtgtgcctgaacacatttagacatagaaaaaatatagtacagatatggtataaaggatgaaaagtgcttcacctgtatagagcactcaccgtgaatggagcttgcaagactggagtggctctggatgggtcagtgatgagtgctgagtgaatgtgaaggcccaggacagtactgagcaaagccgagttttataaacagtcaacacttaggctgtactacgttgatttacaaatttttcctcaataagaaattaaccttaacctactgtaacttttttacgttttattttacttttaaattaaaaattctaaactttttgactctttcatgagaacatttagcttaaaacacacactacagctatacaaaaatattttcttcctttttattcttactttcctataagctttttcatattaaaaattgtttttaactttttaaacttaaaaagtaagacacaaacattagcctgggcctgcacagggtcaggagcatcaagacgccactaggcggcaggacgtttcagttccactagaatcttgtgggaccatcatacgtgcggctcattgttgaccgaaatgttacgccgcgcgtgactgtacgtacctaagaagcagaagctgtgtcatcaggttggattccaccaagcctggtgaccagatcttcagattgtcaccctagtagccaagttaaaataagctgtttggtttaggctttctgtaatactttctgatgtgaccttttggaacacctgacacccttcattaccaggatgtagcagcaagctgccaaatgcacacccttcgatggatggtcagaattgtgtaaaaaataaaacacattctttgggtggcaatagggtgatagcaagcaatgtatatatatttttaagagtattttattccttatacaaaatacattatctcaggtactcttgttgttctgaagttctcttaaatgagcaaatgataggccagacgtcgttattttgggcttcatatatattttttaaagccaggtgattttttttttttttttttttttttttgagatgcagtctcactctgttgctcaggctgtagtgcaggaggcacgatcttggctcactacaacctccgcctcctgggttcaagtgattctcctgcctcggcctcccaagtagctgggattacaggcacatgccacaatgtctggctatctttttttgtatttttagtagaaatggggtttcaccatgctgcccaggctggcctcaaactcctgacctcaagtgatctgctcgcttcagcctcccaaagtgttgggattccaggtgtgggccaccgcactcaggccaggcgatttcttgaatacagctttcagaatgtatttattgcaaggactgatactgtaggtggatgacaaggtcaggagatcgagaccatcctggctaacacggtgaaaccccgtctctactaaaaaaaacctaaaaatcagccaggcgtggtggcgggcgcctgtagtcccagctactcaggaggctgagacaggagaatggcgtgaacctgggaggcggagcttgcagtgagccgagatggcgccagtgcactccagcctgggcgacagagccagactccatctcaaaaaaaaaaaaaaaaaaaaaaaagatagattgtgtaagcctttatatagattactaagttaaaagtttatttttaacctataatgagaaatgcatggtggggtcctgttaaaaatgtgcattctaagttcgaagtcatgagaattttattttcttttctttatttttgagagggggtctcactctgtcgcccaggccggaatgcagtggcgcaatctcggctcactgcaaccttctcctcctgggttcaggcaattctcctgcctcagcctccctagtagctgggactacaggtgcctggcaccacgccaggctaatttttgtatttttagtagagaccgagtttcaccatgttggccaggctggtcttgagctcctgacctcaagtgatcctcctgcctcagcctctcaaagtgctgagattacaggcgtgagccaccgcgcccagctgagaatattatagtttcgtttctaaaattgctccacaaaggaaaacctcccatcttagggagattttctctatctttatttaaaataaccaagaaaagcttcatttaaaatgttttagaacattctacttagtcatatgactttaaatatagtttgataaatagtttgttatgttctgtatatgttaaagtctaattgaagtagctttgtcaaacactgaaagtaagggcctcttaatgactggtagtagaggaaagccttgccacacacagtccacgtaattatttttgtgtggacatattgtaaacccctaccaaacagattatttttttaatcctatttggttaggtcagttatgaagatgttttaattttctgagcaaaagtgtagtttctttaaaaatatataattcttttcagcctgtttgttgaggcttcgatagacagaacgtagttgttgacagtttcaggagtctcgtgagatagtagagcaatagagtcacattgaataacccttgggatcatatagggcttagggagaatggcattgtttgaaattttttttgttgttttattctcctacttagggatttactttataaaagtggtaaaacatactcagtttgttacaagtcagatccactaccacaaattccctttagtgggcacacttttaagtgtaggcccacttattttaagcagcgtttaactgagtgaaagtctagtttcattaaaagatctgttgatgtgggttataatagagtttgacttgcattagtatctaactgtttctactgagacagtggtatttgtgttattaacttttgggaaagagggagtagggaatgatttagacattaaatgtattcctttctgccaggcatgatagtgtggagattgaggcttgaggctcgataacttgagcccgggagttcgaggccagcctgggcaacatactgagaccccatctttaaaaaaaaaaaaaattatacacacacaaaatgcttggaataatttgtgtattttttatctcaagtttgtttcaaatactcacatttctggactatttcccctattgttaagtctgcttaataaatgccagctagtttttatgccatcagaagtgaaattaagaaggcagatggactaaaagaatcacgtataagggattttgaagtgaaatacattaaactcttgattactcttaaactatccactttaacgggttctacttggaccttcttggtggcaaggccatctcctcggtgtaggttatgtgtcaacattttgttccattggctgtttttcaagtgtgaactgttatttgaaaggagaaggacacgccaggggagagcgtgtgaactgaatactcagtgatttcctttagccccaagggaaggatgtatctaaacacaaaagccctgtcttgccgagggttggagagggatctgtgtttcagtgactggtctgagaggagatggttgccatttatcagtaggagtcaacaaaaggaaacttaatacagcccggcacagtggctcacgcctgtaatcccagcactttcggaggttgaggtgggtggatcccttgaggccaggagttcaagaccagcctggccaacatagggaaatcccatctttactaaaaataaaaaaattagatggacgtggtggctcatggctgtaatcctagctactgaggaggctgtgtcaggagaatagcttgaaccggggaggtggaggttcagtgagcccagatcgtgccactgcactccagcctgggccacagagtgagactgtctcaaaaaaaaaaaaaaaaacccaaaacttaatagcttgtgtttgaaagtagttgcaaaacgcgacacccttgttaagagtgagtatggcagacacgtggggagtgcctttgctgctgcttccctcattagcacagatactttggagttgacgaacatgtgacgtttgaaattgaacgtatgctttcattgaacattgtacttttcctgggtctttactaaggaacattcctcatatactagacgaaattgtatcagatgctttcacatcacaaatagagccattttgtatttgatgttttgctttcaaaattatgcaacagtatattttgttttaacagaatataaataatgctgggtaagaagagtggccaactgcccgataagttaaaattccagtgagagagaactaggaaaactgagctcttgaacagctctgaaaacattgcgttgaggtatctagcaatgtcatttattatgaattgttagtcaaaacctgtttatatgatttttcacagtggttttatacctaaaaggcattggatcaagaaacaaagttattacaatttgggtcttctctaatgaattaccctgtccgtgtttatttaagtgtaaatgaacatacagttatgtgctgctttaatgatgtttcagtcaacaacagaccgcatgtacgacagtggtcccataagattataatggagctaaacaatttctagtgaccagtgagttgtgttacagttgcctacggtattcagtacacaacatgctgtacgggtttgtagcttaggagcaataggctctagcatatggcccaggtgtgtagttggctataccatctaggcatgtgatcccacaatgacaaaattgcctaatgccacatttctcagaacatatccccatcattaagcatggctgtgtatcctaaaactgatctttattttggcagtttataaatcatgcatatatttccccccgctccttgggggaaatggtttctcagatattttgcacttcctcttcaaactctgaagtacacaggcagtggtcatgcggcgtgatctaagttaaaaaggcgtggcacctgtttaccgggatccacccttgtggactgagagtttagtccacatctgattcgatgtttgtagcctcacatttattatacatctttccacttcagaaacataagttgatctgtagtcaatgggtagtggtacattttggtcactttgctgtcctccacctggttagataaccaagatagtgtgtgttcttccaaattgatggtaatgaggaaaagaaaagcacttggagaatgttctggacagttagaatgatgacagaaaagcaggtcaacaacaccagaatgtcgattacgggccagttattgagccctaagaatcagagttctgtaccttgcattttcagggattttcaatgttaatatgacccctaagtcctaattttaggaaaacagaatttgatgtgtaaaatatgtgtaagaataatcatagcttatgatgacataaaagtttacgatgctggtattgcctttgagttgataaacaatttcagtgggctgatttgtggcagcccttgtgagctaccatctagcatgtatgtcttaaaatttgaaaaaaggctattaagcaactccatttttctgtatgtcagcagatttcataagagtgaaatttcagttcagccttttcatgtgagttattacaaaagtgaactacaggtttcaattttgtgtcttttatgagtcattctggcattttgtgccttttctcacacattgttctaggcagccccaccaactcctgtgacaaagatggactgggggaggccatcttcctaaagttgctgtctgaacagttaagtagtaaattataccaaccatgatgaattgaaaagaaggcttctggggaaagtttgttattagagccaacttctattatatgcccttaaagaaggtaaaatagatacaccaatggcaatgactttggaatgcaggtcaagtttcaacctagaagttgcctgccctctatccttggtggcccgccttcctcatttttattcttttagcctccataattggaatgcgtattggactttaggctaggaataacattgtaaatgaaaatgttgatgttgaaagaggaatttaaatagagcgaagagtgatattagaaatttggaagtggtattagttctggcttgtccgtaagacctgacttttgcatgataacaataggattcattcacttgaacataattcggtctggtcttaggaggaattagaactgcttttgcacccctgtttttttcactgcgaggaagaagaggagctcacgaacttcataaagcgttagtgtctcctccagttgatggttatcgaaatgagtcaggatggaaggcttagtgtacgtgtgagatgttacaaaagtggaccttaaatgtttcttgagtgtttggatcttaagagaaaatctttgacaataagtatttaatcttcatttcttacaatcattcctcttaaaatggagctttattttttaaaaacgtattttttttttcttaagaaacagggtcttgctcattcattcaggctggagtgctgtggcatgatcatagctcactgcagccttgatctctcaggcgcaggtggtcttcctgccccagcttcctgagtagttgggactataggcaggcaccaccatgtacagctaatttttttattttttattttttatttttcatagcaacagagtctcactgtgtggcccaggctgatcttggaactcctggactcaagtgatcttcctgccatagcctcccaaagtgttgcctgaaatagaactttattaatatatctttaatatgtcaagatgtttaaaacttgtcaagattttaaggaagttgggctaacatttcctcttgggatgctgaaagttgttggttttctcagactctcacataaattcatttgcttttcccttctccttccacctctattagctctttattttctaggggggattctgatgtctgtattgagctggccgtcatgccgggagtggtctgcttatgtatttacatgcgtgctcatctttgctatagctgagcgtggtgcagctccttacctgttccaggtgcggagtgatctgccgcacaatgaatgaagtggcagagccagggcgcgaacccccgtcttcctggtttgtgtgcctgggcccttgccctttactgtgcgtcttctcaggagctgtcatttagactttctggaccaggagctaaatgacctttaaagtctgttgagtcatttctaacaaatatgagtggagtcatttgccgtaaccaacaactttaatctccagatgtttaattgatcctgtattactgtctaatgagaacttactgtatgccatgcactgtctagttggagtaatgattggccttgccttcagggtagtctaaggcataagatcagaaaggaacagatggcagctgtttgtagggagaagtgatcattggcagaggggtgttgaggggagaaagcaaggaggggaggcctcatgcagctagtagggatggcagtaacaggctgaggacacaaaaggccaccaagtcctgttaccttagatggtgcggactttgttgagcagttgaagtgtgagagtcttgtctttaaggagcctcctgtccagagaaggaggcacacagcactaatatcaggtaggcagtgatgaggtcagctactgtggagacagtgtggagaatcttgagtgccttctgtcggtcttactctgagattaggatttaggatcattataagagattaataacagaatgatacggtattttagtttatgaaagacttgccactagataaaatttttctacagtaacagaataatcattaagaaaaatctaggttgttcgtgtctcttctgtattttccaagtctgaaaaggtttattctgcgtttaacgacgtcgtaccagaatggcctttcaaagactgtcaaaggcttgaaggaaagcttggtggagtacatttcctagtacacgtcccaagggcccgtacgtatgttctgctgttgcagaggttgtgctcgttcgcttttgtaggttccttgcagttattgaacaaaccactgggtggtgctagaagacttgattttaatactgtgcaagaaaaactgaaactgctttttaacctgcctgcgcctcaaaataagcaaactggaagctggtatcgatttaagggaatggctgatgtagaaactaaaggtttctgtctgactagttcatgctgtctcacaaataaatgctgggaaaaaagtcggtttatagttgatttatgtatcctttgattgcatagagattgaatggtcaagcctccaggccatgcagattattctgggcccctaactcagttaagaacatgaaaggaggccaggcacagtggctcacacctgtaatcccagcactttgggaatccaaggcaggcggattgcttgaggccaggagttcgagaccagcctggccaatgtggcaaaaccctgtctctagactttgtcccagaaaaaaaaaaaaaggagctgtgttttcagacagagcttagtgcagccagttcttgatggctgtgcaatgctttccttttaagagtggagttagcctcgtcataaagcgtgtttttgagtctgttcgaacgggtcaacaacgaagggaagtttcaggcagatcttgtatgcctggccctggtggctgctttcatttccttccagtatcagtgctaaacaggaatgaacatgttcaagccccgtctcacccacctctggcatcttcgccctaactctgccctagaagacctttccttccgtatcgtcaagaaaactgaagttgctgtttcactccttctcccacccagaaacttcgctgcatcttcctggatccctagctccttgcacccatgatcctgtctccttcctcagcccggcttctggctgagcagcctgcacttgctgtcttcactcctacacgctgcccccactcctacacgctgcccctgcgtgcttctcacttctctacccttccagccctgcactctggggacctgtgcgtatgtttgtgtgattatcaatctgttgaacccaggaggtcgaggctgcagtgaggcataatcacgccactgcactccagcctgggtaatagagcaagatcctgtctttaaaataataattatgattgggtatggtggcacacatctgtagtcccagctactcgggaggctgaggcacaagaattgcttgagacccagaggcggaggttggagtgagctaggatggtgccactgcattccagcctgggcggcagagtgagactgtctcaaaaaaaaaaaaaaaaatcagtcacttgctggtcttttaatatacatatacgatttactggtgtcatctgggtatcttttactaacatctctaaaactgagctcattaccacactaaacaaaaaataacctgctcatctgttgtattcctcctctagttggatagcactgctgccccagtcagtgagaaccttctagtatatctgttcttcctcagcttccatttggtggcttcaacccctgaccttcccagagtttctgcagcccttggattgggctaagcatccttccccaccccccgccccccatctcccaacaccccttcagcttagcctgtacagtgtgtgtttggagccagggacatcacagttcgtcccttcactggtctgcgagcttgcctagggcaggaccaccttgcattcatctctgtgccttccttacccggtgcctaggcagggctcagcaggggtttactcgccttcagcgaaaggcagcatgttatttaacaaaggtttcagccacacaccatggctcatgcctgtaatccaagcactttgggagaccaaggcaggtggatcacttgaactcaggagttcaagaccagcctggccaacatggtgaaatcctgtctctcctaaaaatacaaaaattagccgggcgtggtggtgcacgtctgtaatcccagctacatgggaggctgaggcaggaaaatcacttgaacccaggacacagaggttgcagtgagccaagattgcaccactgcactccagcctgggtgacagagcaagacttgtctcaaaaaaacaaaggtttctatgttagaaagatagcaggctttgagtcttaaggttaggtttaaaaaaaaaagtcatttgatataaaaatactatggcaaagccttgttggaatcatgctggagttttcatttgagacactatgcctttacgtcattgatggttatttgaaaatgcacctttttaacactgcaatgacattagttgctgttctgtggcacacactagaaatgatagactgttgtgatgatatggtttaaagacaaatgtaaaaatccactgtcaatagactttaagcctgtggggaaaagtaagtatctgaaaccttggaataaaagggatttttaagtgaagccccttatatattgaggaaagggctcaacctcttgagtcaggtggacccaggttcacaggtcatttcagctgttatgtgacctcagttttctcatctgtaaaatggggttggtaactatctctgacagtagggttatgataattatgaataatatacacaaagcttctagcacagtgtccctcacatgacaggtgctatctctgctgggtgtcatcacatgcaggcttggggttcagttcgtaactgatccattattcatttatttcaaggcccagttcggtattccatattaagagagagaggagctttgcaaacttagtctaattaaacagattccacagaatctgtaatattttactttctacagaagaagagctagcagaaattattccctacgcttcttcagttagaaggaagaggacatttattcataggaaggagggaatgagaggggtgggggtgtgtgtgtgtgtgtgtgtgtgtgtgtgtgtgtgtgtgtgtgttttgaattttgtaaattaattttttcatttgattagtgccgaagtctgggatctgccagtacaatgtagtttagaaaagaaaagcttatttttgagcgatgccttagatggatgctactatcaaatgtatgtatgccattttggtttttctttcctatatacaatttgtttatttattatactttatttttaaatgaatttttgatttttgttggtacatagtaggtgtatctatttgtgggttatatgattagtatacaatttaaaagtaaaggagacagtgtggattggctgcagattatggagttgaggccctggctatgctacctggctcctgtgtgatcacaggtgagttagtcagtctttgggagcctcattttccttattggtgaaagggtcaaagtggtggtactcctagattactaaggattaagtccagccaattaacatttgtcaattgtaaagaacgtgctaagtgtagaagggtttataaattgtagccatcaccattagaagattcatagtgggacagggggagaccttgtcttgttttcaagcatttctgatggttaattctataaagatggcattcacagctgttttaatacacagaaagagtgatgtccactcagggtgaacctgaggctgagcagcgtgtttgtaaatggaataagggaattacagtttataaaacagttgctaaattggatttctagtggacggtttaatttgtaggagaccgctgtctctgaaaggagtatttttactcactgaacagccattgaacacacacagtgatgtgtagggtcagcattagatgctggggatgcagagaggaatgagacgtgggttctgcaagatatctttctatctagtgtctgaggcgccttgctgctgatgagacacacctggctaatggtgtttaaggaagaaaggctgtatctctcaaatctattctctaataatgatactgtgttaacatttttttgtttctcattaaaataggtagttcttgtgttccctaattctgttccccccaggaagattaaatgttgctatttgagggaaaagattagtttcaaaaatgttctaattgaataatgtacttgatgttgaactgaatgaagccttaacagtatgcattttctttggctgtgtgttttactgaagggattttaaatgctgtcccagagtagagcatgtgaaatgatttgaatgttcttcactagatgtcatcaatttctgaaatatgcttcttcactctttcagagttgctggagaatgtaaccctaatccataaaccagtgtcgttgcaaccccgtgggctgatcaataaagggaactggtgctacattaatgctgtatccttcctggacgccgtccgcaaggccagcttgttgcagctgtccctcctttgggtgcatgtgacttagctcagcttccgtgggccatctagctctccatttgaatccctaagtctggtttattacttggtctgcctaccttgcttataaacaggattattcctgaccccagtccatctccctctaaaagagaggatatgttggcacgtgaatgagggctgcagacaagctggctctcattagaatagtcacaaataatagggcagagcaaccacttacaactggaaatttggttttaactgattgaactgtcttggttaggtcaagttcttgaatacaaacgactgactgcttcgtagatccttatatggacatcacaggacacttaccctagtaactatttggtttattccttttcgtggtgacatatctaagtagttcaacgtccttagcttccttgtgtttttataaacattcttgtgcttcatgtgccttcaggaaatgtggtgtgtctgttcatttcctttacgcttccttactgccactacatagacactgcaggcattggttgcttgcccgccgatgtaccacctgatgaagttcattcctctgtattccaaagtgcaaaggccttgtacgtcaacacccatgatagacagcttgtaagtaaggtggtgaaagatgtgttaagtggtggggtttttcccgtctgataattagaattgaaatagtttagtaaagctcttgatttcctgcaaatgagtcctataattctgtctttttttaaaaatagactgttggcgattttatatggaagttaaccagaaatggaattggagcattgatgatctgtgttctttagattcagtagaaaatattttagcgtttaccagcatatatcacttgaaatagaccaaaaatgcatatagaagagacttgagttcactagctgttacagcattggttacctaaaatctactatactcgtatagctgatattctacttagccatcaaagctctttagtaaaagtatatattgtttaaaactgcactatttaacattttttccccatgtttagtgttcggctaatgaatgagttcactaatatgccagtacctccaaaaccccgacaaggttagtaaaaatgagttttgttgatgctattacatattgggagttatggagacagatgacttaaatttggtaaattcagtcttgttgggaagatagtgtctttacacctatgccattctcaacattcagccaggtgggaggtgggggagttttgatgatgttgcttttttcatcatttatgagttcattgtagttaggaaaacctgtgtcctctttccattgcagctcttggagataaaatcgtgagggatattcgccctggagctgcctttgagcccacatatatttacagactcctgacagttaacaagtcaagcctgtctgaaaaggtttgagacttctctgttgtcactagtatcaagtgttgccttttgttccagtgtttgtgtggtaactgttgcttattgatatttgccctctgtctccagcgctataagtagatgtaggtttataagagtccattgcttggatgatatggtgcaccaagcactgctctcagtactttacatatattaacttagttgactctgaataaagtatgattatggtctccttgttacggttaagagaagtgaagccactgtctgaggtcaggtagctaatgtacatggcagaacccagctttcaagtcagttctcttaaccactgcactatatgccactggggtagaatggagtgcactgggcctggaatgatggcagtattcagaagagcttatgtcttcatcatacttacaggctttagtagctatttgatgtacttgattcctttacctaatttttttttaatcacatactttgttactaaaggcatgagaccaaggggccagggagcccttataaaaggccctggggctgttgagagtgacttgggccgcccttagcaccgttaactggagcatttctttcctcccagattgagtttgtgatgaatcagtacaagcagttgaaatgatgcttagggaaatgtattcagagagaaaaatagttgagaaaatgccatttaagtcaagtttacttgaagcttcattgctttgaagaagagtgaatgtcgagggcatcgttgcaggataccaccaggggtagcatagggtcttaagctttttaaatgcttataatgcagcttttggtattggcttggaatttgcacttcccaagtaatgggaacatggtgttagggatgcagaaatggaatgaagtgcgccctctgccctcagtgagggaatgagttaatgaatagtcaacaagagaagcacaaagatacagagatgccttagaacccagaggggcccacctagcacaggtggaggcaaaataaagtgggtgctcaggaacccctcttggatcgtgcacagagataatgctatgaacaaaagcatcttctaaaggttacattaataggggatgtgttgggctccccaagaccaccctgaggttgggtgattcactggaagaactcagaaaatgcagaagctggtatacccgtggctatggttgctgacagcaaaagcatgcggagcagagtcaggaagggaaaggacaggtgaggcagggcctaaaggaaacttccagactcctctcccagtggggccacaaggctacgcgtaactactccagcaccagactgtgaccacacgtgaaatgctgccaaccagggaaggtcattacagactccgtgtccagagtttttactgagggctggtcccataggtaccatctgcctggcttgaaccaaaagtccaaactcccaaaacaaaagcaaagtgttcagcagaaagcacattgcttgcgcaaacggtttaggcagaatcccgtatcagttattggaccgatgggaacctttctgaaatccaaattcccagacaccagccaaggggcaaccttgcaagcaggcctttccaaggagagccacccaggcctgctatgaaaagtcttcagcacactttggctgtgccagtttttgcccttttctgcacacgtgcagagcatgcactcacgtgaacagctgctgtccacgtctactatctggagagggcaagtaaactttgcagtttacctagatgcttcaaacagaacaatttgcagggccttggaataggcagttgtgctgtgaagaatgaaatatgaactgatgataagtaacagaatcaaacactcgtgatgtgggattattaaactcttgggtgactcgtctgtgaatgattttgctgatgtatgtgtaacacagctaacgctctaaatcagtggagtttttccacatgtagtttgagttctttcccatgtagttgtccatcatcaaagacagacagaagcagacatagggctgcttagctcattgctcgagtggtgacccttgcagttgaacagtgaactggccctagacatctagttcttcgtcttctattttgtttacccaagacagaaacttttttttaaataacttttttgtgataaaggtaatgtggccaggtgtggtggctcatgcctgtaatcccagcactttgggaagccaaggcaggcaggtcacctgaggtcaggagtttgagaccagcctggccgacatggtgaaaccccgtctctactaaaaatacaaagattagccaggcatggtggcacacacctggagtcccagctactcgggaggctgaggcaggagaatcgcttgaacccgggagctggaggttgcactgagctgagattgcaccactgcactccagcctgggtgacggaatgagactttgtctcaaaaaaaaaaaaaagtatatttattgaagaaaatttcaaaaatacagaaagtataaataataaaaatccccattagtccacccatttagagatatgtgtttagtcagtttctccttttcctcctactcttgggatttcagctatgcaagggaaacccatgtcatcatgtcattgtttggaaatactttacatcttccatttcagaggaggcatggttggactttgcaagtactgcatgtcctgcaggcctttgacagtgatcagttcacagtaacgtgattatatttgaccttttcagggtcgacaagaagatgctgaggaatacttaggcttcattctaaatggacttcatgaggaaatgttgaacctaaagaagcttctctcaccaagtaatgaaagtaggttatggtccacttgccgcagagttgtgcaagagttcgctgtaaacaggtgttgcatactcatatgttatgttgcttccctgcccctcagtcgttttcctttcaaatagcatttattccctacgataacttacaccatcgagaaggttatatttaggtaaattacagtttatcccgaacctctgccattttcctttaacttttaattaggaaaatgatcaagcctataaaaaagctgaaagaatcgtttgatgaatacctttataattgccgagtgtacagttttaaacatattttctgatgctatacacacactgtgtatatatatatatgtcttatctgtccatccatatatacatacatacgcatacattttccctgaatgattcaaagttaagttgcagctaacagtttagttcatctcaggtgctaaagcatctcctgcgtaaccacagtcccttatctaactgagaaaaacaactgtaatgacacggtaataccgactttgcagagcatcttcaaatttcgccagttgtcccagggatgtcatttctaggagtttatgtaaacaaggatccagtggtggtgcacctgttgcgattggttgccgtggatcaagtggcattgcaatgggttgcagtggatccagtggcattgcgcctgttgtgattggttgccgtggatccagtgacgttgcacctgttgcgattggttgccgtggatccagtgacgttgtgcctgttgggattggttgccatggatccagtgacgttgcacctgttgcgattggttgccgtggatccagtgacattgtgcctgttgcgattggccgtggatccagtgacgttgctcctgttgcgattggttgccgtggctcctaatgtagaccacaccctgatttcatttttaaaactgcaatcgacagatctgtgccttttttttttttgctgttcttgtcgtaaatagtagtgtaagcagatgctctccttttcagaacttacgatttccaacggccccaaaaaccactcggtcaatgaagaagagcaggaagaacaaggtgaaggaagcgaggatgaatgggaacaagtgggcccccggaacaagacttccgtcacccgccaggcggattttgttcagactccaatcaccggcatttttggtggacacatcaggtttgtgcttttctggaataacttaatatttgccttttctagggttttgccatgttggtgaagggggaaggtgtgaggcttgttttgagacttcttggacgtaatggtttgcatcttgctcccctgcctgctcttctcttgcacttcctgatgcttcccttgtcagcccccgtggcttattctctccctgctggcgcatgtctgcaggggacagggagctcctcccttctactctgtcaagttcagctgctcactgctagggagtaagagaaaagccagctaattggccatacgcggtggttcatgcctgtaatcccaggactttgggaggccaaggcgggtggatcacctgaggttagaagttcgagatcaacctgatcaacatggtgaaaccccgtctctactaaaaatacaaaaatcaaccaggtgtggtgacaggcacctgtaatcccagctattagggaggctgaggcaggagaatcgcttgaacccaggaggcagaggttgcagtggcccagatagcgccattgcactccagcatgggtgacagagtgagactctgtctcaagaaaaaaaaaagaaaaagatacaggagaatgtcatcatgacttaggggtaggcaaaggtttcataagataggtcataaacaataaccacgagagagagagaaaaaaaaatatatatatatatattagacttcatctgcatttaaaacttgcaacataaaaccacctccgggaggcagaggttgcagtgagccaagattacaccactgcactccagcctgggtgacagagcaagactgtcttcaaaaaaaaaaaccagctaaccaaaccatgtgttttggtaagagaagacagtgtatctggaggaattttatttatgttaataaattgtgtatatttaaagtatacacagatgttatgaaatagagatagtaaaatagttgctacagtgaagcagataaacatattccccatcacagttacccttgtgtgtgtgtgtgtgcacatggcaagagcagctgcagttttactcatttcacaaaagtcccaaatacagtgcactatgagtagctcttgtccgatgttccacatcagatctctagacctgttcgcctgtgtggctgcccttggtgtccttcgaccgacatcttccattcccactcgccacccctaggaaccactcttttccctatctctgtagtttcgtcttttttttttttttaataaagattccatgtataagtgagaccatgcaatatttttctttctgtgtctgacttctttaacttagtataatgttccccaggttcattcctgttgtggcaaatggcagggtctttattacagctgaatagtgttcccttgtctatatatacacaccacagtttctttatccattggcccatccacagacagttgtttccctgtcttggctgttgtgaactgattggaagcaggtgaggtagaaagtgaagagagtgtgaagggaggtcttttttacacagacagacccgtgactgggctggagtccctgggcacctggctgtgtgccagttcccttaagcagctttttgctcattcacaaagtccttcggaaaggtttttctttatttacctgagagcttttcagtaccactgtgatgtggaattcagcaaaacttgtaccatctccaagaaggtttacccatcgaaagtactgaagaggcctcattggagcctaatttcctttctgaggccttgcggcataacccccaggctggtatttcagtgacactcttagtctgttgttgtcccaaatgctgcgtacctgaaagaaagagcaccccttttgaggcatcaagacttgattcagtctcagttctgagactgaatcaacaactttcaacaggtgaataataagaacctcagaaacctgcgctgacgccctcagaagctggtttcccgtcctctgtggaagtggatttagaagccagttgagcagccatgtgaccttgaacaagtcacttctgtgttctgcactgtgagctctattccactggcccctttctattctggtgctctgtggagtgtccacggcagctgggtggtcagttgtcacctgggaaacacccagccctgaccactgtctgtggttccttgggacacgtcgtgttgggagggagacgctgaggtccaggttggcgcgcagcagcgagggaaggctgtgccctttgctccttcagcccagcagcctggtttaggattgtgaggacaccccctcgggatgggagagaaagatgaatggacagctcaaatggaggcatcgggaacatggtttttgtgcagaggccgggtatcagaatttcaaggccacagagggtcagcatactcaaagatcccaaatttgtctaagagtaaccagtggaaaataccagcgtccatttggaggacttgctggctcagattgaacagctctgtcacagctgctagccacatcctctgaggggtctctgtgttgaaattggttgttgatgtttctttttgaaaaacggtaaagcaaagatagggaattcttacaacgtaggaacttcttttcagccattgttaagcatgattctttattcacaccaattgaaagatttacttctaaaactcagcctcttcagatgtttttcagtttccccaggaagacttccccgcctttcttccccggtgccacctttgctaaaacacaggaccactgaatcaagagggcttcttgattctccaccagctctcatgagcggtttccccactactgtatccctctccagaaccaggggaactgttgtcactgaagtcttcaaactgtaaaggagcatggagatgcgtaattaaaccctggacagaaaagcttttagcgagctcttcaccgcatctgttctggaaagcctgagtacctgtccacacccattttattccgttgagaaactaggtcaccgagactgcagaaatagaagcccttgttgaacccctggaatgtttccttgctgaggctaaatgagagatgggccgaacacacaatttttactcagaaaaacttagaaaaaggaaaaaaaaaatgaaatgaaaaaccagctaagaaaacaaggtcaaattggcgcccttcttggaagggtggcagccttttttcctggaatgttaacttgttttttattctacacaccctactccccttcttctttttgtaagacatctttataggaggaaaatgccattaaaaatcctctatttaccttgggatttcctctattttattagaacaggctatgatacttggagaaaatggaaagcagcagcgttttgaggccatggcagggtggctgcctttatgaaccggtgcagtaaataacagtgtggagaggaagtgaaagaatttggaaaatgaaatatgttttcttccagagcactggcgttgggaacatttatcaactggtagatttagttgttagaaatactaaggaggtgctattcagcagaattattattattttttttaatttatttttttattgataattcttgggtgtttctcacagagggggatttggcagggtcatgggacaatagtggagggaaggtcagcagacaaacaagtgaacaaaggtctctggttttcctaggcagaggaccctgcggccttccgcagtgtttgtgtccctgattacttgagatcagggattggtgatgactcttaacgagcatgctgccttcaagcatctgtttaacaaagcacatcttcagcagaattatttttaaattcagtatatttttggcttttctctgtggtcttttgaaagtgatattgaataatcttattttcagtgtttattcccttggttaatcttaagggaaagtggcaaggagtggtctcttaatttttttgtttttgctttcaattcttaggtctgtggtttaccagcagagttcaaaagaatctgccactttgcagccatttttcacgttgcagttggatatccagtcagacaagatacgcacagtccaggatgcactggagagcttggtggcaagagaatctgtccaaggttataccacaaaaaccaaacaagaggtatgttcacacttgattttgaacctttctactaaggtgctctggtttggtggaaagaacacaaaattaggaatgaggggaaatgggtttgagttatgcctcttaaatcagttgcttaaccattttgtactgaaagtttttatggttttacaatgaaatggttgaaacgtgatcccaagggcctcttttagctctaaatcatattacacaaggtaatgatctccttttggattgtttatcttgagctacatttaattttctggcaatctaatgatgatatcacaacatcaatactacctctgacagaggccaaatagcttatttatgttcatgataccgtagggtacaactgtcattagattagttaggatgtcagagagattccagacacatctgttttgcatttgattgtagatcttccaggtcattgtaaatataatatagtcattgtaaatataatatagtcattgttctgatgcttgttactctttgatttgatctggaaaaggtaagattcttgagtctttcagtcttcatgaatttaagagtatcacattatagcttggtggagtccttgtcaactcagttgggcgagacggatagcattctgccctgtgagagcttattagttcctggctgtccagatgtgccagcttatagctattttgtactctgcagcagagagtgtcttctctgttatatatcttaggttgtggcagtgaattcataaaaatgcactggggagatgaatgcaggctgataattatggacggtccatagcattcctgcaaagcgatatttgaataatgggcagtggatggcagctacaaggtaaaataaggtgccccaacgtagaagacctgtcatcacattgcatgactgggatggatctatccttggcttatcttgtgtgctctgagtcagaaagagcaaagtaggacatagggacccttagcaccttcggggtgtcctgctgtggactggttcacccaggctctggggggatcagtagaagttatgcctaatcttctaccgtatttgcagacttgcatctcatgggtgattttgtttaaaaaatagaagcagtaggagccagaggcagaaacttggtagttgacttcagtgaatgagctaagaagagtctggcggtggacctcgtggaagagagagagggaaaaagtggtatttgtgttggggaggttggttgggtggttcagttgtgcattgtgggtgactgtcggcttggctcacttctgtggcagctgcaactccagagatagctccctggccctggctgctggtgcactctgcttatgctgtttcttgagccagctatgggagtctttggccacccatgctgttggggaggtggtcagcctttccatgggctgcctagggaagacccttttgtgatgtgtctgtttttctcttttgcttctgctgcaattacagtttgactttgctggggtgggctggtaggggtggcggtgtgggggcaggggttgaggcgcaggtagttgttagcctgttgttagacggtagtgaagaaagaatggtttatcctaaatagcaggtttggatgaaggcttccagaaagaaggcgggccaggtgtggtggctcacgcccttagtcccagcactttgggaggctgaggcaggaggattgcctgagcccaacagttggaggctgcagtgagctatgatcacgccactgcactccagcctgtgcgatagtgaaaccgtgtctctaaaacataagaagaaataaaaataaaggaaagctggcattttggtggactccggaagataaaaaggatgctgccagccgttctgggtgcgtggttgtggtggtgtgttaccagatgaggccaggaccactttcaacagcagatgtttcaggaagatttgggacagcttgtatggaagtatctataaggagcaaattacatattttcttgaatgtgtttttttttaagtttttaaaatgccacctttaactttattatgttttagatcagaagtatttttctgtgggaacatgtgaaggttttggggaaaataggattatatgaaatatttgctatatagaaaatgtctgcctttgttgagtgattagaaattaagcctcagttggctgggcgaggtggctcacacctgtaatcccagcactttgggaggccaaggcgggtggatcacgaggtcaggagatcgagaccatcctggctaacacggtgaaaccccgtctctactaaaaatacaaaaagttagccgggcatggtggcaggcgcctgtaatcccagctactcaggaggctgaggcaggagaatggcgtgaacctgggaggcggagcttgcagtgagccgagatagcgccactgcagtccggcctgggcgacagagcgagactccgtccccaaaaaaaaaaaaaaaaaatctccagtggctgatgcctgtaatcccagcattttcggaggctgaggcaggcggatcacaaagtcaagagatcgagaccatcctggccaacatgttgaaaccccatctctactaaaaatacaaaaattaactgggcatggtggtgtgcacatgtagtcccagcctctcaggaggctgaatcacttgaaccctggaggtggaggttgcagtgagctgagatcgcaccactgcactccagcctcgatgacagagcgagactgtctcaaaaaaaaaaaaaaaagtgttatccaaatgaatatgggaagcatcaaagactttgtaagtacagagaatgataaagggattgttatttgtaaagatgcatcttagtgacaaaaaacctggctttatttaaaagcagcattcatcagacctgtgaaagtacttcaggaacagattacattgataaaactcatgattagaataaatagctttaaaggttatttaaaacatctaattggcctggaatcccagcacggtgggagactgaggcgagcaggttgcttaagtctaggagttcaagaccagctgggctcatggctgtagtcccagctacttgggaggctgaggtgggagaatcacctgagcccaggaagtcaaggctgcagtgagtcctcatcatgccactgcactccagcatgggcaaccagagtgagatcctgtcttaaaaaaacaaacaaacaaaaaaacccacctaatcctactggtatcagttttatcaatactatcagagttattttaaaatgggtcaatactaggcctagcgtggtggctcacgcctgtaatctcagcactttgggaggctgaggcaggtggatcacctgaggtcaggagttcaagaccagcctggccaacatggtgaaaccccttctttactaaaaatacaaaattagccagatgtggtggtgggagcctgtaatcccagctactcaggaggctgaggcaggagaatcgtttgaacccgggagacggatgttgcagtgagcgcagatcgtaccactgtactccagcctgggcgacagagtgagaactccctccccccaaaaaaggcgggggagtcagtacataaataaggtggtactaagttagctttttaatttttatgctaatttgtcagtaatgccacagagtaaagttcttaactttgagtttacgactggacttcagggacccaagaggctctctgcagttgtgcttatgggaacgtatgcatttttcttcttcttttttctttttttctgagacaagatctcgctgtgttgcccaggctggggtacagtggcgcgaacttagctcactgcaacgtctacctcctgggttcaagggattctcttgcctctgccacccaggtagctggggttacaggcgcccaccaccacgcctggctaattttgtatttttagtagagacgggatttcaccatgttggccaggctggtctcaaactcttgacctcaggtgatccgcctgtctcagcctcccaaagtgctgggattaatgggcatgagccactgcatctgggtatgtgcattttcttaagaggagcattggtagatctcagagcttctgtggggcaggaaaagccatgaagtcctgccacaggactcttgggcctcacctctcagaggacgtctttgagcggaaggtggatgtggtgttagctgttgcaagtaagacagggacggtgtgtcctggtgtgctttgtgtcttaggttgagataagtcgaagagtgactctggaaaaactccctcctgtcctcgtgctgcacctgaaacgattcgtttatgagaagactggtgggtgccagaagcttatcaaaaatattgaatatcctgtggacttggaaattagtaaaggtaatgcatacataaggtcgggagtgttcgtggtgacacactcctgcacatcagaagctcaaccctgtagcatttctttatgatgtcaagagtgaggacattctcttgctggacgtggacttgttttaagtttcttgacttgtaatagaccttaatactaaaattctcatgaaaatggcctgttgaaaatagaggcaaaaataactaaactctataatcttactagattagaaaaatagcagcttttgtctatcaaaaagaacatcacttttctgtgaatatttcagggatgaatggtgcagtttgccttccaccgagtattaacagctgtgttgactagcccagttaagtggtttttagtgaagtaagaatgatttctcataggcagtgagagtcccttctaacctctagttgtggtggcgcacaaataagacgtggcacttaccagcctcaagtctctgtcaggtcacgggctcggcactttttgaaagcaattttaaagagccccaggttaaaggcatcttgctaaaagcacagcttcaagaagacttttcttgaaagctttagaatttgtgaaaacgtatagtacaacactgaggcttgattgggactgtgattagctagagaggattctcagaatatcgaggtgtttgggaagcagaaaagaggacactgggcctcactcctgggtcctgcagaggaacaaacctgaaccgagagtcctcttctctccgtcccctggcacagcaaccccacctcatacctccttccatatagatgacccaggaactgtgggcatggctggcttctagccggctccctgtctaccctaggggcgccctataccttcccgtgaagactcagacactgtctctcccaggcctgcacacaagagctgtgctttctgctgacgggcttggctgctgtgccgggtttagtgtccgttgctcctctcacacttctagctgccttatcactcatcagccgattgctttttaatcccatttgaggaccagcaagaggaagaaagatgccagtgagaatcatgtaacagatcctcctccccattttattctatccatcgggaaacctggaatgccggctaagtcaaagaaggcatcctcggcctctgctcctgcatcttcactcgcctccagatcagctgtctgagctgacttggatgttttgctacagtgattttatttttatatcttttcttgcttgctgtatttttatatccgctgccacctccaatacattatcaaaatatgacataaatgggggctgggcgcagtggctcacacctgtaatcccagcactttgggaggccgaggcaggcagatcacctgaggtcaggagttcgagaccagcctgaccaacgtggtgaaaccccaactcttctaaaaacacaaaaattagcctagcatggtggtgggtgcctgtaatcctagctacttgggaggctgaggcaggagaatcgcttgaacctgggaagcagaggttgctgagatcatgccactgcactccagcctgggcaacagagcaagactccatctcaaaaaaataaataaataacataaatgggggacaagaggacctcacttgggtcatgggtcagaagtacagatggctgcctcgaacagcatgcctccgacggactcttgtgtcggtgtaagtggtacttctgcgcacagtaagagcagggagttcccgcctcgtagcagctggtagactggttcctatttggagaaatcatgttactgttctgtaactgaagttttgttttgttttttttttgtttgtttgtttttttcttgctctgtcacccaggctggagtgcagtggcgcgatctcggctcgctgcaacctctgcctcccgggttcaagtgattctcctgcctcagcctcccgagtagctgagactacagccgcgtgccaccacgcccgggtaattttttgtatttttaatagagacgtggtttcactgtattagccaggatggtctcgatctcctgacctcgtgatcgcccgtctcagcctcccaaagtgctgggattacaggcgtgagccaccgtgcctggcctgtaattgaagttttatgatctgacgcatatgtaaaattttaattcttgccttggatttttcacaactgtttttgtttttaagtcagcagcttttttcttttccattttgtagagcacctgtttttaaggggcctcccacaggagcatcacagcctcggccgttgctcctgtttctttagtgagctggctgcacattttgtgtcctattacgtcacatggctcatttccttcatgagtcaatttttgtgcaactgaagggatagagtgttgttttgttcctggtctgacaggcagtttacttgctggggagaatgttgttagccattttctgctgctgttaccctgaacctttctaaaagtgcttcaagccattgatattttgttttccagaactgctttctccaggggttaaaaataagaattttaaatgccaccgaacctatcggctctttgcaggtgagtaaatttgtacgacattacttcttcattaaaacactgatgaaggggtttacagctgggcacaggtttgctgcaacttagcatagcgaccagatgctgtactcaggtatccctgtggccttgtgagtcggggagtcacgtgagagttttacctgaaactctgcgtagatgacggattatcatcttggccctgaggacagataacagaagaccttgctcaaagcgaacatttctgtctttgagtcagaggagggagtttcaggctcccaggctggctgtttgagaatgtgacctctcccggctgtgcttgtggcacctgtgggtgacagtgctgtggagtttccacgacacctggtcacccagccaggttgggtgagcgcgcccccagccggtgatccctgcgtcctcccccacaggtattgttagggctgcttgagagggtgggcccgattacacaagctcctcggctgccaggccctcagtcagtcatgagaaatctcccaacagggtgaatggcaccccctgttccctcatgggtggaccttgagacctcttctgtctcctggcttaggctccctgcagtatcattttttctgccacatcatcttccctttcctttctgccttcccttttatccttctttctcttttatagcgtcatcttttatgcctctgagtctttacctctttggattgttgctgtttgccgcacttttgtttgcttcccaggctgtttttactacatgtttctagcttctgtgtcttccctcctctggtgtggcctttggtgaacctgtttgtatcgtaacataacactgccatttattgaccttcacacatgtattgaacctcttcccaagatattctttcatttccttacatgtgtcctaggagatgggaggtgggatccctgttttataaaagaataaaccagaactcaaggaagaaaactcaccactctggcctgcagtggcagagcagggcttcaagctcctgtccacctcagctcacgcccgatgttttaggaagtttggcgagtgggtgagggcccagggatgggggcccaggggtgagggcctagcggtgggggcccaggggtgagggcccagtgggtgaggcccagagccacactgcaaggtgccaggcttccctctcttcctctcactattcattgttccttttgactctcttcttttctccccccgatcacaattcctcctcaacttgctgggcctcagatgggacggccatgggcaccacgcgcttgtgggtgtctccagccctgtctggaatggaaggtctgagtcctcagactctgcagccagccattatcctgcctggctccttggagtgtggcacccaggtcccagtgggtggccagcagtttctccgccttctccctgcacctcttcccctggaggctcttgcgggggacatcactgggcaggggcaggggctagggattgctcctctcctggtcagggccccagtgtgagcacacacacccctccccgactctgcaacctgcctcgccccgggacctgggcctgggttgctctcccctgccctcctgaatcctcatcccctaacccattatttttttgagatagagttttgctctgtcgcccaggctggagtgcagtggcacagtctccattcactgcaacctctgcctcccaggttcaagtgattcttgtgcctcagccccccgagtagctgggattacagctgtgcaccaccacatccagctaatttttgtattttgaatagagacgaggtttcgcccttttggccaggctggaagcctattctgatcttggaaatgaggtcaccggactggttagaattacctgtagagtgagcaaaggaacactttttaagaactgctgtgattgtggggcctgggagaagcaatctcgcgcacaagcttttcaggcggttctcagcgctcctgtcaggggggcttgcaggtgtgagtgacacacggctcagcccagggtagttaactgggctgctgcttatgaaactagaatggtgacatgcagtcccccttgacattttagaatggagatgtcttgtgggaaagacaagttagtaaaacccccaggccctgcagattctactgatggtcgctttgaagcaaaactcttagcccagtcagttaggtctgtgaggtgaagatctaggacagaagtctcaaagtgaacttgggatccaggggacatgctgctgtcatgggtgcttcctgccctttcacaagatggctgtgacttgtgcagcacaggatgaagctatgcccttggattggctgtgtccctggctctccgaagtacgggccccacagtcttgctgtccctatgctgttcagtctcctccggggtccctgcacagaggatttctttgtgcagagcccaggagtctgactggtggcctcagtcataagcactgtcctctagccagccaaggtccctggcccagagaggactgaggcctcctgctgtcatttagcccctccacgtgacaactgcgactagaacctggtgatgtttggtcttgttttagtgctgaaattccctaccagccaagtcttgcatctctcctggttccttttcttttgtgccactgatggtgggcgcagcttagcaggctgccctgtcattccccgcggaatgctgccggacagccgccttcccgaggctggtgtctgctgctggccaggcagacctgtgcccctctgctccatagaagtggaggatgtgttctgtggctgtcttaatgttttcatgacatcttctacagattttttgttttaggcctttgactaaggcttcttggttataggattttttttttaagtaaataactgtgtgtgtgtgtgtgtgtgtgtgtgttttgttctgttaaaacatagaaaaatgggtaattttttttaaaggcaaatgcgtaactaccagcaccatctccgcagtgccccaccacagctccacgctcaagcaaccgtggttagcagtcccagggtccctcctgccatgtgggccggcaccgggagattgtgtcccgtgtctttaggatagatgggccacagaaggcctaaggaccttgttttctcatttaatataccataagcgtattcccgcatcaccattcttaatctattccacgaaaaaataaattgtgttattttaatataatttactcatcagtcatttcttctagtggctattgaggttttccgttttttcactgttataaatgacatcataatctctgtccaagattcagataatctcttcaggacagtctagaagtagagtcagccacatccaagggcatgagccaggtctgtaggcctgtacagctgatggctgtgtaggagtgtctgtgtgaggcgtgggacattttaaatatgtggttaatatgcgtacatgcacacatgtacctatctgacttacccttaccttgcagttatagaaaagtttttattatggattgcttgcgtgtttgagttgaaatagcattggtttgtgtgatgacatctctctgtcccacctgctttggagaggggttttacacataggatgcatccctggagggaagtcggcggagacctgtaatgattcgtgtgcagtgctgttctcactctgctgcctgctgggctctcttccagtggtctaccatcacggcaacagtgcgacgggcggccattacactacagacgtcttccagatcggtctgaatggctggctgcgcatcgatgaccagacagtcaaggtgatcaaccagtaccaggtggtgaaaccaactgctgaacgcacagcctacctcctgtattaccgccgagtggacctgctgtaaaccctgtgtgcgctgtgtgtgcgcccagtgcccgcttcgtaggacaccacctcacactcacttcccgcctctctttagtggctctttagagagaaactctttctccctttgcaaaaatgggctagaatgaaaaggagatgccttggggttcgtgcacaacacagcttctgttgactctaacttccaaatcaaaatcatttggttgaaacagactgttgcttgattttagaaaatacacaaaaacccatatttctgaaataatgctgattcctgagataagaaagtggatttgatccccagtctcattgcttagtagaataaatcctgcaccagcaacaacacttgtaaatttgtgaaaatgaattttatctttccttaaaaaagaaattttttaatccatcacacttttcttccctaccctttagtttttgataaatgataaaaatgagccagttatcaaagaagaactagttcttacttcaaaagaaaaataaacataaaaaataagttgctggttcctaacaggaaaaattttaataattgtactgagagaaactgcttacgtacacattgcagatcaaatatttggagttaaaatgttagtctacatagatgggtgattgtaactttattgccattaaaagatttcaaattgcattcatgcttctgtgtacacataatgaaaaatgggcaaataatgaagatctctccttcagtctgctctgtttaattctgctgtctgctcttctctaatgctgcgtccctaattgtacacagtttagtgatatctaggagtataaagttgtcgcccatcaataaaaatcacaaagttggtttaaaggtgtgtgcgtgtttctttgaatgcgaatgccttttcgggtaactgaaattcatgggggcatgagtttgcctgcagaattaaaatctgcccttcgatcagctcgacgtgtttgtggaagctgaaccaccactcaggttatgcttgtttagtattttcaaatggattagtgatttgggtacacgaagtttttgactcttcgattggcagaaaggaggaggttttctccccttcccctcctcatcccttgtttctatagcccaccgttttcagtatcaccaaaatagttgctgtaggtcaaggctaaatgctcttcagttgagtgccactggggcggctgagcggtgcctccagacgccaccctcagtagtgggaaggaagccttctgagacggaagacatggagagagggatgtcacgtgcaagggtgcccgtgccccggcttctggccctgtgtggatgattgtggtgtcctgagatctacagagaaggggttttaacgtggtctgagcctttctctcaagttcttgctcttaccatctggtatttctgattgtagcctggtgccatctggggttcagagcttcctaaactttctgtacaagtgttgtccgtctaacctacttaccctttgtaattctattgtgatttgcttggctgaattataactcatattgagaggtgaagccagctggacttcctgggtcaagtggggacttggagaacttttctgtcctctaagaggatggtaaaatgcaccaatcagcactttgtagctaggattgtaaaacgcaccaaccagcactctgtagctagcaagaggtttgtaaaatgcaccaatcggttcttaaaacgcaccaatcagcaggagtctaaaagcagccaatcacagggaggactgaaaaaagagcactctgataggacaaaaacagaacatgggaggggacaaataagggaataaaagctggccgccccagccagcagtggcaacccgtttgggtccccttccacactggaagctttgttcttttgctcttcacaataaatcttgctgctgctcatagaaagatgcaagctagtgctagcgagacagcctgcaaaacccctgtgttgttttgggctgttaaccatagtctgagtggcttagacaacaaacatttatttctcacagttctagaggctagaagtccaagagcagatgccagcagacctgtctggggaaggcctgcttcttggcctggagacagccgcttgctcactatgtcttcacagggcagagtgaaccctggtctgtttctcttacaaggacactcatcccactgtgggcctccacctttgtgatttcatctatacctaaaaggccccacttcctagtattccgccgggggttcaggcttcaaagatgaatactgggggcgacacaaacggagcccataacctcatgccgcctgactcctgaggctgtattcgtgatgaacgtgtggctgcccaagttttgttttgctcaggcaggatcagcacacacccagccacagacagggaagcccagagcagggcagaatatggtccctcaagtgaataattggcccagggatacagaattaggtgattctagcaaatccagacattttctagggtgccagtgaattttgggtctgtccctgttagctgttcttgagattttgcactcaacttgcgatggttaatacggagtgtcaacttgattggattgaaggatgcaaagtattgtttctgggtgtgtctgtgagggtgttgccaaaggagattaacatttgtgtcagtgggctgggaaaggcagacccaccctcaatctgggtgggcaccatctaatcagctgccagcgtggccggaataaaagcaggcaggagaatgtggaaagactagactagtcttgtggcctccatctttctcctgtgctggatgcttcctgcccttgaacatcggactccaagttcttccgttttgggacttggattagcttccttgctcctcagcctgcagacggcctactgtgggaccccttcttgtaagtcaatactccttaataaactcccctttatatatacatctacctataggttctgtccctctagagaaccctaacgcacaacgtttccattttatgttgcaacgtttaatgtttttgtaagtttcatagtacggtctcctaactttaggttatttacttcgggaactttgctcattaaccttggtgctgaggctacagacttagtgattttccttcattatcatttaacatgcctttgtaggtggcatttaaagcagtgaatggttacatttttagtatgttatagggagattttcctcgcatttgtcagttgttgacaacaagacttggaagttctcttacagggaagatgtcatgaagtttacctggttggtatgttatttgtccactagccaaggaagcgcaagccactgtgtgtttgaggcaggatggagaatggaggtcattctggcctccactggtgtaactatggttcagccacccaagtggctcacagtggcattctgctttcatttctctctctctctcttttttttttttttttttttgagatggagttttgccctcgttgcccaggctggagtgcagcggtgcgatctcaggtcaccgcaacctccaccacccaggttcaagcgattgttctgcatgtgccaccacacccggctaattttgtatttttagtagagacgaggtttcaccatgttggtcaagcttgtctcgaactcctgacctcaggtgatccagctgcctcggcctcccaacatgctgggattacaggcgtgaggcaccgtgcccagcccctgctttcattgcttgatgtcattggtcataccatcctagtctaatgtgtgggcaacgtgagcaggaactttgcagtcagcaaaggcatcatcttagaatgtcttttatttggtgacgtttctgattattgctgtcatagactgcttatacttgaccaggccaactggttacaaagtgacaagcatagtccaagtcagtggcttttgaactatgggaaataacccaataaaccagtgagctagtattgtacagccaactcacgttcatgagtcaatgagaatgagcaagttgtagcagtgtggacacagcagtctcttggcttcatttctcttgggaagtgctgagtgcatcaaaagaactaaaaacagcaagagacagaagactcacagtttttctggtacttctctggctcaagaaggaaaaatatcttgactgagcctagtgaagacagtatctctataccaatttcctgagggtcagtggacttaaaagagattagaccaaaatgttagtgtttttaaaatccgtgtctagcaaggccaagtggtaatagccaactctacacgaagtgttttgtgtttcctttattgttttttgtttgttcgtttgtttgtttgttttctgagacagtcttgctcttgttgtccaggctggaatgcaatggcataatctcaactcattgcaaccttcacctcctgggttcaagtgactctcctacctcagcctctcgagtagctgggattataggcacctgccaccacaccagataatttttgtatttttggtagagacggggtttcgccatgttggccagactggtcttgaactcctgacctcgtgatccatacacctcggcctcccaaagtgctgggattacaggcatgagccaacacgcccggcatgtttttcctttaaaatcagtcacagcaaaagtcaccgagcagacactgttctgccttcttcagacattttctctggcttcctaggaattggggttttttttgttgtttttgtttgtttgtttgtttgtttgttttagtgttattcatcttttagactggccgttcccatcttatttgcaccttttggggaaaagttaacttgctcgaaaatgaaatgcacccgatggcatctgctggctttacctcatggtgatgttcctttatgaactagtgaccaaatgcttcattctcttttctgattgtttccctccctttgctcatcccccacctcagtaagacatgttacatcattttaatgagcaagtgtacatttttttccagtgggactcaaattgtacgtttgcttcttggtcgtacatgcattttgtttcacggatttagttgtgtctcctgttgttctgtggtcaggatacgggatcatttgctaggcactgatttgctgaacacagtagtatttcgttgagtggcccttccttggaaacaactggcaagtaagcaaacctggaaatcactgttctgtgctgtattttcagtaaagggaatttacacagcgcttgctgctgtgggatttgcaaactattttattttgactctaggatttcacacagtgatatgcttaagatattttttataattttttttttttttttttttttttgacagagtcccactctgtagcccaggctggagtgcggtggtgtggtcttggctcactgcaacctccgcctaccgggttcaagcgattctccctcctcagcctccctagtagccgggattagaggtgcacgccaccacacccagctaatttttgtattgttagtagagatagggtttcaccatgttggccaggatggtcttgaacacctggcctcaagggatccacccacctcgaattcccaaagtgctgggatcacaggtgtgagccaccgcggacgacctataaaaacttttatccctttcattttctcatagactcccgtttaagttcttgctctgttttgggggaaagtgtttattgtttgattttctaataacgaaaacattagagtagcttcatttatgctgcctgtttcaagccaatacactgctcagttgtgtttgtgtatttgaaaagtcccctgataggaactttctgaggggtgcctgtgttgttggcacatttgagaactagacaaaatctaactctgtgtcttttttctttctttttcccctattatttggttttgtttttttaacaacccctctggagtgtgttttggttcatgggatcaggccacgtgccctggttttcgaggtatagccttggctttcttgggtcgggtctaataaccctgaccttggacttcccacgtgtccttcaaagaaagcaattatttttgcctattttctgagtatgatggtattctccatttgatttaacaaaaaaattcttcctctgctttaaaagactgaaagcctccctgtaaggtgctgattgccttccagatctgaggaccccgtctctgcctcattcctcctgtttccatcagaagacacaggtctgggactcagcgcagctgacctgtctgtccctctctgcacaggtaaccacttatttattgctgcttaaagtagagcttctgatacccatggggctggcaagagaccctgacattcttgtcttattttatcacatacagtttactcctgggctctgcagagagaagtcagtgcctcaattttccattgaaatatgcacccttggcatcctggcaggtgagcggcgcccccttagggctaatacagtgacataaaatgtgtcatatttttggctgtgtggtggctcatgcctgtgatccccacactttgggtggctgaggcaggctgactgcctgaactcgggagttggagaccagcctggccaacatggtgaaaccccatctctactaaaaatacaaaaattagccaggcatggtggcatgcacctgtagtcccagctacttgggagactgaggcaggaaaatcccttgaacccgggaggcagaggttgcagtgatctgagattgcgccactgcactccagcctgggcgaccgagtgacacttggtctcaaaaaaaaattaattgtcatatttttgaaaaagtatattagctttgcaatgagtaaagttcactctctaggaagatgtccctgtttcctgtggctacaaatgctccctgccacactgggaggccgcacctcactgcgccggagtgcagtcttcagtggggtcctctgctgtgaccgaaagaagggtgcagccgggcctgcttccaaggctagggtctgagacctggagtgtgtccatggatatcagatgttgagctacaggggaccggcagcccacagcagcaccctcggtggctaccttagggtgttcctgtgggcctccccccaccagcacctccctccagctttcctgcctccatcccccctccaggacacttcctcctctggctaaaggtttggcacctttcatttgagagagattaacagcaaacacacagggctttctgcaggccagggctgctgctgagcttttgccaggcatttggtcctctgccaagcccatgcatagtttctgtctacattgtgcagttggggacttggcacctgcccagcacctatgcttggggcccctcctctgtgctgcaggcgggtgttcacaccctttcatacccgctgtcatctccctgcagcccaccctgcttgacgaggtcatcactggtgcttaggagtaaactggaatggcagacagagcccagtggatattgcagaggaacagaaggaaaaagatgtgcatgacgcctcagtgcttgcagcattaaagcaaaaaaaaaaaaaagagcaaagtagcacagtgattaaatagtcgggtgcctgcattccatcctcacctgctgtgaaccagccacatgaccttggacaggtggcctggtgcctcctctgggtagtggctgggagtggcactgtcacctaggccctgtcacctaggcccaggggcaggagtaagcaaggtagcaggtgtgatccattagcacagctgatgctcagtcacggtggccctggcactcctcagagggcccctgccatgcctgggggaggaggggctgcagtccgtgcccagtgaatgtaccacctgcctgacatcgcagcgtccactctggcagatgcgacaccacgcctagtgaggtctgaacagggaccctcagcagtgcgcccacaggtgcacatgagtgatgaccatagctgcccgctggttgtgccctcctgggcaggaagcacaccagggagccctggcagagcaggcccttagggagcacccaggagggcctggggctggggcctcgattctgggcagccagccttcgggaccttggtcacgcgcctacctggacctctgcccctgcctgccctatccctcattagaatcccagccctcctggctgttctgggtactctgatcaagccagacagtgctagttcagcactgagagagtgtgtcctgtctggtcagggaccaccagggtagacagacattcactcctaagttcccaccgaaaaacagcacgagggtatattgggcaaccaggtgaagactgttccagagccagttatcccagaggagctaggaagcctttccctctgctgtcttccttttactcagacacgtcctccagagctggctgcatgtgcattccctctgctttcctggaagtcccctcctttccatctacaatgggacttttaaaaatactcacagtcactagtgcacaagaagaaccattcaaagccggcatccaacctcagatttgcagcaacctaagatttgtttgcaaaggaatagaacgataaagcttcaacccacccacgtttataactgagaagaaaacacacacttcatttggtaaatacagcaaacaactgaaagtatgctttgactctgtattgaggccagttaggggatggaaagggtgaggctaagcaggtaaaggaaatggaagagaaggtcaggagaaggaaaatgtgagctaggcaggcggctcatgcctgtaatcccaacactctgggagcccaaggcaggaggatcatttgagtccaggagtttgaccccagcctgggtgaaataatgagactttgtctctactaaaaaaaaaaaaaaaaaaaaagttaaaaacagtaataaaaggaaaatgtagaggggagaagcaactgagaagagaggggagagtgagaaggaatgagcagggaggtggagggcgtgggggtggctttgttttggcctcatctttccagggagacagccctgtggcgatggccaggccacgatgctaggctgctcttggtcattaccagcccctgaaatcagcgtcctcaaccctagccctgtcatctctgctgggagtgggtctctatttcttttctgcaatttacatttaaagcagagtttaccctg

SEQ ID NO: 25 - DNA, 173700 bp, Homo sapiens
gctttcaggcactttcagtattctcctacccaaggggctggaaagtcccagcaggcaggagatgggtgcaggggtccagaactagggatgtgggtgaggcctggacagcatcctctgcttgtggcttgcaagtgataagaaaaaggagcctctcagctgctgagatttttaagcagacaacaaatgtatattgaatgtgacaaagagttagaatatgtgagtttcatctttacaaagtttacaatctacttgtggagtttaaaatacagctactggctggttgtagtggctcatatctgtaatcccagcactttgggaggctgaggcaggaggatcacttgagcccaggagtttgagaccaacctgggcaacatggcgagacctcttctctgcaagaaattaaaaaattaggggacgttgggcggagggagagagcagaaaagataactattgggtactgggcttaatacctgggtgatgaaatatgtataacaaacccctgtgacatgtgtttgcctgtgtaacaaaccttcacatgtacccccaaacctaaaataacaatttaaaaaataaaattaaagttaaaattaaaaattagccaggtgtggtggtgtgcacttgtagtcccagctactcgggaggctgaggtgggaggatcacttaagccagggaggtcgagactgtagtgagctctgatcataccattgcactccagcctgggggacagagagcaactctgtctcaaaaaaaaataaaaataaaaattgatatggtttagctgtgtccccacccaaatcccatcttgaatcatagctcgcataattctcacacgttgtgggagggacctggtgggagataattgaatcatgggggcagtttcccccatactgttctcatggtagtgaataaatctcacaagatctgatggtttttataaggggaaacccctttcgcttgactctcattctctctttacctgccaccatgtaagatgtgcctttgctcctccttgccttccactgtgatcgtgaggcctccccagccacagggaagtgtgagtctattaaacctcattttctttattaattacccaatctcagatatgtctttatcagcagcatgataacagactaatacaaaaatacaataaaatatagctactttaatcaccccatccagacacccaactcagtgctgagtggtttctgctctcatggaatccaaggtctgctgcttccgccccatttcccaccattccctgcaagcatattgtggtccagacagtctgggctcttcatgggctcagaatgttgcttcgttcttccaggcctttgcacatgctcttcccttcacctggatcccttctctccctcatctgcagggtgatcccccacttacactttcaaataccattccaacaactctcctcaatgtttatacatcatgagtaaattcaccttatcccagggattccaggaaagtgtagggtttctttttaaagttagtagaatttaccatccccagagcaaaacagaaaagtctccaggaggcagagatgtgtgtgtgactgacagcagcagcaagcctgtatcagtcacttgtttatggcacctcagtcaccgtgctgagatctatgtcataacttgctaaatcctccctgcaacacttgaggtaggccctattgtaacccttacctcacagaggaggaaagggaggcacagagaggctttgtaacttgcccaagctcacacagctggcaagcggcagaagcaagggtcgatctcagaccatctttacaccagcatgctgtactgaatgaatgactgaattaatgcaaccagcaacaccaaaatgatgcaagatctagagagaagagagccctactgagccagttcctgcagcgtgagagaaggtcctggatggccagttaaagggtctggctacagatggcagagatggcagtcgaggatgggcacctgctgtgtgaagcaggctcccagggccctgcagtcctccttcgcttgggttcccatggccaaaggccagcctctgccttcctatatctcacgatactgcaattgcatgttcatgcgcctgcctctcccacttcagacgcagggccagggttccactcagccctttcagccaggactgtttgcctcgcctagaaacaacccatttttctttctttctttcttttgagatggagtttcgctcttgtcacccaggctggagtgcaatggcgcaatctcagctcactgtaaccgccacctccagggctcaagcgattctcctgcctcagcctcccaagtagttgggattataggcacccaccaccatgcccagctaatttttgtatttttaatagagacggggtttcaccgtgttggccagactggtctccaactcctgacctcaggcgatctgcctgccgcggcctcccaaagtgtgggattacaggtgtgagacatcacgctaggccccatttttcttttgcccaggctggagtgcagtggtacgatctcggctcactgcaacccctgcctcccgagtagctgggattacaggcatgcaccaccacgcccagctaattttattttatttttatttttgtatttttagtagagacagggtttcaccgtgttggtcaggctggtctcgaactcctggccccgtgatctgcccaccttggcctcccaaagtgttgggattacaggcatgagccactgtgcctggcccccatttttcttaaataaaggagagaacaggattcaagactttaggagccctggtgagaacacagccagatccactccagaggcagccgagcaagaagccacttcctgtcaccaggtcagtgtcagagcagctgctcagctgacgaggaactgaccgtgcacttgctatttccctaaggagaggtaggcctggcctggacttccagcttgaactctgcagacaggacctaaggggtcccagcctccagagttgtgtgggacaggcagcttgtcagggaaggtgatgcaggaggtgacgttgaagagggtgactgtgagttctgagaggatgtgtctgttattgctgcctgctgctctgctcctagaatcccatggggacctctgagcttggggtctgctgtgatcaactaacaatggcttccatgggcatgggatggagagtgaaggcatgcatgttaactgtcccccatcctgagtagcagagccatgggagaagggagctgggtaaattactagcaatcagcagcgtattaagcacttagaatgtactaggcaccatgttaaatgcttttcctgctctatctcatttaatccttaaactaaccctaggagaggaatgctattattattcctcctttagaaggtcagcaccatgaggaacataattttctaatctgcactattaatgctgtgttgtcagcacctaaaatagtacctagcacatggcagacactcaataagtatttgctggcaaatagattaactctcattttgcagatgaggaaactgaggcccagagttgtacgtaacttactatctcagagcaaaacagaaaagtttccaggatacagagatgtgtgtgtgtgactggcagtggcagcaagtaaccagcaagttgcaagcagctgcgtgtgtgcccttcctgcggcaacaatgctgggagggctttgatctgagttgctttgttttatatatgagagatttgacgggtccaaaggaaacgaggctcacacagggttacctgctgagcctggggtccagccaggtttgcaaccttgaaatcctaagtccctgagccacttcatttctatagttgtcagagagacatgcaatcaggtccagcgtgccttggaggaacaggttgtgggcaatgccagcctggctggggacctcagtgaccattctgtttgagagtaattctgacccaacagaccccacgacaagagtcagctcaggcaaaactgtgatgcacaggaagcctcctacctgtttccctccctccttctccatcactctgtctggggggctggtgtcttcctttcattccaatcaaacatgatctctaaaaagtgcctgaacctgatgaacgctatggtataaatgactacgaaaaggtattcatttttgaatcatttctattttaacaggaatcaaaggctcaagacaaagaatacctctctaaatggcagaaaaagtgtccatttccaaatgatttctgttttagcaggaatcaaagcctcgagagaaagaacacctctctaaatagcagagtgtctaccaccatcagcaaaagctacagtgtacagggctttacgtaccaggcactgttcaaagtagtcagcctgtattcattcacgtaattctcacgacggctccatgagagaggaataagcgcttcatttagagatggagaaactgaggcacaacggagctaagttgctggcccagttcacacagctgggagtagccaggtcaggactccaatccaggcaaagcagagagaaaaatactggtgaggaggagggaggaggaagtgggacgttccagctgaggagaggtcttttttccttaatctgatgttaggggccacccaagcactggggccagacgcccaccatggctctgcgcatttgctggtttggtgatctgaggacatctgttgcttcttgtcctctggtttaacagttacaagtgtacaggagcatgtgggccaagcatcccgcgtgcggacgtgatctggcttggcctgcaggcctgctctttcatgccaggctgcaattttttgagattactcaaccttcggaagggaagctgggccaaggacagacctttggtgagaagcagggggagtttagagaatcagccctcctcctcctcctcctcccagcctcctcccccaggagactcggacttggaaacacccagcagggaaaattgctgcagcagcaggtagcagttattatgggacctggaccgccccttccaggcccagctgttctctgggaaagcctggcggcagctctcacaccctcttccaaatggtcttcagagggagacggagatgctcctcgccccgcctgttgatcttcaccactgcaacctcctgtgtcccaggcatggtcagcttgcagccctgggggcggcttctggtgttctggtgaactggttaactgggcactggcatagatagcctgggtttctcatcctggttcacgtgcttaccagctgtgtgatatcgggtgagtcatctaatcattcagaacctcagtttcctcatctgtaaagtggggagaacaatagcattgaccataggttactgtgaggattagacaggggagggagcagagcagttagcacagggcctgtgcatgaattatgatcaaactaggcctaacttgcccaggccccgccccatgtttttgctattctgggcttccagatggtgtgcctctttcactgggtactcttctgtgacatttgtttctgcacagaggtattgaggatggagataacctaagcctggagtggtcgtctttggtgacagtggcaattgttccacccaggaaagaaaggaagaaagaaagaaagaaagaaagaaagaaagaaagaaagaaagaaagaaagaaagaaagaaagaaagagagagagagagagagaaagaaagaaagaaagaaacgaaggaaggaaggaaaagaaagaggaaagaaggaaggaaggaagaagggaaggaaggaaagaaggaaggaaggaaagaaggaaggagagagaaaggaagaaaaaaggaaaaaaggcaccatgttggggagagagtgtgcaaaagaaaggaacaagcttttctcctgcttttttggaacaaaaggtggcccacattttcatcctgcactgggccatgcaaaacatatagctggctggctccatcggatggtgcctgaatctcagaagtgacagtgttgagctgctgttgggggcaccaattaggacaggctttcaggggagaggcatggtttagggtcttacaaatatgcagacctttggagccagcaattccccttcactgtcagagatgtgcatatggatgtgtgagcaaggatgttcaccacggcatgattcataatagagacaccagctggatgcccaacaatggggggaggtcaagggcacaatccatactgaaggatcaggcacagccattaaacatcatgtcatcaacgaggacttactgacatgtgaaaaactcatgacatttgcaaaatggggaaaaagtcagctaccaaggagtgtgcaccataggatctcatttgcataggcgtgcagggaatatatgcaggagaaaaatattgagctggtttatccttaaatgccaatagctgttctcctcaggtgggttatgttttcctcttctgggcctgttttccaactgtctgcactgagcacacatcactgtcatcagtgcactgaggtactgttgggcagtggccaaggctagggctgcagacactggaggcagactccctgggttcaaagcccagctctgctccttacgagttctgggaccttgagcaagggatttaacttctccaggactcagcttccccatctgcaaacagggaaagtaatgataccttcctcaaaggatcaaggtattaactcaccatgatagggtcatggctgattgacttgtttggctgtcttcctaaaacccctgaaattttcttctttatatccctggcacctaccacagtgccaggcttacagcaggtgttcctgaaaagtctgctgaatgaacgaaggagggagtgcatgaattcatgtaaggatggagatccacatcccagggtacagagatagtatcaaatgagttaatacatgcagagggcttacagcactgcctagtgcttagaaaactggaattatcattatggcaaagaaattgtgtaagaggaaaatgttgagagaacaatatgaaccaatttttttgaatgatgtagaaatgagtgtttgttttattttgttttgtttttgagacaaggtcttgctctgttacccaggctggagtacagtggcacaaccacagctcactgcaacctcgacctcgtgggctcaagcaatcctcccaccttagcctcccaagtagctgggactacaaatgcatgcagccatgactggctgatgtttaatttttttttgtacagacgagagtcttgctatgttgcccaggatggtctcgaactcctgagctcaagtgatcctttttcctcccaaagtgctggaattaccggcatgagccactacacatggctgtttggttttttgttttgaacttttctgtattgagagtagctgagtaaagcatgcattacttttataatttgggaggacacaaaacgttactgaaagaaaaagactgagagagtggttcacaaagtgctgttggggaacgcagggtgaagccaagttagccgagtccacaccgttttcatgtcaaggtcatgtgtggatgagcttgtcttaggcccttactccggcccccatacaccaggttgcacgtcttctcattcatgatgaacacaacacccggaaggccgatgttcatgctgagttataggctctacagcgaaatctcttgttagataaatagatagatagatagatagatagcatagatacccatatatagaggtgcatgtatccatttatctatataagagttataggctcttaaaatatctacagctaaatctcttgttagacagataaatagatatgatagatacccatatatagaggggcatgtatctatttatctacctatatctatttatcaagagaatctttaactctagctgtaaaaaagaatatgtccaactcttggtgctccgtgtattgccccaacacagtactcaccacgctaggaccattgctgattgacttgttttcctgtcttcctaagagccctgaaagtttcttctttgtatccctggcacctactacagtgccggccacacagcaggtgttcctgaaaagtctgttggatgaatgagaggcagtgcatgaattcatgtcagaacagagatccatccacatgtcggtatggagacagaataacaggaggattagctttgtctggggtagggacaggtccaggaagggtcaaagacaggcaagtaaggcttggcagggtgaatgtgtacagtccccaaagaaaaggggagagagagagagagagatgggggacagcaatccagtcagtgagaacatcatttaaagatccttggctcacacctgtaatcccagcactttgggagcctgaggcaggcagatcacccgaggtcagcagtttgagaccatcctggccaatatggtgaaccccatctctactaaaaatacaaaaattagccaggcgtggtggtgggcgcctgtaatcccagctactcaggaggctgaggcaggagaatcgcttgaatccaggaagtggagatttcagtgagttgagattgagccgttgcactctagccggggtgacagaaagactctgtctcaaaaaaataaataaccatcccggctaacacggtgaaaccccgtctctactaaaaatacaaaaaattagccgggcgaggtggtggacgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaagaaaaaaaataaataaataaataaataaaataaataaataaataattaaaaaataaagatcctgtaagtgggctgggtgtgctggctcacacatgtcatcccagcactttgggataccgaggcacgaggatcgcttgagcccaggggttcaagaccagcttggacaacaaactgaaaccctgtctctataaaaatcaaagaaaaaaaaatagccaggtgtggcagccggcacctgtggtctcagctgcatgaaagactgaggcaggaggatcacttgagcctgggaggtggaggctgtagtgagcactacacaaaagaaatcgctgatccttcagcagccatttcccactccagcaactccccgcccctggcaaccactcatctactttctgtctctatggattggcttgttccggacatttcacatacacggaatcatacagtgtgtggtcttttgtgtctggcttctttcactaagtattacatctccaaggttcatcccgctgtagcatgagcgaagtgtgacaattgatagatggatcgatgaaggttacattcattcattccatacacatttactgagcacctactgtgtgccagtcttggcgacgacccagtcaggaatagaactaacagtaaaccctgccctggagggcttctggtagggaggagagacaataaaccgaataaactagtacattatttggaatattagacgctgataagagctcaagtgaagcatggggttggaagttgggtgcagagagaggggctgtgacttcgagcagagcggtcagcaaaggcctcgccgcagggtggccgcagggacgctcccgctcagcccggaaggaggcgagaggcgcggtgcccgtcccggcgactctgggccagcaaagagctcccagcgcacgcgtcggtgcctcgaggcccgggaccctgcgtgtctggtccccgccgtggccctgcgtccgtgacggtgggtggcaccagggagcatttcgcgcggcggggctggggcctgcctttgaagggacggagtcgggcgtcgtggtggggtggacaccggggatccccggggcgcggacgaggggggcgtccaccctgcgagctcaccccacggcccccgcgtcccgccctcagccgcaggccccgccccgcgccgcccggccccgcctccccgcggccgccgccattggccgcgcgcgccgcctccgccctcggcctcgcacttcctggcggagccatggctgcgcagcgggctggccgggggtctcctgaacccgggccccgccgccccgaccgcccggccccgccgccggggctgtccccgccgcgtccgtagcgcgtcctgccaggtgggcctccgcgcgcgcccaccctccagcccgggaccgccaggaagccgcgcccggccggggcggggagctggcggagatcgggagggtccccggccaccgcgagccgcgacccccctgcgccccttggtgccggggcgggcgggtgggcgagtgggggcgccgcggccgggggaggggccgccgcccccgcaggtgacacaggtgcggcctgtgcggaccgccccgcgcgtggcaggtgagtggcccccgccccgggccgtcccgactccgcctcctcgccgccggctggagcctgctgggcggccgttgcgctgagttccgcctgggctgcggggtccgagcgaacgacagcggcgtccccggagaccccgccggcgagccggtgtcagcagcgtcgctttctccaacgctgaggtcgggagggagcttggggaggaggcgctctgggaaacccccggccggacggggcctgcggtcccatgtttactggaagaccttttccagtgacctgggattgtcactgtgcttgggggtggccttgacccttcacctgcttccaaaaagcgtcggaggccgctgacgtccaacacgggtggaaatcagaccccacccccacgcacttgcaggagacagcagggagcctccggccccgcgaactctctctaggtatcttggcctagaaaataaagcgttgagcgttagaaggcctggttgattctgggcaggctgcctggggcggtggagagagagggcacctgctgcttgctgttctgtgaccttgggcaaccccccctggggcacccgagcgccaggtctcactgtgggaacgacggtgtcacctctcagcgtgaaggtggaatgaagtcgagtccgcggtgggcaccgcaccaacgctgggtttcttctcttccctctctgggctctccagcatcctaggggagggccggggtgggaacagcttgtcattgtcacaaagtttctagtttgtcgagaggaatccagttgccccttctctccctaggggagttgcacgggacggactgtgcccgaattcattccttccatgggaacactggagtgccctccctgtgtccccagttatctaagaacagtgctgacttcttgtcacattgttctttattagtgaagactatttgttcaataggtaacaaactcttctcatgaactcaaatagcgggggaaaaaaatcctctttaaaaccttcgtctcagtatgtgacttgtgctaatattagttggcaaagtcccttctctgtgttcccttccatctttgaagcacctgcccctccccctgcctcccccgccccccacacaccaaagcttaactctgtctgcagtgatcccccacccaagagccaggcagtgtagcctaagagttaagagcatgggcgcttccctgagctggaatcccaattctgccagttcccagctgtgtgacgccgggcagcttatttcacctcactgctctcagcatcctccagtcacagtgctggcctcatggggttgcagtggggactaagtgaagatgcagagaagcacttggggacagtgtgtgtctagaatgtactgtgtacatggtagtcatcactgtaccacatcctcatctgcatcatgatatttttaaagtgtgatactctcgaacccgggcctcattcagcagcgtgtcatggtgatggatccaggttttgaagctggacagaccgaggcgtgattctcggccgtttactagctttgtgaccatgagatcaatatcctcatctgtgaaatgaaataagtgatatcagcctggccaagtataatctttgtgggggttaaatgagatggcacacttaagtcacttagcttggttcgagggctgtagtctgggctccgaaatgataacttatcattataaccttgatgtagccaaaaggtaattatttgtaggaagtgaaccaaatgacatgatatcagattttagatgataaaggaatgggagttaaatgttctgtccaattctaacaacccgatgatttctcaactcggtgtaaaagagttctttgtagtgcacggtcctccctccctccttcttccgtgtgactgttttcactgtcatccttggtatctgctagcagggcctgaaattaatgaatgacctagagttatgactgcatgctcagaaatcctgttcttctcctagggctgaaatctctttaatgatggagggaagcaggcagacgcgagtgtctcggccatacaagatcagcgaatcatcaaaggtctgtgaatgttcactcaccacctatgcaaattgcctaagaagtgtgatcctttttctgattcactcatttctaatcacagactgatttttttgtcattggtgttgtcagtctccttaatgacaagtaaaggtggaaacgggcaaggagcagaaattgtcataaaatcagacagtgggaagtatgagggatggtagagacgctatggccagatgtcttcatttttccatgtgacattccggagctttctttttgtgacaacttgactcattcgttaacccaaggaggtggatgggacaggaagaaaactgggattcccatgcctgcttgggggctcaaaaactccaaggacaggtccattgagaacccagccttctaccttagggtgagggcaacacaccgtgtacccggaccccaagggcctggagtcgtcttccctggtcatgattccctgcgacctaagagcaagtgagggcaagttccccagagccaggctactgggggagttctaattagaaatatgtagcctgttcccaccagccacattaaaatccaagagccagacccggctgctatactttccacaaactcctgtccccacagctgctgttggtaaagagtgggggagccattggtatgaggttcctggtaacctgtttccccgttataaatattcgtaatgccctctgttctttagaggtatcccttttggagattaaatcttatggttacctcagatcatggattctcaatgagtatgatattgccctgaagtgggagaaaattggttctcgggagggtggaaggaattttactccttttatgcataagacacaattatacatacagtacatgagcagacatacagtgcatctgtgatgttaagattttgctggggaggctattagggaaaaaaatcttaaaagccttcttgtggggcaataatgaaaaaagatacagaaacacttctttagatgaagggagctggcagcagcctatagagttgagaaaaagggggaaagagattctacagattctaaaagaaaaactggctgtcattttcaagagaggttggctctcttgagatatgacctcctgttctcacgtgagttccccaagaaggttcctgccaagcccagctttatcgattgtgaaaacccagagaggtctcgccgctcgctcacaagggctttgtttgggagcttagcttgggagacactgctgctttctaagtttgacagcactggaagtctttgtccattaatgccaggaccctgagtttgtttctgtctgaactgaatctcttaggactaggcttctgtatcactggatgatgtttctaactttttttttttttcgagacagggtcttgctctgtcacttaggttggagtacagtggtgcgatcatagctcactgcagcctctacctcctgggctcaagtgagcctcccacctcagcctcctgaggagctgggaatacaggtgcatgccaccatgcccagctaatttttgtatttttagtagagacggggtttcaccatgttggccaggatggtcttgatctcttgacctcgtgacccgccagccttggcctcccaaagtgctgggattacaggcgcgagccaccatgactggcctgtttctaactttttatttttaaaaagtgtacccattaatttctagacattaaacacacctatgttgccagcacccagatgggtaaaaaacagaatactaccaaaccctcccagttgttacactcaagatagtcgctgtcccaaccccaccgctgtggtttgatctgcttttgaactttgtctaaacgggatccgaggtcgggtactcttgtgtgtggtttcttttgtgcaacattgtgcctctgagcctcacccgtgttgctgcatgtagttggtagtggtaggttttgctttctcagcatgttggtgtcttcccactgtgtggccacagtgtctgttcacctgtctgccctaagatgtgttgctcagccaggcacagtggctcacgcctgtaatcccagcaccctgggaggccgaggcgggaggatctcgtaagctcggagtttgagaccagcttggacaacacggctaaacctcatctctacaaaagatacaaaaattagccgagcctggtggcatacacctgtagtcccagctcctcaggaggccgaggtgggaggctcacttgagcccaggaggtagaggttgcagtgagctatgatcgcaccactgtactccaacctaagtgacagagcgagaccctgtctcaaaaaaaaaaagtgttgttcctttttgatgctaaattctttttccacgtctaatacctggtacctgccgcctcctcccaggtgtaagcccccgacaacctgagtttctccctctacttggccttgcatctgattaaggcactgaaataggaaataaagaaatgaacaagactcatatcatcagagaatgctgtggattggagcttctaagttacctgaaatgcggaaactctgttaccaatgtccctttataattgggaaataggccaggcgcagtggctcacgcctggaatcctagaactttgggaggctgaggtggatggatcacttgaagtcaggagttcgaggccaacatggtgaaaccccgtctctactgatatatgtatatatgccgggagtggtggcacctgaggtcaggagtttaagaccagcctggccaaaatggcaaaaccctgtctctactaaaaagacaaaattagctgggcatggtggtacatgccggtagtcccagctactcaggaggctgaggcaggagaatcgcctgaacctgggaggcggaggttgcagtgagccgagatcgagccactgcactccagcctgggcaacagagggaggctctgtatccaaaaaaaaaaaaaaaaaaagggaactcgtgtgcctgtgtttttggaaagttgtctatgcagctgtgctaaaacaccagaagcagattgcagctgattgtacccgggtacagcatcactccagcccacttagagcagaaacccagttttggaaacaacactgctcttgccccctgccccagctcactggagctggtgtctcccctcggcagccgttcactggggctttccccagtcctgccccctgggctctttcccttttgacactgcagtctggggttgtgtgtatctccgtctaagcatggtagggccagcaccctcaccagcgtggagacagccagggtccccgggtggcagatagccgcctcatgccctcatatgcgtctctcaggccgctaagcctgtactatgacttgatcaccgccactgtagtactttttaatttccttccttcagctcacacccaagaggggcctccagtcaatgtctgtagaagcactgaccattcctgcataattagaagctgaggcctagcacggtggcttatacctgtaatcccagcacattgggaggctgaggcaggaggatcgtttgaactcaggagctgaagaccagcctgggcaatgtagtgagaccccatttctacaaaaaataaaagtaaaaaatagctggatatggtggcacacacctgtagtcccagctgccaaggaagctgaagtggagggattgcttgagactagttttgttttgttttgttttgttttgttttgttttgttttgttttgttttgttttgtttttgagatggcgttttgttcgtgttgcccaggctggagtgcagtggctcactgcaacctccgcctccggagtgcaagtgattctcctgcgtcagcctcctgagtagctaggatgacaggcgcccgccaccacaaccagctaattttgtatttttactagagacggggtttcaccatgttggtcaggctggtctcgaactcctgacctcaggtgacctgcccacctcggcctcccaaagtactgggattccaggcatgagccaccacgcccggctgagcctaggagtttcaggccgcagtgatctctgatctactgttgcatgccagcctgggaaacagagcaagaccctgtttctaaaaatgagaaaaaatttaaaagcccggtgtaggccagcctggctctctttgtgggtaaccaggataaatagagatctccacgtgtgtgacctgtgaactgaaaagccagcctggaatggaagagcgggagagcccgtcctctgaactcagaaggaaatgccaagtcggatctgtctggcatcctccacaggctgtgagaatgtggcctgctcctgtagcatggacagagaagttgctgttggaattgactggatgtggaaataccacagggaaataaagtgtctcaatgacaaacgcatgtatggcaacaaaaagaagatttgaaagggaagaaaaaaataaaacccactgctgtaggacacatgttaagaagcaacttttaagaattcagagcctgggcagtttagggagacgttgtccctgcaaattataaaaatcagacaggcgtggtagcgtgtgcctgtagtcccagttactcaggaggctaaggcggaagaatcacttgagcccaggaggtcaagggcgacatagtgagacctcgtctctacaaaaaaattttaaaattagccaggcatggtggcacacacccgtagtcccagctactcaggaggctgaggtgggagaatcacttgagcccaggaggtcaagggtgcagtgagccgagattgtgccactgcactccagcctgggcaacagagtgagaccctgtctcaaaaaaaaaaaaaaaaaagtcgaaccacatagctgctaatacctaatagccctcggtcagttttcttcctccaaccacatttcccctcttcaggctagtgcccagccagttcttcacctcagtcaccctggaatagaccagctatctatgtgatagttttcagttacctgtttctccctatgttgaattcatttatttatttatttagagacagggtttctttttgtcgtccaggctggagtgcagtggcacaatcatggctcactgcagcctcaagctcctgggcttgagcgatcctcctgcctcagcctcctgagcagctgggactacaggcgaatgccaccacgcccacctaatttttaaatattttgttaagacaggaatctcgctatgttgcccaggttggtctcgaacttcctggcctcaagtgattctcccgtctcagtctcacaaagcattgagattacaggcatgagccaccatgcctggcttgaattgttgtgttgtttggttttgggtttttttggtttgttttttgttttttcttgtttgttttgttttgtttgtttgttttttgttttttgagacggagttcttgctctgtctcccaggctggagtgtagtggtgtgctcttggctcactgcaacctccatctcctgggttcaagcaattctcctgcctcagcctcctgagtagctaggattacaggcacacgccaccatgcctggctaaattttgtatttttagtagagacagggtttcaccatgttggccaggctgctctcaaactccagtagccgggctgtcgtcccagctactcaggaggctgaggcaggagaatcacttgaacccgggaggcagaggttgcagtgagctgaggttgtgccactgcactccagcctgggcgacagagcaaggctctgtgtcaaaaaaaaaaaaagaaagaaagaaagaaagaagttatattaataagagaaggaaaaaaaaaaccacgatacacaggcatactcagaaacacctgtacttcctgcagtgccctctgatgcagcattttatttcctgttttcttcagtttcattttgttgaaaatgctggtcaggacccactgggttggaccagggccgagcaggctgctgcgccgtttctaatgtgtcttctctgtccaggtataccgctgggccgaccactcaagcacggtgctgcagcggctgaacgagcagcgtctccgcgggctcttctgcgacgtcgtcctggtggccgatgagcagcgtgtgccagcccatcgcaacctgctggccgtgtgcagcgactacttcaactccatgttcaccatcggcatgcgggaagctttccagaaggaggtggagctgatcggcgcctcctacattgggctcaaggccgtggtggacttcctgtacggcggggagctggtgctggatggcggcaacattgactacgtcctggagacggctcacctgctgcagatctggacggtggtagacttctgctgtgagtacctggagcaggaggtgagcgaggacaactacctgtacctgcaggagctggcctccatctacagcctcaagcggcttgatgccttcatcgatggcttcatcctgaaccacttcggcacgctgtcctttacgcccgacttcctgcagaacgtctccatgcagaagctgtgtgtctacctgagcagcagcgaggtgcagcgggagtgtgagcacgacctcctgcaggccgccctgcagtggctgacgcagcagcccgagcgcgaggcccacgcccgccaggtgctggagaacatccacttcccgctcatccccaagaacgacctgctgcaccgcgtcaagccggccgtgtgctcgctgctgcccaaggaggccaactgcgagggcttcatcgaggaggccgtgcgctaccacaacaacctggcggcccagcccgtcatgcagaccaagcgcacggcgctgcgcaccaaccaggagcgcctgctgtttgtgggcggcgaggtctccgagcggtgtctggagctcagtgacgacacctgctacctggacgccaagagcgagcagtgggtcaaagagacgccgctgcccgcccggcggagccaccactgtgtcgcggtgctggggggcttcatcttcatcgccggcggcagcttctcacgggacaacggaggggatgcggcctccaatcttctttataggtatgacccccgctgtaaacagtggatcaaggtgagattaaagccagattatttcttttctcttgaggactctctcggtttccttaacctagccttgactttccttacctctctggggccttgacaactatcctgcttctgaatgaggtgtgatgataaagtgacgagcagaataccccggggcctacatcctggacagggagagggagagccgacccaccccttcgaggggtccgtcatcgttcagagcagcactgcctggcggggctttctgtgcagatggaagggtctgtctgtacttcccgatacggtagccacagccgcatgtggcgactgagcacttgaaatgtggccagtgcgactgaagaagtcaattttcaattttatttcactttaaccgattgacgtgtaagtgtatgtggccgcacgaggcgtggctaccctattggacagtagcatgggtctagatgtttgatccatggttcaacatccccaggtcctggagtctctgtggggctcctctggaagcattttgggagatagtttaaggagaccactagtgctcacgcctggcccttgggcatgtattgtgtcctgattctgggaagagcgtgggccttgatgtcagacctgaggtctcatcccagcctggctaagtcatagctaggaaatttcagattcttgtcctctccacattttggattccccttctgggaatacgtgggggacagggagtgcagtagctcatgttgactggcaagcccctggcgtagggaaggtgtctcctttctgctgggagcgctctccagccactcggtccccgggacagtccatctcagcctctatactcacacctcagcgtcgcgcccagctcagtgctgttctcagctcaaaacccagtcagaatggactccagctgaccttttgattttactctcagaaatctgagactgccctccaaggtcgaagtgtcaccactggaaagggtccctggctttggagcctcctcccgaagcctggcagcagtggcagcagtgtgtttgccttggattcgtttaaaaaaagaaaaaaaaaagttggctcttctactttttgtgtgtgtgtgtgtgagacagagttgttctgtcacccaagctggagtgcagtggcacgatctcggctaattgcaacctctgcctcccaggttcaaacaattctggcgcctcaacctactgagtagctggaattacaggcgcctgccaccacgcccggctaatttttgtattttcagtagagacggggtttcaccatgttggccaggctggtctcgaactccgtgacctcaggtaatccacccaccttggcttcccaaagtgccaggattacaggcgtgagccaccgcgcccagcctcttctgtttaatttcctgtcgaatgccacgtcctgctctgttaacacggagtggcagagcagcactaactttacaaatctgatgtggggagaggaaagatgaatttttatttcataaagccactagatcagcaattctgacccctgtgaccacagagttcccatccacgcggctaacgacatgaccagagaagttcgggggttcagagcatctccatcccccttttggggactcagagcgtctccatcccacttttggggattcagagcatcttggtgaaacctcgggggctcagagctcccacctgaagaagccctctttattcaggtgcagttccctttcccaaacattctccggggttgtgcattccgcagacacatttgggaaccgcagcgccagatgttgatgctgtcccgggttcggggaagggaaggtacaggtatctcaactccacaggtggcctccatgaaccagcgccgtgtggatttctaccttgcctccatcgaagacatgctggtggccatcggcggccggaatgagaacggagcgctctcttcagtagagacgtacagtcccaagactgactcctggtcctatgtggccggcttgccaaggtgatctggggcttggtggaaggttctccaaatgggatgtttttaagggacatagttcagtccacgtgcctcactttctgggcatgttggcctccaattccaggaatgaaatcttccggcttgtcaggaagagtgggtacaccatgaggggcggagggcgtgacggtgcacagtccgggctccggtttcagacttagggcaagggtcagctctgccgccatgacggacatccctccatggctgagtgtgtgcagttgctgagcttcagagggtgaggcctgacctgaggatctccctgagcttgggcaggaggagttcaaagagatgggggtatatgtgctagatctaagcctcaggcatgggtcttcaccccgctcggcctttagttcctcatctgtagaggtagacgataatgatacccaccccacagcactgttgtgcagagcagatgcagtgctgcttgtgaaacctgcatccacatgcagggagtgccccagggtggccgcctcaccctcctcagtctcccctgcgttccgatgtgcatgtatcgagcatttattatctccatgggattagcagaaggtgcacaccattttttccaccagttccctgttgccgcacccagcagtgcactttctgaaccagtctttgctgtggaatacatccaggtgtccgtaagagttagaagtgtgtggggtaagcgctcgtatttttgtttttctgagagagagtctctctctgtcacccaggctggagtgcagtggcgcgatctcggctcactgcaatctctgcctcctgaactcaagcagttctcctgcctcagccttctgagtagctgggactgcaggcgcctgccaccacacccagctaagttttgtatttttggtagagacaggatttcatcatgttagccaggctggtcttgaactcctagcctcaagagatccacccacctcaccctcacaaagtgctgggattacaggcatgagccactgcacctggccatattgatcctttcttattcactaaaggccctggtttacatcagggttcccacttcctggcacagttgtgtgggttttgaggaacacaaagcaacatgaatccaccattacagcatcacgcagaatcatttcactgccctaaagcccactgtgtgcgtgctgtccatccctccctcccctctccccacagtcctggcagccactgattttgctgtctctatggttttaggcaaaacttttcccgagtgccagcacagttagaattggactgtatgtcgtatttcctctttgatgtgtgattcatcgggtgcatgtgtgcctgctagctcattgttctagtcgtttccagccattgtgaaaagggtgatggtcctgtgattattcccatttcccagatggggcaagggagactcagagagagtgaagctgggttctggcccaggcggcctgactgcaaagctgtccacttccccgccctgccctgccatttctttgctaatgacggctactgtctatagagtgttcatggggtgcccactccctatattcttaaatcctcatggccctctaagacggcaggctgttccccggctcggagggggtaagcctggcacagccctgagctctccctctgtctctgcccgtcgaccctgcaggttcacgtacggccacgcgggcaccatctacaaagacttcgtgtacatctcggggggccacgactaccaaattggcccctaccgcaagaacctgctatgctacgaccaccggacagacgtgtgggaggagcggcggcccatgaccacggcgcgcggctggcacagcatgtgcagcctgggtgacagcatctactccatcgggggcagcgatgacaacatcgagtccatggagcgcttcgacgtgctgggcgtggaggcctacagcccgcagtgcaaccagtggacccgcgtggcgccgctgctgcacgccaacagcgagtcgggcgtggcagtgtgggagggccgcatctacatcctgggcggctacagctgggagaacactgccttctccaagaccgtgcaggtgtacgaccgcgaggccgacaagtggagcaggggcgtcgacctgcccaaggccatcgctggcgggtccgcctgtgtctgcgccctggagccacggccagaggacaagaagaagaaaggcaaaggcaagaggcaccaggaccggggccagtgaccctagctgcgcctcttgggaccatcctcaccgtcacctcccagggctctgtagaccagcagcaacttcttagtattccggaaacattatgtacaacttagcagctttttttacttttatgattcttggtatttctatgatatcacagtaaccaattaaatactatctgtaactttacatatcttgcttgaataactaaccctgggcccaggcagtgagcaaccccttgtatcttcacaggtctttgccccgtgttatgattcctcatgggtccttgctgactgtccccctgagagtagctggcacgtgggtaacacagaaatttctgtagtgaagcttgggcctcaaagggttctcttaggccacctagtccaagcctccccaaacctggctgaacttttaagaatacagatgcgtgagccccgctcagaattatggaatccaaaaccaccaggaacggggaggaggtggtgcccagaagctgtattttaactagttcttggaattctgggtattagtcacatctgggaatcactggcaaggtccagtgtgtttgttttataaatgagtgcacagagaccacccatgagggtgagtgagtgagtgaccaggggccacgcagctcgctagactgtcagatgagacatgatgacttcccgctggggagctgttctccgtatcaggtgaacgctgtttctgaataattccgtctttcctcattggaaaccttcttgaattctaaaacgttacaggtaaccaaaaacgaaaaaaggtatgaagctctttatacatatttttttgtaatttgtgcatttttttccttttttttttttctgaacccactgtcttttatattactgatgtactgagctcccaaatctgtttatttctcaggaaagaaaaagtgagtgctatggaatttgccatcgttctctgtgactctatcttgaggcgctgttgaaagttcctgcacagaggagcacatgtggatccctgagaaggcagtggagggctccctaactcccacgccaggtcctgccccagttttctgcttctaagtagtttcgtgctgctgggcaaattctcgaacaagtccgtgtgttccctcatccaccccgcttagccacaggattagatggaataccctccaggctcctcccgggtgatagggccattcagcctctgagctgttcgtacccggatggcatccccttcaggatgtggagctggcctgcactgactcctgcaaacagttcctaaagcaggtgtcagggtcgcttgccctttaagagggctcttagctgcccgagtggatgagaaacgtgcagaactatgggaggataggagtgtgatgggttttaagcatgagccaaggaaggcatgaatgagctgtacctcacccagcatccgatggcagagatcagtaaacttcaagatgtgcttcatcttcaatcctagtctaacaccagtcttcctgcagacagttccgagagcaggtctcgatgtcacttgccctttaagagggctctcagctgctcgagtggatgaggatcaatgtgttaagattgatattagactaggaaaaaaatcttagttaactttaatttccatttcttctgcttctttgctgcccctcctttcccttcccttcagggtttactgtggttctcactggtctgtttatgtagccatccagaagagatgagagcattttggggactgaaagcttcaatagccaacttactgccctctgtggttagtgaggagggcagtctgcatgttcagctagctagttatttgcatgtgaagtccctggaggcttacaaactgttgagaggttctgcgaggcatacaaacaaacagaccaaaaggctggaaactctgcttggagctctgcagcattccggtgtatgaaaggttccgagaagtctcaacccagcatttccaaacttctttgagcctaaaagtcgtttgtctcatacctagtcccagacccccacaaaacatgttttgcagaacttctgccaactttgggatagcttacccccttcctattcgggaaaggttttattgcttgtagacccctcagaaggcagggtagggtgtacgtgggctgttctccccatctcagcctgggtcatgaacaaacgggcagttgtttggcctgaatctcggggcaagttggggagagcacatagaaagactctgtgagtgatttggggagtgggatagctttgaccttggagagaggagagccattggttttcagcctaagccagctcttttatgttttgcttctgggacttgtccctggaaatgtgtgagcttctggcctctattctgattttcttgtgcctcatgagttacatacgacgtcctgcgcttcatattttgtggtgtctctcctgatactatgaaggtggtttgtaattgacatggctttgaccctaatattactaaggttgggaccacccttttaaagggaggataaacaagtttcatcttgtgggtcaacttctaatatttgatggtggctacactgtgacaagaaaggtttttgagcttgttggggtcagtggatgggcacaagggcacccagtggtggtgcccgggccaggtttttgttacttgtctttttaagttgaaaattcaccctactgtgcatgaaaatggaactgaaaatggaagagaccatgcctgggcaacatggcaaaaccccatctctacaaaaaaattacaaaagattagccagggatggtggggcatgcagtagtcccagctgcttaggaggctgaggtgggagaatcacctgagcctgggaggttgaggctgcagtgagctatgaccacaccactgcactctaacctgggtgacggagtgagaccctgtctcaaaagaataaaatgttttttaactcagatgggcagagtttgggctgtgcttatgcagtggccatttgaaccgcacagtcacgaatgtggggttttaaactagagtgatgaaggcacaggtgcttgcaggctgccattttgagagggaaacagccacacatgtcatcatgttaaactttcagtgtttcaagctattctgcttgaattttgaagacacctggatctttttttttttttaacatttcaaaataagcatggcaggcttctattgaggtttggacttctctcatttctaaagaattagagttgtaacttcatattagttgtaagtttggggtttggtcctcacccaagttggaaagctgtttgcttaagacatagatgtattataataatagaagggagggagtagaaagctgatgaacccttgttacttatagcaaacttcctgctgttttaaatgcacagagattattttatcaactgtggttagcacgcaattggtatttttattgttctgccattttattgaggctatcaagtgggacttcagacctggctctgagcaggaccacacgtgtgtatttatattgagtgccctcactcatgataaggtgacttcatggagacccagaaactcaccctaaggggtgttcacctttgaggtgggcatccagatgctgaggggaagtggggtccatcctctgaggtccaggggcctactttgtgagctcagttgtgttcacctgtggttcagtgtacctcggcccctaagccaagtgatcgttcagtgacttgcagcaatgtgggaagtgaggggacccctgccacaccccccaccaccccctgtagagtcactgaccttcatccttcaccctggtcctccatggtgcagcagcatctcatgggccttgtggctgtcagagcccgtggttggaaccccgtccactggtcccaaacctggaggggcagctgcagatgaggtttagacctcctggtgtctccgtggattctgagtgcccaggaggggaggggagggggtggcatcctggcctctaggataaatgcctggagtatagggcagcgccacgggcacttggagaccctgtcctgcgcatctgccaagcctggcagtttttagagttttttgaaatgttttgatactttttgatacaatttgctaataactgttttgtagaatgcctgccggggttttccacctcatccctttcctccggccccttgatttgtgctggacaacaaatggcagcaccaggacctcgcctcatgtggctttgtcttggatcttgcccttctccatcgctgatgtgatacagctctagaatttcgtgaagttgcatgcaaagttgcatgcagcccgtgggtatgactgtctcaggcccccagctcatttgccaagaggaaaccttaacccccctgagagggtctgcgtttcttctagagctcctacctcagtggtgtgcacagagttggagacacctgagggctggtccacgtctcacctttgccatacgggtcatttcttgatcaaatatatgactggggtcctggtttactcccgcccaccctttcttttaaagtattcttaacatgaaatccacaaaagcggaaacaatgaaccattcttgcactttacagaatcattgtccttagctttagaggttgttaatttcttgtttttaacatgaacagaatgtgtggttctgaaggtgtgtgggggtctcaagaaattgtcctttggggccgggcgcagtggctcacgcctgtactcccagcactctgggaggccaagggggacggatcacctgaggtcaagagtttgagaccaccctgaccaacatggtgaaaccccgtctctactaaaatacaaaaattaggcagtcgtggtcgcctgtaatctcagctcttccggaggctgaggcaggagaatcgcttgaacccaggaggcagaggttgcagtgagccgaggttgcgccactgcactccagcctgggtgaccgagtaagactgtctcaaaaaaaaaaaaaaaaaagaaaagaaattgtcctttggttgccttagttaccagagttgaatgaatgtacacatttcggtagtgggggggcagagcggataaccccttccttgtctgtttcctttgagaaaggacactccaccttttcaaaggtacttaaagccatctttacagattgcttgtaatgtaaggaaagagtcatgtcctttggattgattgaggttaaatcatcaaccactagccccctttcaaaatcagcgagatatttgatgattaagtgattcattgggtatgttctggctactgatgttactgaaatctgcaatcgtgtatgttttttaatttgttgcttttgtatttgtaattttatgacatttcgaagtttctgtgtcttaactctttttaattaattttctgcacgttgcttttttctctttgtttttaattccatacagagtattcaattcttgaaacacattaaaataatttgcttgctagggtatggtttattttataattacattcctagtcttgtgtggttattgtaatgatgtctggtcctaatttctctgcccgtatgaaaaagaaccccttgcctgttgatcctaaatataatttggaaattaaccagacttccttttggtgttgtggggaggctgggacatttcaattctgctttcattgtgtttctaattactgtattttgccaggaatttcattcagttccttgattgcagggctaagtccccgtgacctgaaatgaaactatttgcttaaatgtgtgtcaactggggtaatttgattagaaaagaaacacagaaaccaagggaaacagcttatgacaagcagtgtgctatctttatcagaaaaaatgcaatcacaatactctaagaaccagctctgttttccttcgggcgctcccctgccttgctggggttttgcaaggccaccagcagagaagcccaggcacggttgtgcaccctttccttgtcccttcggcaggtcagcatcgggagggttggggaggggtgtctgcgcagccatcatacctgataaggtggttagaatttgcctctgagccagtgagccccaaacgggacccgctgcccggtgccgacttcctcacctgggttctttcgcatccgcttcagaagcatctcaggttaggttgatagtctcccgattttccaggtgaagaatccaaagctcaggttaattaccttaccccaactgtattgtcttccccgcccagccagtcagtcgttgccttggtttgagttctcttcaacgcagaaccttagacaaggacttggacacaggtagggcagagaggtggtccccgggaagccagaatgccatgaagaaggagagaaggcccacgagaaggtgctttattgccgagtaaccccaagccacggcttccaacaatatcatggcggaccactctgcaggttgactgggcttggctcagaggctctcccctgaggctcctgcacggtcacatggtcatggacaggtagtggctcttgaaggcgtgagtgagaacacacagctcctccagcatctccctctccctttcttctctctccctctctccctgccttctcatttccccttctcttccccgcccccccagtctctttctctctctctccttgttcactttggtctggctctctctggtctcttcacacggcctcacctagatttcttacatggcagccaaaggctcccagagcaaacgtcccaggtgtgatgagcagaggccacgtggcttctgccagaacctcctgggaagtcagggagtcagtttgctgcatttcacctcttgaggccatcagaaaactcccccaggttgctggccctgcgagaggtgtcagccgtgtcccgtccctgaccctggaaccctatctgcaaaccatgggaggagctgggtgtgatggctcacacctgtaattccagcacttttagagacctaggcaggaggattgcttgggcccaggagtctgagaccagccggggcaacatagggagacctctgactctacaaaaaaaaaaattttttttttttttttttgagacagagtcttgctctgtcacccaggctggaatacagtggcaggatctcggctcactacaacctccacctcctgggttcaagcgattctcctgtctcagcctcccgagtagctgagattacaggcatgcgccaccacacccagctaatttttgtatttttttagtagagatgggttttcaccatgttggccaggctggtcttgaactcctgacctcaggtgatctgctcatctcggctcccaaagtgttgggattacgggcgtgagccaccgtgcctggctttttttttttttttaacagggtcttgctctgttgcccaggctggagtacagtggcgtgatcttggctcactgcagcctcctaggttcaagtgactctcctgcctcagcctcccgagtagctgggactacaggcgtgtgccaccatgcccagctaattattattattttttttaatagagatggggtttcaccatgttggccagactggtctcgaactcctgacttcaggccatctgcccacctcggcctcccaaagtgctgggattacaggtgtgagccaccgtgcccagccaaaatttttttaaaaaaaattattcaagcatagtagctcacacctgtaatcccaacactttgggaggccaaggcaagaagatcacttgaagccaggatttcaagaccagcttgggtaacacagtgagacctgatttccacaaaaaaaatggaaaatcagccaggcatggtggtgcatcgttgtagttctagctgcttgggaggctgaggcaggaggattgcttgagcctgtgaggttcaggctgcagtgagctatgatcacaccactgcactccaggctgggctacagagcaagaccctgttctttaaaagaaaaaaaaaaaagccctcagtggaaggaaggtatgttcctaaggccactgcctcagacggcaggggtttgatgttgctgggcccgcatgctgtcggttggagaggagagcatttatggggcctgcgctgctcagtgagggctgctcccagaggccttggcgcacttcagctcctggctgccgtgcacacacagagccaaccaacagccaagcagggcctgagtggccatgggacggaagtgcagtgtgtgatggaggggacaccgtcagcacgtggccaccccgagcctgcactgggtgcccagcgccgctgtggctagaatcagcagagggccaagggcctgcactaggacaccaggggtagctgctcagcaggggcagatgttaacccaggtctgccagctaagaccacatttttttttgtttgagacagaatctcactctgtagcccatgctggagtgcagtggcacaatgtcagctcgttgcaacctccgcctcctgggttccagcgattctcctgcctcagcctcccgagtagctgggattataggtatgcaccaccacgcccagctaatttttgtatttttagtagagacagggcttccccatattggccaggctggtcttaaactcctgacctcaagtgatccgcctgcctcggcctcccgaaatgctgggattacaggcgtgagccaccgcgcctggccatattttttaacaactctaaaacaaccaccaccagagtctctgtatagggttcagaattgtgtccccaaaggctccactacaatgcaaatgtgtgagtggagaggttaaccagggaagccctggacttccacaaaaccatcggcagagatttctgttacctcacccaaagggaacagagaggcagtggataccggacagggcgtcttcgtggggtcaggggagggcggagggaggacccgcacagaccccatcgttgctacctgttggctgaggcctgggccactctctcaaggacctgcccacagccttaaatcaagaccgattagaactcactttcccgctggagcacgatagttctgaatgaactctgcgttcactctcaacacacgtactcatcaagcctccactctgtgccagacaggcgctgtactagatgctggggatcgggtggtggacaaagaagcaggctgcctgcccccaggggcagaaacagaccaacaagatacataggtcaggtggggataagtgatatgaatgtactaaaacccgctgtgttgtatacttttttttttttttttttttgagacagagtctccctctgtcgcccagtctggagtgcagtagcacgatctctgctcactgcaacctccacctctcaggttcaagtgattctcatgcctcagcctcccgagtagctgggattacaggcaccggacaccacacctggctaatttttgtatttttagtagagacggggtttcaccatgttggccaggatggtctcgaactcctgatctcaagtgatccacccccttggcctcccaaagtgctggacaggcgtgagccatagtgcctggcctacattgtatactttcaatgtatacaagtcagtggattttagtacattagtttgtgaatctcaaactacaactttttttaaaaagctctgcaggggaaggatgtgcagcaagttagaggagcaaagtgctgaaaatgtgagaaatgggagctggcgcatcacagaaggctgtgagctcgggaaggaggtgatctgattcgttttcaaaggagagcttcggcagctgctgggtgtgtgtttgtgtgtgtccaagtctatgaattttaacaaataaccaattattcacaaaaatcaaagcccattaatggatgcatggataaacacaatctggtctgtccctgcaacggactattatccagtccgtaatacagaattaaattctgatccacgctacaacatggatgaaccttggaaacgtgatgctgagtgaaagaagccagacacaaaaggccacatgttgtatgattccatttctgtgaaatgtccagaattcgtcagaataggcaaattcatagagacaaagtagattcgtggatgcttagggctggggtggggacgaggaaggatggggagcaacagctcaagggcacggtatttatctttgtggtgatgaaaatgttctaaaactgggtgatggtcgcacgcatctgtgactgtacaaaaaatggaatcgtacactttgaatgggtgaaatgtatggtatgtgaatgatatctcaagttgtttaaaatattagagcaatatttccctccattctcggagttctgtgtattggtctcctagacagtacaggttgagaggcagaattcaacctccctgcttagattctaaaacgggttaaaacggtgagactagaggcaacattcatctcaagtctgcgtgagagcagagctcagggcatcctccagggggcgcgctagagcagcagtcctgaaaatgcggtccctagaccagcagcggccgtgacagtgggaacttagcaatgcaaactgccaggtccacccccagaccagctgaatcagccactcctgggctgggggcctgccaatgcgtgtgtttacaatgtttacaagccctcccagtgattcttttttttttttttttttttgagacggagtcttgccctgttgcccaggctggagtgcggtggcgtgatttctgctccctgcaacctccacctccacctcccaggttcaagcgattctcctgcttcagccttccaagtagctgggattacaggcgtgcgccaccgcgcccagccaatttttgtatttttagtagagacgtggaggggaggggtgggtgaggtgggattcaccaagttggccaggctggtcttgaactcctgacctcaagtgatccacccaccttggcctcccagagtgctgggattacaggcgcgagccaccgtgcctggccctctcctggtgattctgatgcctgctcaagtcggagaaccactgttctccaaaggtatctgtctccattctccacccacagacctacctaagctatgagtccctgcccatagccaacagctgtgcctggcttgctccggccgaaacctgaaccaaggggcagctttcagattaagcacagccgggtctgaatcttctgccttgggaagtctgggaaaggccttggagtcagcctctgcaggggcatgcacctgttgcctccctgagaaagtcacctcctctgtgcccttcctgttgatggcagcaggaaggctgtggcatggcccaaccctttaactggtgtccagcatccgctggctgtgtgctcagagcatgctcagagcctcatgctctgttcggatgggatccttttaccaggtatgctgcaatagtgtgattcatccccccaggggccccagccccactcttgcaggcatctaaaggtgctaaaaatacataactcctaagtgcggttctgtatttctgactgtaccagtgttgtgggcctttttatgctccaagctgaaattcaagaggcctggattccaatataaggcccatgattaatgggcctccagcaaggcctcactcagcatctcctgtatttagatggggcctaaagcatgtctctgtgatgtggaccaagcacggggctataagtcagggagtgtgagttgcagccttggctctgtcacgtgcacctgggccagggcttcatcttgttcaatttcagttcctcacactatgggataagatggttggagattagcgctcctctgggtgtgatctgcagagccctggtctgcctaaaggacctgcctgaggtcctttaagcagctgcctaaaggagtttgtggtcaggaaacatttggggagctctggagatacattccccctctgggagactcaacattagagaacacgttcatatttcttttattttcttttttctttctttttcagatggagtcctgctctgtcacccaggttagagtgcactgcaacctccacctcctgggttcaagtgattctcctgcctcaacctcccgagtagctgggactataggcgcctgccaccatgccaggctaatttttgtatttttagtagagacgagatttcaccatgttggccaggctggtctcaaactcccgacctcaagtgatcggccctcctcggcctcccaaagtgctgggattacaggtgtgagccacggagcccagcccaaggcctggcttttgattttgcagatctaaaatcttgatttggttcatgcatctgtagtggttaagtttgcttgtaacttggctgggccgtggcacacggctgtgtgtttgaacattattgtagatgtttctgtgaaagtgtttttggatgggattaacatttaaactgatggattttgagattgccctccagtatgtgggtgggccttttccaatcggttgtaggccgtaagagaataaactctgagtttcctgagcaagagggagcagcagacagccttcagacatcagctgcaacatcagctcttccctgggtctccagcctgccagctgacttaaagtcattctctctgtctctccctctcactgtgtgtgtgcatgtgtgtgtgcgcgcatctggccatggtggcctgtgcctatagtcctagctactccggaggctgaggtggaaggatcgcttgagcccaggagttgaaggctatagtgagctgtgattgagccactgcactccagcttgtacgacggagccttgctccatctctcaactatctatctatctgtatataaacacgcacacaattgatccttgaataatatgcgtatgaactgcgtggtccacttttacacgaattttcttttgtttctgtcgcccctgagacagcaaaaccaacccctcctcttccttcttctcctcagtctatgcaacatgaaggcaaccaagatgaagaccttcgtgatgatccatttctacttaatgaataataaatatattttctctttctttttttttaagagatagagtcaggctggagtgcagtggtgtaatcacagctcactgtagctgcaaactcctaggctcaagtgatcctcccacctcagccacccgagtacctgggactacaggcacacaccatcacacctggctaattttaaaacatttttgtagagatggggtctcactatgttgcccagactggtctcagactcctggactcaagcgatcctcccaccctggccttccaaagcgttgggattacaggcatgagccaccgtgccttatgattttcttaataatgtttcttttctctgggtcactttattgtaagaatacagtatataatacatgtcacatataaaacgtgttaatcgactgtttatgttattggttagacttctggtcaacagtaggctattagtagttaagttttgggggagccaaaagtcatactaaaatttttgactgtgcagggggtcagtgccccaacccctgcatcgttcaagagttgtccacgtgcacacgcatgcgcgcacacacacacacacacaaacacaggcatgcacacacatgcacacacatgcaaacacacaggcatgcacgcacacacacgcatgcacacacgcacacatgcacacacattttattggtctgtttctctggagaaatctgactagtacaacttccacagaacagactcagggaacacacaacaggaactggaccgaaccctagaagacagcagtgagggcagctcctcccaagaggcagggctttgcctcacatacctgctcacccactttacatggagagagaagtgagttgagattagaacatatatatacatgtacatatacatatgtacatgcatatgcatacacacaaaatacacacatatacatataatacacatgcacatatatgtatgcatacatacatatatacatacacgtgcacatatgcatatacatacacatgcatgcacatgcacatatataaatgcatgcacacatacacatatccatatccatacacatatccatacacatacacatatgcaggcacatatacataaagccatgcacacatacacatatgcatacagttacacgtaaatatgtacatagatccatgggcagggccaatggcttttctgcttggtcagaaacctggaagaaaaacagtgtctaggacagggaggactggagaagagacatgtggatgggctcactcacatgggcccggagtgtgaagatctttgaatccgtgttaatgttcactggagaacattcaccatgcaagaagcactcagcgactaagtaagcaggatgattttgcccatagatgtcagccagcctctgaaattaccaccccactgctggtacagtgggcacatgaacagaatagccgaggtagcagggatgggggctgtgcccgggctcagcagcacacgcaccacggctcacctaactgctcccacccccaacacagagcaatgctgagctgcccatatggcaccattcctcgagacccacctgccactcggtggccagttggttccactgggccccttctaccctgtaaggctcagcagatcatgttgccccgaactgacactgttccaggtatagtttgcccttgcccacagggtctctgcagaacctctagctgatggctttcacagcgtttaattcactgacgtgggatcctgcgtaacaacaccttgggacaagagacccactttacagaagagaaggtatggccgggtgctgctggctcacacctacaatcccagcacttgggaggctgaggcaggaggatcccttgagcccagtctgggctgagttcaagaccagcctgggcaacatggtgaaaccctgtctatacaggaaaaaaaaaaaaaaaaaaaaagcagcagcagaagaggaggaggagataagaaggtgatcatataaccttgggattcccggtcccatcactctaccgcctagaagctgccagtgtgataaggtgatagaaagatcttttgaaagcacagtaaacgtggcagcctagagacattccaacttgtacaacagatcaaagccccgtctctaaactatctgtctatatataaacacacacacaactgaaccttaaacagtgtggttgtgaactgtgtggtctacttttacacgaattttcttttgtttctgagactttggggcaccacctcctgaaatgtaacataccccctaaatcaacgaccaacatagcatgcggtgttcctaaaatggagaaagcattagtctaggaacaaagggatggccggaggtgcggccctgctgagtgtgttctcgatgaccacgtaggaggtgtgcctcccactcctgccaccttcgctctggaggtctaaagatgcagtttctccgaagagttcatgtttccaccaagagatgcagagaggtcccattcaacttgaagctctgcttcctcctggtcacttctggctcctcatggaagcagtctgcaggctgggatgcagcagcaggaggcagcagggctgctattacacacagaacggggggggctctctcagacctcctctgcttagcttccgtagagattgcaacagcagcagccacagcctgcaaaaggcatgatggccaggggttcagaccctccaaggatgagaatctgagtcaccccccagttccaggttaccctgctgggaccaacagagggcctgggtcagggtgaggggaccctagtagaggatggagaagaatatcagctgtggcccccagacagctgggttggttccatgaactttctttcctctagtaaatttcccagccgggatcctggagggactgtgtatttgtttcccggggctgccataacaaagcatgacagactgggaggcttaaacaacggaaacctattttctcacatttctggagcctggatgtgtgagatcaaggtcggcgtggttggtttctctccttggcttgcagatggccgtcttctccccgtgtcctcacgtggtcttccctctgtgtgtgtctgtgtcctaatcgcctcttcttgtaaggacaccggttgtattggattagggctcatgtgacctcattctcatttaatcacctccttaaagaccctatgttcaaatgcaggcacatttctgaggtcctgggagttagaacttcatttgaaatgtgcagggaacaaaaaattcagctcataacaagctgtttccatgtaggttgaacttagtgtattaaacaagtgatctaacagtgcaaggggtggacagtacagaacccaggggcatcgtccctgcccccacccttcaagactgcagtgcatggccaggcacggtggcttatgcctgtaatcctggcactttgggaggctgaagtgcgcagatcatttgaggtcaggagttcgagaccagcctggccaacatggtgaaaccccgtctctactaaaaatacaaaaattagccgggcatggcggctcatgcctgtagtccgagcaactcgggaggctgaggcacaagcatcgcttgaacccaggaggcagaggttgcagtgaaccgagattgtgccactgcactccggcctgggcaacagagcgagactggctccaggaaaaaaaaaaaaaaaaaaaaaaagactgcagtgctcattctcccagctgccgggaacattgcccctgacagtttgtggctgagtctctcactgggcatttcccctggccaaaggaactgccttacccagggatgccctcctcccagggaaagctcccatgccatgtctggccaacacgggagttcagagctcagcctcttttctccaatatgtgacacctctgagggccatcccaggttcagggctgtccataaaacctcagtttaccttctccctctgctcaatcctgttccccgcagccctggcaggtgttgattctcagagcacattccccaaccaattccctgcatgcaatctcatagtctgtttttgggagatacaattgctatgggtctaaaagtttgtgtcctcccccaaattcctaggttgaaatcctaacccccgaggtgatggtgtaaagaggtggagcctttgccaggtgattagggcatgagactggagccctcatcatgggattagtgcccttataagaaaggcctgagggccgggcacagtggctcaagcctgtaatcccagcactttgggaggccgaggtgggaggatggcttgagcccaggagtttgagaccaacttgggcaatatagcaagaccccatttctaaaaaaaaaaaaaaaaactatatatatatatatagttttttttttaattagttgggtgtggctgggtgcggtagctcacgcctgtaatcccagcactttgggaggccgaggcaggcagatcacctgaggtcaggagtttgagaccagcctggccaacatggtgaaaccccatctctactaaaaatacaaaaattagccaggtatggtggcaggtgcctataatcccagctactcaggagcctgaggcaggaggatcacttgaacccgggaggcagaggttgcagtgagctgagatttcgccactgcactccagcctaggcaacaagagggaaattctgactcaaaaaaaaaaaaaattagttgggtgtggtggcacatgcccgcagtcccagtagtcccagctactcgggagccagagactggaggattgcttgagcctgggaggccagggctgcagtgagccgtgtgtgcgcccctgcactccagcctgggcaacagagcaagactttctcactttctctctctttctctctctctctctctgtatatatatgcctgagagagaccccttaacctccaaccatgtgagcacatagaaagatggagccatctatgaaccagaaagccctcacctgaatttcctggagccttgatcttggacttccagcctccagagctgtgagtaataaatttctgttgtttataagctactcagcttatggcgttttgttgcagacaccagtctagggcaaatccttgtgcactgaagtcactagggtcaaattctcactattggctgtgcacaaaagccagcacatacgcataaaccgagactcatgtgcagggctttatcccaactttagccgtcaccaggcaggaaaaggaaagtcccaggctgttattagggaaaggcaaatgaaaccacaataagagaccacgtcacagggactaggagggctagaaccaaagatagataatagcaagtgttggtgaggatgtggagaaattggaacccgtctgctctgttcatcggaatgtaatgggaacagtggtgcggccgctgggggagacagtctggcagctcctcaaaaaggccaacaatgcgttaccctaccacccagttattccattcctagggatatgctcaagggaaatgaaaatgcatgtccacaaaaaaactgtacacaaatgttcataacagcattattcacagtagacaaaagtgggagaaaacaaaatgtccatcaatttgatgaatagacaacaaaaatgtggtctctccatacaataaaatattattgcatcatgagaaggaaggaagttctgatacacgctacaaaccaggaaccttggaagtatcatactaagcgaaagaagccagacacaaaagaacacatattgtgtgactccagttgtatgaaatgtccagaacaggtaaatccatagagacagaaagtagatttgtggctgccaggggctgggagatggaagaaaggggagtgactgttaatgggtgcagagttttatggggagatgatgacaatgttttggaattagatagtactgatggttgaacaattctgtgaatatactaaaagctactgaatatatactctaaaaggctgagcatgcagtctttatggtatgcgaattatatctcaataaatttggaagctcagagaatgtgcaggacattgttttgctgacagagcatcattttctctgacatctcgaggcaggattcacacttttactggtggaatttcatttactctgtggacccaagcccaggcaatcaaagcattaaatcttcctagcaggaagaatggtctagacctggacataactcaggtcagtccaaatgagcctttgttttgggtcatctgtttgtatagttggtgaaagaaatgctgtttccgctggggatgccacaaaaaggatgttgttagactgcttctagcactatctaatcaccatgagagaagagttggcctaagaatggagctaacccaaaagaaagcaaggatgtaagaaggagaaagtaacacggagtcccattgacatcatttgaaccctggatccagccatgcctgaaaccctagacttttaggtccaacagatgataacatttctttttccttaccctagagatgcacttctgtcatttgcaagcaaaagtccaatctagactatttcatttaaatgtttttgaagcatattgtcagactcccagaacagttaaaccaactcatacttccaccagagcatgcatgtccccacagttgaagcagacattgagtcctgtagctctattataggttccaaacagacttccacaaagggtcctccatctcagaatcctcaatttgttttgttttgttttgagatagggtcacctctgtcacccaggctggagtgcagtggcacgatcatagctcactacaacctcaagctcctaggctcaagtgatcctcctacctcaggctcctgagtagctgagcccacaggcatgaattgccacacctggctatttttgtactttttgtagaggtggagtctcaccatgttgcccatggctggtctcaatcctcaattttagaactggacaagagtgcaaggaatcatgtatatgatggttaatttcacttgtcaacttgactgaatcaaggtgccgaaatgtctggacacagcttactctggtgtgtctgtgagggcatttctggacaagaggaacacctgagtcagtggactctggaaagcagactgtcctcctaatgtgggtggacctcatccaatcagtgggaggcctaaatagaacaaaagggagaattctctctccccacctgtctttgaggtgggacattggtcttctctcgcacttggactgtaacttacatcatctgctctcctggttttcgagcctttagactggaacaggaactacaccacctgctttcctggctctccagcttgcagagggcagatcctggaacttctcagcctctgtaatcatgtgagccaattccttacagtcaatctctctctctctctctttttttttttttttttgagacagagtcttgctctgtcgcccagactggcgtacagtggtaccgtcacatgggctcactacggcctcatccttgtgagctcaagtgatcctcccacctcggccttccgagtagctgggactataggcgtgcaccaccacacctggctaatttttaaacatttttttttgtaaagatggaggactcactgtgttgcctaggctggtctcaaactcctgggctcaagcaatcctcctttccttggtctcccaatgtgctgggattataggcatgacccccgcctttctatacatttatctcctaatggttctgtttctctggagaaccctgactaatataatgtgataacttgaacacagagaagaccttgtgcataaagatgttcattaatatttataagagcaaacaatttgaaataatttatatgcatgaaacttgtacagaacagaatatggtacaattgcttaaaataatgtttatgagggttttttcattttaatcaaatggaaaaattattgcacttgtgccatagaaaggccagaatacaaaaatcagatatcctgtaataataataataacactttcattttcctgagcaggaacgaagtgccagacactgccttgggtatattatgtgcatcattgaactaaatgacattctcagcattacattcaaaatatcaagaagaaagatttggaaattataccaaaaagccaacagtgtttgtcttttaaaataaatcggtttttttcccttctttccaccttgttttaccctctttaccacactgagtgtgtattgcttctatatttggaaagaattaaaacaaactgaattttttaaagtaagatggagcctcagtcccatgcctcaacccttcctccaatttgtacaagatcatggtactcatggtggcagccgatgacaggtggtagcatgcccctccccttctcccaggaggctgtcatccctagaatcttcccatgaagttaaatttaaaattattgtataactaatgtatcagtagtgctaccagcagcaacatgatcttatatgcaaatcggttttatttaatcacagcacaagcccagcatagtaattacctatcaagtggtaattacgcttttattatttttttaaactttcattaaaagaaagcattttaaattggaaagaaacaatccatgtcacaagccagttagtcaaaaaatgtttgtctgtttggaggtcccagaatgaacatcgtaatatccacccctgattaaacacttaccatgtagcaggcatctcgaaaagcacttcgcatttcatatctcaatatgtattcctcgctactgtgctgggaggtgcgtcttgttatcacaaaattactgataaagaaacagagactcagagaaatttcaatagcttgtcaagcttaatagaatttaaggcgaggagcatttaacacagaagccaggggaggtcggcagcagtgactcatgcctgcaatcacagcaccttgggaggctgaggcaggaggatcgcttgagcccaggagttcaacaccagcctgggcaacataatgacaccttatctccaataaataaataaataaataaaatattagctggttgtggtggcatatgcctgtagtctcagctatggggaggaggctgaggtgggaggattgcttgaccccaggaggtcaaggctgcagtgagctacgatcacaccactgcactccagccagggggacacatgagaccctgtctcaaaattatagatagatagatagatagatagatagatagatagatagatagatagataatcaatctgactttgtgatgaagcgatgcaatataggatgtataaaagggaagaatgatctgatagtcatccgtggggtgcctcagaggctctttgacttgcgtatttaaagttcctaaaggaagccaggggattttacccactgtgctgctttgcctggaggggtgtggacttcacctccctgctatgctttccacaaaggcatgcagatgcaaatgaaggaggagagaaaggcatgcccgcagtgcccgcagaagagcagtccttcccctggctgggggtcatttgcgtgtctctctgtctcctatcaggctgagagcagtgagagatgaggttctccgtggagttaggcactcctcctagactgcccctttctacccaatccaacaaatcagaaatataccactgggataacatttcctgtctctcaccattcatatcatttggcagattccgtgaccttaatatctttccatgccttctactgttactgatctccactgcagcatcctgttctggatggcttcattgggaagtctatgtattttctctagcttcaggcatagctgtatccaggagttcacaaagtatctccagcctggattcaggatttcaggtacaggctcttaactagctacgaaccttcccatctttttgtgcttctctaacctcaccatcttcccacccttagttccgtctggtttacatcccaacggatgtaaacagagaggtctttctaaaatgaaaatctgatcaccattcctgtgccaaagccatcagtggaaagatgacagttgaacttcctgccttggcatgatctgccatcagcctagctcctcaatctcactatcctccatttcccccatgtgccatataaagaaaatttataccaaacttgggatactgaatgccctttagatgtcataccaaattattgcattgtcttcaagtcagcccaacagtcatctgactctcaaaggcagagcttctccaacttgagtgcacgtcaggatccctggaggacgtgctaaacccggagtactggcctgctcctggtgtatccgattcagtgggcctgaagtcagccccagtatttacctttctcatagcccttgggggctaacgctgccggtccagggaccacactttaagaaccacagctctgagatcttctggggcaagggttagaaagcttcctgaaaagggtcagatggtcaagattttagacttcgtgggcaagacggtttctgttgcagtgactcaactctgctatggtagtgaaaaagcagctatgggcaatatataaacagatgggtatgcctgtgttctaaccttatttataataacaggtagagggccagatttggcccacaggccatagtactttgctgctctagagaaatgtaattttttttgagacagagtcttgctctgttgcctagtctggagtacagtggcgcgatctcggctcactgcagcctctgcctcctgggttcaaacgactttcctgcctcagcctccctagtagctgagattacagggacccactaccacgcccggctaatttttgtactcttagtagaggtggggttttgccatattggccaggctggtctcaaactcctaacctcaggtgatctgcccactttggcctcccaaagtgctgggatcacaggcatgaggcatcatgcccagccaagaaatgtaattttttaaacttactatttacttttaggacctagactctgcaaagttagatgttagctcatagaatattttttgttccatacagatggaaagtatttccatctgaaagaaaagataatttccaatgttgtcattttattgccttgtagggcgttaaccttcttgtgttatacttcacaattttattccagcattctttctttcattaactgtacagaccacctctgacttacaacagtttgacttaacaaatttttgaatttacgatagatttattggggcattaaattcatttttgacttaagatattttcaacttaccattggctttttggaacataaccctattgtaagtcaaggagcatgtgtgtatacttcagtctcttgtatcttcctttggagcaacttgactgccctggtggggctctcattaatgaggtaagtgaatctctgtcatgcgttcactacatattggcatgaaattttttttttttgagtcagggtctcactctgttgcccaggctggagtgcgatggtgtgatcatggctcactgtagcctcaaccttccaggctcaagggatcctcctacctcagccgccccagtagctgggaccacaggtgcataccaccatacccagctaacttttaaattttttgtagagaaaaggttttgctatgttgctcagtctggtcttgaactcctgggctcaagcaattctcctacctcggcttctcaaaatgctgggattacaagcgtgagccacagtgacctggcaacaaccaccatttattatctgtcacaatattgtgggttggctaggctcaactgggcagttcttttctctggagacagctggggttgccatcatctggggtcgtgaccaggctaagcaccttagttctcctctacatggcctctccatgcagctgagggctgggttccacgagggaacatcctgagcacacaagacaaaggcccagccctggagttgacacagcatcacctccactgcacgctattggtcaaagcaagtcacagggctggctcagcttctaggggacagaaaatagactccacctctcaatgccaagagtgtcagagaacaggcagccacttctaatctctcagagacagatcagggctgttaaactcaggaagaaatcttcaaggtgaccttgagtggattgggatcataatcccaaaagacacaatccagaatgccataatcccaaatgttgaaatcccagaagatcaaaatcttgaaaatatcattctgaaaaaaatcataaaacattaggccaggcgcggtggctcctgactgtaatcccagcactttgggaggccgaggttggcagatcacctgaggtcaggagttcgagaccagcctgaccaatatgatgaaaccccgtcgctactaaaaatacaaaaaattaggccgggcatggtcgcaggtgcctgtaatttcagctactagggaggctgaggtgggagaataacttgaacccgggaggcagaggttgcagtgtggcgagattgcaccactgcacttcagcctgggtgacagagagagactctgtctacaaaaaaaaaaaaaaaaaaaaaaaaaaaaaaaaaaattgtaggatatcacacttactaggatgttgctagaatccaggaaagattcaaggtgtctgtcactagctgggtaatctcttcaatctggaaaacctagtttgtcatggggtggggaaagggaatctctactcaggagaaaacataaagatggtttttgagggtatgaagcccattcgcctccttgtccagagactttagctaccattcagatgttctctggggcctcagctcatgattaattcatcaagtattggttgagctctcgtcacatgtcagggatcatgccttgtgttgaggcttacaatggaaagcaagaactacaagagcaagatcatgatcgttagagcagaaccaggaaaccctgtggctttgactcaccagcatgcaacgggaccaaaaaaaaaaaaaaaattcatctcctgtccaatttcatcagcattaagtggcctcctttctgaagagggacagctgttgggaaacccttgcggggtaagatgtaaaatgctcaccatccaccaagtcattgcttatttacttacttaatataataaaatcggggaaagatctgttaagaaataaacacttcacggcagtgctgtcaatgatggtgagatgctggaaacaagctacctgtctaacagtatgtgctgagagcaagcgtgtatatatgtgcattgatatggtttagctgtgtccccacccaaatctcatcttgaattgtagctcccataatccgcatgtgtcgtgggagggatgcagtgggaggtgattgaatcatgggggtaggtttttcctgtgctgttctcatcacagtgaataagtttcctgagatctgatggttttataaggggcagttcccctgcacatgctctcttgcctgccaccatgtaagatgtgcctttgcttctccttcaccttccgccatgcttatgaggcctccccagccatgtggaactgtgagtccattaaacctgttttttttttcttccttccttcctttcttttttttgagatggcatctcactctgttgccaaggctggagtgcagtggcacgatcttggcttactgcaacctctgcctcccgggttcaagcgattctcctgcctcagtctcccgagtagctgggattacaggtgtgtgccaccatgatgcctggctaatttttgtgtttttagtagagacagagtttcgccattttggccaggctggtctcgaactcctgacctcaggtgatcctcccacctcagcctcccaaagtgctgggattagaggcatgagccatcacacccagtctaaacttctttttcttaataaagtacccagtcttaggtatttcttcatagcagtacgaaaatggactaaaacatgcatacagaatctgaatacgtccacatttatatacatactgtgtacattcttagttgaccggcggagattctagtaacatcctactaagtgcaatatcctactgtttcgcccttatccctcccaggctactcttcacacggcagccagagagatcttgttcaaacctacgtctgctcctgtccctcctcattccttagtttacaggctaatccatgttccccccatgtgccttccctccctcctagggcaggttgctgagctgagtttgatgttggtgtttaaggataaacaggtttcagataacacgtctgcacagagggagccataattcagggctcagacggaccacctgaagtctgattcagctctggaggaaaaattgtctgtgctggttttatggcgtgacgtagagacagagccaaacaggaaagaaggcacgtgacaatggagacagatggaagcagtgactcgacaacacaggaattttgttcaacttaccctcacatctttggcatctaatatttccatacagtaggagctcaccacactttttaatttttatttatttatttttatgagatggcctctcgccccgttacccagactggagtgtagtggtgtgatctcagctcactgcaacctccacctcctgggttcaagtgattctcatgcctcagactcctgagtagctgggattacaggcatgcaccaccatacccagctaattttttgtatttttagtagagacagggtttcaccatgttggtcaggctggtcttgaactcctgatctcaagtgatctgcccacttcagcctcccaaagtgctgggattacaggcatgagtccccactcctggcccgttcaccacgcttttgtcaaataaataaatacaggagaaaatgaatgagtgatgcatataaagggtttaatctgagtgcttgacacacggtgctcagtaaatggttcacaatattatgtgaccagaccactgcccaattctccagcgccatctctgccaagactccctcactctcccaggaaactcagctgcgaatccaccctggcaccttggaagtgctgggtgaactatcccggtttttcctggatcacccttctctccattcctcctggatcacccttctctccattcctctatgccacaccctttgaagggacccttggtatcagcttcctggggtagctttgctgatgcttctccatgtacctcagtttaccctaccatagctgatgcacaccgtctcatttaatcctgacagtgacctgtgtgaaaggcatcattacccccatattacaaatgaagtaaaaggtttccaggagcagccttgcccacagcttcctgccgctaagcgggagagctgggaactgagcttggaccctcggactccacagtctattttgtagattcccatcacattcatgttaacaacaagctttaaaaaatcaaacaatcagtgtttgtgctagaatgctggggtcacagattatttttttcttcaaaattgtataattctgttaaaataatcaatcttgcctttagagtagaaaaatatactttttttgtaggctaaagaagattgaaagaatgcttttgttctctgggtggtctggcaaagaagaaaaaacctacatcacaggaaaattgatgaaacagaagaaattcttggatgagtgggaaaaggaagggtttgtaagggtgactggagcaagaaaaatgaaggagcattaaataataatgtcacccacttcaactcattgataatatgaacacattgcagccaatgtatcatttcacatgactgaagttgccaccaccttcatcatctccgttgatctcagtgtctactcaacgaagcatgcaggacaaacagggctttcttccttatgtaggaaccaagttacagaaaattagtgatttctccaaggtcttaagagtgacttggggggctgaattaagactggtacccaggccaggcatagtgactcatgcctgtaatcccagcactttgggaggcctaggtaggtggatcacttgagcccaggagttcaagaccagcggggcaacatagggagaccctgtctccacaaaaagtaaacaaaattaactgggtgtggttctgtgtacctgtagtctcagttgctctggaggttgaggcacgagaattgcttgagcccaggaggcggagattgcagtgagctgagatggcgccactgcactccagcctgggtgacagagtgagaccctatctaaaaaaacaaaaaggaagaatggatcaataatgtgtcttttatttttttcttattgcctttctttagcagttttttctcctggccaaagtctttgaagatgatggtgcctaaatttggcccactgtctggggaggggcagagacacgggaaatgagtataatgtttaagtgaggaactgcattatatagatcctcacttaagaagagacgtcagctatgtgagttctgccaccaaaaataaaagagtaaaagaattagaagaaaaaaaaagtgggtgttctagtccattcaacatgctatcaacgagcaaagagatccgagtgaggctcagatgagaggcagagctctgtgctccctccacgggtcctccctccctcctagggcagattgctgagctgactttgatgttggtgtttaatgataaacagatttcagataacacggcccgcagagcaagctgtaattcagggctccaatggaccacctgaaatttgatccagctttggaggaaaaattgtctgtgttggttttattacatgacagagacagagccaaacagaaaagaaggcaggtgatgactgaggcagagactggagccatgatgctaccagctgaggatcaccaagggtggccggctgcaccagaagctgggagacgggcctgcagcagcgtcctccttggagcctccggagggagcatggccgtgccaacacctgggttttggactctgacctccagagctgtgagaatacatttgtgttgctttaagccttccagtttgtggttgttacagcagccacaggaaacagcgactaggttggttgttttctgggacatacgggacttctcttacgtgcagttgtgtcccaaggactcctgatgaccttgctgaaacttttagaaaactgccctacaggccgggcgcggtggctcacgcctgtaatcccagcactttgggaggccaaggcgggtggatcatgaggtcaggagatcgagaccatcctggctaacacggcgaaaccccgtctctactaaaaatgcaaaaaattagccaggcatggtggcgggcacctgtagtcccagctacttgggaggctgagccaggagaatggcgcgaacctgggaggcggagcttgcagtgagcagagagtgccactgcactccagcctgggcgacagagagagactccgcctcaaaaaaaaaaaaaaagaaaaagaaaaaaaagaagaaaactgccctacagtgaaaccctcttcctcccagccctctgccttcctgctctcctctgcaggggccagccccacactctgccggccaatctcccatctctgcccacccttcctctttccctcctgggccttttccttctccacctcttggtccctgtttctcagaggaccgggactaacaaagacatccatatatcaggttcaacagctaccaagattttgcaacgtttgcttcgtcacttcctttttccttcctgttttgtcctcagatactttaaagcaaatcccatacctcacgtcatttcattccctacatatttcagagcccacttcttaaaaccaggagtattttcttatataaaccacaatgtcatgaccatacctaacacatgtattggtaaatagtttcttggtattttccaggcctcacctacattctctaaattatctcaaaaatgtcttttcatagtacttgatttgactcagttttgaactctgcatttggccaatcttttttatcccaatctgccccacttataagtgacatgatgttaggcaagtcacttgacttttttccatttcccccaccttaaaacggggaaaccaataggatctgccttactgggttttccaagaattaaatgaggtcattccttccttcattcattcaacaaatgttttgtaagcagctgcccaaaatgcctggaactgttctaggtcctgcaaaaatatcagaacacaagaccaagtacctggcttcatggagcttatattttttattattattattattattttgagacagttgctctgttacccatactggagtggagtggtatgatctcggctcactgcaacctccaccccccaggttcaagcaatcctcctgcctcagcctcctgagtagctgggattacaggtacctgccaccatgtccagtggatttttgtattttttagtagagacggacggtgttttgccatgttagccaggctagtcttgaactcctgggcttaagtgatccacctgccttagcctcccaaagtactgggattacaggcatgagccactgcgccaggcctgattctagtggaagaaaaagacaataaacacacaaaattaatatgccatagaatgtcagctagtttccccaaatgtcagctacaagtttccccaaattctaatttttgtttgaaagaaagtttgtgagtgctgtgggaaattaacctggatagcaggagggcacagggtggggcacccattatgggcaaaggagtgaggagggtcctttaggaagagacgaccattaacagaaacctgagtgaatgaagggttgagcctccctggggaaagttccaggcagacagagggcacatttaaagtgggcacttgctggcacgggagagctggagttctcaaacttcttggtcgctgatctcttcacattcttaaaaattattgttggctgacctcctgttggcaaagctaaagaattaaatgagaaaaaaaaaaaaaaaaaaagagccagtgcggtggctcacgcctgtaattccagcactttgggaggccgaggtgggaggatcacgaggtcaggagttcgagaccagcctgaccaacatggtgaaaccctatctctactaaaaatacaaaaactagccgggcgtggtggctcacgcacctgtaatcccagctattcaggaggccgaggcaggagaatcgcttgaacacaggagacagaggttgtatctgttgtggtttaccatattagaagtaaaaactaaaacattacaaaataataacaatttatttaaaatataatactttcattaaatgttaacataaataacatcattttagtgaaaaacaactatactccaaaacaaaacattttggtgagaggagtggcattattttgtatttttacaaatttttaaaaagtctgggccaggagcagtggctcacacctgtaatcccagcactgtgggagactgaggagaaaggattgcttgagctcaggagtttgagaccagcctcggattacaagcattagccattgtgtctggccccactgtcctatcttgtactttgaatggatcttttactcatgtgcaattttataacatcagtcatttggaaaacattgattcgctgagttatgcagatcttccaaatgttgacgcattctattctattttttttttttaattacagacataaagatggcaacaatagacactagcgactactagagggggaagggagggaggggggcaagcgttgaacaactaacagtgggtactatgctcagtacctggggggcgagatcattcctaccccaaatctcagcatcatgcagtatacccaggtaacaaacctgcacatgtacctcctgaatctaaaagttgaaaaaaagttacatttattactatcaccaccaatcttatcagaaaagtctttaagaattgggtagctgtccatctcacaatggtggatacaagtgtctccaaattctaatttttgtttgaaagaaagcttgaattttataattggcaataaatgctgtcaaatgcactgagcccttcctgtgcaaacctcactttcccttctaagaactctgggagtaataatgacaattttcaccatttattaagcccttgctgtatgccggacattttgctaagcaatttgcctctgttatcttattctccttttcacgatatccctgggaggtattatttctcccattttgcagatgaggaaactgaggtccagagacactagttacttgcttaaggccacacagttagtggcactcctatatactttcagagttccagaaaagaactcttgggaaacacctactcatcaagatctagctcaaatgttacctccttggggaagccttatgcccaaactggacaatgagaaaactcacttaccatttgttgaatggtagtttaaaagcaccaggcaccgggcatggtggctcatgcctgtaatctcagcattttgggatgccgaggcgggtggatcacctgaggtcaggagtttgagaccagcctggccaacagagtgaaacgctgtctctactaaaaatacaaaaattagctgggcatggtggtgcatgcctgcaatctcggctacttgggaggctgaggcagaagaatcgtttgaaccctggaggcggaggttgcagcgagctgagatcatgccactgtactccagcctgggcgacaaagtgaaattccgtctcaaaaaaataaaaaaataaaagcaccaggcagcacactccatgtgctagctccattacttcatctcctcctagcaacaggcttatagaacaggtagtgttgcttcccctgtcatagtttcctattgttgctggaacaaaatttaccggcttaaatcaacacaagttttttgttttaaagttctgtagctcagaagactcacggggctaaatcaagctgtaagcaaggctatgttccttctggcagcactagcagaaaatgtttgcccttttccagctcctagaggccacccacattccttggctcgtggcaccagcagcgcagcatcttcaaatctctccctctctctttctgcttctattttcacatctccttgtgacctgactctcttgcccctccttctttccctcataaggacccttgtgattacttgggacccaccagtcatgtcataattaggttatttcccaggataatccatctcaaagcctttaacattaccacatttgcaatgttccttttaccatgtaaagtaatatatccacaggttctgaggttggggcatggacatctttgaggggaggggcattattctgcccatcacaccaccttctacaaaagattcacagaaaatgtaggtaacttgcccaggttcacacagctagtgagtgggggattccagatttgaacttgggcctgtcttgactccaggcctaggccactgtccccagactcatgggagataccaggtgtattagtcggttgtcatgctgctaataaagacatacatacccaagctaggtaatttataaagcaaagaggtttaattgactcacagttccacatggcaagggaggcctcacaatcatggcggaaggcaaatgaggagcaaagtcacgcttaacatggcggcaggcaagagagcttgtgcaggggaactctcatttgtaaaaccattagaggctgggcgtggtggctcacgcctgtattcccagcactttgggaggctgacgtgggcagatcacttgaggtcaggagttcaagaccagcctggccatcatggtgaaaccccatctctactaaaaatacgaaaattagccgggcgtggtgtcacatgcctgtagtcccagctactccagaagctgaggcaggagaatcacttgaacccagaaggcggaggttacggtgagctgagatcctgccactgcactccagcctgggcgacagagcaagactgtctcaaaaacaaaaacaaaaacaaaaacaaaaaaacaaccaaacaaaccaaaaaaaccacacacacacacacacacacacacacacacacaaacattagatcttgtgagacttactcactaccatgagaacagtatggggaaaaccacgccaatgattcaattatcaccacgtggccccactcttgacacgtggggattattacaatccaagatgagatttgggtggggacacagccgaagtatatcaccaggctctgctaagcactgaaggccatagtgcttgttcatagcttccttttaacatctatttccttgtactgaaggtatgtgttcatatctatgtgaattatttgaaaatgaagactgggatcttttttatttatttatttatatatttatttatttgtgagacaaagtctcacttttgtcccccaggctggagtgagatggtgtgatctcagctcactgcaacctccgcctcccgggttcaagcaattttcctgcctaggccccccaggtagctgggattacaggtgcccgccaccatgcccagctaatttttgtatttttagtagagacggggtttcaccatgttggccaggctagtctcgaacttttgacctcaggtgatccacccgcctcagcctcccaaagtgctgggattacaggcgtgagccaccgtgcctggcctgggatcttttgtttattatcacttttatttgttgttcaagcaactgtatgataaaaatcagacaaacaactatatatatatatatatatatatatatatatatatatatatatatatgtttttttttttttttttttttgagacagagtttcactcttgttgtccaggctggagtgcaatggtgccatctcggctcactgcaacctctgcctcccgggttcaagcgattcttctgcctcagcctcctgagtagctgggattacaggcgcctgccaccacgcccgactaatttttgtatttttagtagagacggggcttcaccatgttgatcaggctggtcttgaactcccgacctcaggtgatccacccacctcagccttccaaagtgctgagattacaggtgtgagccaccgcaccgagccagagagacaaccataaatcactagtgagttttcacgtcccccagtttctatccaagtgcagatatcgcttttccatggttaaaattatagcacagacactatattgtattgttttccccaattttttgttataaaaattttcaaacatagagaaaagctgaaatatatagcactacttagagccaacaatagtaaacattttgccatatttgctgtctctccctgaatgtttatgtgtgtacatgattttatcttttgttgaaccattaaacaatagtttacaggcattatggccttcactcctcaactcttcagaatgcatctcctcacaataaggacattctctcagtgagcacagtataattattacactataaaattaccaataattcacgaagatcacccatatccaatccatattcaaatgtctccaattgtcaacaaatagtaaaaccagcttaaaagacatatcaggatccaagcaagatgacacattgtatttggttatgttttctagctcttctattttggaacaacccctccctaccacttatatttttcttttcttttctttctttctttctttctttttttttttttgagacagagactcgctctgtcacccaggctggagtgcagtggcacgatctcggctcaccgcaacctccgtctccggggttcaagtgatcctcccacctcagcctcctgagtagctgggacgcctggtgtgccacactacatcccaccaatttttgtatttttagtagagttggggtttcatcatattagccaggctggtctccaactcctgacttcaagtgatccgcccgcctcggcctcccaatgtgtgggattccgggtgtgagccgctgcgcctggcccacttatatttttcatggcatcccatttatgaagagaccaggctccctattttatgtaacgtgggaatggatcttcctgttcatctcctctgctcagtgtacggtctagcaagagcagactctctgtaggtgtttgttgaataaatgaaaccaatagtaatggttattaataacaatcccagtagccaatttttattgactattctcttggccagtgtgctcacgttaatctaatttgaacctcacagaaatcttacgcgttatgacatatttgtcttattcacaggtgaggaaaccaaggcttagggaaggaaagtcgcttgtctgaaatcacagctagaaaaggggccaaaacccaagggtggacccactggctggaaaacagtgcagttaggcaggggcccctgtttcttaataatgaatgaaccaacgacccccaaggctggtttgcccgtgcacacgcacgcacgtgtgcaacacgtagcacttgctgagtgtttgctacttgccaggcctcatgtcaagcactttacgcgtgcttttatgccctacgttttgtttttgtctgttttgcttttttcccctaatgcctagccaaaggcgtggcccaggcgcccaggcaggacttggggagtgaatgaagagtgaacaaatgaatgaatgcgcggcaacgggatcttcataaaccagaccctcctcggggatctaatgcgaacactcccgaggcccgggcccaggtacgctgagggcggctcgtgggccccaggccgacctcagcccgcgactcccgggctccgggggcccaggtggcccccagtaggtgaggagccgggcccgccggcgccttggcgttgccacctctacctgcctgccctctccccttccggatccacagccaggcctcggcgggctcctggtgtgcagccgcccggccgcttccgcccgagggtcgcggggctcagagtccggcaggctccaggcggggcaggggatgtccgcggcccggcaggcgcacgcccacctgtcggccgcgcaggcgcagcagcgggccggcctccccgcgccccgcggcgcgcggccagtgcgcaggcgcggcggccgatgcgagtgtgtatgtgcgggcgagaagatggcggcggcgggggaagcagcgtgagcagccggaggatcgcggagtcccaatgaaacgggcagccatggccctccacagcccgcaggtagccgccggtctgcgccttcggccggaaggggcccgagccccgggcgggcggacgccgcggcgggcgggcgtccgcgccctgcccggagcgagcgtgtgggagtgggggagggcgctgggacacgctgcccgggcctaggccggagccacccgccgcctccgcgcccgccgcgccttcgtcccctgagccacccggaccccctagtcccggggaggtcgaagggcgggggctccgggccccgcttggggagggcgtggagggcgccgaaggggttaacctccctggggctggaccgcggggcgagcccggggtgtggagtggggccctccccgccgcgccggccgggggaggcggcccgggggctccgggagtcccctggagcgcaggggccccagagcagctcaggttgctgcctctgcctggagcgagcctcagagatttgggggtgccctgttgcccctttgccccaagagcttcctttctcagcttgattgatgatgcgggggttgccgattttctgttttttagatagaagtagcagagtagcggccttgggctgctgttgcaaagaaaactcgaaataagtcgcaaggaccgtactttcacttgcgtttgagtgacatcccttgcacgaatccatcccagccaggctgacaactaacgcaccctgcctgaacagtagctaaagcttgggggccctttacaataatcccgtggtggaaagaaagagctctttttgggagatgtgcgtgtagagttaagctcttattcccctctcccaccccttctctcacatcttctcccccctccgccattataattattctggacaaaaatcggcatgatgtattatttgtcagccttgctttagactgctaatttgttgacatctggtccctataaattgttgcacacttttaaaccatctcattgtgtatttgtattaaatatggggaaatgaaacaaagtagccattcgggaaactgattgcgagtaaaatcataacccttcatgagcaattgggttttgttgcccttctgcagatgaagtcaatctgactacacctcttttgaaacatgattttcggaactattgtaatgaatgcgtgttgtggaatctaaaatgcgaaaactttttaaaaaattagatcttacgacaagcttcaattttgttaaattagctgtagtttagtttgcatcagaatttccccctttaacgttttgttcccttattcatttacttttgtaagtagtgtaggtctttgcgccaaaaaagggatcagtagttgaataatttttacaaatgtatagcccaaagattttaagagatttggtgtatttagctttgtttagacctttctgttaaaaaaaaagatttgatatttgcttttttctcaacttaaatcctaattaactagcttattagaattggtatgaacaagtaaaaggctcattatgaattaatgtgtaatattccttgtgattttgacatgaagaaagcatctttaggcatagctcacttcctttatttaataagcatcaatcacaattcaaggttgattgaaatgttaattaatggggatggataatatgtaaacttaattgtaatttcgtttgcattcattgtcccagtatttacgttttatacaacagtctaaagcgttatacacatctttagaaaattggagtagcaaaagttggcggaacgtaaatgttagcaacactttgggtttattcttttaaagtatgatttaaatgcttttaagttttagcatggagaaagtagcaaaggaaatagtttgatttctcataattttcttcttctttttttttttttttttgagttggaatttggctcttgttgcccaggctggagtgctgtggttattaacctataaacttttttatttattttgagatggagtttcgctcttttttttttttttttttttttttttttgagacgggagtcttgctctgtcgcccaggctggagtgcagtggcatgatctcggcccactgcaacctctgcctcccgggttcaagcgattctcctgcctcagcctcccaagtagctgggattacaggcgcccaccaccatgcctggctaattttttgtatttttattaaagacgggtttcaccatgttgatcaggctggtctcaaactcctgagctcaggtgatccacccgcctcggcctctcaaagtgctgggattataggcgtgagccactactgcgcctggccgatttctcataattttcattttaaaagaatagtaatgcaaacaagtaatggaatcatgtatgacaggatttagttactggttcctgctccagtcattctgagcgttttaataaatttgttttacttggttgcctactgtcctaagagtcttgcagccttaatggccattcattcattcagcaaatactgattgtttatcagatattaagcgtcatggtatgtatattacttgtttatgttgggaataacaactgcaaattgaaggtcttattttaaaattgacttgttaaagttaaatttgtcactgagaataatgggaggtggaaaaagttacagtttaaaaatgtttacaggccagcgcggtggctcgtgcctgtaatcccagcactttgggaggcgcaggtgggtggatcacttgaggtcaggggttcgagatcagcctgaccaatatagtgagaccctgtctctactaaaaatacaaaaattagccgagtgtggtgaagctcgcctgtagtcccaggtacttgggaggctgaggcaggagaatcgcttgaacccgggaggcggaggttgcagtgagccgagatcatgccactgcactccagcctgggcgacagagcaagactcccgtctcaaaaaaaaaaaaaaaaaaaagagcgaaactccatctcaaaataaataaaaaagtttataggttaataaccttatttccaaatattagaaagtgttggttgatccctgttacctgtattgaagtgtaatagtgaagaatttggaaacattttgagaccggtaactcagcattttagcaaagacaaataaatgaactttaacagttgaagtgtaggtccaagtgaatatccttgtcactgaggggaccggttaaattatttggggtaattaatttgaagctattagttttgccttacaccgaaaaaatatttgtgattattgatgtcatttatagtgaaatctccacaataatgcttcctacacccaatttgaatgtcatgcagttggcttctgtccttgtctctgcatagactcaccccagtctcttttttagcttgtaatagcagatcctccacattttacatgatggaaagtcttggattccccctctagcatatggctgaatgttactgtattgctgaatatctgtttctagccaacagctggattagtgttaattcttaaaagagatacatttttattagaatctcaagtaatgagcagctgaagtaaatacaattgtttgaaatgttgacagggcatttggagataacagttttcctttgcatagtgacagcaagctatttaaacatgtcctaagagtagatgttttaagtttgtgagccagtggtcaccttagtggtttgtacagatggcctgagaagtttgtgagccagtggtcgccttagtggtttgtacagatggcctgagcagccgcgccgtaccaggacctcaccatcatgctcttgagcccatctcattgagagcacagcgcactgaaattccagtgaatactaagcgggcctaccacattctaaattcctcactaaagcaaaagttaggacatgtattccagtgttctgttacgtggaactgataggatttaagcagtgattcacataggaaaacttaaaggagaaaaggattacgaagcttaatgattgctgtttaatgccaagcctaagcggcacgttgcactgtgctgtgctcagaatataacattcaagtaattgagaaaagtggtatcatctccaattgaattagttacatcagggtttttgtttcggttttttgtttgtttgtttgtttttaaagatataatttcagacatgtaggtacttcctgttaatggttcctggtattcaggtggcacattaaacgtggttgctgaggacacttattactggtactataccaaaatatgaaacgtagtgggaagagcttgcttttgaatttgtaattaggctgttacttttctatttactgccacacatgcaagaatcaccatcgcacaaaacagataaatctgtttgcaatggaatttgctggccttgggccattggattactgtcatttgtcactttagtgccacttcagcagtgtagatgttcatttccagagacttgtatgtgcttggactgcagttttcctgtttattgaagtgttctcccaaaaggtctttctttgaccatttctgtcaatacaggctggatgaagaattagtgtaggaaaataaaggtagcccttggggtatgtgtatagtatttgtttcaaggatcagaaaatgtagaatttatcataaacctcgatgtagaatcttcagatcctagattttttctgaactggctattttctggctatttgaaagctcctgggccatgatcccattttcatcagatgacttgagaacccagaagctctaccagcactgccattctgtcccgtcttgaaacatcatgccctggttgccctctcctggaatagggcaggtaaggtgttgagatagaaatgtggtttggggctgttacagcctgaattcctcgactttcccttttgggctcacatgagaattgttaggagaatgtgcatgtggagtgcgggcccagcacctgctaccgtctgcgctgtaatggtggctgctcctaagagtcctcagtctcctccccgttgggcttgtgtgtacagccttatcggttgtcattcttcggatccattctcagtttatttttctggtattagctggagggacatctccttaagcctgtactctatggctcaggagtctcaaaaccagtccattttgaagtgagagtatccctaataaaaaggtgagtgtccccactcctgtgccttgttttttttgtttgtttttttttttgagacggagtctcgctctgtcgcccaggctggagtgcattggcggtatcttgtctcactgcaacttctgcctcccgggttcaagtgattctcctgcctcagcctcctgagtagctgggactacaggcacccgccaccatgcccagctaattgtttgtatttttagtagagactgggtttcaccatgttagccaggatggtctccatctcctgacctcacgatccgcccacctcggcctcccaaagtgctgggattataggcgtgagccaccacacccagccactcctgtgccttttgaacctgatttttacatctagctgactcctccctccgtccctttccctctttctttcttcctgatctgatggtgctagatttttgttttcccatttgtctttgttttatgaagatgtgctcctttccatttgtgtatgttgagtacagacataatcatgcccttgcttgcttttttttttttttttttttttttgagacagtcttgctctgttgcccaggctggaatgcagtggtgcgatctgggttcactgcagcctctacctcccagattcaagcgattctcctgcctcagtctctcaagtagctgggattacaggtgcctgctaccacgcccagctaatttttttgtatttttagtagaaacggggtttcaccatgttagtcaggctggtgtggaactcctcacctcaggtgatccacctaccttggcctcccaaagtgctgggattacaggcatgagccactgcccccagcatccctactcattctttgaaaaaaacaatttgttgttgttttgtagagacagggatttgctgtgtttcccaggctggtcttgaactcctggcctcaagggatcccttctgcttcagcttcctaaagtactgggattacaggtgtgagccaccgcgcctagcctccctattcattctgcaagtatcagtctttttacttttgataggacatgttgaagttttggttaaaaatagaagaggatttgaaaatgaagttcaattctagaggttttcgagattcctgcccaatataaaaaacttctgatacattaaaacaatttttttatacttcattttttagagcagttttaggttcacagcaaaattgagagaaaagtacaaagagttcctatataccccttctcttggtattttaagtaataatttcccttacgtggctgcaaagactatatatatatttatatgtatttatttgtatatgtatttatatttatttatatttttatatttatatatatttttatatatatatattttttgagacgaagtcttcctctgtcacccaggctggagtgcagtggcgcaatctcggctcactgcaagctccgcctcccgggttcacgccattctcctgcctcagcctccggagtagctgggaatacaggtgtgcgccaccacgcccagctaattttttgtatttttagtagagacggggtttcacggtgttagccaggatggtctccatctcctgacctcgggatctgcccacctcggcctcccagagtgctgggattacaggcgtgagccaccgcgccgggccaagactatatatatatttattcaagacctgaagtaggctttctgggtagatctgatcattggagaaggagaaacatatttattacgagatactaagcattgtagtagtcatcatttgaagcctataaactctataaactgcatagtttagaaagtgccttagcttgtttgagcctttacagcaactctgtcctgtattattataaccattttacagatgagtaagataagacccagagaggttgtggcttgaggtcaaatggctgctggccatcaggaccttttaaaagcaggtgttttgacttctaaatcctttgctttttctactttgccagactggttttctggaagagactgatgaaggcataatctttcacactgtgacttccccttagtagttcctccataaacatttacagaatgaatgaatgaaatgtgcatttagaaactttaatgttactaattacaaaatttgttactataatatgttactattcactaaagtttgtgtggggtacattttaataaagtcgtttattttattttctagtataaagacatgctatttttaagacacgaaaacagcacagacgtatttaaagtgaaaagtagaagtcattcccttcctctctgatccttaatcgtcagtttggtgtgtgtcttctatgcttttttccactggagtattttgttgttgttgttccgttgtttcataatatggtctgttgtatctagtcactgaactttattgagcaaaccttgttttcaaaattattgaaaacatccactgaagtcagttttcttaggtttacctaattttgccagggaatgaagcagatattctggagattgaagtgacttatcaggatccagtgtgcaggggattgtggaagtgctgccacaacttataacatgttgtccaaacaatttttttttttcttaagaaatattttgggccaggtgcagtgagtgactcacgcctgtaatcccagcactttgggaggctgaggcaggcgaatcactcaagctcaggagtttgggaccagcctgggcaacgtagcaaaactctttctctacaaaaatacaaaaattcactgggcatggtggtgctctcctgtagtcccacctacttgggaggttgaggtgggaggatcgcttgaacctgggaggtggacattgtagtgagtcgagattgtgccactgcacttcagcttgggtgacagagcgagactcttacgtcaaaaaagaaaagataagaaatattttgaagacttccacccccttagtagtagtcatgctgtccggtgttcatagtgtaaaaagaggtctggctgggcgtggtggctcacgcgtgtaatcccagcactttgggaggtcgaggtgggtggatcacctgaggtcaggagtttgagaccatcctggccaacatggtaaaacctcatctctgctaaaaatacaaaaattagccgagtgtggtggcgggcacctttaatcccagctgctccgaaggctgaggcaggagaatagcttgaacccgtgggggcagaggttgctgtgagacaagatcacgccacttcactccagcctggacgaaagagtgaaactccatctcaaaaaacaaaaaaggaggtctgattcacattcagattcttgtccatccattgcctttgcactagatttatgagaggacaaactttttattagttggagattggtaagtcacctgccctagggaataatgagaaactgggtaattcacctgaatttttctccatcttcttcaaaatcatgtttttgtcttctgtcactttgtttcatcagagtactgcaatggcaaaaaacaaaacacttcccaactcaggtcccactcctgagagataaccacatttaagtacttctgacttgtaatagaatgcaaaatcggggcttccaagtgtggtttactattttgtttagaattaatttgtagaatactagacacttttttcagaaccacatatgaaggactttatatcttttgtgattgttcacagattttggtggccggacgttaggagtatagagctgaagagagaattcctgtgctttagaggttcgctgggtagtgagggagagaagcaggctaatggctgggtgcatccagttttagggtggtaattcctgtaacacaagtgtgaacaacatagtcaagaacattcattcattcgtttgttcattcattcagcaaatagttaccgagtggctgctgtgtaccaggcactgaggagggagtgatgagcgaaaacaggcattgtttctctcgcggaggagtttatgggtccattgaggaagacagcttgctaatcagataatcacagttacgtacacgtcactccaaactgagagatgtttcccaaaggaagggaacacaatctgaagtcagagaaccgttcccgtggaagtgacgtgtttacagcatgagacagtggggacagcatgtgtggtggacctttggctggagggaatttggagcactttggagaactcagcaaggagttgtgtgtcttgggcacagagctggaggggagggacagacgcaccatccaaccttgcagcctttgttagatgttactgtctttattctgagaaaagtgtggaagagggggtggtacaacatttgaccatggaacctcataatcacattgccttttgggatcatactctgcccagtgaagaatagactcacggggtcgcagtggccataaggagatcatttagggcagggtccttggacttttgactcggagggtgccgtggaggtggagagaagttgcgtgactcaggagttaggtataaggtgtttcaaaaaaggaggagagtgggactgaatgttgggcaaagctgggaagacgtctcttgtagaacggtgacatttgagctggagtttttcaggcagagaagcacacggacaagggcatgtggaggagactgtgcagaggaactgtctcaaagcctgcagcctgtttgggaaacagataaatttgtggctgaaatggtgtgtagggtgaagtggttagccgggagtctggagaggagagagaaagaatttggtaatccaagctcaggactgagtgaagttggtagcaactctgtgttaagatagctggttgaggccgggtgcgaggctcacgcctgtaatcccagcactttgggagaccgaagtagacggatcacttgaggtaaggagtttgagaccagtctggccaacatgctgaaaccccatctctactaaaaatacaaaaattagccgggcgtggtggcgcatgtctgtaatcccagctacttgagaggcttaggcaagagaatcgcttgaacccgggaggcagaggttgcagtgagccagactgtgccactgcactctagcctgggcaacagagcagactccatctcggaaaaaaaaaaaaaaaaaagattgctgggttgagttgattgtgcaggggtcttacttagatgcttcgaaagttgtcagggatttgattctttaggctctcctccatagctgggactctactctctgctcattttggcatcttaagcctcataactttgaggggaaagaagtagggcatttcttttggggacttttgagacagattaatgtgaggcaggtagcccttcagtgtcctcagtggtaattggatagagtagttagggaaggtcatttagggacatattccctttattttgagggggaggcacctttaaaaacaagcatctgtcccttgattatattcgtagaaaatattaaggaaaacttaggtgacttgttaccttattttaaatgtttcctgtagtacttttggtagtaaactttagaaatttggaatcattggatttaacagcgtttttaggtttgtgatcctcgagtgccctcttctaataccagaatcacctggcaccctgggtgccaccaagagacactgagtaaggatccctgtgagcaggtccccaggccgtctgagccaggctcaggttgcaggtcgtccgcatgggtttgtgtacagctttttttgttttaacttgttgagccctttcgcatgaatagcaataacgaaatcgtattttggacaaagtgttacatctccagtctaggttaggcgtgaacaacaacaaaaatatgaattgtgcccctccctctgagtgtgatactcacttattttagcgccgagtggaatggtggaacagttgtgagcagatgagaaacctgacattttgccactttgaagagctgtcatgtcgtgtcttcagaacgagatttcagtttggcttggcattcattaagtccatgattatgccttttaagcaagcatttacccagtacttgctctgtgccagggcccgtgttgggatttataagttgcaaaaaaacatgtttttaaaaatgtaagtacacatgtgttccccagaaccttaagagctgctctggctgttgctctgcaccccacatcttgaaataggacctttgtggacagcatgggatcagcacactcccccacagctcagtgtaactgtgagcatctgatgtcccagagaactggaactttataattcatcctgaagcctggttgtcaacatctctgaggatgtgtgcatagcattaagccaatttaccatcgggaattcctgctctcttttgctgttgttgctcatggattcgtcaggtgaggaaattctagtctctagtttttcccaaactggtgctgaaataattacgcttggttctctgttgcttcttacctctttgctcttctgtgccacaacaatgtattctaagttaggtgccagcagcagaaacttttcttccacctataactagagttttaggcgtgaggaagggctagcttttttttttttttttttttttgtctgagatggagtcttgttctgtcacccaggcagtggcaagatctcagctcactgcaacctctgcctccggggctcaagtgattctctggcctcagcctcctgagtagctgggattacaggtgcgtgccaccatggctggctaatttttgtatttttagcagagacggggtttcaccatgttggccaggctggtcttgaactcttgacctgaagtgatccgcctgcctcagcctcccaatgtactggggttacaggcatgagccaccgcgcccggtggcttttgctttttaaggtggacagaaacaccttgcagctgtgcttcgttgcccttgctgcttttgggtggaaacatagacttaagttagcatattcatcagttgatctcttttctgtgagaagggaaagaaatcgcagtattttgtgtgtatggcaggctttgagggcccttatactttgattctgtagatgccctgtccttcctcaggaggcagtcagctgtgtacagaggcccttgtggtcctgtcctgagagtagcggaaggaagacatggctctgcctggggagactgtgccttatgcagaggccaacaccacatggatgagccggaagcagccgctggcctggctgctctttcgggtcaggaaggctttcttgagtctggtatggtctggctgccccagtgtccccactgcctagcacagtgggcactcaggtgtttgtctgttggatcggttaattggcagggaccagttgaagcaaacagagaacagctggttgtcattcactgttttcaggactgcttatggttgtttttggtgtttctataatagttctaggcatgaagttcaggaccacagcatgcaagaccccgaggggcagatttgccgtctatagaaatagtaatgagagctgatgaagaagaggtggctgcttcccacagtatcaccttgattgtcatttctgcatttagaatgcatgagtgacccctaagctgctcttcaggttcttcagtgctctctttacctctgttgtgtagtttcttgaatccaggtgactgacccgcacgtcacatataagttatttggttttattccttggtctctttctcagcaagtgtagtctggagatgataggacacttagcaatgcagagagaatgccttcaccagagttaccagcaagtgcttggctgtgggggctccgtgtactaaagctcttccaggattgttagtgggcatgccagtgatctatcttcgcaggcctgcttacagcaaatgcagctgtcccccaaatgcaagaaccatggagcagccagcctttccagtacagggcccaattatgtgtcaccagtgaacatggaaagagcttttcggttggtttgccacagttagtttatctttcccccacctttgtgaccttagatatctcagccaatgccaccattcacccactagttatttattgaactcagctatgtgccaggcattgttggtacagaaatggaggggaacacattgtctgtccccgagaccctctgtctgtagacaggctcgccccctttgtccctgtggtttgctcccctactttcagtgagtctctgtgcctgggccatcttcttacacccactttacccacctttaaaattgcgccctccttcacacttgtcaccctgtctgcttgctccctctccagagcacttcacacctaataccctacatacccgctatcctgacgtgtgtgtctggttcactctctcgtcctcccccaatgtaagctccttgaggccccaatgtaagctccgtgagggcaggggtttttgtttgctttgttcactgctggggcccctagtcctagaatgtggtgagtgctcagtaaatatttattaacaaacaccttcatgaaagacataccacagtggacatattcagaagcccacagtcaggtgtgggaaagaagctagagaatcaactgttaggatccagaattagagagaccatcacaggagagtccccggggacaccttggctcatgtttgtgaggaaaatagttcacaaagatgagcctttggaactgagttctatagtttgcagagtcagccaggccagcagggtcccaagagaagggcgcccaaagcagaaagacctggcgtgtgccgtgtcgctgaagtgcatttgggacgtggagagttgtcggggctgcagcactgggggttggctgggaaggtggatgggtgcgtcttgtaggctctgctagagccttttagcctgaaaagttctgggagactagaaaggcttttcctgggcaccagaatagtaaggttcagttgagagacagctctgtggtggccacatgcagtttggagggtgaggggtgagcacagaggcggaggtagattgttgcagagacccagttgagaagcgtggagggcttgaacagtgcctagaggaggggcaggccttagggtggcgggaggtgggtggctggcgggagccagctcgttgtggtttgttcatggtatagtagtttcttccttaaaatgtggaatgacacttgtttagtaaaatgtttttcccacttcttcctcttttttagagatggggtctggctctggcatccaggctggagtgagtggcacaatcgtagctcactccctgcaccatctaactcctaggcttaggccatcctccctctttagcctcccaaaatgctggggctacagacgtgcgccaccgtgcacggctttgcatttcttatattgttgaatgtttttccattaaatattttcctttgcgattgtttttttttttagatctcaagagccttaacttaatcttcagcattgttttttaaggactgcagcgtattcacaagttatagtttatgcatactaaaaatggtaatgtttggcaggtttttttggtccaatttttagttgttacttgtgaatttatcttatttcctagagcaaattaagcacattattgtaaactggaagatgaacgtccttaattcattgattatttttggggtgaagggagagagatattttgctaagggatattaagaagatacttagtggatatttaaaacatgaatttttttaaattttaaaagtaatatcaaaaacaagttctacatatgaaatgtttgaaaaatatttaaaaagttctgattattattattattattattattttttttttttgagatggagtcttgctctgtcgcccaggctggagtgcagttcgcagtctcggctcactgcaacctctgcctcttgtgctaaagcgattctcctgcctcagcctcctgagtagctgggactacaggcatgcaccaccatgcctagctactttttatattttttagtagagatggggtttcaccatattggccggtctggtctcgacctcctgacctcaagtgatctgcccgcctaggcctcccaaagtgcttggattacaggcgtgaggcaccactcccggcccatttataaaatatcaataagctgacttatgtttggtgaaggccaactatttcagctattgctgtagatatccaggaagataaccaaagcatccttacctttgtgtataatggatagctaaggcataagaaacaactgggcacgttacaagatgtgtaattaagtgctgaattatgtggtgcatgtggcaggttcttttgtagtaattcagagaatgaagatgggtaatgagctagtcttgagaaggaataggatctccgcctcccaaagtgctgggattacaggcatgagccagtgagtccacctgggtgaccttactactttatatgaatcctctggtcactgctgcccaactatccttttatctccctttttgcttaccccatttatgtgttagggtgccctcccttttttttttaaaaaaacaaacaagtagagctcagctttctaactggcttacaccataaactagagatttagtggctcatgtaactagaaattccagaggtagatcaggcttcaaagttggtttaattcagccgtttagttacagttttgaggacgtggcttcttttcattttttcacttttcatttcttcatcttttcattctgcctgtcagtattatcccagggctagtttcccccacgatggcggaatggccacagcagtttcaggcttcacatttgggcacagcctccgtcacaccagcctgaccaagagagtgagtgtgcatcccagaattttaggcagtgtcctgagcttcttgccctttgggtcgtccctcaaccagagcactgtggcgaggagggtggtatgccaagcagggctcccatctggcctgggggtgggggtgtgttgacttctgaactgggtgactactatcccacagggtaggaaggggagctggccagttcgctactgtcccacatgagcgtaatgtctctcccccctctccttttccagatatgccagttcctcctggactcctcagactggaagattgtcctttctccttggcaaatcatctgtactatctgattgcatcttacagtcttctttaaatattattgttccttaactgttaatgtgtctgtgccttgaggtcagcctcaggttccaatcctgttccattttgtttgtggaatctcaggcaaggttggtttctctgaacttttaaagttttttcatcttcattcagcaaatctttattagattctcagtattgtgcttcagtggacgaaatacagactgacacaaggagataacagttcattcacagagacataggtaaatgagaattactatgaaatatgaacagtgctttggcagaaatagggtttagaaacacttcctgaggaggtgatgcctgcgttgagctttgaaggacaagtaggacttcttcagagcatgggggaagagggagctgcctgcacgaaggctgatcagcagaataatgaataaatgcagagttactgggatcttaggtgcacgaccttcggcaaggttggtaggcagagacgcccattacaccaagttgaagagtgaagattctacctttatatacaccttacaattacatggggagtgaccgcatgtcctggtctaaacttatcccagcataattcatcataatgatcctttcactctgagatatgcctctaatttggatgataaatggttacgcaacttaaaatagaagtccagagccatagggacagtcactgtgatagcagtgtgcttgcttcatagtagagcttcgggattacatgagatagagcatagcagtgcttctcaaacttaaaagtccgttgagaatcagctgcgggtcttgtgaatgtgcacatttagattcagtacacctggggtgggccctgtgcgctgtctgagctcctaggtaattcctaggctgctggcctggtgacctcactttgagtagcaggtcgtattgggcttcgggagcttcagagggtctgtgaagttctgaaatcatacgcagaaatgtgtgtacatgcattctttagggggtgggcctaattcccttacatcagtttctcgggaggtctgctgccacccaaaaaagattaggaatcctcccttttagaaattttgtgcagattaaatgaaatatgttgattaaatgcctttaacattgtctagagcataatggacattcagtacacactagctgtatgtcctccttccctgaccccagttctttgaaggcaggacacattgcttaaacattttaaactgctttttaatgtcctttttatgtcattggtgctcaataagtgtcgatttagcttggtgacaagctgtttggtgactgtgagccattctgtcagcatttgctagtctcttaggtgccaagcattttactaggtaggtaggaggaggccactacctaggttattgcagatacccaggcataggtggagtcatcagggcctgtgctggatagtaactgtagagttgaagaggagatgcatcacttcttagtaatcttcctgagttatgtgtgttcaggaaagtgcttctactgcctttgattcattgaggtcctagtctctggtcctcaggtgtatgtgatttcagtacggattaatttactgtaatgcttaatttaattcattcagttgctattcttgccaaatgcagtttttctgaacattttgatattttgttgagatggtcccagaaatttgggattcgtgatcacgttagggtatttgtgatggaaagggtatataatttatggtattttcaaagttccttacctaagagattggaagaacaatgatgagagagagattgggagattacttgtcttatagagttgtagatgcttcagagaacttgactacattgcgaagggaaaatcttggattggaaggttatttttgagaaagtggagtgttggtagtgaaagttagatttcagtgaattaaaagcaaatgagagatgagtttaattacaaaagaaatgtcttttgttcagaagacatttctgaagagttgcttgtgagttcatttattttattgagacaggattgtactctgtgacccaagatagagtgcagtggtgcaatcatggctcactgcagcctcaaagttattggctcaagggatcctcccacctcagcctcctgaggagctgggactgcaagtgtgggccactgtgtttggcaggagtttaatttttctgtcatattacttctaatttagttgcattatagtttttcttctggccgggtgcggtggctcacgcctgtaatcccagcactttgggaggccaaggcgggtggatcacctgtcaggagttcaagaccatcctggccaacatggtaaaaccctgtccctactgaaaatacaaaaattagcccagacatcgtggcacatgcctgtaataccagctactcggaggctgaggcaggagaattgcttgaacccaggagtcggaggttgcagtgaactgagattgcgccactgcactccaggttgggcaacagagcaagactgtctgacaaaaaaacaaaaaaaaagtttttcttcttttagttttgttgttgttgttgtttttgagaaggagtctttctctgtcacccaggctggagtgcagtggtgcagtctcagctcactgcaacctccacctcctgggttcaagcgattctcctgccttagcctcccgagtagctgagattacaggcgcccgccaccgcacccagctaattttcgtattttagtagagacagggtttcactatgtaggtcaagctggtctcgaactcctgacctcaaatgatccacccgtctcggcctcccaaagtgctgggattacaggcatgagccaccgcgcccggccagtttagttgttgttgttgttgttgtttttgcctttattaacttgttaatgatcagtaaacccttaaaagcactaaaagagttcccattttaaagacatctggatgttgttcatcaactttatatagtgagtaattatctcaaattattttataatttcttttttaactgggaggcataactgaatggagaagtagctcccctcatcctcctgttttctgcttagtttctcccacctcctcagttgcctgtagtgatggagcttttacttggatcacgggaatgcccctacacagtgattctaaactccaactgtaagtcagaatcacacaggaagtgtttaaaatgctaaatgaggcctggactccaccctagaccactgaagccagaattgttgcaggtgtggcctgaggatgctctgattctaaggtgtggccaggttcgaggactgttgtcttaggcctttgtccaatatggtttatgctgctcccctgctaggtgagtaccaccgcggattggttacctgcttttatgtggaaaatagaatataggaagccgattgggtggaaaacatctcttctagtgtatgtaggtcccataagggggactttgaagtctggagttaacagttttctaataaaagatttcagaccatatccaggaacttaaatacataattaaagagtggaatgcaaattattaggatttttgctggtaaagcaagctatacttgcataatttaaatctttggagggcatgtttcgacagatcattaggtgaaggttaaactgagacagcaaacagtggattccttccttagctagtataccactttttgcattcttttattttcaacagatagtaattttgcagctttttacttcttcaaccaaaccttctaagtaactttgctttccattaacaacaaagccgctcattaaggtggaagttctgtgcttgatcttaacaccggaaggagaggagtctatttaccagctaatgtaagtacttcttattagacagtcctagattttctaggagatttgaagagtctgctgacagtggccagcaaatcagaggaaaatcatttctgtagctaggttcttttttcatggatgtcctttaagaggaagctctgccgtggcgatgtgcgttccttcctggcgggtggcctccagtagctggccttctgttggtccggttccagcgtattttattaagtgaaaaatcctgtagaacagatggcacttacaagtttctgcccatgtagcactctgtttaatgaaatactatagttttgcttcattgtttttggcagtaattgtctttgtgtggagtttgagtacatggtccgagaagctcggcagtaataaaggttgagccaggcaagaataatctgaagtgactgagtaatgatgggacagaggcttcagagtggtgcacagttaaattgaaaacagatgcagaataaaaagatgatgcccaatttttttttttttttttttttttgagatggagcctcgctgtgttgcccaggctggagtgcagtggtgcgatcttgccttactgcaagctccacctcctgggttcacgccattctcctgcctcagcctcctgagtagttaggactacaggtgcccgccaccacacccagctaattttttgtattttttaatagagacggggtttcaccgtattagcggggatggtctcgatctcctgacctcatgatctgcccacctcgacgtcgcaaagtgctgggattacagtcctgggccaccgcgcccggccaatgatgcacaattttttttttttttttttgggaaggagtctcgctcttttgcccaggctggagtgcagtggcgcgatctcagctcacggcaacctccgcctgccgtattcaagctattttcctgcctcagcctctcgagtagccgggagtacaggtgcccgccaccatgcctgactaatttttgtatttttagtaaagacggggtttcaccactggccaggctggtcttgaactcctgacctcaggtgatccacctgcctgggcctcccaaagtgctgggattacaggtgtgagccaccatgcccggcaatgatgcagaatttttaagatgatgttgtgtagcactgggaggtctttggaccaaggaatgtgaaactaaaaatcccagagtgtggatgcctacaaatagggtgtactgaagaattcttcttccgtagatgagagattaacaaatagagcgtactgaggaattattcttctgtaaatgaaagattacaactgtggccattggtcttcaagagctttgattatggtactgcttcatctgctttacatagattgtgcataacaatttttaaaaagtcaaccttattgaagtataatttaatacaataaatgtacccattttaagtttgcagttcgaggttttttgtctttgtttttcagacgaggtcttgctctgtctcccaggctggagtgcagtggtgtgatcatagctcactgcagccttgacctcctgggttcaagccatcctcctgcctcagccctcccaagtaactgggactacaggcatgtgccaccaagtctggctttgttttgttttgttttgttttagagattgagtcttgctctgttgccaggctggagtgcagtggcgcgatcacagctcactgcaacctccgcctcccgggttcaagcaattctcctgcctcagcctctcgagtagctgggactacaggcacacgccgccacacctggctaattttttgtgttttcatagagacagggtttcaccgtgttgcctaggctgatcttgaactcctctcaagtgatcctctcaccttggcctcccaaagtgctggaattacaggctgggagccatcacgcccagcccagtttgagttttgacagatgtatacaccaaagtagtaactactaccacactccatatatagaacatttccattgctcagagagtttcttcatgcccctttgccatgaatccccaccttgtccaggcagctagtggtctgcttctgtcactataggctaagaaagtttgccttttctagaattacattggcccagaattacacaaactgtactcttttgtttggttaccttcacctgacccaactatttagatttagccatgttgagtgttgagttccagccttttcagtactgggtagtattcctttgtggatgtcccacagtttgcttgtctctttcctcttgatagacatttttgttgttcccactgtttgaatctgctgttcacattcatgtacaagtgtctgtgtggacataggttttcatttcttgtgggtaaaatgtggtaagcgtatattctattctgtaagaaactgcaaggctttttcaaagcggccatgccgttttctatctgcaccagcagtgtatgagaatgcttcttctctgtcctcaccaacatttgatattgtcagtcttctttttttgagacagagtctcactctgtctcccaggctggagtgcagtggtgtgatcttggctcactgaaaccttcacctcccaggtttaagcagttctcctgctagcctcccgagtagctgggattacaggcagactcccccacgcccagctaatttttgtatttttagtagagatggagtttcaccatgttggccagtctcgaactccctaacctcaagtgatttgtccgcctcggcctcccaaagtgctgggattacaggtgtgagccactgcgtccggctcagtcgtcttaattttatagtacatcaatttaaatgataattttttgtccctaggaacatgagttcctgtcattgacagcaaagtgaaactgagtacaaataggtggttcttagtgaaatgtgcccagaaagacagtttgagcagaaaggagggaccaagaaatacaggatgcatgcctgcttcacactggaaaccggtggtcttatttgagggtcaaagatggggggtggggaataaagtcgattttaaaaggattgaccggctccgataccttctgatcacatccagggtttttttttttttggccttttttcccccttatacacttaagattttgaaaagtggtttctctttagcttgggaaatggatcacatggtaattgttaatgatttttctttaggtcaaaataggtgttcctttaaagtgttctgtgaagcttaattcacttacgttgaataagtcttatattttaaaatataagtttaagtgttatactttaaaaataagtgttatttcttgattgtatttatttgaagattatatttgagaatgaaagatgtactcctagctggaacatctctggtgataataaaaacatgagaataaaaaccattcagagtgatcaagttaagactgtcagcccactgacgcctgggaagtcacaatgattgctatgtagtttggagaaattattccttatccttagataagctttttatttgtgtgggttttttcatcttcctcttcctgaattcatttgttcaacaaagctattttgagcacctactctatgccaagtctactgcattaacttctggctaaacaaagatggatctaactcgattcttgtactttaaagaaatcagctttatggaggtataacgtatgtgcggtgaatttcacccatttaaagtgtatatttccatgaattttaacagatgtattcatttgtgtaatcacctccacaatcaagacaccagttctgtcattccccagaatgacattgagcccccttgcagcctcttcttttgttcgtccttggccccagcaaagatagaactgcttctgttacagtttcttttttattggtttcatcttccatttctttttttcttaaggtcagcaccaaggtgattgtaatgaatatgaaagttggtggaatcttgaacttctactagggctatcccagataaagttgactgaatttactccctaatttatctgctgtgtttcatacaatagcaattttacacaggaagttattcaataatgagggctatctatattaccttgctatttagtactagttaagagcaaagcgagttaaaatttaatggccattttgtaatacagttctaatatagacacaggactggaaagttggtaaaagtgggtttctgttaagtgaatcatgttttctaatttggagattcaatctgaattcaatctaaaatttctgaaggaaattttagctcggaatctccatgaaagcacttaatatacagccaacctgttaaaaaccatactttgagaggtaaaatgattactttttgatagcactttaatagtagaaatagaatatacaaacagggaagtagacactcaattgcagtactttgacatttgagtttcaaggagagaggctgcctgtgagagtgactttgtgatagtttgtctactttgttcgcttctcaggacctctttgccccaagaaagtaaagcaaaattttgctatagccctattagtgagggaacaaaacttctcttcctccttcttcctttgtctgcttctgccatttgtaacacttagttcagcttgcagttggcttgcactgtaataaaactgtaaatgtcaccatgccctgacccctgtgtgtgttgtgttcaaagttttactctcgtagtctcgcatagttgagtgtggattgttgatgctcagtgcatattgttaaattggcgaacttcctggtgtgcattcactagttgatgatagtgtcatctccagatgtcctcagaaccacccacaccaccttctgaagttgaaagcacacaatgattgttcagtagatatcagctagcacccataacttactgggctttgattcataaagcctagtaaagaaattaaaatttttattttgatataagtactgaccttttttaaaactttattgagatataattcacatgctgtggagtttgtgtatttgaataaatatgcatttcagtggtttttagtgtattcacaaagttttgcagctaacaccgtagtccattttagaacatttcatcatccccaaaagaaagctcatgttcattagcagtcaccgcctcccgctcccccattctcctctcctcccagcccttggcaaccatgatctttctgtgtctggtaatttgcctattcttggcatttcatatgaatggaagaaacaatttatggctctttgtgtgtggctttaacttagtataatgttttcaaagtcatcctgttgtagcatgcattagtctgatgacattttctttttctttttctctttcttttcttttttcttttttgagacggagttttgctcttgttacccgggctggagtgcaaatggcacgatttccgctcactgcaacctctgcctgctgggttcaagcaattctcctgcctcagcctcctgagtagctgagattagaggcgcctgccaccatgcccggctaatttttttttgtgtttttagtagagacagggtttcaccatgttggcagtctgttctctgactcctgacctcaggtgatccacccgcctcggccccccagagtgctgggattacaggtgtgagccaccgtgcccggcctgtctgacgacattttcaaacccgtgtttcttaatcctttttagatccaagagatccttttggagatgggaagaattttagaagttgtctggtccaacataccttcattttgtagatgagattaaggctttaatcatgccaaacagtctattgctcttttcatgtttccccaaattgagcttatttggatcaggagaagagggagaatactttatacttctcagcttcttgtgtatttgactgtgacctggttataccatttgccactgtgaggcttagctgtgcatctgtgaatgggagattgttcttagagattggtcatagttgtccacctgcctcggaaactgcaggtacaaatgcagcagcaaagtatttacattcttacttcagggctgatctcctatttctatcagtccttttgaaggcagagaatgttaatttggaacaacctgcatatttattcaaatttccagagagatgaaactttcagaatgctgtgctgcagcgccccctagtgccgtgctgtactgatagtccccagcgtctcctgaagccgaaagtggcgtttcccgcagttccggcgggagagctgtagccagcaggttgtgcaagtgaacattagacatcttttctccttctcgccttccttgggctgagatggaggaatgtgtctttattgctgagggcaaggtctttgtttttcctttagcaggaacactggttttcccacttcgtctaaacctttgcccagggtttctcaactcaggccccctgagggccgtagtggcctccacacacctccagaaggtaaactgagccagcttagccaacaggctatgcttcagggaggaaggtgtcttttgttcccatccctgctgtggtgtgggcttgccccccttttctcgaagtgtttcttgtatatttttttccacatcctcttgagaaaggatcagaaagtaaagatgtgaacagtgagagttttgaaagcccgggatggaggccggatgggatatgaggggaagtggtggaggggaataaatagcttctctagttcacagtcttacttcccctaaaaaggggaagaaatgcctgaagcccttgtactttgctcccccgaatcgcaggcatttctgtgccgtcccgcccctgggcatttcctatgcaaccacaggacgcgggaaaggagcgtttgttactgctttctgatacctccttttgaccccagtgttctgactctggcagagttgctgaaaccttagggggcttcccagtctttcctgatggtatttggtgtagctgtgggaagggcagagttagccgcagcagtgtcacagtttctgtggtgtggcatggctgacagggcctccaggtacctgcttttattttaatgacagccaccaatatgtcctaagctctgcactttctttgaaattacaagaaacgatgaacttactcgtgctttttagtctcccgtgtgaactgaattgttctgtattttatcttgctctgttatgggcaaaactaattcatgtcatcagtggcatttccctcttcactaggttgtaaatcctgtgaagtcagacacagcgttattttcatctttattttacccaaacacctacaattttcccccctcatgtgacagcctttgaaataagttaatcttccagaggagagaaaacactaaacagtcaaacataaggagagggtaaaggttttcctcataacctcacaattttcagtgttagctttaaaaaaacaaacaaacaaacaaacaaacaaacaaaaactctttatttgcaaatagtttgaaacttgaaaagttgcggaaagaaaaatagtacaaagaatccccagatggtcctttacccagatccacctgttgttaagattaaatccatttgcttaatcatttgtgtgtgctggaattctctgtctgcaaatacacactcatacggatacacatacagacacacagacatgggctaacaaatgcaaatatacagacatacaatatttttccaaaccctttgagatttcagggaagattacatacactgtagccacttaatcctaaattcttgaatgtgtatttcctaagaataggcatattctcttaaataaccacagtaatacgttaccactttcacaaatttacattgatgcagtacttttttctaacctgtccatattctaattttgggagttgaccatataatgtcctttctagaattttcccttccagcacaggatccagtctagggtcaggaaatgtatttagttatcatgtctctagctttttgtagtctggaagtttcccacagcctttcaggatattgacttttttgaacagcagtttctcctcccctcttttgataacattcctcattttaccaaacacctaaaataacatttgattggaagttaggaaggcttttggagaaggagatggtgaaaccagaacattttaatagcagttggctgtcctgaatttctgtgataaactttttggtgtcacaaacatgccttgcttcaacatttagtcagatatcattttagttaaataattgtcactcactggtatttgctataaatatattgaataaattgaataaataattgaaatatattgaataaatatttggccttttttactttttttttttctcgctgttgcccaggctggagttcagtggtgcgatctcggctcactgcaacctctgcctccccggttcaagcgattcccctgcctcagcctcccgggtagctgggactacaagcatgtgccaccacgcccggctaatttttgtatttttaatagagacggggtttagccaggatggtctcaatctcctgacctcgtgatccgcctgcctcggcctcccaaagtgctgggattacaggcgtgagccaccgtgtccggcctccttttgtagttttatcaaaattataatttatgtccgtccactcactggtatttgctactgaataagtatttggccattttccctttttgtagttttatcagcatatgcaaaaattaccttttttcctcccaataaagttgtcatattctgttttataagcagcacctcttcttttttcttttttttgagacggagtcttcctctgtcattcaggctggagtgtagtggcaccatcttggctcactgcagcctccgccttccaggttcacgtaattcttctgcatcagcctcccaagtagctgggattacaggcacccaccaccatgcctggctaatttttgtatttttagtggaggtggatttcaccattttggctgggctggtcttgaactcctgaagtcaagtgatctgctcgcctcggcttctggaagtgacgagattacaagcgtgagccaccgtgtctggccaagcaacactttgtcttttggaatagtgttgataataaatgcttcttcattgtagtgctttgaatgatgcatatgattttgttaaatacaaaaatgatgtcttaaccttcacatttgtatggattattttatcacatcattcataatccatgtttgaatggttaccatgccagcttactttgccaagaaagaaatatttatcgtttttcaaaatgtgcattgcaattctaagaaattccgttttattcttaggattcccctagcttgtgatatcgatgacttgtcttttactgacatttgatagttaactccccaaatagaggattcctttatatgtggttattgggttgtatcagaattcctgcttgagtataagttatatttgtattgacacataggaaaaagatacatgtagtttatctgccatgagcatatggggaatactcattgtatgggagatggaaattctaatcaagttccccgggaggctgagcgccttgcagagatgctcttaaacccttggcactgacttcttagcccgttcctttatttcagttataaaatcgaaaggaccggttttaaatattgctgaagtgtaactgctcacttttaaaagctcatgcatttaaggattaaaatgtgattcacgtgtattttgatggagttgttttttgagctatgtgagccagtgttaaggaaattaagttggagttcaaaacagccgtggctagtgatttgtcaagtgttaaatgatagttcagtgttgcatagctggtaatcagcagttacttatggtgtatttttttgcgtgacatgttttcatcaagtcctaagctgttgtcaatgagctcttgaaactaacatgcttatgaaattatgtctgtgcaaaatgggtgtatttgaagagttgtaaggtgatttctgttgtgtttactttttatgattaatgttttgaataaagtatgtagtcccctcccaagaaaaccctccaaaaaacgtgctaggaaatcccctccactcctgtctgcgtccactcagcgtccactcagtgctactgtcccaaaggtgaagggccacattttttcttgttgatctttccagtgtctctttatgcagacacaaatatctatattattaacaaacacaaatatgttattatatagcaacacagatactctattttcctaccttttttacaccgagagtgctttcttcttttaatagtattttgaagatctctcgctgtctgtacctaaagttcttcctcattttcccctagttaattctgtaatttgattgaaggtacatatctgtggagaaattattgacatgaagttataataaaaacacgcttaaaatctataacattttctcagatactttaaaaataattaagtaaaactaataaatttgaaaataataggagaaaaaaaactcagtgaaccgtttctgagcgttccagctcatgacttgagggtgtttgccgctgactcatgctgaagccacttggtgtctgcgtttgaaacaggaagtgtgtgttagtggcttggaatcttgttttctcctcctctcctcctctgctgccaagatttttatcaaatcatttggatttgtagtgttcttactggattgaccagctctaaaaactttaggctgtatatgaactgaaataagaaagtgtgcttagaagtatgatttaaataaacatttttattttccattgtctaggaagaaaaccttcctaaagaaaatacctgataatcctgcagaacattctgatttcttatccttaggtatcttccccacattctgaagtaaaaggcctttcttgttagtcataagataaaatggataacttttaatatatagcatttctaccttttttttttttttttttttttgacacggaatctctctctgtcagcaggctggagtgcagtggctcattctcggcttgctgcaacctccacctcccgggttcaagcgattctcctgcatcagcctcctgagtagctgggactacaggtgcatgccaccatgcccggctaattttttgtatttttagtagagacggggtttcaccgtgttagccaggatggtctcgatcttctgacctcatgatccgcccacctcggcctcccagagtgctgggattacaggtgtgagccaccgctcccggcctctactttttttttttttttaactgctcgttgcagagcagggctacgccataggcaatgtgcacagagtagccacgtttctactattgatattaaacaaaacagcatgattttagtttatttattcttaatatttgcattaaacttcacagctgccgtgtgtttcttgtattttacttctttatcattcttgtatttctcgaattcattttctggaattcttaagcagtttcctttcctccccccaagaaaaaggtgtatgtgacagaaagtgttctttctcttttgcacttgaaaagtagtttatagaattctatgaaaaaatactctggcattctaggaacaaaatccttttttctcgaaactttcaaaatgttgccccattgccttccatagccttgttgattttgctattaagacgttctgttgagttttttaatttagtgatttaaaattagtaattaatttccgcgaacactttcatgatctctgatagctcttttttttttgtgatagtctgtgctaattttttctgcttccttttagcctatagaattttcccttccattgctttgagggtttcttagtgaaattcatatcatcttttcccagtgttggtgatgagaagaaggtgtaaccttctatattcttcactgaaaagtgacagtatttcagaagatcatttctgaaccattttgaggctctgtttattttcactgttactgtcaatacataatttctttgttgacttttgcaagtatatgtaaatattatatgaaaacttttttgttcttaatgtatatttatagttttggtagatgttgtcaaagagctctccagaaacgttttccctgtgcattcttaccaggagggtattacatttagtggccatttattcacatttacaataataatgagtattattcatttatgtaatatttagttactggttatttttgaatcacttggcttgtaaatttccctggaagctactagactgtttagttccattagaacagaggaaccacactctgcttaccatttttatacccagtactgatcatacgtgggcatttgtaggttctaaataattattgattaaatgaatgaatcattgcttctccgttgtggaaattgctaattcttctcaatgacttcttcttcttcttttttttttttttctttttgagatggagtctggctctgtcgccccggctggggtgcggtggcgcgatctcagctcactgcaacctcggcctccctggttcaagcaattctcctggctcagcctcccgagcagccgggactacaggtacacgccaccacgcctggctaatttttgtatttttagtaaagatgggggtttcaccatgttggccaggctggtctcgaattcctgaccttaagtgattcgcccatgtcagcctcccagagtgctgggattataggcgtgagctactgcgccaggcctcaatgacttgtttcttgaagctccatggagaatatgaactggtaggcacttgccagactcacatccgtgcagtttaaccacttcgttttccagaaaatcacattctgaattccgtgaaatcaggcttgcaacaagggctgtgtctgtctgataatatgtgtatctgtgtatcctatggaaatgcatttttaaactaagaagttatatagatatttttaaagatcattaatcaggatcattaacattttccttttttggatttccttgtcttcccatttgaaccacgttttctgcttttctttagtatgtttggcagagaaagcggaaatggaggtagtggcatgagtcagcagaaaggtaaatggaacaactggcagtatttgtgaaccaataaaaatctcctgcaagcaggactcgacaagtttggcatacaaaattgatttgtttcaaaataagctttatcagtttcatagtgttctttgacaatttgtaggaaaggttcagtagtatttcttttatataaacaacctagaactctgagttgcagatcctctgtttaattgagaaaggatcttgggggttatggcccaaatgttgcataggattgttaaaatatgtagcattttttctgaaagtatataatttgtatattttatgtgatcagtgactctcttattttttttcagtatatttttggagattttagccctgatgaattcaatcaattctttgtgactcctcgatcttcagttgaggtaagacaaaactttgttttagtgagtccgtgggtagatacaattaatagttatgtttctattttaatttgtttttttaaataaagaattccaatgtagagaaaagtatggagactaatatgagaaatgcctcaacccaccaactagatttgactgacatttgatttgacattttgctgtatttactttattaggctttgaaaagcaaataaaacattacagatgcaactgaagcctcctttggacctctctcccatctctccccagaagtaactactctgctgaaattgggaaatattggtcctgactggttttcaccttttatcatatacgtgtatatcaccatagtcaatcgtagtgttttatgtgctttaaagtgtcacgtaaatggtatactatattcagtttgtcgtttattttaagctaacgttgtattctttatgctaagaaatttgtccttgttctttgatttccagtgctcagtaccactgattgaacacactgcaatttacttacatattttcctgtcgagggccatttaggtctctagttcagccgttaaaaatattgcactcaatgtattttatcatgtctcctggtgcccctctgtgggctcctccgggacacagacctgggaatggaattactgggttctgtggaccgagcctctttagtttcactagagactgctcgtttgctatctaggattttaacagtcttcattcccatcagcagtgcatgggagttttcttgctcgtattaaaaaaaaaatcttgctaactcttggtgttggcatatttaaaattttgtgaatctgatgtgtgtagtaaatggactctcattgttttaatttacatctcccagattacaaacagctgggtactatttcattctcttcacgtctgctggcaatacggatgtcctctgctgtgaattacttggtttatatcccttgtccatatttttaaatcaagtagcttgtctttttcttactgattttaggattaatctttggttttacaggcatctgttcctagcatgagggctttaagcttcacatgttaggtgaaccctttttggggttgggtttttttgttgttgttgttggataagaggagtacactttcaactttaatgtcaactgaattgatttttttttccttatagtttgtggatttttagttttaaaaatatctttaggaaattcttcccatcctttagataacgaagatatttgtctgttttcttctaaaagttttcagattttgttttcacgcttcagtgtgtaataagctgaaattgaggcactgaattttgtatatgtgtgaggtggcatcgaactccctgcccctgtggccctggcaggtgcctcctcaccattcattgggaactcggcccttagctgtcctgtcagccccgttgggcagtgcatctcccctggttccgagtgtgctattctgtgggcctattgcttatctctgtataaacaccacacgttttattttatttttttatttctattttttcttttcttttctttttttcgagacagggtctcactctgcccaggctggagtgcagagtgcaatcacaattcactgcaactttgaccccccgccccgcctcaggggggttctcatgcttcagcccctgaatagctgggattacaggtgtgtgctgccaggcccgggtggtgtgtgtgtgtgtgtgtgtgtgtgtgtgtgtgtgtgtgtggtgtgtgtgtttttaagtaaggggattttgtattttttcccacatcacactgatgtaaccatacgttttagttgctacaggttttctcaagtgtgtacacatgtggatgggtgggtacctgtttgcaagtgagtagacaaaaacttgagttttcatgtgataggaaagtgaaaagtgcaccgtatttcaagtctgaaggcctggggtcgcttcagttctgccacttccacaggctcggagggtttgggcacgttctttccttttgggcctcccatttcttttctctttcttttgttttttaaattgaaaaaatgcagaatgcttattcacgtcacagaaatgttgggaaatcagctaatgtatggtccgataactagtgagtaacagatgttagtagaaatggatgaaaagggtacagatggtaagttatgccaaaccttttattcacagaagacgtgactgtgtctcatgaaaatgagctcaagcttcagaactcgtagtgtgtgtgggcttatttgggcttttctgtttttcttattttttaacatacggtgaagtttggaggggtataaaaagagtttatcaaaatcacagtaacctgcaaaagggaaatgcaggctaattaacataatcggatggagttgttttccccaatcttcaggaatctgaattataatagcacatgattacacaggaactcactttcatggggcggcatgtggttgggcctgtgggtgtgtgagtggcgagggcgtgtcacttggacctgtgggtgtgtgagtggcgagggcgtgtcacttggacctgtgggtgtgtgagtggcgagggcgtgtcacttggacctgtgggtgtgtgagtggcgaggggagggcgtgtcacttctacagcacagtttggccttttatctctcaggtaacataattgccgctcaaacatgcagtgtttctaccatgtggctgtggcatgagttacaatctagtcgaatttttcatatgctttttctccgttgttaggagcttgataaaatattgttttctctacttggggccatgaattgaaaaaccaaaattaagaaatgtgggatgttaagatgaaagagcattctgccttcctgcagaagcgcctcctgccagcggagggctgctttgtcttttagtttgcttgcttggcagcttgccactggcaagataaggtggctagtaatttagtggcatcaggagaaacgaattcaggtgaaaggtagctggcatcttttctagagttgtgctccagtgatttaaaaattattttctccagtggaaaaaatgcagtcaccttatttaataagcatgtttaaacctcagtcgtaatcctgttatttatgttcagaaagaaagagaaaatgctcaccattctttagtttccagaatctcagctttggaagtagcacacatcccaaccatgactgagtcaataagcccccgatgacatagtgttggcagtgggcagtgtgtgtggtgtgggtgtgtgtgggtactcatggagagtagagagtagagacagttcttaatttggtgtgttttcttttttgagagggagtctcgctctctcgcccaggctggactgcaggggcgtgatctcggctcactgcaagctccgcctcccgggttcacaccattctcctgcctcagcctcccgagtagctgggactacaggcgtccgccacctcgcccggctaattttttgtggttttagtagaggcggggtttcaccgggttagccaggatggtcttgatctcctgacctcgtggtctgcccgcctcggcttcccaaagtgctgggattacaggcgtgagccaccacgcccggcctaatttggtatcttaatgggattttaaaggagggctttgtggttcaggagagtctttgagacggaaagcagaacacacaggtagcccagagggagacttcagaacatgaccttcctatagccacgggcccaggtatccttttcacaaggccgcagcactgttttcacactgtgcgtttagcataactattaatagatgacagttttttcccttgctcactttgcatttgtctagggaattttatgtctttgctttgatttttgaactttgtattcttacaaatagttatatagttaatgagtgaacttcgaaccatcctggcacttttattctgttgtgtatttagatacccagttaccacagactaagtgcatctgatgtgtgagggaggtttgctgaatgaaaggtgctgtgtgcctgtggaataaaacacacacatttccacagtgccacaacccatctggcattcctgcaggtgcgctcttttatcagcttagcaaatcaaagtaagtgtgttgagcatgcttactgaaggtggcagtgtcatctgggagtttgctggtggtcgtctcaccagatccctgctgtgcctcttactggcagtgtcacctgctggcactgtcacctggcttcctcatctgaagctggcagtgtcgcctggcttcctcatctgtcagagggccacagtaacaggacctcctccccagagttgttgaggagcaggatgtgtgcctggcacaccctgagtgcccagtcagtgccacctggtgtcactggtccagcctttccagcctctccaccctcagtcagcgccacctggcattaccggccccgcctctccacttggcttgtcctcagcgtcatctgtgtatttttcccgattgctggggttttcttctgcatgttgtgggagtggctgggagttgagtgagtgttcacaccccgtggttgaatgttgaggaaggggacagccggaagatggtgagcagggttctaacagctctctgccttgtgaagtggatgggtgaagaggtcccttctctgaattgtgcgtcttcccagcctgctgcagtctctcgggtctggaggtttccttcagcattctctcttccccgagcagaacagaatactgggaagtgtgaagagaacattgatataatagtgatgaaactgttttgactcagaaaaagatgatttcttgatgttacaataaattttgtgtaaaaatagagtgattcaaaacacttttcatgcctcaaaataacacagctttctgtcaccagggggcatcctagtgtcattaacagaaaaagagggcattctatgtatcagtttctaaactgtcttctttgaccacagagggttttgaacgagatggaggcttcctgagacacacatggccgctgtgtccactgcccttatagacccacctctctgctccaggtgcctgccagcatcaatgctggtgtgtggaatggtctttgccttgcgggtgccaaggctagtgtagcccatctcagcatacagaatgctttcttctgggtgtcaacgtgatgcgtactaggttgccccctggtggtggagataagtgcagctgtcaactcctgaaggtgttggcttcttttgaattgccctgtgttttcctgtttgtcataattctctgggaagagaacttactgcgttactagcagagagaagcttttattgctgtgattattgaattggtgtgctgagatctcattggagaactcagctgaggaagccaatcaagcagcagctctcatacagtattgggcatgagacttacctaggagcctctgaactttgcggccctagggccgttcctgcactggcctttgtactgcagtgaacagactttgggaagtgctgcaccagaatgtctttttgttcttttgttctgccctcaggtagcagtttatctctctgcttaccttaccccttttcttcctaaaccttttttttttttttgagacagagtcttgtgctgttgcccaggctggagtgcagtggcactatctcggctcactgcaagctccgcctcccgggttcacgccattctcctgcctcagcctcctgagtagctgggactacaggcacccaccaccatgcccggctaattttttgtattttttagtagagacagggtttgttttttttttgttttgttttgttttggtttttgagacaaagtcttgctctattgcccaggctggagtgcagtggcgcgatctcggctcactgcaacctccatcccccaggttcaaacgattctcctgccttagcctcccaagtagctgggattacaggtgcctgccaccacgcccagctgattttttgtatttttagtagagatggggtttcaccatgttggccagactggtctagaactcctgacctcaagtgattcacccacctcagcctccctcattgctgggattacaggcatgagccaccatgccctgccccttcctaaactttcttacacccaatgtgtccattggaagcatttccaactcttaaataaatgttatggaatagctaggaagaagaaaaatttaagttatttttgagataacctttcagctttttacaaagaagtcagacagttcccattctgctttctgtctgccaaacaaggaatgtgacttctagctgttaatgtagttaattaaggcactgtgttaaaaagggagctgcagtcaccaggctttttgtttatagtgcgctttcctctgctctccgaccatggacctggtcccagcctctactggctgtgttgcaatgtagtgatcgtgaataagaggtgcagtcaggaagagtcatcttcgctagtgcacaaacaaaagtgtctgtggtctggatggtcagtcactgacatcctgtggaaagaaggatgtatcataagcatttcattgtagctgatttacatgtccattggagttcatttttattccttttggcttcattttcggatctgtttaatagtgataaatatttgaaagcatttctattgtgtttttttcgttaaatgaagatgatttagattgcactgactcttcatgtatgttattctgctagaagtaacggcatgcaaagttgtatggattaagagttttaatgaattgttgccttaattaaatggtaagcgttggttttaacattttgttgaattaaaatttgttttctgattccttgtgcagcttcctccatacagtggaacagttctgtgtggcacacaggctgtggataaactacctgatggtaagctagttctctccttatttccctgaagggaatttggccatacgtgctgggtgggcaggctacctgtaaacattgtttcccatttgaataaacatttctttgtagcttgaagtttttgctgtaaactgtaatgtatttaattgctgaatcactttgactagtgaattggttttaaagcgtatcctgtgcttcggagtgccagccatgtaagatttagtttaggaaatggttgttgagttctttttttcctaacagttctgagtgcaacaggtatgttactcttcatcagcacatgctggagttgaagcgaactttgggtcttgttgctaagcagcctgctggctccagcgccagctagcttctgagcctgtgttctttgtaaactaaggggcagctggcatctgttgttcttgcagttcacattcatgtcctggtctgtcgctgactcttgggaactcaggtcaactcttcacctcctggtctgttacttttttgggtctccatcacaggcactaagctgattgccagagatggtgcttatggagatgcaatgattttgtattgcttaagtacccagcgttggaataccaacaaggttgtttaattattgattgcaggctgcccttgcacaattcaaacttgtcgagatcatttttcaatctgaatcactttaaaggcccttactggcctccaggaaactgatgccaaactttttctttgagagttagaggtttggattccctgttcagttagcatggtcagacttatgaaaggggttttaattacaatttaggcttcaatagaagccttgaaaagactaaccaaacgttttatctccagtaacatcagggagtgattatatctaaaattttagatttataagaaatgtgggagaccataagggaaagagcagatctaacaatagcttaggacaagtaataaaatgaatgaagcttgagggaccgggaagccgggctgctcagcctcctgagccaccttttaattggctgatgtcaacctctcagacatctgagtcagtgggacttcctctgtcactgtgtgctttgcacgtggtgagcatgctgctcatgttgaaccagtgcttacaaatgccccatgatgttcccatgcacatcacttctttgagttcaccctcctccctgtgcagtgggcaccaccagctcccccagcctctggagttctgcttccccctccctccttccagcctgcctgcccttttcagtgactgcttcttggccctttttctccattctttactctgttccctctaagtcctgccttttttctgccaaaaacacgactggaatcttgccaccagtttgcacagttagtgacaggcctgcttttctctgcagcctttctgggtatcttgtgtttccatgacattagtttctcttccagtgcctgttcgactgtacagagcctgtgggcactgtcatggacctgcctctctttccagcctgctcagctgctgatggcaggatccatttctctgtgtctgtcactgcgcctgtagtatctggaatgttgtaagccctcagtacatttgttggatgaatggtttaggatgctttattctgctccctcccactacctccagctgcagcaagccctttgcagaggcacctcatcgtggcttcccttttagatctcggccttttctatttttgtgttttttaatttttttatattttaatttttgtaggtacataataggtgtatatatgtatggggtacatgagatattttcatacaggcatacaacaagtaataatcacatcaaggtgaatggttgtccttcacctcaagcactgcctgttttagatgttcctaaagcttgagataccactccttcaccctgcccttagcaattcagtgatccatcaagttccactgacctctctagtttctgatagaagttgatcactgtttcctgcatccagaagaatcctttttctaaagctattcacagctttctctcccctccctccatgttttcattctcagttgtttgtatttgtctccctaataaatgtgaactctctgagcagggcccttgtgtcactaatctctgtatatttccctccctcgccccctgccttgtagtccagtcctctctactgcatgtactgcagtgagcagccttggagaaatgctgtgttaggattcgtggttttaagagcctctgcctgcattacctgagtattgagtttccatcttcctaatgtattgattgggttgttgaagccaagcgtgcaggccgtcctgcacttcgtctgcctggcacattgggctctgagctctctgccatgcggtgcaaggcacatggcgtccattgtgagtgttcctccataagaagaggaactgtgctggctaggaatctgccttctagtgagatgatcaaacatggtattgagtaaatgtttgatactaattataacatactgaaatggttctgttcacgttacatcacattctagaatgttttatgttctgataagattgagaattgagatgtgtacagcacatctgtgtcttagaaataatcagtcttgcataagctgaatgacacaacacgttctagtttctaatgtgatttcacagccttcaaagggcaggctccacatggagccttccgccccaggcacacccgtttcaatctggggagccttgacggccccagaacatcagggaataggggatgtatggaaccaaaatgaacagccagcccctacatatgataataaattcatttccccttgatattcttttcaaagtaaggaaacaaaaaataaatagtagccaaaggaattagatggtcgtgacttcatgcataaacttgctgttaggtgtaatcgtcatcagtgttcttttccaggaactttctcttgttggggcaggattgtgctgccaccacccttcaccccccacagtcgggggctgtgattctaaagcatacgaagattcaggaggcctcgggaggctgtgtagctccagcctcctgcacactcacttgcacgtaactggcccctctcagcgtctgtattttttcttctacaaaaagatttctaggggtcctttcaaggtaaaatatattcagttctccgcagtagaacaccgttctttgggtattagtttcttttcttaagatagatgccttgaaaaaaaaattggccccttaatgctagcctggaagaaatcttcatgcattaaagatgaaatataaggcatgtgtccttcccttaacttcaaaatgtgtaactttttatcaaatataaggtgacattgatgcttgatttctgttgaaagacacaattgattctaaaacttaacctgatttcagaggtgtaaactataaaaatacgtctgtcttagcaggaatgaattatgtggattgtggttaactgggaaggaagtattgaaggcttcccaagagatatttaaaagttcacaattctaactttttcttttggtatttttggaaggctttaccacccatggggttaatccagtgtgaatttatttagaggacgtttgcatgtgttcatgtcagggccatttttcagacttaattgaaggttaccagcggaggagaccaagagatagagaattcagaagagtgctctgaagtgcgcttttatatataggattctttgttgttgttgttgttgttgttgaatctttttttgacatcttttttttttgtttttaaatttatactttctaatttctcctatccagtatgtataggattctttgcgtagttcatgtttttggaattaatcaaatcacgttaactacagaagctgatttaaccatgttttaagtccctaagttagttgtcatgatcttttaaaatttaagttgtccaaaatacatattcctttatctcaggcataaggcagctataagaaagtcagattccactggggggtatttttaaaattggcaaaatattacttgctttttattacaaatttattttaatttctaccttctgaaagccttccttagctagaaagataagtacaggcttctgcttttcatatccccaaattaaataataattttatagttgtttcattttccgcaaattgttcagcgtaagtaaaggacgtaatagatttgttgattaggaagagaacttaaggtttttattttcaaagagaaagtgagtaattactggtacttagagtttgtagaactgggttcttaactaatagttttctttctaaacaggacaagaatatcagagaattgagtttggtgtcgatgaagtcattgaacccagtgacactttgccgagaacccccagctacagtatttcaagcacactgaaccctcaggcccctgaatttattctcggttgtacagcttccaaaataacccctgatggtatcactaaagaagcaagctatggctccatcgactgccagtacccaggctctgccctcgctttggatggaagttctaatgtggaggcggaagttttggaaaatgatggtgtctcaggtggtcttggacaaagggagcgtaaaaagaagaaaaagcggccacctggatattacagctatttgaaagatggtggcgatgatagtatctccacagaagccctggtcaatggccatgccaattcagcagtcccgaacagtgtcagtgcagaggatgcagaatttatgggtgacatgcccccgtcagttacgcccaggacttgtaacagcccccagaactccacagactctgtcagtgacattgtgcctgacagtcctttccccggagcactcggcagtgacaccaggactgcagggcagccagaggggggccccggggctgattttggtcagtcctgcttccctgcagaggctggcagagacaccctgtcaaggacagctggggctcagccctgcgttggtaccgatactactgaaaaccttggagttgctaatggacaaatacttgaatcctcgggtgagggcacagctaccaacggggtggagttgcacaccacggaaagcatagacttggacccaaccaaacccgagagtgcatcacctcctgctgacggcacgggctctgcatcaggcacccttcctgtcagccagcccaagtcctgggccagcctctttcatgattctaagccctcttcctcctcgccggtggcctatgtggaaactaagtattcccctcccgccatatctcccctggtttctgaaaagcaggttgaagtcaaagaagggcttgttccggtttcagaggatcctgtagccataaagattgcaggtatagttgaaaagatacaaatctagagtgaagatgggagcagacctcatcaactgggcttatagactgtggtgttacccataacaatggcagattacctgtgtgttaatagcaacgtctgaaggatgcctatgtcttaaatgttctctaaaagtaagataatatagaaacaaatgggaggagagggttgtcgtaactttatgttaagtgaaagatccatgtctgttagcagttcttttctgttgacaagttacatttccatttcttgccttttgttcaagtaattctgctccacggtatgaatgtataatggactttttctgtgatatacctttggtatgataatcctgatttgtactcactgtgtgctccttttttatatttcttaagatacaagaaatcattttgtgaaataacatggttttttttttttggattgagtaaatggattttattcagaattttgatacaccaaggtcagctcttgaagagaaaaaaaatgttaagggttcagcccaaagttaatgttttattttagagtgctaaggctccaaagtagaaacaattcacaataaaaatagaaagctgcataattcacagattgtttttaaaaagttacagtaggaagtcagaaatgcagcagggtatgaaagaggtatgtgtcctcacatagccacgtgttgcttaactaagatggatatgtgttccgagatgtgcgtgttaacatcagagagtactacacaaatacaggtggtagagccttaggctggtggtgcagcctattactcccgggctgcaaacctgtccagcgtgttactactgaatactgtaggcagttgtaacacagtgctaagtatttgtgtgcctgaacacatttagacatagaaaaaatatagtacagatatggtataaaggatgaaaagtgcttcacctgtatagagcactcaccgtgaatggagcttgcaagactggagtggctctggatgggtcagtgatgagtgctgagtgaatgtgaaggcccaggacagtactgagcaaagccgagttttataaacagtcaacacttaggctgtactacgttgatttacaaatttttcctcaataagaaattaaccttaacctactgtaacttttttacgttttattttacttttaaattaaaaattctaaactttttgactctttcatgagaacatttagcttaaaacacacactacagctatacaaaaatattttcttcctttttattcttactttcctataagctttttcatattaaaaattgtttttaactttttaaacttaaaaagtaagacacaaacattagcctgggcctgcacagggtcaggagcatcaagacgccactaggcggcaggacgtttcagttccactagaatcttgtgggaccatcatacgtgcggctcattgttgaccgaaatgttacgccgcgcgtgactgtacgtacctaagaagcagaagctgtgtcatcaggttggattccaccaagcctggtgaccagatcttcagattgtcaccctagtagccaagttaaaataagctgtttggtttaggctttctgtaatactttctgatgtgaccttttggaacacctgacacccttcattaccaggatgtagcagcaagctgccaaatgcacacccttcgatggatggtcagaattgtgtaaaaaataaaacacattctttgggtggcaatagggtgatagcaagcaatgtatatatatttttaagagtattttattccttatacaaaatacattatctcaggtactcttgttgttctgaagttctcttaaatgagcaaatgataggccagacgtcgttattttgggcttcatatatattttttaaagccaggtgattttttttttttttttttttttttttgagatgcagtctcactctgttgctcaggctgtagtgcaggaggcacgatcttggctcactacaacctccgcctcctgggttcaagtgattctcctgcctcggcctcccaagtagctgggattacaggcacatgccacaatgtctggctatctttttttgtatttttagtagaaatggggtttcaccatgctgcccaggctggcctcaaactcctgacctcaagtgatctgctcgcttcagcctcccaaagtgttgggattccaggtgtgggccaccgcactcaggccaggcgatttcttgaatacagctttcagaatgtatttattgcaaggactgatactgtaggtggatgacaaggtcaggagatcgagaccatcctggctaacacggtgaaaccccgtctctactaaaaaaaacctaaaaatcagccaggcgtggtggcgggcgcctgtagtcccagctactcaggaggctgagacaggagaatggcgtgaacctgggaggcggagcttgcagtgagccgagatggcgccagtgcactccagcctgggcgacagagccagactccatctcaaaaaaaaaaaaaaaaaaaaaaaagatagattgtgtaagcctttatatagattactaagttaaaagtttatttttaacctataatgagaaatgcatggtggggtcctgttaaaaatgtgcattctaagttcgaagtcatgagaattttattttcttttctttatttttgagagggggtctcactctgtcgcccaggccggaatgcagtggcgcaatctcggctcactgcaaccttctcctcctgggttcaggcaattctcctgcctcagcctccctagtagctgggactacaggtgcctggcaccacgccaggctaatttttgtatttttagtagagaccgagtttcaccatgttggccaggctggtcttgagctcctgacctcaagtgatcctcctgcctcagcctctcaaagtgctgagattacaggcgtgagccaccgcgcccagctgagaatattatagtttcgtttctaaaattgctccacaaaggaaaacctcccatcttagggagattttctctatctttatttaaaataaccaagaaaagcttcatttaaaatgttttagaacattctacttagtcatatgactttaaatatagtttgataaatagtttgttatgttctgtatatgttaaagtctaattgaagtagctttgtcaaacactgaaagtaagggcctcttaatgactggtagtagaggaaagccttgccacacacagtccacgtaattatttttgtgtggacatattgtaaacccctaccaaacagattatttttttaatcctatttggttaggtcagttatgaagatgttttaattttctgagcaaaagtgtagtttctttaaaaatatataattcttttcagcctgtttgttgaggcttcgatagacagaacgtagttgttgacagtttcaggagtctcgtgagatagtagagcaatagagtcacattgaataacccttgggatcatatagggcttagggagaatggcattgtttgaaattttttttgttgttttattctcctacttagggatttactttataaaagtggtaaaacatactcagtttgttacaagtcagatccactaccacaaattccctttagtgggcacacttttaagtgtaggcccacttattttaagcagcgtttaactgagtgaaagtctagtttcattaaaagatctgttgatgtgggttataatagagtttgacttgcattagtatctaactgtttctactgagacagtggtatttgtgttattaacttttgggaaagagggagtagggaatgatttagacattaaatgtattcctttctgccaggcatgatagtgtggagattgaggcttgaggctcgataacttgagcccgggagttcgaggccagcctgggcaacatactgagaccccatctttaaaaaaaaaaaaaattatacacacacaaaatgcttggaataatttgtgtattttttatctcaagtttgtttcaaatactcacatttctggactatttcccctattgttaagtctgcttaataaatgccagctagtttttatgccatcagaagtgaaattaagaaggcagatggactaaaagaatcacgtataagggattttgaagtgaaatacattaaactcttgattactcttaaactatccactttaacgggttctacttggaccttcttggtggcaaggccatctcctcggtgtaggttatgtgtcaacattttgttccattggctgtttttcaagtgtgaactgttatttgaaaggagaaggacacgccaggggagagcgtgtgaactgaatactcagtgatttcctttagccccaagggaaggatgtatctaaacacaaaagccctgtcttgccgagggttggagagggatctgtgtttcagtgactggtctgagaggagatggttgccatttatcagtaggagtcaacaaaaggaaacttaatacagcccggcacagtggctcacgcctgtaatcccagcactttcggaggttgaggtgggtggatcccttgaggccaggagttcaagaccagcctggccaacatagggaaatcccatctttactaaaaataaaaaaattagatggacgtggtggctcatggctgtaatcctagctactgaggaggctgtgtcaggagaatagcttgaaccggggaggtggaggttcagtgagcccagatcgtgccactgcactccagcctgggccacagagtgagactgtctcaaaaaaaaaaaaaaaaacccaaaacttaatagcttgtgtttgaaagtagttgcaaaacgcgacacccttgttaagagtgagtatggcagacacgtggggagtgcctttgctgctgcttccctcattagcacagatactttggagttgacgaacatgtgacgtttgaaattgaacgtatgctttcattgaacattgtacttttcctgggtctttactaaggaacattcctcatatactagacgaaattgtatcagatgctttcacatcacaaatagagccattttgtatttgatgttttgctttcaaaattatgcaacagtatattttgttttaacagaatataaataatgctgggtaagaagagtggccaactgcccgataagttaaaattccagtgagagagaactaggaaaactgagctcttgaacagctctgaaaacattgcgttgaggtatctagcaatgtcatttattatgaattgttagtcaaaacctgtttatatgatttttcacagtggttttatacctaaaaggcattggatcaagaaacaaagttattacaatttgggtcttctctaatgaattaccctgtccgtgtttatttaagtgtaaatgaacatacagttatgtgctgctttaatgatgtttcagtcaacaacagaccgcatgtacgacagtggtcccataagattataatggagctaaacaatttctagtgaccagtgagttgtgttacagttgcctacggtattcagtacacaacatgctgtacgggtttgtagcttaggagcaataggctctagcatatggcccaggtgtgtagttggctataccatctaggcatgtgatcccacaatgacaaaattgcctaatgccacatttctcagaacatatccccatcattaagcatggctgtgtatcctaaaactgatctttattttggcagtttataaatcatgcatatatttccccccgctccttgggggaaatggtttctcagatattttgcacttcctcttcaaactctgaagtacacaggcagtggtcatgcggcgtgatctaagttaaaaaggcgtggcacctgtttaccgggatccacccttgtggactgagagtttagtccacatctgattcgatgtttgtagcctcacatttattatacatctttccacttcagaaacataagttgatctgtagtcaatgggtagtggtacattttggtcactttgctgtcctccacctggttagataaccaagatagtgtgtgttcttccaaattgatggtaatgaggaaaagaaaagcacttggagaatgttctggacagttagaatgatgacagaaaagcaggtcaacaacaccagaatgtcgattacgggccagttattgagccctaagaatcagagttctgtaccttgcattttcagggattttcaatgttaatatgacccctaagtcctaattttaggaaaacagaatttgatgtgtaaaatatgtgtaagaataatcatagcttatgatgacataaaagtttacgatgctggtattgcctttgagttgataaacaatttcagtgggctgatttgtggcagcccttgtgagctaccatctagcatgtatgtcttaaaatttgaaaaaaggctattaagcaactccatttttctgtatgtcagcagatttcataagagtgaaatttcagttcagccttttcatgtgagttattacaaaagtgaactacaggtttcaattttgtgtcttttatgagtcattctggcattttgtgccttttctcacacattgttctaggcagccccaccaactcctgtgacaaagatggactgggggaggccatcttcctaaagttgctgtctgaacagttaagtagtaaattataccaaccatgatgaattgaaaagaaggcttctggggaaagtttgttattagagccaacttctattatatgcccttaaagaaggtaaaatagatacaccaatggcaatgactttggaatgcaggtcaagtttcaacctagaagttgcctgccctctatccttggtggcccgccttcctcatttttattcttttagcctccataattggaatgcgtattggactttaggctaggaataacattgtaaatgaaaatgttgatgttgaaagaggaatttaaatagagcgaagagtgatattagaaatttggaagtggtattagttctggcttgtccgtaagacctgacttttgcatgataacaataggattcattcacttgaacataattcggtctggtcttaggaggaattagaactgcttttgcacccctgtttttttcactgcgaggaagaagaggagctcacgaacttcataaagcgttagtgtctcctccagttgatggttatcgaaatgagtcaggatggaaggcttagtgtacgtgtgagatgttacaaaagtggaccttaaatgtttcttgagtgtttggatcttaagagaaaatctttgacaataagtatttaatcttcatttcttacaatcattcctcttaaaatggagctttattttttaaaaacgtattttttttttcttaagaaacagggtcttgctcattcattcaggctggagtgctgtggcatgatcatagctcactgcagccttgatctctcaggcgcaggtggtcttcctgccccagcttcctgagtagttgggactataggcaggcaccaccatgtacagctaatttttttattttttattttttatttttcatagcaacagagtctcactgtgtggcccaggctgatcttggaactcctggactcaagtgatcttcctgccatagcctcccaaagtgttgcctgaaatagaactttattaatatatctttaatatgtcaagatgtttaaaacttgtcaagattttaaggaagttgggctaacatttcctcttgggatgctgaaagttgttggttttctcagactctcacataaattcatttgcttttcccttctccttccacctctattagctctttattttctaggggggattctgatgtctgtattgagctggccgtcatgccgggagtggtctgcttatgtatttacatgcgtgctcatctttgctatagctgagcgtggtgcagctccttacctgttccaggtgcggagtgatctgccgcacaatgaatgaagtggcagagccagggcgcgaacccccgtcttcctggtttgtgtgcctgggcccttgccctttactgtgcgtcttctcaggagctgtcatttagactttctggaccaggagctaaatgacctttaaagtctgttgagtcatttctaacaaatatgagtggagtcatttgccgtaaccaacaactttaatctccagatgtttaattgatcctgtattactgtctaatgagaacttactgtatgccatgcactgtctagttggagtaatgattggccttgccttcagggtagtctaaggcataagatcagaaaggaacagatggcagctgtttgtagggagaagtgatcattggcagaggggtgttgaggggagaaagcaaggaggggaggcctcatgcagctagtagggatggcagtaacaggctgaggacacaaaaggccaccaagtcctgttaccttagatggtgcggactttgttgagcagttgaagtgtgagagtcttgtctttaaggagcctcctgtccagagaaggaggcacacagcactaatatcaggtaggcagtgatgaggtcagctactgtggagacagtgtggagaatcttgagtgccttctgtcggtcttactctgagattaggatttaggatcattataagagattaataacagaatgatacggtattttagtttatgaaagacttgccactagataaaatttttctacagtaacagaataatcattaagaaaaatctaggttgttcgtgtctcttctgtattttccaagtctgaaaaggtttattctgcgtttaacgacgtcgtaccagaatggcctttcaaagactgtcaaaggcttgaaggaaagcttggtggagtacatttcctagtacacgtcccaagggcccgtacgtatgttctgctgttgcagaggttgtgctcgttcgcttttgtaggttccttgcagttattgaacaaaccactgggtggtgctagaagacttgattttaatactgtgcaagaaaaactgaaactgctttttaacctgcctgcgcctcaaaataagcaaactggaagctggtatcgatttaagggaatggctgatgtagaaactaaaggtttctgtctgactagttcatgctgtctcacaaataaatgctgggaaaaaagtcggtttatagttgatttatgtatcctttgattgcatagagattgaatggtcaagcctccaggccatgcagattattctgggcccctaactcagttaagaacatgaaaggaggccaggcacagtggctcacacctgtaatcccagcactttgggaatccaaggcaggcggattgcttgaggccaggagttcgagaccagcctggccaatgtggcaaaaccctgtctctagactttgtcccagaaaaaaaaaaaaaggagctgtgttttcagacagagcttagtgcagccagttcttgatggctgtgcaatgctttccttttaagagtggagttagcctcgtcataaagcgtgtttttgagtctgttcgaacgggtcaacaacgaagggaagtttcaggcagatcttgtatgcctggccctggtggctgctttcatttccttccagtatcagtgctaaacaggaatgaacatgttcaagccccgtctcacccacctctggcatcttcgccctaactctgccctagaagacctttccttccgtatcgtcaagaaaactgaagttgctgtttcactccttctcccacccagaaacttcgctgcatcttcctggatccctagctccttgcacccatgatcctgtctccttcctcagcccggcttctggctgagcagcctgcacttgctgtcttcactcctacacgctgcccccactcctacacgctgcccctgcgtgcttctcacttctctacccttccagccctgcactctggggacctgtgcgtatgtttgtgtgattatcaatctgttgaacccaggaggtcgaggctgcagtgaggcataatcacgccactgcactccagcctgggtaatagagcaagatcctgtctttaaaataataattatgattgggtatggtggcacacatctgtagtcccagctactcgggaggctgaggcacaagaattgcttgagacccagaggcggaggttggagtgagctaggatggtgccactgcattccagcctgggcggcagagtgagactgtctcaaaaaaaaaaaaaaaaatcagtcacttgctggtcttttaatatacatatacgatttactggtgtcatctgggtatcttttactaacatctctaaaactgagctcattaccacactaaacaaaaaataacctgctcatctgttgtattcctcctctagttggatagcactgctgccccagtcagtgagaaccttctagtatatctgttcttcctcagcttccatttggtggcttcaacccctgaccttcccagagtttctgcagcccttggattgggctaagcatccttccccaccccccgccccccatctcccaacaccccttcagcttagcctgtacagtgtgtgtttggagccagggacatcacagttcgtcccttcactggtctgcgagcttgcctagggcaggaccaccttgcattcatctctgtgccttccttacccggtgcctaggcagggctcagcaggggtttactcgccttcagcgaaaggcagcatgttatttaacaaaggtttcagccacacaccatggctcatgcctgtaatccaagcactttgggagaccaaggcaggtggatcacttgaactcaggagttcaagaccagcctggccaacatggtgaaatcctgtctctcctaaaaatacaaaaattagccgggcgtggtggtgcacgtctgtaatcccagctacatgggaggctgaggcaggaaaatcacttgaacccaggacacagaggttgcagtgagccaagattgcaccactgcactccagcctgggtgacagagcaagacttgtctcaaaaaaacaaaggtttctatgttagaaagatagcaggctttgagtcttaaggttaggtttaaaaaaaaaagtcatttgatataaaaatactatggcaaagccttgttggaatcatgctggagttttcatttgagacactatgcctttacgtcattgatggttatttgaaaatgcacctttttaacactgcaatgacattagttgctgttctgtggcacacactagaaatgatagactgttgtgatgatatggtttaaagacaaatgtaaaaatccactgtcaatagactttaagcctgtggggaaaagtaagtatctgaaaccttggaataaaagggatttttaagtgaagccccttatatattgaggaaagggctcaacctcttgagtcaggtggacccaggttcacaggtcatttcagctgttatgtgacctcagttttctcatctgtaaaatggggttggtaactatctctgacagtagggttatgataattatgaataatatacacaaagcttctagcacagtgtccctcacatgacaggtgctatctctgctgggtgtcatcacatgcaggcttggggttcagttcgtaactgatccattattcatttatttcaaggcccagttcggtattccatattaagagagagaggagctttgcaaacttagtctaattaaacagattccacagaatctgtaatattttactttctacagaagaagagctagcagaaattattccctacgcttcttcagttagaaggaagaggacatttattcataggaaggagggaatgagaggggtgggggtgtgtgtgtgtgtgtgtgtgtgtgtgtgtgtgtgtgtgtgtgttttgaattttgtaaattaattttttcatttgattagtgccgaagtctgggatctgccagtacaatgtagtttagaaaagaaaagcttatttttgagcgatgccttagatggatgctactatcaaatgtatgtatgccattttggtttttctttcctatatacaatttgtttatttattatactttatttttaaatgaatttttgatttttgttggtacatagtaggtgtatctatttgtgggttatatgattagtatacaatttaaaagtaaaggagacagtgtggattggctgcagattatggagttgaggccctggctatgctacctggctcctgtgtgatcacaggtgagttagtcagtctttgggagcctcattttccttattggtgaaagggtcaaagtggtggtactcctagattactaaggattaagtccagccaattaacatttgtcaattgtaaagaacgtgctaagtgtagaagggtttataaattgtagccatcaccattagaagattcatagtgggacagggggagaccttgtcttgttttcaagcatttctgatggttaattctataaagatggcattcacagctgttttaatacacagaaagagtgatgtccactcagggtgaacctgaggctgagcagcgtgtttgtaaatggaataagggaattacagtttataaaacagttgctaaattggatttctagtggacggtttaatttgtaggagaccgctgtctctgaaaggagtatttttactcactgaacagccattgaacacacacagtgatgtgtagggtcagcattagatgctggggatgcagagaggaatgagacgtgggttctgcaagatatctttctatctagtgtctgaggcgccttgctgctgatgagacacacctggctaatggtgtttaaggaagaaaggctgtatctctcaaatctattctctaataatgatactgtgttaacatttttttgtttctcattaaaataggtagttcttgtgttccctaattctgttccccccaggaagattaaatgttgctatttgagggaaaagattagtttcaaaaatgttctaattgaataatgtacttgatgttgaactgaatgaagccttaacagtatgcattttctttggctgtgtgttttactgaagggattttaaatgctgtcccagagtagagcatgtgaaatgatttgaatgttcttcactagatgtcatcaatttctgaaatatgcttcttcactctttcagagttgctggagaatgtaaccctaatccataaaccagtgtcgttgcaaccccgtgggctgatcaataaagggaactggtgctacattaatgctgtatccttcctggacgccgtccgcaaggccagcttgttgcagctgtccctcctttgggtgcatgtgacttagctcagcttccgtgggccatctagctctccatttgaatccctaagtctggtttattacttggtctgcctaccttgcttataaacaggattattcctgaccccagtccatctccctctaaaagagaggatatgttggcacgtgaatgagggctgcagacaagctggctctcattagaatagtcacaaataatagggcagagcaaccacttacaactggaaatttggttttaactgattgaactgtcttggttaggtcaagttcttgaatacaaacgactgactgcttcgtagatccttatatggacatcacaggacacttaccctagtaactatttggtttattccttttcgtggtgacatatctaagtagttcaacgtccttagcttccttgtgtttttataaacattcttgtgcttcatgtgccttcaggaaatgtggtgtgtctgttcatttcctttacgcttccttactgccactacatagacactgcaggcattggttgcttgcccgccgatgtaccacctgatgaagttcattcctctgtattccaaagtgcaaaggccttgtacgtcaacacccatgatagacagcttgtaagtaaggtggtgaaagatgtgttaagtggtggggtttttcccgtctgataattagaattgaaatagtttagtaaagctcttgatttcctgcaaatgagtcctataattctgtctttttttaaaaatagactgttggcgattttatatggaagttaaccagaaatggaattggagcattgatgatctgtgttctttagattcagtagaaaatattttagcgtttaccagcatatatcacttgaaatagaccaaaaatgcatatagaagagacttgagttcactagctgttacagcattggttacctaaaatctactatactcgtatagctgatattctacttagccatcaaagctctttagtaaaagtatatattgtttaaaactgcactatttaacattttttccccatgtttagtgttcggctaatgaatgagttcactaatatgccagtacctccaaaaccccgacaaggttagtaaaaatgagttttgttgatgctattacatattgggagttatggagacagatgacttaaatttggtaaattcagtcttgttgggaagatagtgtctttacacctatgccattctcaacattcagccaggtgggaggtgggggagttttgatgatgttgcttttttcatcatttatgagttcattgtagttaggaaaacctgtgtcctctttccattgcagctcttggagataaaatcgtgagggatattcgccctggagctgcctttgagcccacatatatttacagactcctgacagttaacaagtcaagcctgtctgaaaaggtttgagacttctctgttgtcactagtatcaagtgttgccttttgttccagtgtttgtgtggtaactgttgcttattgatatttgccctctgtctccagcgctataagtagatgtaggtttataagagtccattgcttggatgatatggtgcaccaagcactgctctcagtactttacatatattaacttagttgactctgaataaagtatgattatggtctccttgttacggttaagagaagtgaagccactgtctgaggtcaggtagctaatgtacatggcagaacccagctttcaagtcagttctcttaaccactgcactatatgccactggggtagaatggagtgcactgggcctggaatgatggcagtattcagaagagcttatgtcttcatcatacttacaggctttagtagctatttgatgtacttgattcctttacctaatttttttttaatcacatactttgttactaaaggcatgagaccaaggggccagggagcccttataaaaggccctggggctgttgagagtgacttgggccgcccttagcaccgttaactggagcatttctttcctcccagattgagtttgtgatgaatcagtacaagcagttgaaatgatgcttagggaaatgtattcagagagaaaaatagttgagaaaatgccatttaagtcaagtttacttgaagcttcattgctttgaagaagagtgaatgtcgagggcatcgttgcaggataccaccaggggtagcatagggtcttaagctttttaaatgcttataatgcagcttttggtattggcttggaatttgcacttcccaagtaatgggaacatggtgttagggatgcagaaatggaatgaagtgcgccctctgccctcagtgagggaatgagttaatgaatagtcaacaagagaagcacaaagatacagagatgccttagaacccagaggggcccacctagcacaggtggaggcaaaataaagtgggtgctcaggaacccctcttggatcgtgcacagagataatgctatgaacaaaagcatcttctaaaggttacattaataggggatgtgttgggctccccaagaccaccctgaggttgggtgattcactggaagaactcagaaaatgcagaagctggtatacccgtggctatggttgctgacagcaaaagcatgcggagcagagtcaggaagggaaaggacaggtgaggcagggcctaaaggaaacttccagactcctctcccagtggggccacaaggctacgcgtaactactccagcaccagactgtgaccacacgtgaaatgctgccaaccagggaaggtcattacagactccgtgtccagagtttttactgagggctggtcccataggtaccatctgcctggcttgaaccaaaagtccaaactcccaaaacaaaagcaaagtgttcagcagaaagcacattgcttgcgcaaacggtttaggcagaatcccgtatcagttattggaccgatgggaacctttctgaaatccaaattcccagacaccagccaaggggcaaccttgcaagcaggcctttccaaggagagccacccaggcctgctatgaaaagtcttcagcacactttggctgtgccagtttttgcccttttctgcacacgtgcagagcatgcactcacgtgaacagctgctgtccacgtctactatctggagagggcaagtaaactttgcagtttacctagatgcttcaaacagaacaatttgcagggccttggaataggcagttgtgctgtgaagaatgaaatatgaactgatgataagtaacagaatcaaacactcgtgatgtgggattattaaactcttgggtgactcgtctgtgaatgattttgctgatgtatgtgtaacacagctaacgctctaaatcagtggagtttttccacatgtagtttgagttctttcccatgtagttgtccatcatcaaagacagacagaagcagacatagggctgcttagctcattgctcgagtggtgacccttgcagttgaacagtgaactggccctagacatctagttcttcgtcttctattttgtttacccaagacagaaacttttttttaaataacttttttgtgataaaggtaatgtggccaggtgtggtggctcatgcctgtaatcccagcactttgggaagccaaggcaggcaggtcacctgaggtcaggagtttgagaccagcctggccgacatggtgaaaccccgtctctactaaaaatacaaagattagccaggcatggtggcacacacctggagtcccagctactcgggaggctgaggcaggagaatcgcttgaacccgggagctggaggttgcactgagctgagattgcaccactgcactccagcctgggtgacggaatgagactttgtctcaaaaaaaaaaaaaagtatatttattgaagaaaatttcaaaaatacagaaagtataaataataaaaatccccattagtccacccatttagagatatgtgtttagtcagtttctccttttcctcctactcttgggatttcagctatgcaagggaaacccatgtcatcatgtcattgtttggaaatactttacatcttccatttcagaggaggcatggttggactttgcaagtactgcatgtcctgcaggcctttgacagtgatcagttcacagtaacgtgattatatttgaccttttcagggtcgacaagaagatgctgaggaatacttaggcttcattctaaatggacttcatgaggaaatgttgaacctaaagaagcttctctcaccaagtaatgaaagtaggttatggtccacttgccgcagagttgtgcaagagttcgctgtaaacaggtgttgcatactcatatgttatgttgcttccctgcccctcagtcgttttcctttcaaatagcatttattccctacgataacttacaccatcgagaaggttatatttaggtaaattacagtttatcccgaacctctgccattttcctttaacttttaattaggaaaatgatcaagcctataaaaaagctgaaagaatcgtttgatgaatacctttataattgccgagtgtacagttttaaacatattttctgatgctatacacacactgtgtatatatatatatgtcttatctgtccatccatatatacatacatacgcatacattttccctgaatgattcaaagttaagttgcagctaacagtttagttcatctcaggtgctaaagcatctcctgcgtaaccacagtcccttatctaactgagaaaaacaactgtaatgacacggtaataccgactttgcagagcatcttcaaatttcgccagttgtcccagggatgtcatttctaggagtttatgtaaacaaggatccagtggtggtgcacctgttgcgattggttgccgtggatcaagtggcattgcaatgggttgcagtggatccagtggcattgcgcctgttgtgattggttgccgtggatccagtgacgttgcacctgttgcgattggttgccgtggatccagtgacgttgtgcctgttgggattggttgccatggatccagtgacgttgcacctgttgcgattggttgccgtggatccagtgacattgtgcctgttgcgattggccgtggatccagtgacgttgctcctgttgcgattggttgccgtggctcctaatgtagaccacaccctgatttcatttttaaaactgcaatcgacagatctgtgccttttttttttttgctgttcttgtcgtaaatagtagtgtaagcagatgctctccttttcagaacttacgatttccaacggccccaaaaaccactcggtcaatgaagaagagcaggaagaacaaggtgaaggaagcgaggatgaatgggaacaagtgggcccccggaacaagacttccgtcacccgccaggcggattttgttcagactccaatcaccggcatttttggtggacacatcaggtttgtgcttttctggaataacttaatatttgccttttctagggttttgccatgttggtgaagggggaaggtgtgaggcttgttttgagacttcttggacgtaatggtttgcatcttgctcccctgcctgctcttctcttgcacttcctgatgcttcccttgtcagcccccgtggcttattctctccctgctggcgcatgtctgcaggggacagggagctcctcccttctactctgtcaagttcagctgctcactgctagggagtaagagaaaagccagctaattggccatacgcggtggttcatgcctgtaatcccaggactttgggaggccaaggcgggtggatcacctgaggttagaagttcgagatcaacctgatcaacatggtgaaaccccgtctctactaaaaatacaaaaatcaaccaggtgtggtgacaggcacctgtaatcccagctattagggaggctgaggcaggagaatcgcttgaacccaggaggcagaggttgcagtggcccagatagcgccattgcactccagcatgggtgacagagtgagactctgtctcaagaaaaaaaaaagaaaaagatacaggagaatgtcatcatgacttaggggtaggcaaaggtttcataagataggtcataaacaataaccacgagagagagagaaaaaaaaatatatatatatatattagacttcatctgcatttaaaacttgcaacataaaaccacctccgggaggcagaggttgcagtgagccaagattacaccactgcactccagcctgggtgacagagcaagactgtcttcaaaaaaaaaaaccagctaaccaaaccatgtgttttggtaagagaagacagtgtatctggaggaattttatttatgttaataaattgtgtatatttaaagtatacacagatgttatgaaatagagatagtaaaatagttgctacagtgaagcagataaacatattccccatcacagttacccttgtgtgtgtgtgtgtgcacatggcaagagcagctgcagttttactcatttcacaaaagtcccaaatacagtgcactatgagtagctcttgtccgatgttccacatcagatctctagacctgttcgcctgtgtggctgcccttggtgtccttcgaccgacatcttccattcccactcgccacccctaggaaccactcttttccctatctctgtagtttcgtcttttttttttttttaataaagattccatgtataagtgagaccatgcaatatttttctttctgtgtctgacttctttaacttagtataatgttccccaggttcattcctgttgtggcaaatggcagggtctttattacagctgaatagtgttcccttgtctatatatacacaccacagtttctttatccattggcccatccacagacagttgtttccctgtcttggctgttgtgaactgattggaagcaggtgaggtagaaagtgaagagagtgtgaagggaggtcttttttacacagacagacccgtgactgggctggagtccctgggcacctggctgtgtgccagttcccttaagcagctttttgctcattcacaaagtccttcggaaaggtttttctttatttacctgagagcttttcagtaccactgtgatgtggaattcagcaaaacttgtaccatctccaagaaggtttacccatcgaaagtactgaagaggcctcattggagcctaatttcctttctgaggccttgcggcataacccccaggctggtatttcagtgacactcttagtctgttgttgtcccaaatgctgcgtacctgaaagaaagagcaccccttttgaggcatcaagacttgattcagtctcagttctgagactgaatcaacaactttcaacaggtgaataataagaacctcagaaacctgcgctgacgccctcagaagctggtttcccgtcctctgtggaagtggatttagaagccagttgagcagccatgtgaccttgaacaagtcacttctgtgttctgcactgtgagctctattccactggcccctttctattctggtgctctgtggagtgtccacggcagctgggtggtcagttgtcacctgggaaacacccagccctgaccactgtctgtggttccttgggacacgtcgtgttgggagggagacgctgaggtccaggttggcgcgcagcagcgagggaaggctgtgccctttgctccttcagcccagcagcctggtttaggattgtgaggacaccccctcgggatgggagagaaagatgaatggacagctcaaatggaggcatcgggaacatggtttttgtgcagaggccgggtatcagaatttcaaggccacagagggtcagcatactcaaagatcccaaatttgtctaagagtaaccagtggaaaataccagcgtccatttggaggacttgctggctcagattgaacagctctgtcacagctgctagccacatcctctgaggggtctctgtgttgaaattggttgttgatgtttctttttgaaaaacggtaaagcaaagatagggaattcttacaacgtaggaacttcttttcagccattgttaagcatgattctttattcacaccaattgaaagatttacttctaaaactcagcctcttcagatgtttttcagtttccccaggaagacttccccgcctttcttccccggtgccacctttgctaaaacacaggaccactgaatcaagagggcttcttgattctccaccagctctcatgagcggtttccccactactgtatccctctccagaaccaggggaactgttgtcactgaagtcttcaaactgtaaaggagcatggagatgcgtaattaaaccctggacagaaaagcttttagcgagctcttcaccgcatctgttctggaaagcctgagtacctgtccacacccattttattccgttgagaaactaggtcaccgagactgcagaaatagaagcccttgttgaacccctggaatgtttccttgctgaggctaaatgagagatgggccgaacacacaatttttactcagaaaaacttagaaaaaggaaaaaaaaaatgaaatgaaaaaccagctaagaaaacaaggtcaaattggcgcccttcttggaagggtggcagccttttttcctggaatgttaacttgttttttattctacacaccctactccccttcttctttttgtaagacatctttataggaggaaaatgccattaaaaatcctctatttaccttgggatttcctctattttattagaacaggctatgatacttggagaaaatggaaagcagcagcgttttgaggccatggcagggtggctgcctttatgaaccggtgcagtaaataacagtgtggagaggaagtgaaagaatttggaaaatgaaatatgttttcttccagagcactggcgttgggaacatttatcaactggtagatttagttgttagaaatactaaggaggtgctattcagcagaattattattattttttttaatttatttttttattgataattcttgggtgtttctcacagagggggatttggcagggtcatgggacaatagtggagggaaggtcagcagacaaacaagtgaacaaaggtctctggttttcctaggcagaggaccctgcggccttccgcagtgtttgtgtccctgattacttgagatcagggattggtgatgactcttaacgagcatgctgccttcaagcatctgtttaacaaagcacatcttcagcagaattatttttaaattcagtatatttttggcttttctctgtggtcttttgaaagtgatattgaataatcttattttcagtgtttattcccttggttaatcttaagggaaagtggcaaggagtggtctcttaatttttttgtttttgctttcaattcttaggtctgtggtttaccagcagagttcaaaagaatctgccactttgcagccatttttcacgttgcagttggatatccagtcagacaagatacgcacagtccaggatgcactggagagcttggtggcaagagaatctgtccaaggttataccacaaaaaccaaacaagaggtatgttcacacttgattttgaacctttctactaaggtgctctggtttggtggaaagaacacaaaattaggaatgaggggaaatgggtttgagttatgcctcttaaatcagttgcttaaccattttgtactgaaagtttttatggttttacaatgaaatggttgaaacgtgatcccaagggcctcttttagctctaaatcatattacacaaggtaatgatctccttttggattgtttatcttgagctacatttaattttctggcaatctaatgatgatatcacaacatcaatactacctctgacagaggccaaatagcttatttatgttcatgataccgtagggtacaactgtcattagattagttaggatgtcagagagattccagacacatctgttttgcatttgattgtagatcttccaggtcattgtaaatataatatagtcattgtaaatataatatagtcattgttctgatgcttgttactctttgatttgatctggaaaaggtaagattcttgagtctttcagtcttcatgaatttaagagtatcacattatagcttggtggagtccttgtcaactcagttgggcgagacggatagcattctgccctgtgagagcttattagttcctggctgtccagatgtgccagcttatagctattttgtactctgcagcagagagtgtcttctctgttatatatcttaggttgtggcagtgaattcataaaaatgcactggggagatgaatgcaggctgataattatggacggtccatagcattcctgcaaagcgatatttgaataatgggcagtggatggcagctacaaggtaaaataaggtgccccaacgtagaagacctgtcatcacattgcatgactgggatggatctatccttggcttatcttgtgtgctctgagtcagaaagagcaaagtaggacatagggacccttagcaccttcggggtgtcctgctgtggactggttcacccaggctctggggggatcagtagaagttatgcctaatcttctaccgtatttgcagacttgcatctcatgggtgattttgtttaaaaaatagaagcagtaggagccagaggcagaaacttggtagttgacttcagtgaatgagctaagaagagtctggcggtggacctcgtggaagagagagagggaaaaagtggtatttgtgttggggaggttggttgggtggttcagttgtgcattgtgggtgactgtcggcttggctcacttctgtggcagctgcaactccagagatagctccctggccctggctgctggtgcactctgcttatgctgtttcttgagccagctatgggagtctttggccacccatgctgttggggaggtggtcagcctttccatgggctgcctagggaagacccttttgtgatgtgtctgtttttctcttttgcttctgctgcaattacagtttgactttgctggggtgggctggtaggggtggcggtgtgggggcaggggttgaggcgcaggtagttgttagcctgttgttagacggtagtgaagaaagaatggtttatcctaaatagcaggtttggatgaaggcttccagaaagaaggcgggccaggtgtggtggctcacgcccttagtcccagcactttgggaggctgaggcaggaggattgcctgagcccaacagttggaggctgcagtgagctatgatcacgccactgcactccagcctgtgcgatagtgaaaccgtgtctctaaaacataagaagaaataaaaataaaggaaagctggcattttggtggactccggaagataaaaaggatgctgccagccgttctgggtgcgtggttgtggtggtgtgttaccagatgaggccaggaccactttcaacagcagatgtttcaggaagatttgggacagcttgtatggaagtatctataaggagcaaattacatattttcttgaatgtgtttttttttaagtttttaaaatgccacctttaactttattatgttttagatcagaagtatttttctgtgggaacatgtgaaggttttggggaaaataggattatatgaaatatttgctatatagaaaatgtctgcctttgttgagtgattagaaattaagcctcagttggctgggcgaggtggctcacacctgtaatcccagcactttgggaggccaaggcgggtggatcacgaggtcaggagatcgagaccatcctggctaacacggtgaaaccccgtctctactaaaaatacaaaaagttagccgggcatggtggcaggcgcctgtaatcccagctactcaggaggctgaggcaggagaatggcgtgaacctgggaggcggagcttgcagtgagccgagatagcgccactgcagtccggcctgggcgacagagcgagactccgtccccaaaaaaaaaaaaaaaaaatctccagtggctgatgcctgtaatcccagcattttcggaggctgaggcaggcggatcacaaagtcaagagatcgagaccatcctggccaacatgttgaaaccccatctctactaaaaatacaaaaattaactgggcatggtggtgtgcacatgtagtcccagcctctcaggaggctgaatcacttgaaccctggaggtggaggttgcagtgagctgagatcgcaccactgcactccagcctcgatgacagagcgagactgtctcaaaaaaaaaaaaaaaagtgttatccaaatgaatatgggaagcatcaaagactttgtaagtacagagaatgataaagggattgttatttgtaaagatgcatcttagtgacaaaaaacctggctttatttaaaagcagcattcatcagacctgtgaaagtacttcaggaacagattacattgataaaactcatgattagaataaatagctttaaaggttatttaaaacatctaattggcctggaatcccagcacggtgggagactgaggcgagcaggttgcttaagtctaggagttcaagaccagctgggctcatggctgtagtcccagctacttgggaggctgaggtgggagaatcacctgagcccaggaagtcaaggctgcagtgagtcctcatcatgccactgcactccagcatgggcaaccagagtgagatcctgtcttaaaaaaacaaacaaacaaaaaaacccacctaatcctactggtatcagttttatcaatactatcagagttattttaaaatgggtcaatactaggcctagcgtggtggctcacgcctgtaatctcagcactttgggaggctgaggcaggtggatcacctgaggtcaggagttcaagaccagcctggccaacatggtgaaaccccttctttactaaaaatacaaaattagccagatgtggtggtgggagcctgtaatcccagctactcaggaggctgaggcaggagaatcgtttgaacccgggagacggatgttgcagtgagcgcagatcgtaccactgtactccagcctgggcgacagagtgagaactccctccccccaaaaaaggcgggggagtcagtacataaataaggtggtactaagttagctttttaatttttatgctaatttgtcagtaatgccacagagtaaagttcttaactttgagtttacgactggacttcagggacccaagaggctctctgcagttgtgcttatgggaacgtatgcatttttcttcttcttttttctttttttctgagacaagatctcgctgtgttgcccaggctggggtacagtggcgcgaacttagctcactgcaacgtctacctcctgggttcaagggattctcttgcctctgccacccaggtagctggggttacaggcgcccaccaccacgcctggctaattttgtatttttagtagagacgggatttcaccatgttggccaggctggtctcaaactcttgacctcaggtgatccgcctgtctcagcctcccaaagtgctgggattaatgggcatgagccactgcatctgggtatgtgcattttcttaagaggagcattggtagatctcagagcttctgtggggcaggaaaagccatgaagtcctgccacaggactcttgggcctcacctctcagaggacgtctttgagcggaaggtggatgtggtgttagctgttgcaagtaagacagggacggtgtgtcctggtgtgctttgtgtcttaggttgagataagtcgaagagtgactctggaaaaactccctcctgtcctcgtgctgcacctgaaacgattcgtttatgagaagactggtgggtgccagaagcttatcaaaaatattgaatatcctgtggacttggaaattagtaaaggtaatgcatacataaggtcgggagtgttcgtggtgacacactcctgcacatcagaagctcaaccctgtagcatttctttatgatgtcaagagtgaggacattctcttgctggacgtggacttgttttaagtttcttgacttgtaatagaccttaatactaaaattctcatgaaaatggcctgttgaaaatagaggcaaaaataactaaactctataatcttactagattagaaaaatagcagcttttgtctatcaaaaagaacatcacttttctgtgaatatttcagggatgaatggtgcagtttgccttccaccgagtattaacagctgtgttgactagcccagttaagtggtttttagtgaagtaagaatgatttctcataggcagtgagagtcccttctaacctctagttgtggtggcgcacaaataagacgtggcacttaccagcctcaagtctctgtcaggtcacgggctcggcactttttgaaagcaattttaaagagccccaggttaaaggcatcttgctaaaagcacagcttcaagaagacttttcttgaaagctttagaatttgtgaaaacgtatagtacaacactgaggcttgattgggactgtgattagctagagaggattctcagaatatcgaggtgtttgggaagcagaaaagaggacactgggcctcactcctgggtcctgcagaggaacaaacctgaaccgagagtcctcttctctccgtcccctggcacagcaaccccacctcatacctccttccatatagatgacccaggaactgtgggcatggctggcttctagccggctccctgtctaccctaggggcgccctataccttcccgtgaagactcagacactgtctctcccaggcctgcacacaagagctgtgctttctgctgacgggcttggctgctgtgccgggtttagtgtccgttgctcctctcacacttctagctgccttatcactcatcagccgattgctttttaatcccatttgaggaccagcaagaggaagaaagatgccagtgagaatcatgtaacagatcctcctccccattttattctatccatcgggaaacctggaatgccggctaagtcaaagaaggcatcctcggcctctgctcctgcatcttcactcgcctccagatcagctgtctgagctgacttggatgttttgctacagtgattttatttttatatcttttcttgcttgctgtatttttatatccgctgccacctccaatacattatcaaaatatgacataaatgggggctgggcgcagtggctcacacctgtaatcccagcactttgggaggccgaggcaggcagatcacctgaggtcaggagttcgagaccagcctgaccaacgtggtgaaaccccaactcttctaaaaacacaaaaattagcctagcatggtggtgggtgcctgtaatcctagctacttgggaggctgaggcaggagaatcgcttgaacctgggaagcagaggttgctgagatcatgccactgcactccagcctgggcaacagagcaagactccatctcaaaaaaataaataaataacataaatgggggacaagaggacctcacttgggtcatgggtcagaagtacagatggctgcctcgaacagcatgcctccgacggactcttgtgtcggtgtaagtggtacttctgcgcacagtaagagcagggagttcccgcctcgtagcagctggtagactggttcctatttggagaaatcatgttactgttctgtaactgaagttttgttttgttttttttttgtttgtttgtttttttcttgctctgtcacccaggctggagtgcagtggcgcgatctcggctcgctgcaacctctgcctcccgggttcaagtgattctcctgcctcagcctcccgagtagctgagactacagccgcgtgccaccacgcccgggtaattttttgtatttttaatagagacgtggtttcactgtattagccaggatggtctcgatctcctgacctcgtgatcgcccgtctcagcctcccaaagtgctgggattacaggcgtgagccaccgtgcctggcctgtaattgaagttttatgatctgacgcatatgtaaaattttaattcttgccttggatttttcacaactgtttttgtttttaagtcagcagcttttttcttttccattttgtagagcacctgtttttaaggggcctcccacaggagcatcacagcctcggccgttgctcctgtttctttagtgagctggctgcacattttgtgtcctattacgtcacatggctcatttccttcatgagtcaatttttgtgcaactgaagggatagagtgttgttttgttcctggtctgacaggcagtttacttgctggggagaatgttgttagccattttctgctgctgttaccctgaacctttctaaaagtgcttcaagccattgatattttgttttccagaactgctttctccaggggttaaaaataagaattttaaatgccaccgaacctatcggctctttgcaggtgagtaaatttgtacgacattacttcttcattaaaacactgatgaaggggtttacagctgggcacaggtttgctgcaacttagcatagcgaccagatgctgtactcaggtatccctgtggccttgtgagtcggggagtcacgtgagagttttacctgaaactctgcgtagatgacggattatcatcttggccctgaggacagataacagaagaccttgctcaaagcgaacatttctgtctttgagtcagaggagggagtttcaggctcccaggctggctgtttgagaatgtgacctctcccggctgtgcttgtggcacctgtgggtgacagtgctgtggagtttccacgacacctggtcacccagccaggttgggtgagcgcgcccccagccggtgatccctgcgtcctcccccacaggtattgttagggctgcttgagagggtgggcccgattacacaagctcctcggctgccaggccctcagtcagtcatgagaaatctcccaacagggtgaatggcaccccctgttccctcatgggtggaccttgagacctcttctgtctcctggcttaggctccctgcagtatcattttttctgccacatcatcttccctttcctttctgccttcccttttatccttctttctcttttatagcgtcatcttttatgcctctgagtctttacctctttggattgttgctgtttgccgcacttttgtttgcttcccaggctgtttttactacatgtttctagcttctgtgtcttccctcctctggtgtggcctttggtgaacctgtttgtatcgtaacataacactgccatttattgaccttcacacatgtattgaacctcttcccaagatattctttcatttccttacatgtgtcctaggagatgggaggtgggatccctgttttataaaagaataaaccagaactcaaggaagaaaactcaccactctggcctgcagtggcagagcagggcttcaagctcctgtccacctcagctcacgcccgatgttttaggaagtttggcgagtgggtgagggcccagggatgggggcccaggggtgagggcctagcggtgggggcccaggggtgagggcccagtgggtgaggcccagagccacactgcaaggtgccaggcttccctctcttcctctcactattcattgttccttttgactctcttcttttctccccccgatcacaattcctcctcaacttgctgggcctcagatgggacggccatgggcaccacgcgcttgtgggtgtctccagccctgtctggaatggaaggtctgagtcctcagactctgcagccagccattatcctgcctggctccttggagtgtggcacccaggtcccagtgggtggccagcagtttctccgccttctccctgcacctcttcccctggaggctcttgcgggggacatcactgggcaggggcaggggctagggattgctcctctcctggtcagggccccagtgtgagcacacacacccctccccgactctgcaacctgcctcgccccgggacctgggcctgggttgctctcccctgccctcctgaatcctcatcccctaacccattatttttttgagatagagttttgctctgtcgcccaggctggagtgcagtggcacagtctccattcactgcaacctctgcctcccaggttcaagtgattcttgtgcctcagccccccgagtagctgggattacagctgtgcaccaccacatccagctaatttttgtattttgaatagagacgaggtttcgcccttttggccaggctggaagcctattctgatcttggaaatgaggtcaccggactggttagaattacctgtagagtgagcaaaggaacactttttaagaactgctgtgattgtggggcctgggagaagcaatctcgcgcacaagcttttcaggcggttctcagcgctcctgtcaggggggcttgcaggtgtgagtgacacacggctcagcccagggtagttaactgggctgctgcttatgaaactagaatggtgacatgcagtcccccttgacattttagaatggagatgtcttgtgggaaagacaagttagtaaaacccccaggccctgcagattctactgatggtcgctttgaagcaaaactcttagcccagtcagttaggtctgtgaggtgaagatctaggacagaagtctcaaagtgaacttgggatccaggggacatgctgctgtcatgggtgcttcctgccctttcacaagatggctgtgacttgtgcagcacaggatgaagctatgcccttggattggctgtgtccctggctctccgaagtacgggccccacagtcttgctgtccctatgctgttcagtctcctccggggtccctgcacagaggatttctttgtgcagagcccaggagtctgactggtggcctcagtcataagcactgtcctctagccagccaaggtccctggcccagagaggactgaggcctcctgctgtcatttagcccctccacgtgacaactgcgactagaacctggtgatgtttggtcttgttttagtgctgaaattccctaccagccaagtcttgcatctctcctggttccttttcttttgtgccactgatggtgggcgcagcttagcaggctgccctgtcattccccgcggaatgctgccggacagccgccttcccgaggctggtgtctgctgctggccaggcagacctgtgcccctctgctccatagaagtggaggatgtgttctgtggctgtcttaatgttttcatgacatcttctacagattttttgttttaggcctttgactaaggcttcttggttataggattttttttttaagtaaataactgtgtgtgtgtgtgtgtgtgtgtgtgttttgttctgttaaaacatagaaaaatgggtaattttttttaaaggcaaatgcgtaactaccagcaccatctccgcagtgccccaccacagctccacgctcaagcaaccgtggttagcagtcccagggtccctcctgccatgtgggccggcaccgggagattgtgtcccgtgtctttaggatagatgggccacagaaggcctaaggaccttgttttctcatttaatataccataagcgtattcccgcatcaccattcttaatctattccacgaaaaaataaattgtgttattttaatataatttactcatcagtcatttcttctagtggctattgaggttttccgttttttcactgttataaatgacatcataatctctgtccaagattcagataatctcttcaggacagtctagaagtagagtcagccacatccaagggcatgagccaggtctgtaggcctgtacagctgatggctgtgtaggagtgtctgtgtgaggcgtgggacattttaaatatgtggttaatatgcgtacatgcacacatgtacctatctgacttacccttaccttgcagttatagaaaagtttttattatggattgcttgcgtgtttgagttgaaatagcattggtttgtgtgatgacatctctctgtcccacctgctttggagaggggttttacacataggatgcatccctggagggaagtcggcggagacctgtaatgattcgtgtgcagtgctgttctcactctgctgcctgctgggctctcttccagtggtctaccatcacggcaacagtgcgacgggcggccattacactacagacgtcttccagatcggtctgaatggctggctgcgcatcgatgaccagacagtcaaggtgatcaaccagtaccaggtggtgaaaccaactgctgaacgcacagcctacctcctgtattaccgccgagtggacctgctgtaaaccctgtgtgcgctgtgtgtgcgcccagtgcccgcttcgtaggacaccacctcacactcacttcccgcctctctttagtggctctttagagagaaactctttctccctttgcaaaaatgggctagaatgaaaaggagatgccttggggttcgtgcacaacacagcttctgttgactctaacttccaaatcaaaatcatttggttgaaacagactgttgcttgattttagaaaatacacaaaaacccatatttctgaaataatgctgattcctgagataagaaagtggatttgatccccagtctcattgcttagtagaataaatcctgcaccagcaacaacacttgtaaatttgtgaaaatgaattttatctttccttaaaaaagaaattttttaatccatcacacttttcttccctaccctttagtttttgataaatgataaaaatgagccagttatcaaagaagaactagttcttacttcaaaagaaaaataaacataaaaaataagttgctggttcctaacaggaaaaattttaataattgtactgagagaaactgcttacgtacacattgcagatcaaatatttggagttaaaatgttagtctacatagatgggtgattgtaactttattgccattaaaagatttcaaattgcattcatgcttctgtgtacacataatgaaaaatgggcaaataatgaagatctctccttcagtctgctctgtttaattctgctgtctgctcttctctaatgctgcgtccctaattgtacacagtttagtgatatctaggagtataaagttgtcgcccatcaataaaaatcacaaagttggtttaaaggtgtgtgcgtgtttctttgaatgcgaatgccttttcgggtaactgaaattcatgggggcatgagtttgcctgcagaattaaaatctgcccttcgatcagctcgacgtgtttgtggaagctgaaccaccactcaggttatgcttgtttagtattttcaaatggattagtgatttgggtacacgaagtttttgactcttcgattggcagaaaggaggaggttttctccccttcccctcctcatcccttgtttctatagcccaccgttttcagtatcaccaaaatagttgctgtaggtcaaggctaaatgctcttcagttgagtgccactggggcggctgagcggtgcctccagacgccaccctcagtagtgggaaggaagccttctgagacggaagacatggagagagggatgtcacgtgcaagggtgcccgtgccccggcttctggccctgtgtggatgattgtggtgtcctgagatctacagagaaggggttttaacgtggtctgagcctttctctcaagttcttgctcttaccatctggtatttctgattgtagcctggtgccatctggggttcagagcttcctaaactttctgtacaagtgttgtccgtctaacctacttaccctttgtaattctattgtgatttgcttggctgaattataactcatattgagaggtgaagccagctggacttcctgggtcaagtggggacttggagaacttttctgtcctctaagaggatggtaaaatgcaccaatcagcactttgtagctaggattgtaaaacgcaccaaccagcactctgtagctagcaagaggtttgtaaaatgcaccaatcggttcttaaaacgcaccaatcagcaggagtctaaaagcagccaatcacagggaggactgaaaaaagagcactctgataggacaaaaacagaacatgggaggggacaaataagggaataaaagctggccgccccagccagcagtggcaacccgtttgggtccccttccacactggaagctttgttcttttgctcttcacaataaatcttgctgctgctcatagaaagatgcaagctagtgctagcgagacagcctgcaaaacccctgtgttgttttgggctgttaaccatagtctgagtggcttagacaacaaacatttatttctcacagttctagaggctagaagtccaagagcagatgccagcagacctgtctggggaaggcctgcttcttggcctggagacagccgcttgctcactatgtcttcacagggcagagtgaaccctggtctgtttctcttacaaggacactcatcccactgtgggcctccacctttgtgatttcatctatacctaaaaggccccacttcctagtattccgccgggggttcaggcttcaaagatgaatactgggggcgacacaaacggagcccataacctcatgccgcctgactcctgaggctgtattcgtgatgaacgtgtggctgcccaagttttgttttgctcaggcaggatcagcacacacccagccacagacagggaagcccagagcagggcagaatatggtccctcaagtgaataattggcccagggatacagaattaggtgattctagcaaatccagacattttctagggtgccagtgaattttgggtctgtccctgttagctgttcttgagattttgcactcaacttgcgatggttaatacggagtgtcaacttgattggattgaaggatgcaaagtattgtttctgggtgtgtctgtgagggtgttgccaaaggagattaacatttgtgtcagtgggctgggaaaggcagacccaccctcaatctgggtgggcaccatctaatcagctgccagcgtggccggaataaaagcaggcaggagaatgtggaaagactagactagtcttgtggcctccatctttctcctgtgctggatgcttcctgcccttgaacatcggactccaagttcttccgttttgggacttggattagcttccttgctcctcagcctgcagacggcctactgtgggaccccttcttgtaagtcaatactccttaataaactcccctttatatatacatctacctataggttctgtccctctagagaaccctaacgcacaacgtttccattttatgttgcaacgtttaatgtttttgtaagtttcatagtacggtctcctaactttaggttatttacttcgggaactttgctcattaaccttggtgctgaggctacagacttagtgattttccttcattatcatttaacatgcctttgtaggtggcatttaaagcagtgaatggttacatttttagtatgttatagggagattttcctcgcatttgtcagttgttgacaacaagacttggaagttctcttacagggaagatgtcatgaagtttacctggttggtatgttatttgtccactagccaaggaagcgcaagccactgtgtgtttgaggcaggatggagaatggaggtcattctggcctccactggtgtaactatggttcagccacccaagtggctcacagtggcattctgctttcatttctctctctctctcttttttttttttttttttttgagatggagttttgccctcgttgcccaggctggagtgcagcggtgcgatctcaggtcaccgcaacctccaccacccaggttcaagcgattgttctgcatgtgccaccacacccggctaattttgtatttttagtagagacgaggtttcaccatgttggtcaagcttgtctcgaactcctgacctcaggtgatccagctgcctcggcctcccaacatgctgggattacaggcgtgaggcaccgtgcccagcccctgctttcattgcttgatgtcattggtcataccatcctagtctaatgtgtgggcaacgtgagcaggaactttgcagtcagcaaaggcatcatcttagaatgtcttttatttggtgacgtttctgattattgctgtcatagactgcttatacttgaccaggccaactggttacaaagtgacaagcatagtccaagtcagtggcttttgaactatgggaaataacccaataaaccagtgagctagtattgtacagccaactcacgttcatgagtcaatgagaatgagcaagttgtagcagtgtggacacagcagtctcttggcttcatttctcttgggaagtgctgagtgcatcaaaagaactaaaaacagcaagagacagaagactcacagtttttctggtacttctctggctcaagaaggaaaaatatcttgactgagcctagtgaagacagtatctctataccaatttcctgagggtcagtggacttaaaagagattagaccaaaatgttagtgtttttaaaatccgtgtctagcaaggccaagtggtaatagccaactctacacgaagtgttttgtgtttcctttattgttttttgtttgttcgtttgtttgtttgttttctgagacagtcttgctcttgttgtccaggctggaatgcaatggcataatctcaactcattgcaaccttcacctcctgggttcaagtgactctcctacctcagcctctcgagtagctgggattataggcacctgccaccacaccagataatttttgtatttttggtagagacggggtttcgccatgttggccagactggtcttgaactcctgacctcgtgatccatacacctcggcctcccaaagtgctgggattacaggcatgagccaacacgcccggcatgtttttcctttaaaatcagtcacagcaaaagtcaccgagcagacactgttctgccttcttcagacattttctctggcttcctaggaattggggttttttttgttgtttttgtttgtttgtttgtttgtttgttttagtgttattcatcttttagactggccgttcccatcttatttgcaccttttggggaaaagttaacttgctcgaaaatgaaatgcacccgatggcatctgctggctttacctcatggtgatgttcctttatgaactagtgaccaaatgcttcattctcttttctgattgtttccctccctttgctcatcccccacctcagtaagacatgttacatcattttaatgagcaagtgtacatttttttccagtgggactcaaattgtacgtttgcttcttggtcgtacatgcattttgtttcacggatttagttgtgtctcctgttgttctgtggtcaggatacgggatcatttgctaggcactgatttgctgaacacagtagtatttcgttgagtggcccttccttggaaacaactggcaagtaagcaaacctggaaatcactgttctgtgctgtattttcagtaaagggaatttacacagcgcttgctgctgtgggatttgcaaactattttattttgactctaggatttcacacagtgatatgcttaagatattttttataattttttttttttttttttttttttgacagagtcccactctgtagcccaggctggagtgcggtggtgtggtcttggctcactgcaacctccgcctaccgggttcaagcgattctccctcctcagcctccctagtagccgggattagaggtgcacgccaccacacccagctaatttttgtattgttagtagagatagggtttcaccatgttggccaggatggtcttgaacacctggcctcaagggatccacccacctcgaattcccaaagtgctgggatcacaggtgtgagccaccgcggacgacctataaaaacttttatccctttcattttctcatagactcccgtttaagttcttgctctgttttgggggaaagtgtttattgtttgattttctaataacgaaaacattagagtagcttcatttatgctgcctgtttcaagccaatacactgctcagttgtgtttgtgtatttgaaaagtcccctgataggaactttctgaggggtgcctgtgttgttggcacatttgagaactagacaaaatctaactctgtgtcttttttctttctttttcccctattatttggttttgtttttttaacaacccctctggagtgtgttttggttcatgggatcaggccacgtgccctggttttcgaggtatagccttggctttcttgggtcgggtctaataaccctgaccttggacttcccacgtgtccttcaaagaaagcaattatttttgcctattttctgagtatgatggtattctccatttgatttaacaaaaaaattcttcctctgctttaaaagactgaaagcctccctgtaaggtgctgattgccttccagatctgaggaccccgtctctgcctcattcctcctgtttccatcagaagacacaggtctgggactcagcgcagctgacctgtctgtccctctctgcacaggtaaccacttatttattgctgcttaaagtagagcttctgatacccatggggctggcaagagaccctgacattcttgtcttattttatcacatacagtttactcctgggctctgcagagagaagtcagtgcctcaattttccattgaaatatgcacccttggcatcctggcaggtgagcggcgcccccttagggctaatacagtgacataaaatgtgtcatatttttggctgtgtggtggctcatgcctgtgatccccacactttgggtggctgaggcaggctgactgcctgaactcgggagttggagaccagcctggccaacatggtgaaaccccatctctactaaaaatacaaaaattagccaggcatggtggcatgcacctgtagtcccagctacttgggagactgaggcaggaaaatcccttgaacccgggaggcagaggttgcagtgatctgagattgcgccactgcactccagcctgggcgaccgagtgacacttggtctcaaaaaaaaattaattgtcatatttttgaaaaagtatattagctttgcaatgagtaaagttcactctctaggaagatgtccctgtttcctgtggctacaaatgctccctgccacactgggaggccgcacctcactgcgccggagtgcagtcttcagtggggtcctctgctgtgaccgaaagaagggtgcagccgggcctgcttccaaggctagggtctgagacctggagtgtgtccatggatatcagatgttgagctacaggggaccggcagcccacagcagcaccctcggtggctaccttagggtgttcctgtgggcctccccccaccagcacctccctccagctttcctgcctccatcccccctccaggacacttcctcctctggctaaaggtttggcacctttcatttgagagagattaacagcaaacacacagggctttctgcaggccagggctgctgctgagcttttgccaggcatttggtcctctgccaagcccatgcatagtttctgtctacattgtgcagttggggacttggcacctgcccagcacctatgcttggggcccctcctctgtgctgcaggcgggtgttcacaccctttcatacccgctgtcatctccctgcagcccaccctgcttgacgaggtcatcactggtgcttaggagtaaactggaatggcagacagagcccagtggatattgcagaggaacagaaggaaaaagatgtgcatgacgcctcagtgcttgcagcattaaagcaaaaaaaaaaaaaagagcaaagtagcacagtgattaaatagtcgggtgcctgcattccatcctcacctgctgtgaaccagccacatgaccttggacaggtggcctggtgcctcctctgggtagtggctgggagtggcactgtcacctaggccctgtcacctaggcccaggggcaggagtaagcaaggtagcaggtgtgatccattagcacagctgatgctcagtcacggtggccctggcactcctcagagggcccctgccatgcctgggggaggaggggctgcagtccgtgcccagtgaatgtaccacctgcctgacatcgcagcgtccactctggcagatgcgacaccacgcctagtgaggtctgaacagggaccctcagcagtgcgcccacaggtgcacatgagtgatgaccatagctgcccgctggttgtgccctcctgggcaggaagcacaccagggagccctggcagagcaggcccttagggagcacccaggagggcctggggctggggcctcgattctgggcagccagccttcgggaccttggtcacgcgcctacctggacctctgcccctgcctgccctatccctcattagaatcccagccctcctggctgttctgggtactctgatcaagccagacagtgctagttcagcactgagagagtgtgtcctgtctggtcagggaccaccagggtagacagacattcactcctaagttcccaccgaaaaacagcacgagggtatattgggcaaccaggtgaagactgttccagagccagttatcccagaggagctaggaagcctttccctctgctgtcttccttttactcagacacgtcctccagagctggctgcatgtgcattccctctgctttcctggaagtcccctcctttccatctacaatgggacttttaaaaatactcacagtcactagtgcacaagaagaaccattcaaagccggcatccaacctcagatttgcagcaacctaagatttgtttgcaaaggaatagaacgataaagcttcaacccacccacgtttataactgagaagaaaacacacacttcatttggtaaatacagcaaacaactgaaagtatgctttgactctgtattgaggccagttaggggatggaaagggtgaggctaagcaggtaaaggaaatggaagagaaggtcaggagaaggaaaatgtgagctaggcaggcggctcatgcctgtaatcccaacactctgggagcccaaggcaggaggatcatttgagtccaggagtttgaccccagcctgggtgaaataatgagactttgtctctactaaaaaaaaaaaaaaaaaaaaagttaaaaacagtaataaaaggaaaatgtagaggggagaagcaactgagaagagaggggagagtgagaaggaatgagcagggaggtggagggcgtgggggtggctttgttttggcctcatctttccagggagacagccctgtggcgatggccaggccacgatgctaggctgctcttggtcattaccagcccctgaaatcagcgtcctcaaccctagccctgtcatctctgctgggagtgggtctctatttcttttctgcaatttacatttaaagcagagtttaccctggaattctgaaggtttcggtgttgaggtatggtttgcattttagaaattcattttggaaatgtgaagatgtcttctatgcggcttgaaagcccgtctgacgttcacaagctgtatggctcaggtcttcagtgcctgaaggttatacagcaaacccaccttgactttgacttcggagtcttttcctcctgaagccaaatctgtttcagcattctggtctcgttaattctcatggtgacagtatattaatatgagccaaagagaaaataaaattcactgaaagaaaataaggctgagcctcattacgcctgtaatcccagcactttgggaggccgaggcgggtggatcatctgaggtcaggagttcaagaccagcctggccaacatggtgaaacccccgtctctacgaaaaatacaaaaattagccaggagtggtggcacacgcctgtaatcccagctactctggtggctgaggcaggaaaatctcttgaacctgggaggctgaggttgcagtgagctgagattgcgccactgcactccagcctgggcgacagagtgagactccatctcaaaaaaaaaaaaaaagagagaaaatgagaataaataagcagccattccacctcttgggtcaaagcttccaaatttgctttttctccaaggagtggcagccacagcaaaacatcttctgcagcgtctggccagggcgttactccagcccagttttgccctggactagattgagtcaggtcgtgcatggaacgcaagcacaaaccacggtcagctcctcgagactgacccactggcccactgagcagaggagcccctgggtctctggacgctgcccagttgttgacatcctgaggcaggtttgcggctgatggagcaacagggacgggctgggcccggcacctttttcacggaaatgatgagctctggacagcagtgatgccagggcccataaagcctcaggcgcccgtcattgctgctgcctgcgtgtgctcgctcaccgcgacggcggcgggctggaggaagctgtgcaagagccaagtgtctaccatgagtctgcatgttcatatggttcagatttgccttggaatccccgcgagccaaactctttcatttcacttagtaaaagggatgcattgactcagatgttctgtcctatttaaatgagaggggcgcgggaggtgatggaacacaaaaccatgagccatggctttgctggggaatgctgtggatctggtgtgtgatagagagagagtgtgtgtgcgtgtgtgtgtgtgtatggcaaagtgcacaaatcgcacgtgtacacctcagtggctttttacacatttagacgtgtgtaagtgtatagagcatttccacaccccagaggccccgagctcactccctcccgctctccccatccctgacgctaacctgatgcctgttgtcgtacatcagcttctcaacctcggcactattgattgccatttggggccaataattctagggggtggtggctgtggtgggcactgtaggatgtttcctgtgtccctggccctgacctactagatactagatgcacccaccctctccatcgtgacaaccaaacgtctccagacattgctaaatacaccctggggacacagtcaccctggctgagaaccagagcgtgggtcactgtgacttccgcgcttcctctccatggcatcgcacggtgccatgtgtcctgccctccgtgttcttctctctacgctgcttctctgaaatccctccagcggtggcgggtgccaggagttagttttgctttctcactttggagtaatgttgcattttatggatgtgccacgatgtgcttgtctgttccactgcggatggcatctcttgttgcagttggggctgttaagagtgttctcagtgtgccttgtggagggcttgtgtcctttctcttgggtgcatcctcctgagtaggactgcagggtcccaggcaggcgcctattagcaggagtggccaccattgcacagtgctcccaattccattcccacaggccacctgagagtcagggagcttctgtcacaattttaagtgctgcaggattaatgcaaactttctgatgtgcttcaagttgctttgtgttgaaatggactagaggggatttaagctcacagacatatatccagagcatgcccactttgataatgctatcttcactaataaattattctcaaaacagcaggtacttgcagttctgaactagataaagccctttcctttccatctactcactgagtcatcaggtgcctggctgacagctgacgctaagtcttcacaattaaccaagtctctgggcgcccctcaggctttaacatgaggacacatggcagattaatcacgaagccccacctctcatttcagctgccatgaatggcaattcccaaaatgcagggggagaaaaagactggaaggaaatgtcgtggtctaaaatatcaccaaaagttgtctttgttttatttatttatttatttatttattttgtttgagacagagtctcactctcccaggctggagtgcaatggcccaatatcagctcactgcaacctccgcctctcaggttcaaatgattctgctgcctcagcctccggagtagctgggattgcaggtgtccgccaccacgcctggctaatttttgtaattttagtagagacagggtttcaccatgttggccaggctggtctcaaactcgtgacctcaagtgatctgcctgcttcggcctcccaaagtgctgggattacaagtgtgagcttggcctccaagggttgtctttgtgggattgtttgccctccatctgtttgtctgtgtattcccagttttctgcaatggacagtttttacgtttcaaacgggaaactcttttctccttccgtgtctccatgcaagcccagagacgccagcatcatgtctgtctcccatcctccacttctctgacgaccaaaggtcctgggttctctgaggcctgcgcctgggccttgttacaacccagcaggcttatcttgattccagtaattgagaggcacatttgccaagtttatataccctcttgaaactcaagtactggtttgtggattaatgcgagattcagttgcatgcatttgaaatgcaagcgtctaattccgcgtgtaaaatacggggccacagacctcttgggcattgcacaccattccattcagatgagcgcagcaaaagcaaactgtaacccctaggattaaattctcctttaaatactcacgggtttttagcttcgggggaaaatatgtctgggaaaaatatcttggggtttcatcaaacacttggaaaataatctgaaaacatttttccaaaccctccatgcctccagcctgaatcctaattgatagttaataactacatcgacagaagccttctcactctatcacgattactggaaggctaaagagacatctgtctggagtactgggagtgaagcaaggatctcaggatcaccaaggatcttgtctggccaaggtctttaccacacaaacaagctttttttcacccccggaaatacttgccccgagtccactgtcaaccattaccagaatcagatctcggaccaatcgcaagtgtatttatgtattcattcatcaaacacttattgagccccaactctgtgccaggcattgcctgtacttgcagggagatcaaaaatgaaaggaggtgagcattttgacagctcttgtcttagagagtttgcagccagtgggagaaagcaagacatcggtaactgggaaaaggcaggggtgctccgagtcacagaacagagcccgtggctggcagagcccggaggagggtctggctgggcagtagatgttgaattctatttttttcaaaatcatttttttctattccagatcctttgcttttccacatcaatttttactatctacaaaaagtcatgctggaattttgacttgaattgtgttaaacctccacatcaatttggggataatttacagcatagttacatttgagccctccaatccataaacacagtatatctctgtttttaggcctttgatttcttttgtgagcattttgataaagcatacagatcatcctcaagtttcgtcagatttatacctgagtatttcatttttggagagctgttgtaaatgggtttaacatttttatcatttatgtatttttcattgctagtatatagaaatatgatttttttttgtctgttggccttatgtcctgagatcttgttaaactcattatttcaataagcttttttgtttgttcatttggacagcgtcttgcttgagcctcggagtttgaggccacagtgagtggtgccattgcactccagcctgggcaagagagtgagactctgtctctaaaaaaacaagtaaaacataaaatacatttataaaaataaaaaaaatcgatcaatgtaatccatcatattaacaatctgtcacccaggctggagtgcaatggtgcaatcacagctggctgcagcctcgactttccgggttcaagcagtcctcccacctcagcctcctgagtaggtgagaccacaggcatgcaccaccatgctcagctaattttttttttggcagagatgggggtctcaccatgttgcccaggctggtctcgaactcctgagctcaagtaatccaccaccttggcatcccgaagtgctgggattacaggtgtgagcccccacactcggtccagcctaagctttttaaatagtttccttaagattttctacatagagaattatgttatatgcaaatatggacagttttattctttcctttcaggtccatgtgccttggatttcttttttcttgttgtagttcattggctgggcctccagaaaagatgttgactgggaatggcaagagtttataaattgtcttttcatgacctcaagggaagcattctctttgcccatgaagtcagtccgttgctagctgtggagtttttatggataccctttataagattatggaagccgggcacggtgattcaggcctgtaatcccagcactttgggaggccaaggcaggtggatcacctgaggtcaggagttcaagaccagcctggccaatatggtgagaccctgtgtctgctaaattacaaaaaattagccgggtgtggtggcgggcgcctgtaatcccagctactcaggaggctgaggcaggagaattgcttgaacctgggaggcagaggttgcagtgagctgagatcatgtcattgcactccagcctgggcaacaagagtgaaactctgtctcaaaaaaaaaagattaaggaagtggccttctgctcttgttctaccctggttttctgagagttttttttttttttttttatcatgaatggatgttgaactttgtcagacttttttctgcgtcagttggtatgatcatgtggtttttcttatttagtctgttaatatgatggattaattgatagtttttttattgttataaatttatttttaaatttttctttagagacagagtctcactctgtcgctcagactggagtgcagtggcaccactcactgcagcctcgagcacctgggctcaaggaatcctccagcctcagccccccaagtacctgggactacaggtacatgccaagctcacttttaaaatttttttgtagagatggggtcttgctgtgttgcccaggctggtctcaaactcctggccacaagtgatcctcccacatcagcttcccaaaatgctgggattacaggtgtgagctactgcacgcaagtttgattgatttttaaaaaatgttccaccagccttgccttccccaaataaaccccacttggtcatggggttgtatgacctatgaccaaaatattagcaaatatatatattattgaatacaacttgctagtagattggtgaagattttcatgtctatgttcctgatggacattggtctgcatgcatttcttttcttggactgtctttgtgtggttttggtatcagggtaatgctgtcctcataagatgaatggggaagtatcctcttctcttttattatctgggagacattgtgtagatttggttgtttcttctttagctgtttggtggaatttgccagggaaagcatctgggcctgaagatgctctttgggaaggtttccagctgcgttgaggtttaggctgggagggaagagcctgggagctccgaaggctgggaggtacccgagttctgctgccttccccaatctgtctgctgcgtgtactctccagaggccctcgatggcagctcccgcactctcttcagggttttggttgcattcagtggcagatgcagggtgagcaggacaggacaggcttatctattctgtggagccaaacctccatagtttttattttcataacaccaacctgtgtgggagccagtggctgagagcattgcagggctcagcacatcctgacatcacagggacccgggaaggcagccgacctccatgcaggaacttcctcctctacagcgtcacacaggagtcccctccaaggcctcagctctccgaggcacatgcgtgctcctcaccttccatttccatttcgcgtgttttgctggcgtcagtgctgctctccgttggaaatgcgggagccgcccctagccatgttacacgtggagaagctgcggtgccgggaggaagaaggcggcgttaagtgggcagagctgagagtcactcctggactcctgcgcttggggcaccacgcactgatctgagtggaaccccagccagcccgaacaatgctgggagggcactggggctctcggtcagcagggccccactcatccagggagtcaaagtgcttgggtgaagcgcgcacagccaagaatctatattctaaatattaatatttaatattaataataacaataacaagagctcctatggattaaacgcttgcacactgaccattaagcacttagcatttatgaagcacttcctacgacctctccttcatctcgctgcggccctgcgaggccgatagtgtttattattctcatttacagaggaggaaggtgagtcctggaggagggaacagactcccggggacacacggcaaggattccagcctgggcccattttggtagcgctccctcacggtgacagatccagccagtgcgccagcagacgcccttcacggaaacctcacgtaaaggctgagttagtgctgtctcagacgactgcagcggcgtggtgggaaacgtcagtaaagaacggtttccttgaaaagtctgcacatttatagtgtgttgttttgattaggaattctgggaaggcagagacgtccttctgcgtggacagctgccatccctcccgctctgcaacgctggctcctcctgaagatggagcaggattgcgtcactcatgggaactttctaaccttctcttcagctgacctcctctgtgctttgggaagccagactgactcagagagttccgtgtccccaccccttccttggtgctggaaaggaggtggaaactcctcaacttcctgtcattaggattcatctcggaaatctgccacacagggctaccccgggaccctatccaggcaggggggtgcgtcagaagcacttcacccctgcaggtgcaggcacacttactctcttattggagacactgccttgccttgtcacccaggctggagtgcagtggcactatcagggctcattgcagcctccatctcccaggctcaagtgatcctcccactacagcctcccgagtagctgggattacaggcgtgcaccaccacacccagctgatttttgtctttttggtagagatggggtttcaccatgttggccaggctggtctcgaactcctgacctcaagtgatccacccgccttggcctacccaaagtgctgggattccaggtgtgagccaccacacctggccaattcctgtacccattaaaaactcaagaaatctttgcctaacccaagctcacaaatgttcttctgtgttttctactagaagttttatagtgttagcctttacatttaggtatctgatttgactgagttaacttttgtgtgggaggaggtagagatcgaaggtaattttttgcatatgaatgatatccggttcttccacgtgttgaaaatactctcctgtccccattgaatttgcctctgcgccttgcgaaaaaattgaccatgtgggtctatttctagactctgtattctttttgttttgttttgtttttgagacagtcttgctccgtcaccgaggctggagtgcaatggtatgatctcagttcactgcaacatccgcttcctgagttcaagaaattctcctgcctcaacctcccaaatagctgggattacaggcactcgccaccacgcccagctaatttttttttttttttttttttttttttgtatttttagtacagacgagactttgccatgttggccagcctggtcttgaactcctgacctcaggtgatccactcaccccagcctcccaaagtgctgggattacagtcatgagtcactgtgcccagcctcctttttcttttttttttttgagatggagcctcgctctgtcgccccaactggagtgcagctgtgtgatctcggctcactgcaacctccacctcccgggttcgagctattcttctgcctcagcctctggagtagctggtactacaggttttgctaccacgcccagataatttttgtatttttagtagagacagggtttcaccatgttggccaggctggtctcaaactcctgacctcaggtgatccacctgccttggcctcccaaagtggtgggattacaggcttgagccaccgcgcccggcctaacagctttacagtatgtaaagaaaaaactgatagaactgaaaggagaaatacacaaatccaaatgacagttggatatttcaacactcctttctcactaattgatgaaataagaagacggaaaaccagtaagattatagaaagcttaaacaaacttaccaactaactgacctaattaacctttatacaatagtccacccagtattctagaatatacattcttttcaaatgcataagataatcacttggaccataatctgaaccaaaaactgtatctcaacaaattttaagagatcaaaatattataaaatattttcttggccaggtgcggtggctcatgccttaatcccagcactttgggaggccaaggctggtggatcacctgaggtcaggagtttgagatcagcctggccaacatggtgaaaccctatctctactaaaaatacaaaaattatctgggcgtggtggcacaaacctgtagtaccagctactagggaggctgaggcaggagaattgatcatgcctggaatcccagtatgttggggggccggggagggaggatcacctgagggtgggtgttcgagaccagcctagccaacatggtaaaatcccatctctactaaaaatacaaaaattagcagggcatggtggcaggcacctgtagtcccacatacgtggcaggccgaggcagaagaatctcttgaacccaggaggcagaggttgcaatgagctgagatcatgccactgcactccagcctgggcaacagagcgagactctgtctcaaaaacaaaacaaaacaaaataattagattataaccctaggaggattcaggaactctcttagctagctttgtaactgttctgtaaaacctaaaattattccaagtttaaaagtttaccaaaatcagtcaacataattcatgatataaacagactaaagaagagccatgtaatcatttcaatagattcagcttttgacaaaattcagcatccattcatgagataagctcgccacaaactagagagggaaggaaactgcttcaacctaacaaaggacatttataaaaaaaaaatccacagctaacatcataattgatggtgagagactgcacgctcccacccatgtctggagcaaggtaaggacgtccactccaccactactactcaatgctgtaatggagcctccagctagtgtaataggcaagaaaaagaaataaaaggcattcagatgggaaagagagaagtaggactctccttatttgcaggcaacatgaaaacctaggtagaaaatcttgtggaatctacaaaaaagctccctgaactaagaagtgagtgtaggctgggcatggtggctcacatctgtaatcccggcactttgggaggccaaggtgggaggattgcttgaggccaggaattcgagactacactggccaacacagcaagaccccgtctctattttttttaatttaaaaatgttttaaaaagtgagtgtactaagcttgccagataaaagatcaatacacaataatcaattgtgtttgcatatgccaaaaaagaacaattgtaaaataggattttaacaataccatttacaatagtataaaaatatgaaatccttgggctcaaatctgacgaatcagcgtaagacctgtacattgaaaactacaaacatacctgaatgaaaggaaagacccaagtaaacggataaatacactgtattcaacaagccaggatttgagggtctccccagagtgatctatagagtcaatgcaatcccaatcaaaatcccagcagctttttttttttttctggtagaaattaagtggattctaaaatacctatggaaatatgaaaaaataaaacacagtcgaaacaactttaaagcatgaccgaagttagaagatttacagtccccttcaaaattgttataaaacttagcaacaccgcatggtacttgtattgaggtcgataaatagatcaataatatagaatgctggccaggcacgaggcgggcggatcacaaggtcaggagatcgagaccatcctagctaacagggtgaaactccgtctctactaaaaatacaaaaaattagccaggcgtggtggcgggcgcctgtagtcacagctgcttgggaggctgaggcaggagaatggtgcgaacccgggaggtggagcttgcagtgagccaagattgcaccactgcactccagcctgggcgacagagcaagactccgtatcaaaaaaaaaaaaaagctgtattatttggcatgtatacatttaggaattttctatatccttgatgagttggcctttttgtaattatgacaaacccatctttatccctggaaatattcctttgtctaatattaatatcaccactccagctttcatttggtgagtataagcatgttgcatggtatacatttttccatctctttacttttaacctatttatgtctttgtagttaaagttggtttcttgtagacagcataccgttgggccttgctttttcatacaatctgacaaccttacattatgttggaatgtttagaacatttacatttaacataaatcaatatagttgggttaaaacctgctatcatgctatttgattttcaatttgtcttatctcttctttgttactttctccccattttcttgtcttcttttagattagttgcattgcctgtctgattccaatttatctatattatttgcttgcagatatgtaaaaagttgaagtttcattagggatatacataaaatagatgatttttctaaaataatgaggccaatcatgagatgactcattaaggaaaagatcaattgaaaaatgcatgtttggaaaaaaattgcatgtttggacttaccttcagttatcattaggaaacagaataaaacctagaccagaagttaagtattttttttttcctaagctcacaattatagtttctatgatttgaatcatcagaagagcaaacttgataatcctggaaatttaggagacatgaggtcatggaaggtcgtggaaggtcctgaaggtgagtattctgtcaggaacggtgtgttcgccttccttatgctcctgctaagccctctctctaaagttgtgtattctgctcgaaaacttcccttgccagaggatacttttcatgaataaatgctctccagttcttgtcattgctaagtacagttcttgggttactttgcatgtctctccaatatcaatttgatggagtgtcttcgaggaactggcaacgtgccaaacactatatgcagggatttgcctacattcaatcatttaatcctcccaacaacactgtgagactgacaagattcttagctcccctccatggctgatgaagtggcatctcagtgaactgaaggaagttgctggaattccaacctgtgctgtccaattaccaggcctatgatcttggcccctaagctatctttgggagggcctgccagtgcttggatttcctgtttctgtctctttccctgctggctgaagttaacaatcagtatttcacagggccctctgaaatttccttccccttcaaatatcagccttatgctggtactggggatacccagggagtgagacgtggtctccagcttatagatgctcgaagtaaaagaggagatggaacaattgtcacagttacctattgccacggtgatgctgagtaacaaaccacctgtaactctgtggctttattcttgctctctgtctgcaaatcatctgggaaaatggggtggggtggggtcacctgatctatgctgggctcaagctacaggatggatccaattctactggacactttgttctgtgacccgtggattgcctggggcattttctccttgtggccatggcggaagcccatcaatcaaagcaagtcacatggctaagctcaaagtcaagaggtggaaagtactctttgcccaccacgaggccatggtagaccccaaggccattgggctgtagaacagacagcagagtggagaaccagaaccgataattcaattcacctcatttattttaacaggtgagcaaagcaatttgcatgacagcaagatgttgctaaggaagacaaaagatagaagcaactgcctaccttgccaaccacatgccttcacagaggaggtgatgtcggtgctgggtcttgaaaggtggggtttcccaggtggagagagagcatgtgcaaaggtccagtggcacaaaaggcccctgtgggctcagagagaaggaaaaagcttagtgctactgatgtgtagaggggtgcatgtgcttgcaggtgggtggggagggtatggggcagggagctgggtgcagtagagagagatgaacccagaaagttgccagtaatgaagataactaaggtcattaatgggcagggaagtgtctggtcaggcttgggttttcaggtaatgattctggctgcaaagtggagaccagagaagaggaacaattaaaataattaacatgtgtaggtttttctttaaaaaaaaaaaaaaagaaagaaacagccaggcattttacatgcctaatttgaacctcacagcaaccgagtgaaataggcattattggctgggcgcggtggttcacgcctgtaatcccagcactttgggaggccgaggtgggcagatcactaggtcaggagatcgagaccatcctggctaacatggtaaaaccccgtctctactaaaaaaatacaaaaaattagccgggcgtggtgacgggcgcctgtagtcccagctacttgggaggctgaggcaggagaatagcatgaacccgggaggtggagcttgcagtgagccgagatcgagccactgcactccagcctgggcgacagagcgagactccctctcaaaaaaaaaagaaataggcattattaattttaattttagcataaaaagaaatatatttgcattcatttaaaaatctttcctcattggccaggcttgaccagctgggagctcactgtgctcaccctcagggaatgctaacttttttctttttttttgagacagagtctcattctgtcacccaggctggagtgcagtggtgcgatctcagctcactgcaacctctgccttcggggctcaagcaattcttctgcctcagcctccccagtagctgggattacaggcatgcgccaccacgcctggctaatttttgtatttttagtagagacggagtttcaccatgttggccaggctggtctcgaactcctgacctcagatgatctgcctgcctcggactcccaaagtgctgggattataggtgtgagccaccgcacccagccagaacttttagtgttgttgtttgctcctgaagcacggaggttgatgttctcagccccattccccagatgaggaaagctgagccctggagagcctgaggaacatgcccagcgtctcaagtgaggaaatggtgggctaggatccaaacccaggaggtgggcagctggccactgggccacagcgcctccccatagggtgagtccagagcccccaaccaaaatggcggatgggctgcaggagaaaggagggactgatgtggcttctacctgcgtcaagtggaccaggtgtgggacgagtttcaggggagcaggaagggaagagaggagtcaagaatcctcgactggctgggcgtggtggctcgtgcctgtaattccagcactttgggaggccgaggtgggtggttcacgaggtcaggagttcgagaccagcctgaccaacatggtgaaaccccatctctactaaaaatacaaaaatgagccgggcgtggtggcacttgcctgtagtcccagctactcaggaggctggggcaggagaatcgcttgaatctgggaggcggaagttgcagtgagctgagatcacgccactgcactccagcctgggtaacagggcgagaccctatctcaaaaaaaaaaaaaaaaaaaaggagtcctcgaccatgccgtatgcttccagttacagaatattcttgaacaggcaagcaagtctacagcaaagcaacagaaagcagatccatggttgctgggggaggtgggacgcagatgggcgtgatgggaacattctgtatcatggtggtagttgggcgggtatagacatctgttcctcatccagctgtccacttaaatgggtacacgtgcttgtgtataaaccccaccccctgtaaggttgatgttaaaagtgcttctgaggcctcctattggtgacattgcccaggtcggtggacgtcaggggatcctatttcttagaacacagggatgtctttccgtcatttgaatttctggctagccgacctttttcctcctcagctggagcccctacctgcctcgggggactaggaaagcttagcagaacctcagcaggaaagcaacttgtttagcttttagagttctcagtgagaccagagccctgggaaggaatgaagaggggaacggggttgcccacatcctttgcaccccttttgcatcaagagtcaggcccgtggtccttggcaaactcacgcaggaaccgaaaaccaaataccgcacgttctcactgataagtgggagttaaacgatgagaagacatggacgcatagaagggaacaccacccactggggcctgtcggagggtggagggtgggagcggggaggggatcaggaagaagaactcatggatactgggcttaatacctgagtgacgaaatagtctgtacaacaaaccctcgtgacacacgtttacctaagtaacaaacctgcacatcctgcacatgtaccctggaaattaaaagttttttttaaaaaaacgattgttttacaaagtcagtgaaaaaagggccaggcgcggtggctcacgcctgtaatcccagcactttgggaggccgaagcaggcggatcatgaggtcagtagatcgagaccatcctggctaacacggtgaaaccctgtctctactaaaaatacaaaaaaattagccgggcatggtggcgggcgcctgtagtcccagctactccggaggctgaggcaggagaatggcgtggacccaggaggcggagcttgcagtgagccaagattgcaccactgcactccagcctgggtgacagagcgagactccgtctcaaaacaaaaacaaaaagaaaaacaaaaacaaaaaaacaacaaagtcagtgagaaatttaaaagaaaaaaaaaggtcaggcctattgaacttcaaacttattatcagccagaggggatggaaaacccagtgcctcatggaaggaacaccccaaacataagaaggtggaaaatcctccctcccagctccagcaaggtgagcggacaggtgaaaaagagcttctgcccctggtcgggaccctggagtcaagggaggaggcagattaaggaggaggctgagagcgaacgtgttacgaggcagctccctccagtgcaaggtggaggacagccctcgtgcacagtggagcagccccagcctgggtgactccccaagccctgtaggccgatgtggcccggtatgtccaagcttgctggagtgggttaactggtggcccccagaatgatatatccaagccctgatgcccagaacccgtgaatgtgaccttatttggaaaaagaatctggctgggcacggtggttcatgcctgtaatcccagcactttgagaggccgacacaggtgaatcatctgaggtcaggagttcgagatcagcctggccaacatggtgaaaccccacctctactaaaaatacaaaagttagccggacttggtggtgcacatttgtaatcccagctactcgggaggctgaggcacgagaatcgcttgaacccaggaggcggaggttgcagtgacccgagatcacaccaccgcactccaacctgggtgatggagcgagaccacatctaaaataaataaataaataaataaataggctggctgcgatggctcacgcctgtaatcccagccctttgggaggccgaagtgagtggaccacaaggtcaagagattgagatcatcctggccaacatggtgaaaccccgcctctactaaaaatacaaaaattagctgggcgtggtggcgcacgcccgtagtcccagctattcgggaggctgaggcaggagaatcacttgaacctgggaggcggaggttgcagtgagccgagatcaggccaccgcactccagcctgggcaacagagtgagactctgtctcaaaaaaaaaaaaaaaaaaagaaagaaaaagtatctttgctgtaatcaatagaaggtcttgagatgaggccatcctggatgaccatgtgtgccctaagtgcaaccatgaatgtccgtataagaagagaagaaggctacgcgaggacagaggcagcgatgggagtgatgcggccacaagccaaggaacacctggggcccctggaagctggaagaggcaggaaggatcttccctctctccactctgcagacgctttgatttcagaccgctggcctccggaaccgggagagaacacatctctattgctagccacccagtttgcagcagtttattaggacatccccgggaaattaatcacggctcctgtcatgtaaaaagatcggtgggtgggctccgtctttgcctctctgcaaaaccgtgaagtccctaaacttccttcccactcatctagggggagaggagaggaaggagggaaagagcgagggccctgagtggctctgagtgcacatgggtgggctagttgctgcagagaccactgcaaattaacagagatgatatagagagactgaggctgagcatggtggctcacacctgtaagcagcactttgggaggcagaggcaggcggatcacttgaggtcaggagtttgaaaccagcctggccaacacggtgaaaccccatctctactaaaaatacaaaaattagccaggcatggtggtacaagcctgtaatcccagtacttcgggagtctgaggcaggcagatcgcttgacatcaggggtttgaaaccagtctggccaacatgataaaaccccgtctctactaaaaatacaaaaattagccgggcatggtggcacatgcctgtaatcccaaatactggggaggctgaggcaggagaatcacttgagccccgaaggcggaggttgcagtgagctgagattgcaccactgcactccagtctgggtgacagagtgaggctccgactcagaaaaaaaaaaaaagaaaccaagagatgtcctgttgtcaaggttaagtactaccccacccctcaactgccctgttagggaaaataaggcagttgcattttcagacacgcaagtgggacccgccgagattaaaaatgcaagaagcagcggttcacaggatgccgaggatgactggacttcctgtccaccccctgggcctggccagagcttctgcaggcacttcaggctcccctgatggtggcggtgatgccgtgggtgctcggggacagtgggaatgcagtgacaccactcgggctagagaaccccccggaggctcttgcattggtcgtcctgggccatgcacagcctggaactggccgctatccaattttgcatctgggaagtgttcatcgattgctagaaaaataatcaggtcgaacgcaggccatttccggtaaagaggctctagggaagcaccttcaggccagatgactcaggactgtgcggagtgtgtgtggtctgggagccggctgcctgccgggcccgggtgctctgcagggaaacagttggctgcctgagggctcattcatggctgtttcccctggaagggcggcgcaggagcccggttctgcagccctgccgacgccgtgtcacagacacagctcttcatggatgcatctggtttcccatggctgcggtaacaagtgaccacaaggttggcggctggaaacagcttaagtatcccatcttacggttctggaggtcagaagtctgagatcggcatcactgggctaaagtcaaggtgtgggcggggctggttgctcctggaacctccaggggagaatcgtctccttgacttttccagcttctagaggctgcctgtactcctgggctcatggccccttcgtccatcctcagagtgcatcactccaacctcggcttccatcatcacagcaccttctcttctgacgctgaccctctggcctccctcttacaagggaggcttgtgattccgtgggggccacaggagaattcaggccgctcttcccatgtcaccacccttagcagaatcacgtctgcagaggccccgttacaatgaatgctgggtccaatcgcgtttcccaaaaatccatgtccacctgggacctcagaatgggaccttatatggaactagggtctctgcagatgtaatcacattaagatgatgtcacactcaactaggatgggccctaatctagtgcctgatgtcttcataagaagaggaaagtttggacacagatgcaccgggaaggtggccatgtgaagaggaagtcggagattggaatggccacagacgggacatcaggcattgccggccaccagaagctgagacatgtgcagatggatcctccctaggcccttcgggaagagcatggccccttcgacaccttgatcttggactcctggcctccaggactgtgggaaaatgcgtttgcgttgtttgaagccccctgtttctggtacttagttacagccgccctaggagcaaatgcatcgtgtaagggcacatttgcaagctccaggagtcaggaacaggcctagacggggtgccattattcagccctccacagacccttagcagggcggagaaatgggccaagccccctgtcaaggaagagctggagagtggagagggcacctggaagggtgtcagagtggcgtggctctgcagaacggggcctgtcacagggcaggtgctcaagcccatgtggataaggtgcgtaagttgagactgtcacatgtgaaggtggcctctgctgccaggcgggccatgagactcttttttttttttttttttttttttttttttacacagaatcttgctctgttacccaggctggagtgcagtggtgtgatctcggctcactgcaatctctgcctcctgggctcaagtgattttcccacctcgcctcagcctcccaactagctgggaatacaggcatgcaccaccatgcccggctaattttttgttttttgtagggatgagcgtcttgctatgtcgctcaggctggtcttgaactcctggcctcaagtgatcctcttgccttggcctctcaaagtgctgggattataggcgtgcgccactgcacccggcctgagaccttttctttctttcttttcttttccttttttttttttaattgaggcggaggttctctcttgttgcccaggctggagtgcaattgtgcgatctcgggtcactgcaacctccacctcccagattctcctgcctcagcctccgaagtagctgggataacaatcatgcgccaccacgcccagctaaggttttttatttttagtagagacaggttttcaccatgttggccaggtgggtcttgaactcctgacctcaagtgatctgccctcttcggcctcccaaagtgctgggattacaggcgtgaaccactgcacccggcctgagaccattttttaaaagtgtacatagaccccaactgggtgagctaatggaaccacctcagtattccagagcaagacacagaaggacgctgagggagggactgaccctgggacactgggatcccaaatccctggtcgtcttggtgcctgccttcaacacacctgcctctcctcatgtgggctaacctggcatctgagtctgtttcagacactaatttcttccctgttcctagagcactggatggccacaccctcctgcagagacaaacctttctactgctccatccccgccccaggctccaaccctgcgctccacccagaggggatgctgggagggatagctcttcctccatgggccagcccttagctctgcgggggcgggtgctctgtgtcctcacttccctaagtggacacatctctggggttttcatctgtcccaattcctgtaccaccccaagtaccaagtgccagctcatggtggaggtcagcgtagggcggaggctgggtgccaggccccgttattgtctatcctggcaataaaaatccaattgttgttaatgtcagtgataattaatctttagttaaaccttaatatttactatgtgcgcaagcatttacctattttattttaattcgttgtactggattgggtgttggccacccaaaattcgcgtccgcttggatcctcagaaggtggttttggaaatagggtccttgcagatttatttagttaaggtgaagtcacactggaattgggtaggccctaatgatttatgtgtctataagagaagacacaggccaggcacagtggctcacgcctgtaatcccagcactttgggaggccgaggtgggcggatcacctgaggtcaggagttcgagaccagcctgactaacatggagaaaccccgtctctactaaaaatacaaaattagctgggtgtggtggtgcatgcctgtaatcccagctactcgggaagctgaggcaggagaattgcttgaacccgggaggcggaggttgctgtgagctgagattgtaccattgcactccagcctgggcaacaagagcaagactccgtctcaaaaaaaaaaaaaaaaaaaaaaaaaaaaaaagaagacacacagacacacacggggagagaaatgcagtgaccatgggggcagagactggagtggtgcagccagaagccagggaactccagggacctccaggggtctccagggacctccagggacctccaggggtctccagggacctccagggacctccaggggtctccagggatctccagggacctccaggggtctgcagtcaccaacaaagctggcagaggcagggaggaccctcctctagagccttcagagggagcacagccctgccagcatcttgacatcacttctggccttcagaactaggagtgaatacatttctgctggtttaattcacccagttggggataattcgtatggcagtcctgagaaaggaatgctgtcatttacctgcttatcaagctttgaccagaaactctacttatttgaattttttttctggggtgggggtgagtggggcaacccatggcagggtgatagcagtcatagcgtttatagagaccacagtgttgacgacttggagagcaaagatggaggggagattactaatgacgagaacttccgatagtgagcccacctggcacacagtgttaggaaggggtgttattatcattcccactttacagatgcaacgctgaggtgcagagacaccaaggcacgtctccagggtctcaagccaggaggtgttggagctggggttcacgcccaacaggggacctggggacccagcgtgggtactgctgagtcctcgccaggggcttggcgggataagtttccattctgttccggcctggtgtggagggatctgggctcacacaggatccagcacacaccctgaagccggggacaccatctgcaggacctgcaacatccagaggcctgccttcttcctggcctgacaggtttagaatcttccagaaaccgcaccctggaggtgaagcccagggcgccgtctcctctggagaagcctcctgactgtcctccaggggagaaagtggtcacagccgcagcatttgccaaaggagccgcccaggggatatttttctgaggaattcccgctccaggtcatcaccctagttctctgactcctaagcttggatgatgaagaaatgaaaggggcaggaactcaggggatggtgggaacccaggtatgctttgggtatgagcttgggctgtccaggggtggtggttacaaagcggcctgggcaaaaagtctcttacgacatcgcgcagtagagcccccagcttctcgtagagatgcaatcatccttccgttctgtggttttcccccaaggttgaagaggtgccagatggaggattcaaaggaaagaaagccaagatgcaataacaaaaaagaaactcccttgttctaacattaggtctattttcacttttcttttccactctgttgcccaggctagagtgcagtggatcatggctcagtgcagcctcaacctcccagcctcaagcaatcctcccacctcagccttccaagtagctgggaagaccgaagggaatgctgtcatttacctggaaacaggtgcatgtcaccacgtccagctaatttcttttgtgtagagatggggtctcgctgtattgcccaggctgttcttgaactcctggcctcgagtgatcttcctgcctcagcctcccaaagtgctgggattccaggtgtgagccaccatgcctggcctattttcacttttaaactaaaggcgtatcaggtttagctactgtgggtaacaaacaccgttccccttctccctcacctaaatggggatataaatgtatctctcctttatgtagaagaagtctgacctaggcagtgggactggtatagagacctacagtgtcagggattcaagacccaccatttgtgccttctgttccgaaggcacctcatgggccaatgtggctgctttgctccagccatcataccctcattccaggtaggaaggaggaaggagaacatgaaggacacacctcctcctccctttagagagatgtcctagaagtcatacacaactgtcccactcacttctctttggctaaaacttatttctatggacaggagaagctgcaaggcaggcaggggagtatcatctttagttgagtgacagtgcacacatttagaagtcaggaatcttcctattattaaggaagaaagcagataagatattgggaggcaacttgagccgtctgtgccactgctggggacttttgtggtagaagggacctggccctgagatggagacttgggaagctggcgttagagtcccagggcagccaccaactgccaccctgggtgttgatgacttggcagcctcatcacttttttagatctttccttggcttcggaggaaggatttacgagcattccaggatactttttttatactattgaaaccataaa

SEQ ID NO: 26 - DNA, 172825 bp, Homo sapiens
ttcattttacttttcccaaaaattctatatgccatacaaattccactcaagatcaattttctgtttcccatgtatttgtggctttatctgccatctgccaaaatgctctcagttttgaatgttccactatttaattctcttctattttgccctctctctctagaacatgttgtcttgctatttgacattcaaatttattaataaacttcctgtacaatgtatagcatattatattcctgttctttgctctcattttgaaatgtaagcatttgtaagtcaccattcagtctgctttttccttctcaattctatttcagtgttccttttctgaatttcatttactattcatttcacattctgtggccttttgtaattttccccattaccttttcttttctcatcagttttgccctctccagtaaaacaggaaagctccttccctctcagcctgttctcaaaatagacggagaatagccagttaccatcctccattctatggccttttagcaaaagctttctgataatatagaaaaggaacatggctatgacttcacgctcttctcaccctggactctgcagttgtcctgaaaatctcaagttatagaaccctagacagcatagaaaagtcttcaaggccaaaccacccacctttcactgatattgctgattataataattcagttcatgtacatagaaaatatgtaaatcctgggaggcagaggttgcagtgagctgagatcacaccactgcactccagcctggcgacagagcaagactccgtccgttactgtgcggtattttatgttcatagcaattagaaaacaattttgtgcaaatgaggttttttttcccccagaaaagaggataatatgttaaaatatcaactgctttctgcttagatttttggaagaaggaaatttagaagctgcagcatcagagaagcaaagagtagaggaactccagagatctcggagacgatatatggaagaaaacaatcttgaacatataccaaaattttttaagtaagtcagttaactcccatagcaagttcatgttttgcaaatggttgccacaggccatgagaaactccagttaaatgaaaataaaatgggtaaatggattttggtatctttgcttttggcagtgaaaatattgaatcgattttgcacttatgaaaagttagtaactataaaaagaaattttttctacagctcttctcttttcatgggcagcagaaaagagtgagcatcctgcccagaaggctctttgtccttcagctgcactctttagaatggtggaaactggttcccactcccttagccagggactgaaccagaccccactgcccacaagatcatcctggcttttattaggatttcattttatttctatcacacaaagcttgtgtgtgtttagatttggtctctctgtggtatgatagtaggtgattattacaggattatttgcaggattatatatacatcacacagattaatctgaggtttccaaatgcatctgttgccctccagagccaggacaaaaagctcagggtaaccttatctcctttagacttgtcctgtcattactgccctggggtagaaatgcagccttgcccttcagatgtctaaaatgtgctccttggacatgggcccagtaggggctcttagagctactgatattgcatacttttagtgaaggagaaaggattcttgtgggtctgggacctgaagctcttagttacagtatttgtatatgctttattgggggctatttactttttacccctgccaggaggtaatttgttcctgccctgagttcctctccccctggccctacctacttccatttcacacatttaacaacaaaaatgacttcacttccagtcaaaaatagtcacatcatcagtagctagcagataagatactaactggcttacaaacactgcttatatgtccatgtctaatctataggagagggtcctatttaaggttaccttgatgtgattcatgactaatgttgatgtttatattttcacagaaaagttattgatgccaatcaaagagaagcctgggtttctaacgacacctactgggagcttcgaaaggaccctgggtttagcaaagtagacagccctgttctttggtagactgggaatgtagagctagccaacatatcacattctgaatgaataaataactatgcacaattatgtttcttatagctatgtgtggtttctgggtcaactgaaaacctaccatttgcttttctattcatctttataatggactttcagaagtgcattagacaaggcccctaaccactttgggatcctttctgttttgctgcaaccatattccttaaaaaaaaaaaaaaaaaaaaaaaaaaaatccacaccgtccttggaaagcagaataaaaggagcagaatataaaatccaaagtctgaccagtttgtaaagaaaaacaaatggtaactggtgcttaaagctgatcaagaaagttaacaacaacatagaaaccacacgattgttccactgtctggaagcaccatcccctatcgcaggactcctgggccacaagcagtcggtcagtgcagacttcaagtgtgtctgtttgatgtggtgtgattgtgctggccttgtcgaaaaagatgtgatgcttctcagaacctgttccatctgtatgccattgttcatgccttaagaaatgcaaagatgtacaataaatcatttttaaaatgtgtgctcataggtttatgtgaagaacagattttttgaatcatggcatgattcactttctcaatcaggacaattatgagactaacttaaatgggttttttaaaagtgaacaacacgtgctttactctgataagtcagttaccatatggtatgtctgaagggaaagaaggaaaagacgtgctaagtagatctctgtatttacgtggctcgttaatttcctgtcctgcgtccagataataaaccatccctcttccacctaacctcacagtgtgccctattatttggaaaaatctgtctttgatttggacatttggtcatcagtgttaaaaccttaaaaggaaataacaaaaagcatatggaattcctgtgtgggcttagtagtactataaatgtaattgtttttgagtgaagcaccatgtaatccatgtctcaatcccatgcccgctccactgacactagtcgaattccactgagaacagaagcaagaataatagtagtttatttgcattgtttaaatgaattctatgcaaaatcatatttcaaattttcatcaagtgattccatatggtacatggctacatattaagcatttaccttgctattggcagagatatgaaacttaagctaaggaatgtatccatcccaaagcaggaaagcagaagtgtgttttgcatacttcaggatttgtttttcctccactaatatacagaggcttttgcagaaaacttgcatcagtattcctgtttctgcacgtaggtgactatataaatgcctgtatgttttttttaaaatatctcctcagagattttcctagggaattataaaattacatatattttattgttagttagatgtttattcttggattcttaccattagaatttaagtgttatttaaaactctgatacagttacagacactttacattttattatgaggtgttgattttagtggtatttctcctcagcaaagcattcctaataatggctaatacaccatcaaatgaaaaactgctgatgagagtgtaagagaaagcgctaacgtttccactagatggcgcaatattttatttatccaaaactcctcccttgcatctgagtttttatgttatgtgtacagtctgcattagcttagaatggaatttcattctcaggtaaattttcgaatccatcaccagatctaagcattctgcttcaacaataccctctctattcctctcattcccattttaaatccataggtggcttgccctgcggcagtaaaatcttccccttgatattgattctttttctgctcattcatcttgatgttctttttctgcatcctgagatacatgtcgttaattttaataagaatcctattgacttcctcacgggagtctgttctcctatggttgataaagctttaaatactatttaaagtggttctggtctgtacttactagcacttccctgaacagtctcaaaatagcctaaacataagaaaacaatcctgcaaagtaaaggtttttacaagcagagatgaaggaaagggagcagcagctgaccatcagatgtggtatcaggtagctggaagaggatccaggacccatcagggaagcaacgactgtacttagcaatttgggttataattacaaaaaagaaaaaatagtagaaaggatctttaccagacagtaaggtcatggtacaaatcaggtgagtgaatgttggtcagaggtagcctgacactctgatgaggacttcaagatgagaatgagaaaaatgtctattaaaatcactacatttgataatatctcagatttagaatctcttttgggattcagatagtctgattattccaattcaagtgttcagttaagttttagttactattcctataatacccaattcactaatatcatatctcctgtggaatattcattggtgcgatggcctcatccccttttttactttttattgacatggtggttataaaatgaagagacttactctattggaattttcatctacgtagtatttgggctgtcaagactaaatagcaaaagggtagaatattagatcattctcttaataagacctgatttattccttaggatgttatacaaacctttttatttcaggcctactttcttgttttttcctaaaaggatctaggatagaggagaacataatatgcctgtatacttctcccatggtttattcataagctgcttcatctcattggagatggtcattgaggagagcagtaataagtgacgatgattctgaggacttggctagactgagcggatcaatggcacacaccagcactggtagaggctgaccagaagctcatcgattccatatgctgtcacccagggtgcagatttactctcttttgctgttattttattgtttttcttaaattaagccattgtttttcatggattatttttaaaatacctaccccataattttcaggcaattgtaaaaataaaccttatttaagataacttttaatggtacatatcaactatatgtggggaaaaaatgcaattttctgggcaagagaaaccaaaggattttcaatatatgagatgccaggttgtcaattttctaaaccttttcctctagattattctggccctaggcctttcagcaaccccactaatcaattattagatcctgccccaaggagcagtggcttgggggctggatttagggaggaaaacctgattaaactgttttgcttagtactggttacagctgtagctggagaagagtttataatcataaagtacatttttgttattaccttgtggattttaattatccatcttgtctaatcttgttctctgtcatcctagataatgaggtgtttgtgggagcagagctctgcacacaccaggggatgtaataaatgtttgcacttggcccagtatattatgaatgtggcacagtaaataaagtttgtgtacaaaatactagtttatttctatgggagccattatgttcaggatatataaaatgtatctaattaaacaattttgaatctattttgtgctctagaaatgttcttttggggaaagatggaaagaaatgtataaatggagttaagattaaagtatttggggttttttttccccaaaagcttcccagttgtttagaaataatactatccaaagtaggattcggtcctgtaagtcctaactgaatttcttttgtaaaactgatacgtttaaactgtacattgcataatcattctgttaaactaaacctttgtttaatacataattgtaagagcatatatttgttattgaattgaaagactttttttgtagcttttgcttttaaagaagatggcaaattatctaagaaagacttagctttattacgtccaaaatgagatctaaagaaggaggtctttaaaaattgttgtgatggaccaacatgtccaacatcttaagcaaatgaagcttcatgattaaggcagcttacagataagtggaaaagaacttacctgtcatatgcatccttttgttttccaaaacaacatctgatttagttcattttctccagccttgctcctaacatagtgaaaggcatagatacacatgtatgttcttttacactgtgtcattgtttgtaaaatatacagtatttatgtacagtttcagagacattcaatattgaaaaccacttcagttagcctcctagtgaatactattaatttttcatggattacatattaccatatgaccccataaatacattttattagttactttggtatcttcaaattggtaagaaaaaaacataaaacaaaaatgttcttattttctgcaatttttttttctagccattccttcctcccaaatagaagtgagggcaattgtagagagaggaatattaagttttcataaagcaaagtatcatcttatttgtgttccacctgtttcttctaacacttaattcataaagtgagcaattgaacttcttaatactgttagagaatatgctagaactattacttcttttatcttagacacccactttcccttaattctcatctatttagttttttaataaaattgttgctagaatttttttgtcttttcaagttctttttttgttaattttattgatattgctgtacttttttttttttttttgagacagagtcttgagtgctctgtcacccaggctggagcgcaatggcacaatctcggctcactgcagcctccgcctcccaggttcaagggattcttgtgcctcagcctcccgagtagctgggtttacaggcgtgtgccacccacctagctaatttttgtattttagttagagacgggggttttgccatgttggccaggctggtctcgaactcctgacctcaagtgtttcacccgcctcagccccccaaagtgctgggattacaggtgtgagcaaccgcgcctggactcaagttctttttaaagcttgattaaggtataaccgacatataatacacttcgcatatttgaacagtacttgatacagtttgatgtatgtatatacccttgacataatcaaaatagtgaacatatctatcatccccaaaagtttcccctgcccctttgtaatccttccccatcctctatcctgaggcaaccattgatctgcttttattatttttaaaagttagcgtattttcttatatgtattgcatatgggatttttctagaaggccacgtgcatatgcaccctccccttccattaccccagtatccgccatcaagtagtaacatgttgtaacagaaagaatcccattaagtcctagttctggtagcccggtacaaattttagattttcccccaaaaatgaaaaaaaattatttaaaaaatttagatttgaaatgcttagaaaacaatcatttatttttttatgtcaaaatgtccaagtaaattaatggattaatttccatgcttctggtgatgtaacaccacttggtggtggcgctgaggaaaccctgggaagtgtttttctcttctgtgtaatgaaagactcactgacaaagccgtcggtatccagaatgactgctcttgaaatgatattttgatgatgatgatcagggaagtagcctatgctgatttatttatcatccccccaccccaaccccacttttgtgtcacaaacatttgaaacacccagtgctcaagaatgctgcttttccaattctgctaatatcctctctccccatctggaaacaaagttactaaacctagttttgaaaaagcaatggaaatgaaagtgtccagtgaacttactggcagttgtgcaagttgaaagcttattccttacatcctgagcctaaaagccttattccttatatccggagcctaaaagtttgctcaaaagtagaaaactttccagacaagatcacatacaaaatggttaacatgaaatgctaatgaagaaacaaggcaagaatgaatacaagagaaatggaatctggggaaaaaagtaggttctctaactggggcagggatcttgcttcttgggggcatatggttggatcccaggtgggccacgaaaatcatcttggatatttgtttacaggctgattcctgagtttccctccaaagattctgagtccacagatctagggtgtggaccgagaatcctcattgtaacaagcaccctctgcccccgggacattttaaggtagatggagaactaaggtgagagtgtgccagctaaatactctttcctttgtccctgtgcctcagtcttttttgtttgttttttttcatgtgacactcagtaggaaagtctagttcaagaaccggaaactgagccgggcatggtggtgcgcacctgtagtcccagctactcaggaggctgaggcaggaggatggcttgagcctgacgcccatgccgctgtgagctatgattgcaccactgccctgagcctggacgacagagcaagttcctgtcttaaaaaaaaaagtaataaaaaagacatttaaaaaaaaattagagctcagtgacctgtgactcactttgccactttgtcattttcttgacttctgtcccaacgccagccctgtaatatggagataaagagtggggaggacagaactctgaaacctaaaaggcaagatttttgctaaaccggagaacgtaaaaatacattcctagaggcaatctaaccagccagataaccagaagtttactcttcaaagccaagaatcagtacccccacctcaccttccattctctcttaggctttgtctatgtctctaaggggagtttttcagttgactgatgaggtcctgactggtagggaaagcctgcagggaaatcctgtggcaaagcacactcttgatcacctacttaacaagaaggtctagcaggacattcttgatccaggtcagcttcttccctgaaaataatacatatttttaatttctgtttgaaaaaactccactgtgaaattactctgcttatattagaaggtatgaagacagtagttatgtactgttcgtttgcatacggtcattttgagatagaaaaattaaatttttttaggaaaagaatttcaagcaactttctacgaaaatacagcttgtggttaaatttcctaatgaaagaggaattattcactgaaaaatttgtctaatctgtgccacctcaaaataagaattgtgcctcttcaatgaatgttgtatatgagaatgttacatttgtaacagcacaggaaactcaataaattataaatgaattacataaagagatttttttgtgtacagtatgtcctgatgacttttctacattactaattttacaaaaattactaaatttgccaaatatttttatctgtttgaagcaagagacttcacataggatataaagcttgagtacttatatctgactatatttccaggtcttcttcatgtgttttcaaatcgaatactaaaacacagattcttttcctgaattttgaactgaattttcctgaatattaaaagacttaaggctgggcactgtggctcatgcctgtaatccctgcacttcaggaggccaaggcggtggatcacctgaggtcaggagtttgagaccagcctggccaacacggcgaaaccccatctactaaaaatgcaaaaattagctgggtgtggtggcacatgcctgtaatcccagctactcgggaggctgaggcaggagaatcacttgaacccaggaggcagagtttgcagtgagccgagatcacaccaccgcactccaggttgggagacagagcaagactccatctcaaaaaatagtaataataataataaataaacaaaaaaagacttagagttgccttcagtttcccatgtttctagattatgggagaaaagctgtagttcatgaagtctgcaggaaactcacaatcacttaggtgagagtttcttccatcttggtctcttgggaaagttctagggattcatttacattcattcaataattctcccttgggaagagagatttcatgggggctattttctatctgtcaatggtgaaaacactttcaataaaacaatgatgatgtgtttagtttgtaatctgtacacgtattataagtagatgatttatcagtcttaatctccaagtctccaatttcttcaaaagaagtagaggaagaaatattttcagagtgtcaaaacaacataccaactgtttggttaactggaatcccaaaatctgttttttgtaaaacaaacattggtagtcaacctatttcaatcctgctggaatgtgataaactcacatgctctggggcctttctacagcctggcctcactgtggtgcatttatgggctggtacccagtctatcctgacactgtccaatcacagaaatgtgaggaccttgtaatatcacgtcctagggataagttcctagggctctattgaggagaaactttgatgtggttggcaagaacacacaaagaagtcagtcttgtctccttttctgtgtatgcaccagaagttatcagcttagagggaagggggaggtggcgagagaagattgagaaaatgctaaacacttgaaatgacaaagaaatgcccccaccccctttgccatatgtacttaagtaactgggaagcaaattgaaaatagagagacataatagatgaaactttcatttgcatagtttgtgattatacagtcacagttgccataagtcagttttcctgcccaattataaaatcatgccagagaattaatcttttataaaagtgcatatagccccagttacattaaactattgctggtggtaggcagtggtttcttggttttgttttagcttgctaagtacagaattggaggatacgatgggataaacaactgaatacgtgacaacagtttgttgactcagacagaaagccatcagatggcaagggttgaccgttgaaggatgtgggttggcctgactcagaactgcacggcctgtctggcagctgcttggccaggcagctgtgcaatgtggacagctgtctgcctgaagaccagcctgcttcaacagcacaggttctgctaacatacatgctaacagggctgttttctctttaaaacaatgggtttgatgggttgggagggagtgaaaactataaaaataaatctctgccaggaagctctcaagtctcttaacgaggtcatccatatagcaagtactctaaggtataaataatgaaagctcagtatttcctacttattcctgaaattgtccatcatttttaaagtttaccaagagtaaacttcccaaatgtaacagcttagtactttacccttcaaattcagatttataaaattttagaagagaaatataagaatgagaatttttctttcaaagaaaatcaaaccacctcacattcaacccttctcttccttaagattctcctccaaaatacttaattttctacttcattctcagaattttctatatgttagcatagtattttttggttattattttttaagctgctcatcttccccaattgctttattattattattatttgagacggagtctcactctgttgcccaggccggagggcagtggtgcgatctcggctcattgcaacctccgtctcgtctcgcgggttcaagtgattctcctgcctcagcctcccgagtagctgggattacaggcatgtgccaccacgcccacctaattttgtgttttagtagagatggggtttctccatgttggtcaggctggtctcaaactcccgacctcggatgatctgcccgcctcggcctcccaaaatgctaggagtaataatttaaatatgttttaacccgttgcagttattatttttactgatgcttaaattgtctcctctttggccagtgggaaacttattaatcagctcctgagcctcttgacactgtggtgcagtggttcacacctgtaatcccagcactttgggagaccaaggagggcatattgcttgagcccaggaattggagaccagcctgggcaatgtggcaaaaccctgtctctacaaaaaatacaaaaattagctgggtgcagtggcatgtgtctctagtctcagctacttgggaaactgaggcaggaggatctcttgaaccagggaggttgaggttgctgggagccaagatcatgccagtgcactccagcctgggggacaaagtgagactctgtctctaaataaataaataaataagccagcatgagcttattagagatctacattttacttttagtttagagacatggtctcactcatatacttagcagtatatgagtagatgcatacaatgaacaagattctcacttaacacatgattaaatctgaaaaaaaaagaaagtgaaaaccttaacaatatcctctctctctctcacagacccttgcaggagtcaatataactaaatacgtcctaaaatttcaaggagagtagccatggttcttgatgataagacaaagtatgctcagactgaggggctgaggacagccggatccttccagtcgtgtgggagaagcagttgatgctactgctcagctacttggtgtgtctgttgtgctgtggtctgtgccttggcatgcaaggtacatgaagcagggtcaatgaaaattgtggaaagttatagagtacatagaggtttaacagtcttatggaagagtgtataacagtccgttcactcttgctatagtaattctagtatttattgcatggtgaaagtctactactgttcatttattttcttggttgataataattttttttgttgttaacgagacggagtcttgctctgtcgccaggctggagtgcagtggtgtgatttcagctcactgcaacatccgcctcctgggttcaagcgattcccctgcctcagcctcccaagcagctgggactacaggcgaacgccaccacacccagctaatttttgtatttttagtagagatggagtttctccatgttggccaggctggtctcaaactcctgacctcaagtgatcttcctgcctcagtctcccaaagtgctgggattataggcatgagccacagcgcccggcccgataacaactttttgtttgttgtaagaagctagctttttaaaaaaggacacatgtaataagagatagagtactgaatatttgttttttaagaaaattgatagctacttgggaggctgaggcaggagaatcacttgaaccctggaggcggaggttgcagtgagccattacactccagcctgggcaacaagagcaagactccgtctcaaaaaaaaagaaaagaaaaaggaaaagaaaattgataaaggatatgtaacttgtaccaagtgttcatcaatgtttaccatccactattggtcatttcatccatcatgaaatcaatgatgggaagtagagaagaccacccaaatgagggcagaggttactgactcagagctagctatagcaagagagtcagcctccatcacttgcatttggcagagactcaaaggcaggaaagagaatagtcaagctctatattttaagcaatttcagatatatttggtttggaagttgttggcaggaagagatgcgggtgggctaagtggaagcaaggcctcttaggtgtttggtttagggagcatgtttgactttctctggttggtcctgagttggaagaggggttaaaaacagggaagttggcagccattgaacaagtcctgactgttctggactgattgttgtaggagttgtaatacggtttcctggaccggttactgtagagcaagcttgcccaaccaacggcctgtgggccacatgtggcccaggacagctttgaatgtggcccaacacaaattcataaacttttcttaaaacgttatgagatttattttacttttttttttttttttttttagctcatcagatatcattagtgttagtgcatgttgtgtgtggcccaacacaattattcttcttccagtgtggcccagggaagccaaaagattggacacccctgctgtagaggctgtgggtaagagttctattgtcatatatgatgtggccttgtctgtttgtatattcagtctctaacttgaaaaccagatttaaatcttgtgaataagccatagcatgtatttgaaaagttagttgttattttaagaacttcatgcctaaagatggtgatttgacacacagagcagcagaaggggctttgtttttttgtttttttttgtttttgttttgttttgttttttgagacagattctcactctgtcgcccaggctggagttcagtggtgagatcttggctcactgcaacctccacctccagggctcaagcatttctcatgcctcagcctcctgagtagccggcactacaggcatgcaccaccatgactggctgattttttgtattttcagtagagacagggtttcaccatgttgcccaggctggtctcaaactcctgacctctggtgatctgcctgcctcagcctcccaaagcagaagggacattttcatagcattccgtgaagcatgagtttcattcagttcacatgtctctacttctaaattacctttactcattttttaatccaagtttcgtgtgtgtacattaacatgaagtaatagctgttagtgtgttggctccaagagcagaactttgcagatagttaaataatgtcaattttataccactggcataagatgcttcaaatagaaaatcaactgaagtaattccaaaagtagttcaatttttttcatccaatttatgaaatcaaagtaaaacttttagaagttaattgtgtcgaaaataaaatatctgacactattttgtgaacgttactaaaaattcagttcaaaagttcaactgtgctgtgaagatgcaaatgtcggtgggtatagcattgtggtaaaagcaatgttcttattaagaaaacttcaaggcaaaaatatactagatataaaataagacaaaaatatgtatatactagattttggctacagtatatattatatagtataatatatattatatatattatatagtataatatatattatatatattatatagtataatatatattatatatattatatatatttggctatagtatatatatagtataattcaaaactgtgttcaaacagagaaatcttaccaatgaaagtagctgtcacatttaacaaatatttatataatttccagtatacgtaatcaaattacaaaatttttctagcaaaattgatattcaatttttaaaatccctgaagttttcagcatagttatataccttttttactatctatcatcaattgaattttaaaatatttgagcctttgaagtactactttgtaaatcatcctaagtatcttacaatggtattgaacttttatgtaacaagtcccctaaattttgtactttgcacaaaatcagttagaaattgttaatctaaatattccatgaatagcatgctaaaaacttcagtttttgaagcttttaatgaattgcaattagtgaaaaacaaaacttccaaacaggataacactacattttattccttcacagaagacaggaactgaataaattaaatgatgagggctcaaacaatgtagacataatcttaaaattttctaactggactttggaatgtcgagacttacaagaagaatcttttgatctagttcttatttttaattgcataaatttatattcttcattcgagtggaataaaatcaagaccgcccaatggttttgcagcatttaaattgacaaaacattcaaaagaatctggagacaatttatttgacatattttgtcttgtcaaaactatttgttgcttcaggcgttctgacgaatggcaaaaggacaattcttgtgaaaatatttaggctgaaattttacacatttcacaacaaaaactattttagaatatcctccatttagcaggatttgccccaaatttaccaagtatttcagcacttgcagagagagagtagtttctcagttaaaaatattattctactgtgaagaaacaattgaagatgtaaacaatcacaaaattattaaccataaaacacaatgtcaaagaacactgcaggcaattttaagaagaaaatgaaaaataataagaccagacacgcactttggaaaatgccagtgatacaatattagagatacatctaagtaactgattagtggacacaaatatgtaccaaaagttattattctgttgagtttttttaatgttcagataatcaatatgaatacatttttaaatttgtttttaaatccttgtatattcttttacgaataaaactttctaaattttctagatttttattttttaaaaaagaattttttctttgaaaattgaatacaattgttataagtccaccaatataataacatgaatttgttggtcaataaatattttttaaaatataaaattataatgatgtttagcacccccttctcaaaagtgtccggtttggacagtaagtcacacaattaatctacatatctgtagccccctctctttctaaaattaggttccttgaaaacttctatggtcatcagttctcccagggtttaggtccaacaagagggtttttaaaggataagaaacctacaactcaacaacaaaaaagcaaacactttatttaaaaatgggcaaaggacctgaatagacatttacccaaagaagatacacaaatggccaacaagcactttaaaaggtgctcaacatcactacattgcattacggaaatgcaaatcaaaaccacgatgagatgccacatcacagagagtaggatggctactataaacaaacgaacaaacagcacacaagtgtcaatgagattgtggagaaattggaacccttgtgatctactgatggcaatgtaaaatggtgcacctactgtggaaaagagtatgacagtttcccaaaaaattaaaatagaattaccatatgatccagcaatctcacctctgggtatatacctacatcagtttcctagggctgccataacagaaaaccatagattgagtgacttaactgaaatttattttctcacagctctgaagaccgaaagttcaagatcaaggcatcaatcagtaggtgtggtttcttcgtggtccctcggcccatacaagtatctggtgtctctcagtgtgcccaaatttcctcttataaggacatcagtcagattgaattagggcccaccctaaggacctcattttaacttaattatctctataaaggccctgtctccaaatacagtcacattctgagatactagggattatggcttcaacataggaattttgtggggacattcagcccataacaatatccagaagaattgaaatcagggtcttgagaagatatttacacagccatattcacaatagccaaaaggtggaaggaagtaatccaagtgttcactgactgaagaataaacaaaatgtggtatatacataaaatggaatattattcagccttaaaaatgaaataaattctgatgcatatacaacatggatgaaccttgaggatattatactaaatgaaataagtcaggtacaaaaagacaaatagtgtatgattccacttatatgaggtacccaaagtagttaaattcatagaaatagaaagtataatagaaaagtggtttccaggagatgggaggagtagaaaatgggacattagtatttaaaaggtacatacacagttgcaattttgcaagagaaagagttctggagattgggtgcacaacaaagtgaatgtacttgacactactgaactgtgcacctaaaaataggatggtatttttttttttttttttcgagatggagtctcactctgtcgcccaggctggagtgcaacggagtaatatcagctcactgcaacctccgcctcccgggttctagccattctcctgcctcagcctcctgagtagctgggactataggtgagcaccaccatgcccagctaatttttgtatttttagtagagatggggtttcaccatgttggtcaggctggtctcgaactcctgacctcatgatctgcccccaccttggcctcctaaattgctgggattacaggcatgagccaccatgcccagcctaggatggtaaattttatgttatgtgtactttaccacaagtaaaatttttaaataaaaaaatgacatctatatccatgttgtaccattgttaatttccttgttttgatattgcactatatttatgtaagatgtaaccactgaaggacttggtgaaaggtacagggacatctccatactacctttgcaacttcccgtgaatctttaattagtttagagcaaaaagtgttaatttcatgtttgtgttaaaaaaaaaaaaaaggaagttatagactgccaatctcttggaccaggataatagaactttatgaacacagagattaaagcctatttaaccacagtttgcccatgatggtaactttgatcagaaagaatctcacaagctgggacccaacaggaccaagtaatccatgtcatgattattacacgttatcagccttccagggaagtggaatttacaagctttccctttggcatggggcccaggtgatggcctcctattgagcagagtccccagcaataattaccctgcatgtcaaaggcctcatttccccaaaacagtaaaccataaaatgtagcccatattctctccatgtatatcactcaatatcacaccgtagaggcatataactgataatattgcctctggcccatgccaaattgcaagtggtagattttttttttccttccgaattaagaaacacaagatttaccccttttcttggaaaagtgttaagagtctagcacccccaataactagggtctacaaatgtctaaaagttattaatcttggtctgtcttaactaccaattctcttaatttgggtaacctcaattttgttgttgtttttttttttttgagacagagtctcgcgctgtcgcccaggctggagtgcagtggcgccatctgggctcactgcaatccccgcctcccgggttcaagcaattctcctgcctcagcctccctagtagctgggattacatgtgtgcaccatcacacccagctagtttttgtatttttattagagacggggtttcatcatgttggccaggctggtctcgaactcctaacctcaggtgatccacctgcctctgcttcccaaagtgctgagattacaggcgtgagacactgcacctggcctgggtgacctcaaatttttaaatgaagggattggaggtaacatctaggattttatctagttctgtcttctatgattcaaaccccaaattctccactgcaatgactgcttctggaataaatattcctggttgcctgtctctgaaaaaaagctctcacataaggctaatgagaggcgaaactaaggcaggatctctcctttcaagaccacatagtcagggttgtttaataagcacacaaagtagagacatatttacccattcaccatgaaaaaacacccctataaaaggcccaatacctgggcttaatagcttcatttcttgtgtgatcttgcagtgtacatcaaaaaattaacaaataacatccagtgacatgatcttggctcactacaacctccgcctcccgggttcaagcgattctcctgtctcagcctccctagtagctgggattacaggcatgcaccaccacacccggctaattttgtatttttagtggagatggggtttctttctccatattggtcaggatggtctctctcgaactaccgacctcaggtgatcagcccgccttacgcctcccaaagtgctgggattacaggcgtgagccaccgcccctggctcccccaccggcaatttctaaaatgtatcggtctcctcccaagcccttgttccttcatcccccacccggggcagattcagacaagcatttattttagttcctaagccgcgcggtgctcccagcttccgcgcctctgggcggcccacacccctccccatcctctcctccgcgccgccgtcttcgttgctcttgggtggccgcggcgcccgctccctctgaattcgccgggcagggatacagccgcccggggcctcttgctcgtgcttggttttccggaccttgcttcctaaagggtctttaggggttcccggactcctccgcctgggagcctctatccgcctgggagcctctatgcgccccgcaaagcccccggcagagccgaggggaggcttcattggcgacctggtggggcctcgcggccctgctccctgacgtcagcgccgccgcggtgatttaacagcttttgttttgggcagaagaacctatgggcacaaaaagcaggaacgagtagcggtggctgaagaacgagcaggagcttgaatttcagttttcttatgaggaattttccagaaaagatatcttcactgtgaaataactaaataaatgcccactcagtacagtaagtattgatatcgtcctatagcatttggctagaaagtggtgtcaatagggtttttccttcagactttgcaatactgttcagaagggccaatgccaatccttctgtgaggaagtttttttcttcctaaatatgttaattgcctcaacttggactaacggtcacacttgtgaatatgagtgtaagaaacagtttatttctcacatgtatgaaaaggaaattttctttcatctatctcaggcccctattcagcgtaaaatcaagattatttaacttgcaagattaaacaacgaccttatttcaaatgaaataaaattcagtctgatcagaaaccccttggagcagtttatattaacctaattatctttttactgcagtaagttaattgaggattatggaatgcatctaaaaagcagttatatttacaggtcccaaaattaaatgctaaggaaaagcatttctgcaaacccaggtagtacggacaaaccgaagggagttttattctgtcaagttttactctaaattcaatcgttgatcagctagatctcggcttggttattcttggaggagctgccttgcaaatgattccactctgagctcgccggccacagtagcgtgaaatggatggcagtcagtttcctcttcctaagactgggtgtggtttctctgggcagactacacagtggcgactctggcgggatttgaggagcctggagaggcccaccacgtgtgtgtctccccctagtgaccaacgggctgaagttcctgtggttaaaggcaattgctgattttgtcattagcaggaaggtgaagctcaacgacctcctgcgtgtacagcaccattctagaagctggatgtgtttaaagatatgatgcaatatgtacccagaaggcataagactagatcactagggtacaaattaaaatatcaagttgcatacgctgagtatgggattaggtcagcggaacacgctttggaaaacactgctttaacgacctcattctgagtccctgtaatgcttaagattatagcacagtttaggcaccttatatacattatgatggaatgctttcctagagtgatattctgtggtggaaagagcaaatcaaaggtctttgtgttctctgtgaccgtggaagaaattgccattaagtagtaatataaataggggttttaaaaaacgtgggaaaagtctgaagaagcatttgcagaaactccttacaaagtcagtgacagctaggccaggccaaggtgggcggatcacttaaggccaggagtttgagaccagcctggccaacatggcaaaaccctgtctctactaaaaatacaaaaattagctgagcgtgggtggctgagatgggagaattgcttgaacccaggaggcagaggttgcagtgagctgagatcgcaccactgcactccagtctaggcaacagtgcaagactctgtctccaagaaaaaaaggaaaaaaagacatgtactgtaaatgtaaaatataaaatataggctggatttcagagacatagtatgtaaaaaagaatgtaaaatatcttaataatttttatatttattacatgttaaaatgataatgtttttgacatattaggttaaatagaatataattcaatcagtttcttttctcaaagagtgtggctactagaaatgtttaaattatgtatatggtttgcattatattttttcagacagtgccgatgtaatagtaacaaaaagtctcagcctcatttaagataaaaggccatcatcagacaatgcaggacagattgtaacaataggaagtactacagagattcagagaatgccataaataaccttggaatcctgtgcttgggtaaaacatttgctttttacttagctgatcccttaaagcctgttaagttgaaatgttacagagggaattttatattagagttggccacctcaatttcataactttttaaggagaaaatggcttacatttgtgcatcttcaaggttttcaaagcatttgcacatttattatctcatttcatctttctaacctgagaggaaggtagagcagtttatccccattttactggtaaggaaactgaggctcaaagagttcatgtgatgtgaagaatattggaattaaggatgccagagaacaatgactcagagtgaccaagtcattatggggtccatttggaggtctctatgtagagggagagcttcctcagggactcctgcagacatctccttattggaggacaggaggaagcttgaagacacttttccccactcggactcagtactgagtacttttccactctaagtccttcaccttctcctcatcccaggccctgggtccataaaactgcaggagccttttgttcaagggttctctcagcaaagctgtgctgatccacctgaccctggattggtgccattctatcacagcatgggattaaagccttgacccttcctttcatattggcttattgtcttcactgcttttctgacttctggcacctcaactctctggaactaagctcggcccttgacagttagacctgctgtctcttcccactctgacttccctcttgtctcccatcccaatactcttccttgctctggctaggcacaacccccgactttaaagttttggagtgatcacgggcatttctgggatttggccaagggataaattgagttgagactacattgagtttgggtttaatgggatatatgtatgtggtttgtagtcacatccatgtatagttaagtaatggtcataccactactggaatggtttctaggaatactcctactagtgactatgcgggttcacatacaccctacatataaaagcagggccagaggtcacactatgatatgaatgtgacctattgcttggcatcagaaatatgcgggtagtggagaagaaacagattgaaatgaactgtggtagatccattgcaagaatgtctccaatacttccctgtaggcagaccctttgcaatgtgattttttttaactctacccgtgaaaagttgggcccacctcttgaatctgggcgggtttcgtgacttgcaatgctgtggaaagagtcatacttgaagaataggggtgctttagtctctaggaaggcgctactttaaacccatgctaacaaagcttttaaaatacccctcctataagaatcaatgtgatccatcactaaattaactgtctgtgagaaaaaaactcaatactctttaaaggaagacaacaaaatcttgattcacagcaatgtagaatctgtaatgtccagcatataatctatcaaaatataagagaatcagaaaagcaggaaaacgtgacacatattcagaatatatattgctggacagtgctgatcacctgtgttttccaacactggaggacttgtggaatcttgactcagcttgtcactcatcagtggtaactgttctctgctggccctcacagagtcttactctgcacatgcacagctttgtatttggctaaagacttcaggggaatccctatgcaggattctgtagttccttctctacaccactccttatcctcaggtactctaccctacttactctaggcaattcagcatccctgaggtctctctggacttcacttttccattctgcagtccaaaatgggctcttgagcagaaatctagggccaccagggggatcatctcatgtgtttcccctctctcaggttagcaatctgtgctgttgtctaagattctttgcttggccccaaactttaatcaggctcctgagccttctactaagcccatctgtgcacttccatgtaaaagccagttgtagcaagaacgctgcttagttgggttagcaagaatccccacctttgatatctgatcacccttgatatctgattgggttcctcagcctctaccatcccacaggtgacatctgattaatctggtctgacttcgcaagaatcctgttagattggttggtttaggcagaattccccttacccttgatgtttcctcttagtaattgtctatccactgccactaccttgccccttggctataaattccctcttgcccatgctatattcatagctgaacctaacctctctcccctactgcagaatcccattgtaacggtccctataccttttgagatagtcctaaaatctgccttattgtgctttaacaagtatcatttaaaaattttttttttttttttttcaggagacagggtcttgctctgtcaccaggctggagtgcagtggcacaatcatagctcactgcagcctcaaactcctgggctcaagtgattctcccaccttagcctcccaagtagccaggactacaggagggtaccatcaaacccagctaatattttaaattatttttatttttatagagatgcggatctcactatttgcccagactgatctcaaactcctgatttcaagcaatcctcctgccccaatctcctacagtgctgggattacaggagtgagtcactgtaccttgcctcattgagtaatttttttctttatcatatacaatgtctgaaaggagctgccttctgtcttttgtccagttttaaagttgtttacagtgaaaggagggctagcccacacatgttattatatcatgtttggaagcagaagtcagttacccttaaattagagatgaggaaactgaggaactgaaaggttaagcaacttgccccaaatcacacagccgtttacctgtgatggagcttgaattcaaacccaggcagtctgtctttagagatgctcacttaattattgttctgtacagcttcttagaaaaatggctttatatatgtatgtaaaatgttttgtccagtgtaggtaacatagtcaatccttaataaagtctagctaaattattctttaaaatcctaaagctcagtatgaatttgttcctagcccagtgtttcaaagcaaaagtcccatcatgtgagttgatctttattaacactaatttttattactgtcctactattaacaaataaaaacaaagcatttgcttaagtcctttattaagtgcatgaacaaaatattaaatccttagcctgctttcttttgccattaaaactacctttcttaactagaaatatgagataaaatgaataaaataaaccaagcaatcaggcacaggtactgtcagtttctgaatttcaaataaatcctgtgcagtaacacacccatctggccataacggagattgcactagaatgaaagcacaagctcataaataagaatgtaaatatttgtaatagaacccagcatttactatactatctaattcttaatctgccatctaaatgtgctccaattgttcatcttattttaaaaaattatgactggagacatctgtaagtccaagcctttctttggttttagctcatatacttgaaaacagtttgcctctgtcttctgcctcttttttttggtgagatatatgtaaatatttttcaaacctctactgtatctattagcacagaatgctataaacatgtggcagctatccattcactcagatcagcatagaaagaaaaactagtttattcaggtcttctctccacgatgtcccactcttgccccagcccaagcagtgaagcaaaaaaaacccacatattccaatccatctacttcaccctctctaatattcaaattgactgaatagctatcagatcttcattacacactgttctctgcagatggcctttttgataagtcttaatctaaaaaaattattgagggaaatgaggaaatcagaaaatgataaattaagtacaagaaatttaagacttagcttattgttatcgtctcctttttgatatcagctgtatttgtggcagaaagccatcatgatctgctatctcaatatactgtcaagctggtaattctgaatatgttgtcaagcttgtaaatgttctgagtagaccacatcttcagtaatttccacaagtttacaatttttcaggtaaagctataatttattgccttaaattcattttttcaatgtagtaagagctgctgcttagttataatactctgaaacttccacgaaactatcctttttagaactcatattacaatatgggctgtttcatgttttttaacttctttggaccttgagatgcagtgttattctagatgcagcattactcacagtggacattgtcctcaaattagcataatttctatttcatttcctacatactgttttggataatgttgaaagaaatcttttgaaaatgcaaatattttttgtcgcggcacatacacacactctctacagaaaccttgtcttagtttgtttagtgttgctttaaaggaatacctgagactgggtaatttataaagaaaaaaattatttggctcctgattttagatggctggaaagttcaagattgggcttctgcatctggtgagggccttaggctgcttccactcatggcaaaggtaaagggaaactggtgtgtgcagagatcacatgcaagagaggaagcagggctggggaagaggaagcaggggtggggaagaggtgccaggttctttttaacaaccagctcttttgggatttaatagcgtgagaactcactcatccttaagggaaggcataaatctattcatatgggatccacccccatgatccaaacaccttccattggaccccatcttccaacaccaccacactgggaatcaaatttcaacatgagatttgcaggagaagggacaaacaaaccatatccaaaccatagcaaccctgccaaaaataaaaagcaaagaaaaaactggctacaaactcataatttatcctctctctagaaattctaataaaaggcaaaagatatatgatctgaagagaatccagagtatctccaatgctgacttgtaattttatatatcttaaattatgtgatttatatgatattcttatcatcttttttcactaaactataactccatatctcaggtgggactctcagggagcagactcaggagacagtaggcagaaggtttattagggaatgcttttgtgatcatcatccgtggaaggaatggaaagaaatcaggattgggtggaaggaggacttgggttgtgatacagtgtcaacagtgttctcagctgaccccatgggaaactctaaagctggttggcccttttgatgtcccatattggagcaagaaggtcaggactttgttgcccagtcactggatgcaaggaacccaaagatgggggtgaccttggatgcagtgacactctcagctggtctcagtgacttacctggtgataaaactcagtccttgatccttagaggctcagagtccccggtccctataatctttttaggctcataatggctgctacactgtccgtttacaatcagaattgggcaagagcataccaagaggtgcatacgtgcagtgcttggttaccaacattttcctccttcctccaactgtaaccgtggtcctacctcctctttatgataagatccattatccctgccaggatgtgactcctctttttgcctgctactttcttggtacaaggaacctgaagtacctagcccgcagatgtagcttataattcaatgaaactgatgagtctcttcttgggtctcactgaactataaactacatctgctggtggaggtgtttcacctttaggaagcaggacctctaaatgacaggacccagtgttgtggagccaggaagcacaatttcccccaagagaatcactgggaatgatagaaagcagggccattcctgcttctacctcttgattcctggacccatgtattctacctgttaagaacacagccctacataaagaccattaaagtgtccacttcatcttaaaggatggtgttcgtgttaggtatgccttcaacaagttaattattcattctatcagggtagaggcttctgggtgatgcagcatgtaataataagacaagcagaggctgtggtcgtttgcccactctttcctcctttgctataaaacaggtcccatgaggtagttcaaactctctgaaagccctcagtgatgctggccaatgccctgcagatagaaaaggagaatcatttagaatatgtgtctattcctgtcaaaatgagtcactgcgtcttgttaggatcattattgtaagtcagcttgccaccaagtgactgattggtcttcttgaggaataggcactcagcattgcagcattggtctctgttgttagcaggctgaaaattcagcagtgaatataactagatcagcctcagtgtataggagcgcatcctgttaggtctgttacatagcctccaatcctgccacagtagttattccaatgccagatgctggatgttattaaccagccaagtcctgatactgacttggttgttcagggccttttccattatggatactttgtagtatagatcaaacgcagtacaaagctcctaacgctttgtgcccactctcatgtgcccaatccaccatttttatctcaaaatctctttgttcccagtagtttagtctattttcaggaccctgatcccatgaccaagccagttgccactacccatgtatattctaaccttgagaccctttctacacaaatggacagcaaagtatactgcccgaaggtctgccctttgggaggattttcccttaccattgactttcagggccacccctgagtggcacagtactatagacaccatctattttgtttgccaaaatatacccatttgtgagtcaaattcatgcattttcctctttcatcagctcgtcatatgggatcagtgacaataaatgtaagccaagggagagacactggtgcaacagtggtagagacatgggagtctaggctgcttgctaatgtaacatactgtgccctttgcctatgtttgtgttctacatgtatagaacccagctcatgatcattgttcttggcttcatggctacttgacatccctttgtctggtgctatatctctataaaagcccagcagcacatcagcagctgtttgttgaaaggtgtttacttctctgctacagatagcatggccagactcttgggtctgcattgtgattttcccattaggacttatcataaactccacacagaatcttttcctatatatctaatacaacagcatctgctgggtggtatggcaaagtggtaaaactgccacctggacctgcttcagagcccttttctgctctgggtcccacttgaaattggaagccttttatgtcatccagtgtataggtaacagcaagtatttcctgctatggcatatgctgcctctagaacccatagaaacctatcattcttttatgctaccttctttatggtgagaggtacaaaatgcaataatttgttgcttattttggaaggcatatcttggcatgccctggactgtggacccactagagagccaccagtagaagttccttgaatctttgtagggtttgtctctcaccttcggagtatatgtgcggtagctccaatatattatctacttcttgctcttctggtccagttaacatggtataattgatatagtgaatcagtgatgttctgcaagatgcccagctggtcttggtccttcagactatattatgataaaagctggaagagttaacatgcttctaagaagattatacatgttcactattgtctgatccaaggtaatgtgtttctgatcctcttttctaatatagaaaggatgcatttgtcagatcaacagctgcatattgtatacgtggtgccatgttgtgatttctacttttttgaatctgttgagacttgtttgaaatatggtctgttctggataatgagaaaagaatgtgtcttctgggctgggcatggtggctcacgcctataatctcagcactttgggaggctgaggtgcgtggatcacctgaggtcgggagttcgagaccagcctgaccaacatggagaaaccccatctctactaaaaatacaaaaattaactgggcatgggggtgcatgcctgtaatcccagctacttgggaggctgaggcaggagaattgcttgaactcgggagacagaggttgcggtgagccaagatcacaccattgcactctgtagctgttgggtgaaatattctgtaaatgtcagttaggcctatttgatctagtatgtagtttaactccaaagtttctttgtggattttctgtctggatgatttatctgttactgagaatggggtgttgaagtcccctaatattactgtattgcagtttatctctccctttagatctattaatgtttgctttgtataattgagtgctccagtgttgggtgcgtagatatataaattattatatcctcttgctgaattcactcttttgtcattatatagtgaccttctttgtctctttttatagtctttgacttgtagtccattttatctgatgtgagtatagttattcttgatcttttttgatttctacttgcatagatttttttttccatcccttcactttccgtctatgtgtgtcattacaggggaggtaagtttcttgttagcagcatatagttaagggcttgtttctttatcagttcagccttttaattggagaattgagtccccttacattcagtgttattattgacaagtaaggacttactactgtcattttgtgcttgttttctaattgttgttttataattcctctcttcctttcttattgtcttcctttgtggttaagtgattttctctggagtatgttttaatttgttgcttttcatttttagtgtgtctattataggtttttacattgtggttaccatgaggcttacataaaacatagatataccaagtcatcttaaagagatgacaacttatcttagattaaaaaaaaaaaaaaagaaaagaaaaaactaaaaaaaaaagcctttataccttaactccatcccttctacattttgacttttgtttgtctcaatttacatatttttatattgcttatctcttaacaggttgctgtagctgttattgtttttggtaggtttgtcttttggtcttcatactagagttataagtggattacacaccacaatttcagtattgaagtatttggggattgtctttgtacttaatttcatcagtgggttttataccttcaaatgtttttgtttttgcacattggtgttttttttttttttcttgtggattgaagaactccctttagcatttcttttaagatgggcctcatggtggtgaattctctcagcttttgtttatctgggaaagactttatcttgctttgatggttgaaggatagctttgctggatacagtattcttgtgtggcagacatttttttctttcaacactgaaaatttcatcccatttgctcctggcctgtatggtttctgttgagaagtctgttgccagatgaattggaatttatgttatttgcttcttttctcttgctgcttttaggaccctttctttgtccttgccctttgagagttcgactatgcctacgggtagtcttatctgggtcgaatctgtttagtgttctctgacctgcatacctggatatttatatctttcttaagttttgggaaaaaaattttattatttctttgaataagctttctaccccttgctgttgctcaactttttcttgaacactagttattcttcgatttggtcttttgagataattttctatatcttgtaagtgatcttcattctttttcattcttttttcttttctccccctcactgtgtaatttcaaatggcctgtctttgagctcactgactttttcttctccttgatccattctgtggttcatctaatttttttttagttcagcaaatatatttctcagtaatgagaattttgcttttttaaaattattttaatctgttaaatttctctgataaacttatagattgcttgtctgtgttatcttgggggttactgagtttccttaaaactgctattttgaattcttggtcagagagctcacatatcaccattttcttagattcagacacttgttccttgctttattcatttggggaggtcatggttccctattgctgttgtttttcttgtggatgtacgtccatatctttgcattgaaggattatttattccagtcttctctgtcttgattgttttgttttctgtcggggatgtttgcttagagattctttgtgacttatctgttaaatttcttattttcccactaggtcactgtctcccttttggaacttgatggcaccttaagcccaggtttgcctccactctagaaactcatcagagtgatgcccttctcaaatgggggaggtcccaaagcggatatcctggcagtgtgaaaggccggctaaaggtttgtgccaagaggatctgtggaatgcatctcctacagctggtgctgctgagtaaccactctgatctggcatcttctttgatcaagttacagagcagagtttccagggctggggattgaagtcctgcctcctccctttgtctctggttgtcctcggtaatgtttttccctcaaggtactcatgatacttcccatggggtgagtcagggacaggtctctttccagggaatccaggatggtagggaggttggttgtctaccttgatctcactttttccattgtagaaactgtgagttggggaaagttttccacacacttggtgctggacagattgtggcaaggggcaccacagatataaaaatctgattcttttaccatgctcagagttttttcacttctgtgtccccaggaattgactcatcctcatatctgagttctgggatattgttggtgataatctcagtgctgtatatttgtttttggttttctggtgtggaagtgaagccagcttgcgtctacactgccatttttgaactagaagtccacctgatgccatgtgggtctgctctaacaaagatgcctgtagctgtctctgtaggtacaattggagctactacctcataaagtttgtggtagcccactatctggtttttggaggggctagactggtaaattaaatggagatacaatttgaaccatcatccccgaatcttttaggtcttttaggatggcattaatttctgccattccctgaaatattattttttgatttactgtattggtatggagaagaggtcaatttttaaagcttccacctggccacttggcctttatcactatgttagctcttaccacacacaccgagaaacctggtgccactaatcaagtgtatttatcacaattatacactcaaggactaggtgggtctgtggatatattgtgagccagacttgggccaggacaccctaggacttggcctccataacccttactctaatcaagggcatatagtgagagttctgtgatatcattgttaactcagaccctgtttccaacagatatcaaaatgttgagtattcccctttcaccactgtatgatttcctgagtaatggtgataggtccctttggagaaggactagaggaatcattattgtgcacacttgtggtattacacaatccttcctcctggggacccagattcttctttagttaatgggcctggatccaaaaacggactcaggtctggaaatcggacaaggggtcatgattattttttatttttatttatttatttatttatttatttttgagacagagtctccctctttagcccaggctggagtgcagtggcacaatctctactcatggcaacctccatctcctgggttcaagcaattcttttgcctcagcctcccgagtaactggattacaggcgcgcaccaccttgcccggctaatgtttgtatttttagtagagacagggtttcaccatgttggccaggctggtcttgaactactggcctcagggaatccaccctcctcggccttccaaagtactaaatttatagtcatgagccactgcaccccgccagtttaacttttttttaattggcttagttgccaagagaggaagttggggaggatcctgaggagtgtatgttttgtccttggagagagagctcattgtcttcaagcaaaagagggagcacactagcccttattagagaagagaggggcacttctgtagccttagaaggttctggaaacctgaggattgaagatttttcaggtgcatcaacccagatggtttcatcccatgtgtcagggttccattttttcccaatcagggtcctgacaacagcacagtagacctgcctagcttgggtcctaacttctttggagttttattctcatgactaagtcctgggcctggtcctcagcttcctctcctcattggcttgagaacctgagagtctcatattctacgagggaggctttctggccctcacactgagtttttgtttgtttttgagacaagatcttgctttgtcactaaggctgagtgtgtagttgcacccaggctgggagtgcagtggcacagtaagctactgtaaccttgaactcctggacccaaattatcctctggcctcagcctcttgagtaacagaacaacaaatgcatgccactatgccctgctgattttaaatttttgtggagatgggccttgctatgttgcccaggctggtcttgaattcctggcctcaagctatcctcccttttcagtcttctgaggcactggaattacaggcatgagccacggctcttggtcccacactcagcttctaattaccaactaatcactctcattcttttattttgagacagggtctcattctgtagctcaagctggagtacagtagtgcaaatatagctcactgcagcctcaaactcctggggtcaggtgatcttcttgcctcagcttcccaaatagctaggactacagccacaagctactgggcatggataattttttaaatatttgtagagacagggtctcgctatgttgcccaggctggtctcaaactcctggctcagcctcccaaagtgctgggattacaagtgtgagccactatgcctggcccattctcattcttctgttatctttttccaaggtatcggtctagctcagtaataactcttcagttccactgtctacactgtttcccacctgatcttcgtgcctgccggtgcatttctttgtgttgacatgccatctcagttcaccactagtcaaagttttaataactgcactgtcagggtgtgctagcagttaacttctccctgccccagtgaggagactctcatcctataagtgagaaggcaagagaaatggctccaaaagcacactggagcacctactttcctgcaacccttctgataccaagtatcacagatgctgagatgaagattagtgggtaggagatttggattgccacctgtggaaagaaaggaaactccactgggtggaggaagaatatggactatgatgcaatctcaaaggtggccttagctgacactaaggggaactctgaagctaggatggtctttcagattgttctaatatggggcaatgggactagtctttgcatgcagcctggcccaagaaggaagtgtgacttcagatgaggtggctcttttcacttaagagggcaattctactgacagctgagggccgttgggtgcacactgccagagcgagaaaacaaaatcctctgtagggaaggggactgtgtggcatatcacagcacaccccgagaacaagggagcggctcttcatcaaataacacaatatgggcccacatattcccagaggctgctatagtgctgggcacattagtgctcaataacttattgaattagtattatcatattgtgctattgccatcctcatcttttaaagtcacttatcacttaatggatgttcttgttagaactgacactatgaagatgactatgacacaattacctgttgagcctatttgagaaattaacctatatttaacaagtttgactaattagattggttaagagccttagcagagggctaaacaaaatggtgttaaagaatacacctgatggtccaagaaaatccctaactccctagaaggtctggatagtctgagaagtgacattcgaacagtgtaatgcactttcctccagagccagaagcagggaaagcagaggcagcagcaattttatcttctgggcaccttatcctcagacctcattttatcaatacatacggactgtctacaaccacgtaatatccttttcatcagccttatgaaattttcccccaatttatccaagtcaggatttcagtatgcagaagtctaatgtcatcttggagagttcattgtgcctcccccatatccaagaccatttactaaaaccttagttcagtctttaaagagtcacaagatcctattatgcctagttttttttccagtcttttaagtctattccttaccttgccaaaaaagtacctgtttctatggtttaacaaatggagcttagaatatggaactatggtaagtgctctttagaatttaaaataagttacatgtactggttttcctttattttgtagttttgttctcaaagaattccagatatgatttttttccagacaaaaatacctgctacatgcttccttctgtatgaatacatgagacctaccttcattcatgtttcctctatgaagctttccctgcactccaaacacagagctgagacttccacctaatgtagaaagctagcacgagccggcgctgacagatggaagacttgagatgttacaagattatatatggaaacacaaaaggtaaggttaaaatctgttcattagacttatttcctaaccttttaatcactcatcactttggaacattcttgcaactgaactgaataagctgggaaggttttttgggtaattctactaacgctttttttttttttttttttttttttttttgagacagggtctcactctgtcacccaggctggagtgcagtgctgtgatcctagctcactgcagctttgatcttctgggcccaagcaatcctcccacctcagcctcctgagtagctgggactcaaagtgtgccaccacacctgattttctttttggtagagatggggactcactatgttgcccaggctggtctcaaacttttggcctcaagggatcctcccaccttggcctccgaaagagttgggattataggcatgagccaacatgcatggtcaaatgctttttaaactagtaattcacctgtgtatggttatgtcaaagaaaaatacaaggttgcatacgcttagagaaagtaaggaagtaacccattacatgtatgtttgtaaattttacttaggccatcattttttattttcacctttgaatttcaaagtaaattagagatatgtaaataacagaattatcaacattaaaatcttattcacaatggctaacaagaacaggatgacagtcaagtcagtagctttttaataaaatgagcagaatcccatcgtaacagttctttgttacatgaattcaaatacacagcagaccaatcatgttccctgaaatttaacaatcaatcatacttaataaaggcctgttagtgctgtccctcaagactctaattctaaagggcttcctttgaattccctttataaagctttgtgcaaagaagagcttaagcaccagtaagaaagactgtcgctagcatttttatttcatcatcaacaacaaacatgcagtttctttctctgatgtgcatggcactgtaaaatgggtgctacactctctcttgtggtacaaagtttataaatacagtatactgatacaaagttgaagccattaaaaagagcttaataacaactatgaggagataattaaatctggagtgttgatggaatctatgaagagatttagaaacaagacataaacactacggtaaaagttttacttgggaaggggccagaggggaactttttatgtgctactgaaagattttttaagttgctccagatttactttctttctgctattatctttaaatactgcaaagcattgtgagctgcatcactttgtgcattgccacaggagataccggagccatgacagactgtgatggggctggtggacagttcagcaagacattgatattgtccattggcgctcagttcatctgtaatgacacattcaaggatgacgattaatgtccaatatgtataaagtggatccctttgtaaaaacaatacaattcttattattgtctttctttttaagcctccatggtatactacaccactcgcaatctttgttttgcttgtacaaacaaaaaaccacaactgctcagctgtagcagttttcaaacacattacacttcataatgatctgacagtgttaaagacatacagatatctaggctgcactctagctcactcaatcagaaatatacagttgggggtggctgattcctacacttaaaaaaataacagctcccaaggcaattctaatatagttagttgaacactatttggaaattactgaaccacacagtaactttctcaaaagggaaagaaccatttgctagaggactggagagattgtattttccactaggaagtcattttcaggaggcatttgaaccaggaataacttcggtcaaggcaaaacctcccttgtgtcttctattaaaaaaaaatgtttaattgatacataataattgtatgtatttatgctgttgtccattcatgttcctaggttttaagtctgtgcagagtctagttctttatttatactgtaaatgggtcatggtattttaaaaacaatacctgacccaggaaacaaacgttcttcccatcaactgatgagccactcttactaaagatggctgaaatgagggcaaagaggaagaaatagaaacgtgtgcggtatgatttatttgaagtaggcataataaaaatgttatttttgatactctatttagtggaaaatatccagatacaatgggattatttaatgagtaaagaggctttctagttctagtatctaggttcttttctcctgaccctccagcttctgcttgaggctcatccatgttgtagaatgtatcagaacttcgtttctttttacagctgaataatatttcattggaaggacagtccacaatttgtttatccacttattcactgatggatgttttgggctgtttctaccttttggcttttgtgaatggtgctgctatgaatatacagatacctgtgtgtataggcatttgtttaaataccagttttttatttatactcctaggagtggagttgctgggtcatatggcaattcatttgaggaactgagaagcttattccatggaggctgaactgttttatattcccaccagcaacgtgtaaggttccagtttatctacatcatcaccaacacttgctattttccatttcattaatgatagccatcctagtggatttgaagtggtaccttattatcgtggttttgattgcattctctattgactaatgatatcgagcatcttttcatgtattttttggtcatttggtcatttttcttttttaattttaaaattttgagacaggctctcactatgttgcccaggtggtctcaaactcctgggttccagcgatgctcatgcctcagtctcccaaaggggtgggattacaggtgtgagccactttgcccagcccatttgtatatctcctttggagaatatctaggttcttttgaaggtagctgcatataaactagccaaattaacagactgtggtttttagatggctttccatatctacaagaactatttagttctcaaaactgggaagaaatgtttcagaggcatcattaattcataatctaaaaatttatcttgggtttccttttttcccccagattctgtatcctccatagtcctattcatgacatgggtcgttcatctctgtattctaaaccctcaatgaactgtagacagtaataaatatttattggatgaatggtctctcatcagccaccttttctttttttttttttgagacagagtctcactctgtcactcaggctggagtgcagtggcgcgatctcggttcactgcaacctctgcctcccgggttcaagtgattctcccacctgagcctcccgagtagctgggattacaggtgcacgccaccttgtctggctaatttttgtatttttagtagagacagggtttcaccgtgttggtcaggctggtctcaaacgcctgacctcaggtgatctgcccgacttggcctcccaaagtgctgggattacaggtgtgagccaccgcacctggcctccagcctcttttcttttttttttttgagacaagtctaactctgtcacccaggctggagagcagcggcatgatcatggctcactgctgcctcaacctcagaggctcaagtcattgtccccacctcagcctccctagtagactggactacaggcatgtgccaccacacccagctaatttttcatcagccaccttttctaaccatctgtctgcactgacttcccaggttctgcatcattattggtttactgagacaatgcacttcacccgtccttcaatcccaaagtagcacagaatatcaggagttctttgagcccctaagtgccctactttcccagggtcaggggaccctgacaagcaaggtccccacatctttctgtggttggatagggatataaaatttctcacacatgttaaatcaagatactttggccaggcacggtggctcacacctgtaatcccagcactttgggaggctgaggtgtacagatcacttgaggtcaggagtttgagacaagcctggtcaacatggtgaaactcccatctctactaaaaaaaaaaaaactttgggaggccgaggtgggtggatcatgaggtcaggagtttgagaccagcctggccaacatggtgaaaccccgtctctactaaaaatgcaaaaattaggtgggtgtggtggcacacagcagtagtcccagctactcaggaggctgaggcaggagaattgcttgaacctgggaggcagaggttacagtgagctgagatcatgccaccgcactccaaccagggcaacagatcaagactccatcttggggaaaaaaaaaaaaattagccaggcttggtggtggatgcctgtattcccagcttcttgggagactgaagcaggaggatcgcttgaacccaggaggcagaggttgcagtgagttgagattgtgccactgtactccagcctgggcaacagaaacaatactccgtctcaaaaaaaaaaaaaaaaaaaaaaaatcaagacaccaaacacacacaactaattagctctataaattgaattaaaagaaaatccatactgacttgctttcccatctgtccatatttgtctatccaaatgattaagggctagagaaaatacagatgatgatggctgagatgggataaaactataaattgacttggttccatttacctcccagaatcagcatacagtgacaaagtagagagaaaaggtctgggcaccacaaacttgtacttgtgctagaaatgtaggtgccttttcatttgcccagcagggctagtttaacagccagggtatcttctgggactcttccccaaatcttgctctaccgctgactagctatgtgatcttgggcaagtttctcaacctttctgtgcctttcttcctttacttataaataaggataacagaatttgcttcatagagttagtctgaggattcagtaagtagatacgtgtaatcttagaacagtgtctggcacacagtaaaactctatctttgctattgttgtttttgttataactgtatagatgttagctattattactatccacaagaatgggacatatcaattatatatattactggcctagtaattatatatacttagaatccctgatcaataaaataaattgtaatagaaatttttattcctcaaacacatttttgttcctcaaacacatttttaaataaacatgtcttgggaaagccaaagaaaaaaaaatcatacctatatccaaatatgttatattaaaaccttgttccttggcaatttcactaagcagctggatgtaatctgtatttggaatactaaggaggcttcttttcagtaagttgatcttttcaccaggagaattcctcaaggaatgccaagtacatcctaaagaatgtcctactacatttgtctgaaaaacagagatgaagatttagactcttgactaggactgggttccaacacccgtaccagtatcattaaaagtacttattaagcactcacatttaatatgttataaagcatgtttaaatggataacatttggttaattttccaatttaaacaagacaacattaaaaagtacacatttaacaatactatatgtttttaagaagcacttgcaataatatactgaaagcattttgtattttgtatagtacaaatgtttctcagtcaagttttctgatggtcacattaagaggtacaagatatctggaagcaccataagtaaatccacaaataattaaatctgcctaatggagcaatttgcagattaaaatatagaacaattttcatatctttggttttttttgtattaaataccaatcactataactgacagctatcaaacaggaaaaaaaacagaaaaaaaaactaaaaaaaacatgaaatgtgcgcgttgggtttgaggaacaagtcattcaaataaatgacaggatgtcaaaaagttcttatcagacttctatcccagaacccaactgagtatttttttcctttttctttctgcttttcctctttcctttatcctcccctatatccttcccttttcatctctgtccttagaatgccttatatttccatattagtttatggttctcaaattgctttcatatgccattaataaaaacaactactttctgaagtaagtagggttactactcttaatattgttttattaatgagcacgacagaggggaggcaatttccaaaagattttagagatggcatgatatggaattaagtaatttattagatttaccaaataaaaatttacattatagaaactttaaaatactgtttttaaataaagaacactatttacatggttaaaaatatacatgcactaagaacaaatatataatgaagagtacagtctcttttccttaccacccattccctgaagacctctgttctatttcttagacatactgttaaacatttttcagtatcttcccataaatgttctatgcatatgcaagcacacacaatcttttaaagcaaatgataacttactcctctacatcttgttcatttttcttttatcagtgcacatatatgcactgtatttaccttacggatctccaactgtgagctttaggttgtttctagtttcttgcttttactagcaataaacactcttttgcacttgaatgagtttctctgtagaattatttctagaagtggaactgctaagtcaaagaacatgtacacttttaattttgataaatacttccaaactgatttctgaaccaatttatactcctaccaactgtcttggagggggcttgttttctcataccctcactaataccagctattatcaaattttgtagtttttgccaatctaaaaggtgaaaatattttatcttgcatgaataaagttgaatattttttctttttttcccttaatcgtttgcatttcttctactgggttgtctttttaactgatgcataagagctttttaaattttctcttttttaagagttaggatcttgctgtgtggcttaactctcaaactcttgggctctagcagtcctcccaccttagcctcccgagtagctgggactacaggcatgtgctgctgtgtgcagcagatgtgtacaaaagagctttaaaggtagtactgaaaacagttcctttatagttctatgttgaaaataatttcttcccacttttttattgtcttaatttacagattttttgctgtgcagtaggttttatgttgtcaaatgtattaatcttttaacctaggttttaagttaaaatgctttccccatgctaagatttttaaaaagaaaaactcttccatgtttcctaatatttatactgtttcaaatttttatgttcaaatctttgatccatctgaaattcactttggtgtaaggaataaggaagcattctaaatagatgtcatacacatcaacaaatatatatatatagcccccacccaaatgtggatgtaaactgtttctacatcattattgaataatccatcctctcacccactgatctgaaatctcactgttgctatatactatggtcctatgtggattagcatctacgcctggattctctattcgctcctctgactattcctggcccagtaacttgtctgacaagttcagttttacagtatgttttgttctctagtaaagcagcacacccttgctctcccaactcttccttttcagttttcttggctattcttgagggtttttttccagataaacttcaataaacgtgtatcaaggtccaaaatgaacgctggtaggtttttttttttttcgagttggggtctcactctgtcgcctaggctggagtgcagtggcgtggatctctgctcactgcaagctccgcctcccgggttcatgccattctcctgactcagcctccggagtagcggggactacaggcgcacgccaccaggcccggctaatttttttttttgtatttttagtagagacggggtttcaccgcgttagccagaatggtttctatctcctgacctcatgatccgcccacctcggcctcccaaagtgctgggattacaggcgtgagccactgtgcctggccaaacgctggtaggttttgagtgagaccacattacatttaaatatatttacaatgttttctgctctattctttagtagacttttcctcacgtggtcctacgcatttctttctaagtttattttcatatagcctatccctgtctacaatttaaattgggatcttctatattctagttattatttgtaaataagaaaactactgacttttttctagtatattttctcagaataggattttctatttttctataaaatgaccaatgttatgaagcttcgtaagttttgtcaaagtgatacacacatacagcaaaaaatcaaatagtacagaagtataaaagcaacaacctctgccttgccccttctccaccttcaggtccccttcccagatacaataatttttagctttttatttttaattattctggttgttacctacataactctgggcaatatggaaaagttattgattttgtatattaatttcataatcagttaccttgatgaattctcttgtttctagtagtttttctttagggttttaaagggatacaatcataccatttgcagttagtaaccattttatctcctcttatttccaacttcgtactgttttctcttgtctaatttgtttttaattggtgggtacttctagaacaaggttaaataaaagtggtgttggtgggcgtccttatttctgatattaatgggaatgagtataatgtataaatatataaccatgattttggtttttttccaagtttttatcagtaatgattgctgagttttatcaaaatttttttggcatccattgagaggattatatattactctttgacacattaatgtggttaattaaagtaaccaacttattaaccttgaaatagtcttagttaaataaaccctacttgtcaatgctatatcattattttaatattgtactgaacattttacaaaggtgtttcaccataaggcatattgatctgtaatttttttttttctgttgaacttgctattgtcaggttttggtgtattatgttggttttggagaataaatttaaaagtttcctttatgttatctatacattgcctgaaaagagtttaaatagcattgaaaatgatctcttctttgaagatttaaccaatttcacctgtaaatctgtctgtgctttgtaattttggtgatactgttgactcaaattccaaaagcagtaaatgcagtgttttatatttttctattaaaaatgtaaaatcaaattatattactcatttgtatatagtctttgatttttttctaaagaatgagcccttattttatcataagctcagtgaagaagttgctacagttgtacttttttatttcccacctaatacactactctcagataatgtaccacatgacacacctatctgtgaatatcagaatctgaagttatatatcatgtgtaggccaatctcttaagctctgaatttatttgttcagctactcgatatattcacttagctattccataagctattccataagcacttcaaattcaatatatttagttcattatctgctcccctcttgctattgccaagtttaaaatagtaatttcctccctttcccttgcttcccacatccaatcaattaccatgcccctttacctcagttttctaaataactttaaaatctacccatctctctccattttcccagccactaccttagttcaagctgtcatgtctcacgtgtcttctgtaacagcactctcgcaggtctctttgatcctaatttcactcacttaccataatgcagccaagtgatttccttgtaatgtatagactagatcctgtccttcccagattaaaattctttaatgactttgtactacccttgggataaagttcactttccttatataggggtccctttaagatttaatccctctttactttgctggcctcattgagactccctccctccaacactatgttctacacacaacaaatcacttagggctcctagactgcatacgatgtttcactcctggcctttgcacacgctttttcttctctctggaattcttttcccccattctacaggtcttggcttagacattacttcttcctggaatctgtctccaaacctgtttttgttggatgccttcttctatgttcccacatcacactctgtaaggactagcctatagaattccttcctttcagtagtctataaactccttagaggcagggactgcttattcactgcaccccagtacccaacacaacacttagcacacagtatgagctcactaaatgtttgctaagtgaatgaatgaacaaacaaagggatggaaatgcgctgtcactttgaaggcaaaaatggcactactggcctatcatctttagatcccgtcctattattctgaatttgactgtgtctcccaagctctcttacctaattgcctctgtgatcctgactcacaaacaggaagcagctaaaaatggggtagggtataactgaataatgaagagatttctaaaaatcacaactctgaagtagctatagaataagaaatcaaggaaagtttcctactgcaagaaatgcttaatgacattaacatcatagctgtcaacattactcactaaagaaatgtggttctctggagaaatattactaaatttggcaagaaatttctcagcagcattccttttggcttgcttttttgatgccccctttcctgaacaaagaaaaagaaatggtagatttagaaaagaaattagtgtccacagaggatgatcaaacgtatgaagtactgtgtttaatcagagaacctcacggtttttattatatactagactatgttcttactgacctgataactttgtttgttatgctattttgtttgtatagctattaattctttttttttttttttttgagacggaccctcactttgtcaccaggctggagtgcagtggcaccatcttggctcactgcaacctccgcctcctgggttcaagcaattctcctgcttcagcctcccaagtagatgggattacaggtgcccaccaccacacctggctgattttttgtatttagtacagacagggttttgccatgttggccaggctggtctcaaactccttacctcatatgatcggcccacctcagcctcccaaagggctgggattatcagtgtgagccactgtgccaggcctgtatagttactaattcttacacttttgaagacatttgttttaagtttttctttaatagttatgctttctgtttttctataataattgtattttcctatgtctagcattactgaaccatatttggtttaattctgaccaattatttagatttattaaaatacatctgaattataactcctctctctcaatgtctatttcctgcttatgatcttctctaaactgacgattatatgaaattccttttaacaggaataagaaaggcacaggggatggtggagttgaaagataccataaatatctacctccatgcttttgttttatagattaaaaaactgaggtccagagaaattaagtaatttgcttaacttcgcgaatcaaggactgcatcaaggacggaagctgaggttcctgcttttggcctggtgctttctgtactggccacactacctcccaaaggcaaatagtttcttattacttgaaactattatctagctaagctaaaatcccattttaagccacttttgaaaataacaaaaacatgccagagaagttaacaggaattctcgctagtactttttaaagtgacagcgtttcttatagtttatatcctttataacatagaagttgctataattaagaaagataattttcatttttatctcactgcaattatttgccatgtagtctcttattaatcatataattttcaagtgtaatcttcctctagtcctattttctagatagaatagctgttaaaatccaagagatttactatagctttttctccaaattgaggttttttaagtcagtaatttatcaatgaagactgtttaaagtacagagccaacagtttgtctttctattaataatctatgatttttaaaaatatcaaattaagaagactaagtatcttaagccaaatatttatacttaagttcaacctcagaaagtcagagacaataaaagaggagtgtatcaatttttctgcatagaaatatttgaaaacattacgacagaaatttcgatagtcattcatcatctgaaaatatttcaaatgcctttaattgtaagaaataagtaccagtttccataaatgactctagcctgcaaattgtagtatattctctcttatgagcaggtcctccctcctgggaaagggtatattcaggaagtctccagccatgatgaatagccaattcctataaaatcaagatgaggctttaatagtaattttatgcaatggctcaatcacataagtgttttcttaattttgatcccatttctatgtatatgtttgaaaagaatagtgatattctgcaacagaaaaaagagggaagaccctctatttctcaaagacattcccgcattttatatttttataccccaataccaaaactgaagcagttttgtgctacgaatggtgttcttgcattaaaccacagtgagctggtatcagacatcaactagaaaaacaggctactaccgccctctttggcaacaccagaggagaccatctacaggtttcactgccatcagttcctaaagtccctcccctcctagctatagacttccaaacccacagctggccaagaacacatgaggagtagggacagcaaacaacagacttgcataaagtgggggacagaaggtgaagaaaactatagaaaagctcactgtgcaggaaaaggagaccaaaggactggctgaataatggggagggaaatggcctaacagagcacatggataatctgcaagaaggatattctgcatatagaaattcaaagctgaatatatgtgtgtgtgtttgtgtgtgtatagataaaattttttttttttggtagaataagcaaatagactccttttcttcagttaggttcactgatttgatttaggctctctataaagtcttctgtctcaacagaagtagaaagagatttgtcacaagagtagcaagaactattcttaaagtataaaacactttacccatgtgcactgagggcctgttgatcttaaatgagaattctataagccaaaggcaaatactgtatatgaaagaaaacccagaacataaataggaaaataatttcaagttagctctgttaatctaatgatcgtaagttggaaaacaaaatatatcactatcttgtctttaaaatattaattccttgtgttagcccctctgacattacaaacttattatatatttcatcagtaggcaaagaactgtacaacttacctgtaatgaaccaataggattaagctggttctttggttgcttggaagggtcaggcattaaggggtcaggaactgcaaagctaaatattttttaaaagtgttataaaacaaaataatttcccccgaattatgaaataaatgacaagcattttctaattaactctctatgtctttgctcttgtcattccttctacatggaatgcccttttctcagacctcttctatgggaatctgatcggtcatccaagatatatctcaaatgtcacttcctccaagaagcctatccttttaccccagtggtttataatctctcccttctttgaaacattataacacatggtttaatcctttcttgaaattgttttaccataaattatatactcttacaaatacatataatttgtccatccttcaccacacctctcccctgttcagacagtaagctccttgaggtagggcctatgtatcacttacctacataagctttgtggtgttttgtacataataggcatgccataaaaatgtatttaaagaatactctgttacaactatacaaaaaacagaagagtaacaatgatccagaaaatttagcctggcaatgtgaataatacagattatgtgtaaatactgttttttcatccacagaactatgaagagagatctgtttgatctatcatctgctcagtgctgggataatcctctaagatttacatgtatcctgcagaaaatagatggcttagatgaatttggttttagcaagtggggattatgattagggaaaaagagaacaacctcttctagggagtctggaattactagttacttagcaggtcagtacttaaaactgaataagcggcatttcaaggttagtaccacctaggcaactggagtcatttttccatgacaaatgaggtttagttattgccacttcctcaaggttttttttttccaactgtgagaatttcaagctttacataggctgatgagatatgagtattcacttacaatgctgcatgccgaagctacccaaataattgtgatggagaagtgagaaagtctctgtattaagtcaggccactttaggcctgattacagcttagtaattcccattttatctgtcaagaagcacaaatatagtaaagtttgttagctttttttgctgacaaagtgccaagatgcagaaaggacactccatacccctcatttctacaaatgtacttaatggttgggttcaccttcaggctatacagaaacagcatggccatcaccagtgggggagaacccaatacctgccatgtcatttggcatgtcttttttttgtttgtttggagacagagtcttgctctgtcgcccaggctggagtgcaatggcgcgatcccagctcactgcaaccactgcctactgggtccaaggaattctcgtgtctcagcctcccaagcagctgggattacaggagcgtgccaccacactcggctaattttttgtatttttagtagagacgaggtttcaccatgttggccaggctggtctcgaactcctgactcaagtgatctgcccaccttggcctcccaaagtgctgggattacaggtgtgagccaccatgcctggccttgtttttctttgaggcagggtttcacaggctggagtgcaggggcacaatcttagcttactgcaatctccgcctcccgggttcaagcgatttttgtgcctcagccacccaagtagctgggattacaggcgcctgccaccatgcctggctaatttttgtatttttagtagagacagggttttgccatgttggccaggctggtcttgaactcctggcctcaagtgatccacccacctcagcctcccaaagtgctgggattacaggcgtgagccaccccgcccagcctggcatagatcaattataatgcatgaccctagagaatcaagcatcatcttgtgaaatgcaaggcttgtcttgggcagctgcttatctagagggttgccatgtcactggttagttctaaactacccaaacggtttagaatgatttacaaaaagagaggaatactacatgagaacctaactacacccctaatccaaaagcctttctatgactagggaacaaaaaacccatcccaaattccctgggtctctactgtcaactataagctgattacacagatcgtacttcaggcatatgtaagtgtatgcacaagaagaacttgaaagcatgccaagctccagagtgcacccagtggacactactttaatatgtgagatgctccaggaccaatattctatctagaaacacctaaagtagtaaaaaatctatcccagcactttgggaggccgaggctggcggatcacgaggtcaggagatcgagaccatcccggctaaaacggtgaaaccccgtctctactaaaaatacaaaaaattagctgggcgtagtggcgggcgcctgtagtcccagctacttgggaggctgaggcaggagaatggcgtgaacccgggaggcggagcttgcagtgagccgagatcccgccactgcactccagactgggcgacagagcgagactccgtctcaaaaaaaaaaaaaaaaaaaaaaaaatcttactttagaaagatatgtcaagaattaatatcccacttaacattctcttcttttggtatacattatataataaaagaaaacctctgcctgcttcttcaaaattagaattcccaaaagagtacttttagtggatctttctccatctcacactttgttttcttcaatgtagaaataatcaaagtctaaatacaaaatgttaatattaatatttgcaagaagcactgattttctactgttgtatcccattaaaaaaaaaaaaacagtaaagcctagttcatgagcaccttcatttaatagctaattgctggatttgattggataaagttttctttaatggatgataagttttcataaggaaatagaatttgagaggtaggatgctaacaactgttcactttgttgcttttgtaagcatgttcaaatttttaatcttacctcagccatgatatttttgagctgctgaatacaaagaaatttagctcaccaaatacttgcattggctttcaaaatgtttatggcagcctctgcagctctatgtttcgccagcttcttacttgtaccttcacctgaattaagatttaaaaaaagaagtctttatctcccacaaaaatgtgcagcttacaaagatgttttcaatacacaaaacaaagtcactatagattttacatacacatactaggtaataaaaatatgtacgttatatactgtacataaaaatatgtacatgttatatactacatggttatatactgtaataaaatattcaccatgtgaaaaaattttaaaaaataactttttaaagttctatataattctatgcatacctgcataaaaatccttatttctacattatatatgtttattatataacatggtaataaagtagaccgtgtcacacctctgaagaaatgcagattagtattttactcttcctttattcctggaggggaaattcttctgcagcaagaagtttcttttaaaggaaccatttacagcagaattgtttgatagcaaaatgtgcataattttattctgacagcctgtcctataacgtatcaaactgctttgctaggctgagcagtcatgattatgtgttgggtacaacaggaaagagttttatggaataaggtgacagcttgttatgtatcttctggacggtctgtatcttctgcatgggtagctaagttgggactggggataagactgatgtctaatttcagtaagcaatcacaatggcaaatgataaattccatctttttccttttaagttcaaactcccataccctcatggaataagtttcaagtgtggccttcaagtgtggccctcaagtgtaagaagacacagaaaccatatatttatctgctaacacaggtattagggatatagcatacagggtccctgccctcaagagccaacagagtagtgtgggatttttgtctgttaataggcacctgaagtatggaatgggatatgttacaacaagcctaagtgcaggctgtagcggaggttgcagtgagccaagatcatgccactgcactctagcctgggtgacagagtgagaccctgtctcaaaaaaaaaagaatgaacactggttgtaatgtgacaaaaggacatcacaagactagaaggtaaacgtgtagctacaagactgcagctacaatccaagtgagagatgatggtggcctaggcagtagcaatggccagaagagagaagccgacagattcaatggatagttagtggattattaaacgccaatggatagagtttaataacagactggacaagagggagaaagacgggaagtagttaggaagacaaaagcctacatttctactgaactaggtgattgtggagcctttacatagaaagggaatgcaagaagaatgggtttgagggaaaagatggattcagtttgggacaatgagaggcttgaggggcctctgtgtcatccaggcaaagatgctcagcaagcacagactgatacactattctgtaactgggcttgggatgtagacagacatttcagaatattagtctttagacagtatcagaagccatggaggcagataagcttgcacaggaagccatggtagtgtgagaagagggcgtaggcagaacggttgccataggttgttaatttggggtctaaaacacattgagagggaaaaaccctcccttttcttgaattcttcctatctagaaatagactagctaaagtaagtaatgcagtgttgactctatggttcccatggggacccttccggccagcacctacaatctaactgcctcacacaaaaagttttaaacttttcttaaagtggcatcaattaaaataaaagactccaaacttccagggacacaaacaaatgctgtcttcagattttccagatggtagaacttgagccttcctactaaatttttttcttggcattcttccaaattaaatttagcatccaatgttttctgtgtttgcaattaaatagatacataagaaaaataatgtccacatttacaaatgagcaactttagttatcatttgctcaagctcacagaccaaaagaaagcatgaactttaaaatttcattgctttgtgacttcattgctatacgcatgttacttataatctctctgaacctgtttcttcttgtttaaaaagtggataatatacaaaatatctgttcagtttcaaaaactagaagttattatgtaatatatgaggaccttctccccttcctcattttgtttggatacagaatcaaaagtagcacaatggacctaaagtgccaaatgagtccatacagagaggagagacgctcagaaaattctggggtcatgcctcctggcatccgctataatctatgaaacttcacagtacctactgacccagctatgactgctccaagaacctttcctgcttccctctaattctaagaagaaccctaggaggatcctagggtatgagaagagccatgcaggatccagccatccggctgggtaactttttagtttctaagcttccttggtatgtggggaagagaaaattaggaagagaatcagatgcagctgaaaagccctaacgacctgagatgagaggtctcagtttcagagcctgttcctcacagctgtctggcaaaaagagaacttttccgaactgaaaagcaacaccaagtattgactgccaacccactcggtcatccaggttaactgtgtatacagacctgtgcaggttatgtcaccaacggttactctgaaggtgaaagtgggcacgtgtatttgcacatcagatctttcacattcataaactgggatgttcttggtcttcatgccgtattcgtgtaatacctgaatcggtgttttccctggcttagctgttatcatcttccccaaactgcaaaaaccacaaaaaggtgtgctttgcatgccaaattggagattgaagcagaagcgtagaggccagttttaaccgccaccgacggtgacgagggaggcgccgagttccccggaggccagggccagagctggcgaggctggggcgcacctgtcttccggccccgctgcggcagtcactccgcaggagcaggcggggtgagcgaggtctttagagagagcacttgaatgcgggtaggagagattctcaacagaacagggctggcagcagcgccgcagcctctcagggaaaacctgacgatcccttcccgggcgcgccgaccgagcgtcacctccgcccgccccgcgcgccgccagggaccacgagaggggcggggcccggccgcagaccccaaccctcgccgccgagagggcggggccgagcacccacagccgcggaggcgtgggcgccgggcacggctttacccagaatgcctctggagggccggctccccgcgccccggccctgccgcccaacgctcccggccctggggccctgactgcccgcacgctgacctgaaggtcccactgtcctcgcgctccagcggcggggcctcggcgcggtgcctgctctgggacatggcgagaagggacggctcagcggctggaggaagagcggtgcggagcgacgtgctcgctccccgggtcgctggtccccgggaggagctccagcgccgccacctcctccgactcccccgcctcctgcttgcgttgctccagcgagggggcaggcagggtgggggcggagccttggtgccgtagctccggctacgccccctcgctgctcctctgcgggcctccgtcccggcccaactccgcccctgtcccttccagggtccgcccccttcccgcccggctccgccccgctcccgcgtgggcacaggcattgggctcccgggggttctccgcgcccgcccctgccggccctgaccagcctgtagtaactggcccctaggccgcagttctttgtccttagcaggaggccgtttcttgccgggagagagggattagagggattgtccggcgtgggtctagggtcgttgaggcctaaagttaagcctttgtggggaggacggattgggggctgggtcactttaagaaaaagattctaaaattacgaaggcagaattccagggagtctcccgggcctggtcctgaagcttgagaccccggatatatacgctccagggggctgcggtgcgctcttcgggtccccgagccctgtgtttaggaacacgcggggacgtccaaacacccgctcctctcccgccgggcgggctcctttgtcttctgggctttcgtcgcgagatggaacgctgggtcagtgcatcccagcaaaacacgttaggagtaaacgaaggcctttccggggacctgggtagtcggttgtaatggcgtttgcctgggatgcagcacctttggtgggccattagatgacgtgtcgcttctccaggggcttgctaggcactagcagaaatgctcccctgtgcttactcggtgttatggaagattgcttgcacaatgctattcgtacgaaaggatattattaaaagtgatttatgggcgggcgcggtggctcacgcctgtaatcccagcactttaggaggccgaggctggcggatcgcctgaagtaagcagttcgagaccagcctggccaacatggtgaaaccctgtctctactaaaaatacaaaaattagccgggcgtggtggcatgcgcctgtaatcccagctactcgggaggctaaagcaggagaatcgcttgaacccgggaggcaaatgttgcagtgagccgagatcgcgccactgcactccagcctgggcgacagagtcagactccctctcaaaaaaaaaaaaaaaaaaaaaagcgatttgttgttttgttagcatgtaagccctggatgcttgaaacaagtgaaagatgttcagaatctaatcaaattatatcatctgatgctttaattagagcctattctctcttcctctccgtctatatatgtatgtatatagattactatccatcactgttttaatggatatcttattggaagggctacatagtcagtatttcacaatatatgaactccgcataacacctatggcaaaacatttcagcactcaggtaaaattcattttttgccacaaaattacttaaaaacaggccagaactttatatagctcttgttaaaggttaagtagctgggataataatgaaacaaaaagatgcagcaggactccatttcaaagagagagagtctgtgtgcccaacttcagagtaagaaaccactaggtaatagtttatatagttacttatatgtaatgtggctttattttttaaataaagatttgcatataattgtttatatctgtgaatttatatttaatattaaacacagttttgtaagcatataagatggaaaatgaatgaaatgctcaatcaatgagctgtatgccatgaggattcaaaacagcactttggtgttgccaaaattccggtggtggacttgtgaaggaattccctttggactaggtccactgtagattgtatccgggactatcgttagtgcctaaattgcattgcttcccacagcactatatgcttcccttaaaattggcccattgccagtggcaaatcactatctactgtgatccttatcatagacattggtcatatttttacgttattagttttctgtgtatattttagtgctatagcctgccattccaagttaaacatgctcttagcatatcattttacaccgttgatctataattcattacctgagcacatgagcagaggcagggaattatacagtggtaaactacttggtgaaaccatgctttgtatttttaagatgtataattatatttaaaaacaagcaatgcttaattttgtgcctgattttcctctttaaaaatggatttatctgggggttgcagttgatgacgttttgattttaatatgtttgctgctgctaccaagagctttgtcaagcaagttggagatggagggagattagttcctgttccaagcctcagtgaagctgacaaatatcaacctctaagtctggtggtaaaaaagaagcgatgctttctgtttcctagatataaatttacttcaacaccttttacactgaaagatattctcctaggagacagagaaatttcagctggtaagtttaaatgtttgggagtgccaactcattcatctgtattattggcaacctaaacataggtcatatatgctacttatgttagtaatacacattttcaatgattaaagcaacttttattatgatgttagtgtaataacattattaagattaacaatgccaaaagtttgtataatatcaaatctcttattggtcaaataattttcaaatctatcaattattttataaattgttttaaccaaatcaacttagaatatgacatatttcttcatctataaaatgggatattatttgggcttacctatgttacatggtcaaatgagatgaaaataatttgtatttattttttacaattcaattattacaattggtaaactgaaatgtattgaagggtaggttatataataagctgatattttgatgagttactacttataaacgcttattttttcttttaattgcccggtggatcttgatgcttaagaagttctgttggctgaatagaaaatttgagttccttttaagaattctggctatgtgtttctttttgttgtaagattaattgaattactactttaagtcttggtgagtcatgttgcctttctctaacatttgggtatttgagtcttcaattgttaatttaacatgttactatatataatctacataagataaagatgtttaaaaaatactgagtttcttcttataaaggtatttcatcttatcaattactgaattatgaagatgaatcagatgtttcactctatggaaggcgaggtaaccatattgtaaatgacgttgggattaacgttgctggatcagattccattgcagtgaaagcttcatttggtatagtaaccaaacatgaagtggaagtatcaacattactcaaagaaattactacacggtcagtataataatcctaatatatttcagtgttttcattaaatactttaggtatataaacttcattacaaagaatgcttaaaacattgaggttgtattttactagtgtaatttgctagatatgtttgaaatacattggtagtatatccaaactttgaataaggatagatatcaaaaatcacttggctgaagtcagagacctcagggccccagatcaaggagctaactgatgaagaggcagagaggctgcagctagagattgaccagaaataggatgcagagaatcatgaggcccagatcaagaatggcagccttgactccccagggaagcagaagactgaggaagatgaggaggaggaagatgagaaggacaaaggaaaactgaagcccaacctaggcaacagggcagacctgcctgattaccgctggaccaagaccctgtcggagctggacctggcggtccctttctgtgtggacttccagctgaaagggaaggacgtggtggtggcatccaacggcggcacctccaggtggggctcaaggggcagccagcgatcatcgatggggagctctacaacgaagtgaaggcggaggagagctcgtggctcattgaggacggcaaggtggtgactgtgcatctggagaagatcaagaagatggagtggtggagccgcttggtgtccagtgaccctgagatcaataccaagaagattaaccctgagaattccaagctgtcagacctggacagtgagactcacatcatggtggaaaagacaatctatgaccagtaacagaagtccatggggctgccaacctcagacgaacagaagaaacaggagattctgaagaagttcatggatcagcatccggagatggatttttccaaggctaaattcaactagcccctgtttttccctccctgaactcttggggctgagctgcaaccacccaactttctttcccactcttctctgggacttgtgggcctcagggcttggggcaggcatgggactggcccaggcacacaggtcccagggcatcaggagaaaggctggggcttggggtcttgtcctccccagttggcctactgttacacattaaaatgatttgcccagctaaaaaaaaaaaaaaaccacttggcttaaacaaaacttttaattgttccacaaaattactttggctctacacacatttgcttaattattagatttaaataatacagcaatctgtctgcaacaaatagagtccccttcaacagactttcaacagacagagtgaaacattctgcataagcatgttttaagaaaatagagaggagagacaaattattacatttcttttgggtgtattttctgactattaggattgccttgatttactattaggtgaactatgaatgaataacacatgatagcaaaaaatgtatttgattatgtgtaattagatgttatagagtcttgtgaatgtatcttctttattttagaaaaattaactttgaccacagcttgatacgtcagtcaaggagcagcagaaaggcagtattgtgtgtggtcatggagagcatccgaaccacacgacagtgctcactgtctgtgcatgctggaattcgaggggaagcaatgcgggtaaaccacacttgttgggttctcttactaactaaagtgttgccatgggaatttttttaagtattgaatttctagtcaggcttgtgtattttgtgaaatgttctgatgaaagagctgcagttgtataggattttgcacagcaatgtctgttctagaatatgaaaaaaaaaaacaaatcttgggattctaaacatgtgtaatataatgcaaaaacagtaatccttgtgaaattacgtgcatactggagtccctcaagttactatttaagtgttgttttaagaataaaaattgagtgagttgaattgattttatttttaagtgatacagtttttgactgggcacagtggctcacgcctgtaatcctagcattttgggaggccgaggtgggcggatcacttgcagtcaggagttggagatcaagttgggcaacacagagaaaccccatctctactgaaaatacaaaaattagccaggtgtggtggtacacccctgtaatcccaagccactcaggaagctgaggcacaagaatcacttgaacctgggaggtggaggttgcagtgagccgagattgtgccattgcactctaacctgggtggcagagtgagactccgtctcaaaaaaacaaaacaaaacaaaaaccccaaccaaaaaaaaaatgtgtaacataatgcaaaaacagtaatccttgtgaaattacatgcatactggagtccctcatattactatttaagtgctgttttaagaataaaaattgagtgcttaagttgaattgatttaagtgatagagtttttacactttgaattttttaaagctgaatttatagattttttttttgagacggagtctcgctctgtccccgaggctggagtgcagtggcgcgatcttggctcactgcaaactccgcctcccgggttcatgccattcttctgcctcagcctcccgagtagctgggactacaggcacctgccaccacgcccggcagtgttatccaggatggtttcgatctcctgacctcgtgatccgctagcctcggcctcccaaaatgctgggattacaggtgtgagccaccgcgcctggcctgaatttatatttttatattcaaatagtttttcaaagttaatattatcaatggccatacatgctttattcaaggttagttaaatcctttaaaaaatattagcggcaaggtgcagtggatcatgcctgtaatcccagtgcttaggaagactgagataggaagacagcttgggaccaggagttcaagaccaacttgagcaaaataatgagaccttgtctctacaaaaaataaaagaattagctggttgtggtggcacatgcctatagtcccagctactcggaaggctgaggcagggggctgcctgcggggtttgggtcattgtcttttagaatttgggaggctttgaaaagccgtgcttttgtgctggggaagatgtagcagtctcttctccaaaccacccatttgccttcggacttctctggggccagcagccatccaactaggggcccggggccacgggctcagctgacgaccatgggcttcgcgtccaaccagcagtttgcaggttcgagctcaggacttggcggggacaccttaggatgcaggagtggccaggagttcaaggttacagtaggctatgattgtgccactgctctccagcctgggtgacagagagagaccctgtctctgaaaaaaaaattggaaaagtatctgtgtttaattttcagctcaattatgatattgtttatctttgtcattcagtgacacctaataatgacttgattggattaaaaccaattgttagaaagatagggttcaaggataatcttttcaagtctttgcaaataaaagttattttcgcatattcagctgcctgtcaaattctgattaacattggatcatttttgaggcacaaactgaaacatttacttgattgttagcgattgctttagaaagctactaaaagctctggagggctttggaatggtagacaggctaggctgaaaactttaactctggcactgctttctaagatttcctgttaaaaaaaaaaaaaaggcttctgctccagagcattatggttgtggtagcactaatcatgggctgtaataccaaagtaagtgaaaagtgcagaggtatttcctaatatagaccaggagtttctgttggaccaattggatctctgctataaaaaatggtttaattcaagcagaataatcctttacttgggaattttttgttttgtttttggtaggattataggaaatgtttcatttctccaaaaagctatccttacatgttatgatccttaattatgttatttatttattcaatatagtttcactttatggatgaacagaatcccaagggaagggacaaagctattgttttcccagcacatacaaccatagctttcagtgtttttgaactcttcatatacctggatggtgcctttggtgagttaagggtctgcatgaaatacaaatgattatatttttaaggagcattcattagggcatgtgctctctctctctcttttctctcatttctcgtgtctaacaattatagaagatgctctcagcactgtcaatcttatgctttggcaaaatagctgagaaagaccctccgttcgctgcttccccattccacttttctgcttcttggtgaaggttgtaaactctccactaccccatttaaaattataaataagagctaaaatgccatctactgacaaagtattccttagcttacatggggagataataaatgaccttcttataggtagtttttgatggtggcaaacagaggagtaggtagatagtaggatgcctgaagtgttaggatgcccaaaccagggcctctaaagacagcttttcttacttcagttttacttatcatagacccagcttccccttgcactcttcctaaaaaataactttaaaaagtgaaaatacttcctccaaaattgtcaccttgtataatacctaagtgcagctcactttaggtctctacatttcacaggtctttaaggtctgttggccaactggaacaagtccaggtgtagcccaagggatcaggaaaggcagcccctagccatggtaatttacaaatgtttttagacctgttcttgttcatttctgcaattttgtaggaggagggaatagggagtccagaaacaaaacaaaactacatgttaagtaaattgtctttttaaaaaatatttttaatttttgtggctatatagtagattatatatatatttatgtatgggatacatgaggtattttgatacgggcatacagtgcataataatcacatcatggaaaatggggtatccatcccctcaagcatttatcctttgtgttacaaacaatccaattatactcttttagttatttaaaaatgtacaaattctcagtctaagatggagaaaaaactgtacaattacattattttgactgtagtcaccctattatgcttccaaatactaggtcttattaagtaaattctaattggataactttaggtttttacagttttattgatggttgggaggaatgtaaatggactgatatatccacaagaatttaaaatatatatataatttggacttccacttctaggaatttatcctacagatatatttacacatatatgaaatgatatgagtgcaagtatattcagtcctcaataacaagagattggaaacaacattaaggagactaaataatggtgcatccttgcaagagaatactatgaagccaataagaatataatacttttaatagatatttttcaagagctgagtataatatgtaactatttgggcataaataattttatacacatacatgtatatatgcatctttctttatgcttataaaatatatggagtatttctggaagcaaacataagaaacttaaaccacgggtgcccctaagcccctgaggtagaagactgtggctggatacagggtgggccagagacctatttgtcactgtatctcctttctgtatgaattttgtaccatgtgaatgttaccttttccaaaagtatgtaaaagtcaacttttaaaaacaatacaatgaatgatttgtactagaattcatcaccccatcaaacaataaaatatgaattattcaagttataacatcttctaacaattttttttgtagacctttgtgtcacttcagtgtcaaaaggaggatttgaaagggaagaaacggcaacatttgcactgctgtacaggttgagaaatatcctatttgaaagaagtatgtttattgaagagtactgtgaatgtcttttttttttctttcctggcttaacacatgaggttttctattcagtaatctcatctgttaaggaaaaatttaaatttaaaagcctggctggtatggtggctcatgcctataatcccagcactttgggaggccagggcaggcagattgctagcactcagaagtttgaaacacttgggcaatgtgagaaaaccccatctgtacaaagaatacaaaagaaaaaaaattagttggttgcagtggtgtgcacctgtagtcccagctacttgagaggctgaggtaggaggatcacttgagcgtgggaggcggaggttgtagtaagtggagattgtgccactgccctccagcttgggtgacagagccagaccctgtctcaaaaaaaaaaaaaaaaaaaaaaaagccaaattatttcatgactagtggattcacatatttattaatgctgtttgcattatgtatttttcattttcacttctaacacatttcttttctgtttttgtccttttagatagaagagtgatggatgtcatttctcgttcacagctttacttggatgatcttttttctgactactatgacaaacctctcagcatgactgatatttcactcaaagaagggacccatatccgagttaacttacttaatcacaacattcccaaagggccttgcatactctgtggaatggggaacttcaaaagggagacagtttatgggtgctttcagtgttctgttgatggtcagaagtatgtgagacttcatgcagttccttgttttgatatttggcacaagaggatgaaataaaatgaaaaatgaatacaccgtgttggtgttttaggtgcagttgtgccacaaaccttccctaaattatctaggtttgctttgatgaattaaattaaaatgagaaaagcaaaaagaaattaacctgtctgggtatcatattccctatctataaagtagcaattataacagtagtgtctatttcttaagttgtcatgaaaattaataacattgtttatatcaaaaaagatttacatataaaattcagagattatgaatcatgccagtcactttagaatcatttttgggatgtagtctatcattttagttcaccttttttttttttttttttgagacagagccttgctccgtcacccaggctggagtacagtggcatgatctcagctcactgcaacctctgcctcctgggttcaagcaattctctgcctcagcctcccgagtagctgggattactggcgcctgccaccacgcctggctaattttttgtatttttagtagagacagagttttaccatcttggccaggctgatcttgaactcctgaccttgtgatccactttcctcggcctcccaaagtgctgggattacaggcatgggccaccgtgcctggcctagataactttttatataattaagagatttttgtaaataccaattttattttcaatcaactttcagttcaatatgtaaggatgacaagactgcacaagtagcaacttttggtgtttcaactattgcctttggtctggtaaaatgagaaaaatgtgttaataatttaatgcaatcttaaatgtttaattgcagtatcaaattaaaagcacactgaactcaacatggggttttgtgtacacagttaacaaggtgactgatagtagtaatgggctgccattctatgatgtggatatgctcacgagttttgtcttcataaaacgcaatacggtcattgtgaagttaagacaggtaagacacatctgtttctttgaaaatgtttaaaacatttaacatattcaattctgaaagatctttttaatctactctgctgagaaatctgaatttttcatacacaaacaacctaaattactatttacctttattaaaataattataaaatgaataaaatgttaaaattctagaactcaaggcaaccccctttgggtccctccttgaatgggagctctgttttcactttatttcactgtcttaaatcttgcaactgcactcttctggtccatgtttgttaaggctcgagctgagcttttgctcgccgtccaccactgctgtttgccaccgtcacagacccgctgctgactcccatccctctgaatctggcagggtgtccgctgtgctcctgatccagtgaggcgcccattgccgctcctgatcaggctaaaggcttgccattgttcctgcacggctaagtgcctgggttcgtcctaattgagctgaacactagtcactgggttccacggttcttttctgtgacccatgacttctaatagagctgtaacactcactgcatggcccaagattccattccttggaatccgtgaggccaacaaccccaggtcagagaacacggggcttgccaccatcttggaagtggcctgccgccattttggaagtcgcccaccaccttcttgggagctctgggagcaaggacccccggtaacactttggcgaccacgaagggacctccaaggtgaattgaaactgtaaaactacaaatggttcatcaaatggagccccagatgcagtccatgactaagatccaccgtagacccccggaccggtctcccagcccatgctctggtgttaatgacatcgaaggcacccctcccaaggaaatctcagctgcacaacccctcctatgccccagttcagcaggaagcagttagagcagtcatcggccaacctccccaatagcacttgggttttcctgttgagagtggggactgagaggactagctggatttcctaggccgactaagaatccctaagcctagctgggaaggtaactacatccatctttaaacatggggcttgcaacttagctcacacccaaccaatcagagagctcactaaaatgctaattaggcaaaaacaggaggtaaagaaatagccaatcatctattgcctgagagcacagcgggagggacaaggatcaggatataaatccaggcattccagccagcaatggcaaccccctttgggtcgcctccttgtatgggagctctgttttcactctatttcactctattaaatcttgcacctgcaaaaaaaaaaaaaaaaaaaaattctagaactcaaaatgtagtcacagcactcaatgccacatatatgcatatgaaggcataaggcaatcatgcagatatatgaaatacttgtacactgtattgtatgtagaatgattataaatttatttttaattatgtaaatacaagttttagaatgaatcatcttcctattcatgtggcattatctgtcattttttaaaaacaagtttaaaagcactttgtatgataatgggacaaaaaaattagaattacaaagtttagattatagggtgacttcttaatatggatacaaaaaattgagacaggttccaaaccaaaataaagaatattgagttacttagtttacttcaacggagcaggtttttttgagggaaggcgatgaaagagtaaatgattaagcatgtgaaaaagtattagaaaattgagcatagaaatgaagaaatattgggaggaaggaaaagatagtacagattcttgttttataaggtgtcaaattatgtgctagccatatgtattatttactaatctcatggttgtgttacccctatgtatacttttgtttgtttttgtatgtactcatctgaaagccctctatttttaaatagaatttttgatagtgtaaagaagttaaaggatgaacaatggtttggaaagagcaagtttcagaaggtagaaaaaactttacttgtttggaactcaattattttgaacagagctatttactgtctgaccatactttcctatatatgcagtgtagtagtccattttcacactgctataaagaactgccccagactgggtaatttgtaaaggaaagaggttaaattgactcatggttccccatggctggggaggcctcaggaagcttacaatcatggtggaaggcggggaagcaaggactttcttcacaaggtggcgggtgggagaatgaatgcaagaggaactaccaaacacttataaaaccatcagattgcatgagaacagcacggggaaaaccacccccatgattcagttacctccacctggtctctccattgacatgtggggattatggaaattatggggattataatttcaagatgagatttgggtgtggacacaaagcctgaccataccatgcagtatgcaaaatctatgttccgatagacatgtgccctttctttggtaccaacgtgatcttctacagcatctcttacatactattctcaagtcatatgatatcataacttgaccatgacacaaaattgccatggcactgtatatcctcctttgtttggcacatttatcaaaatttgacagcataccaatttgtaatgatcattcatcattagtgacaagaatgatgggaaatgaggtgacataaggaaagagataactagagaaagggaacgaaaactaagaaatttcatggcatcaatttaaaactatcaagacaaaagcttggggtggcagacatcttataaaggtttacaagagggaagaggagttgcacatttacaataatgtctgaaggaatacaaaagccaggcagtacagtctttatgcttgctataagaggcaaaaagtctttggtttggtcaaatatttttaaacattccccactggaaaatacccaaggctagaagcttacaccaaaaagtttagagactgtgttgcgttctttgtggaacagagatatacaactatcttcctgcacatataccaaaggaagactcttcagttctaggatttttatatcgtcttcataatgttataaaaatgtataaacaagtgaaatgctaattcctgggtccttaatggatattttcaaaatatgaggcactttaacttttaaactataaaaaaactggatattaacatgctggtaaggttaaagttgggaaaagcttgcagtttttgacatactatacatgtcctcctacatcctgaaaggggaaaaaatgcccactgggacccagaggtctgtttcatggtgctacaattcttgtttacagaataaagcagtaggaaacacagtcataccattcctgcaagttaagtttgcaaaacagcctcacatttattataccaaaatcaatgtattggggagatcaaaatatcttctcataggggaaaaatagcaaatacaacttggagaaaagtgactttgttttatacataaagtacagtaaatagctaaaaaaaaaaagtagaaatacaaatatgctatagttcatcgtgttggtatacattgtattccttgggagaaatgaagccatcaccatcatggtcattcttcttaaaaatatcttctaaaactgcatcctgatatgacttgtcacgtggcttctcatctttttcaaattccctttgcaagtagaggtttatctggaaggccaaaataacattcctttaattaaaaggtatcacagtgaatttccagtaactttaaggaatagttataataatgaaactcatgtgcaagattacttacagtaaatgatacaacagtatgaaaagctatttgaggttttatttttcttattctttgaagcaatgttttggagagaaacaggtcttcaaattagttttccctaagatgatagatggttagtggtacatactcgaagattaatatttaaactgaattttgttgaaactaaatgctttctaataatccatgctgttcctattatcaaaggaaaatcacgcatgactgccattagtgaaagaaacccaattggcatttctataatctctaaaactaatgaatatgttgtataatcaataaaacacaaccatggggtttgaaataaaatttagtattttaagtttttctatgcttctatagctctcctccaagtctacataactataataatctctttaataatgtcaaataaagaatcctgaagtattcactaattatataaaatttctatatgcaaacacacattaaaagtattgtccaatatagtagccactagccacatgtgactaatgagcacttgaaacatggctagatcaaaatgagatatgttactataaatataaaatatataacagattttgaagacttcaaaaagttatctcattgataattttacatcgatctcatattgaaatggcaatattatagatatattgagtgaagatataacattaaaattaatttcacctgtatctttttactttttaagatgtgactataaaaattttaaaattatatgtgtaacaattgtatttcctttggaaagcactaatccttataataactaaagaaagcaatgcacaatcatctggaggtaatgttcagtaaggctggcattatagaggcaagagtatttttgaaagctagagtttgagaggtttttagcaatacatatcccagggtcaacccattgcaagttgactttattttagagcaatcagtggaccttaatgaaggatacatcaactgttctcaaatgggactttggtcctacatgaggcagacacatttttttcttccagccaaagcttagcaatcctatgtaggggtaaacaatttttaataccttcaaatatttctcagtttctaagtaagtcaaattatttttacataaccaatattgctgatgcttaaacttgactccttttccagtaaactacagtacagaggtacaaaaagacagtgggtaagaacatgaccttaattttgctagtaatgggttccacactatttccactttttaatttaataaaatactgtatttcccccgtcctttccgtctttattaatattaaagaaagtttttctttttcttttttaaatgttccttcctgtacactgatgaaatagtttacttaatctttctgacaatgaataaagttttttgtttgtttgtttttgtttttgtttttttagttcgtgtttctacttcaggctttgtcttggatttgctgtgtggtcttctgcaaattaacctctctgaacctcagttttgtcatctgtaaaaggagataagtaagtatctatattgtaggattgatatgaggattagaataatgattatggccatcaataaaagacagctattgttattcaagttagtgaaaatcactctcatccatctggcaataaagcagctgatatcacatagacatctggggaaattgtagataagtagattactattttggattttctctatttttattttccagaaaagaacttaagatcatctaatgtcttactgaggagtattcatactgcagaacgtggctcttggtgtgcctgtgataatgagtggtctgtgtgcataggctgagctcttgggtactatgcgaattcatctgcagctgctattcactctaaaaaagggtgataaggagtcaatagagaagtacactttgggaaccatttgccaccccggtaactgcccttcttcttaagaacaggacatgttcccttctccttcttccactgttggccaaccaagatgcctgaagggaaagtcattactaatatcctggtgtaagaagttgaactgggtggggaaaggattggagagggagatgaaaaagaaacagagaaaaagacttatttttattacttgaaatcaacctagttagcttttactacttacttatgtggtagagttacacatttttaaatgtctcctaactagttaagaggggagacagctggtttactaattttaagcaggagtatcgtcagtgggactaagtaagacattagaattcaataaatagtattagacttgaaacattcatgattttctctgaaagaagcagtctaggcccaaagttaaaaatatagtagtgggctgggcatgatggttcacacctgtaatcccagcactttgggaggctgaagaaggagaatcacttgaggccaggagttcaagactagcctgggcaatgtagtgagactccatctcttaaaaaaaaaaaaaaaattagctgggtatggtggcatgctgcggggatcgcttgagcccaggggtttaagggtgcagtgagctatgatcacttcactgcaccctggcatgggcaacagagaaagaccctgtctctaagaaaaatttaaaaaattgaaatgtaagaacagtcatgaagccagattgcccaggttttgccccttactactgtgtgatttttggctgattaacctgattattattttccccatctaaaagcgaagatgatgacaatagtgtctgccccataaactatcatgaagattacataagttcacatacttatgtgcttataaatagtacctggtactaaaagtataaaataaatgttatctattattatcttttttttttttttggaggcaaggtctcagtctatcttccaggctggagtgcagtggcatgatcacagctcactgcagccccaacctcctgggctcaagcgatcctcctacctctcagcctcctgagtagctgggaccacaggtatgcaccaccatgcctggctaatttattaaatcttttgtagagacgggggtctccctgtgttgcccaggctggtcttgaactcctgggctcaagcaatcctcccacctcggcctctcaaagtgttgagattataggcatgagccacatgcccagcccaattatcattattattacaagatctttattacaaggctgagatacagacgctagctggctgaacttctggctcctgtttaccaactttctagcccactcaattcagacccttgctagctcttttcatcatcctatgaggcgtgaattatttgccctgttgcaaattcttacagtgctgtctgaaaaagagatatgctagtgtaatctagaaactggaagagcactgtagagacaaataattcgggattttaatgactctcttgcagggagaaaggcaattgaacaggatgactcacaaggtttatactgaaaaagcttagagctttttctaagcgcttagattattttttagtgaccagctctataaaagcagtgatcagagcccatgctagctagacctaaaaagtaatagttgtaacacagatgtatttaaactgtgataaaaaaattagactatacacatgaaattggtttgaattacctcggctttagagagctgcctgtcattgtccatgtctatttgtttaaatgtctcaatgctccgtggtcctttggtcacagcataaagttcaatctcaaaaatcaatgtagcatccggtggaatcttgccttctgctaagggtataaattttaacagtttaacttatgtaaagatatagttcaaatatctattcatgaactgccataaccatattatattatttcatgttgataagaattgctatctgaatactcacaatttttaattttttctcatcttttataacttttttcggcttttcaatagttttcttttttgtttttttttctcttttttttataaatacttttttaggaatattttttccatatgtttccaaaccaagtcaattcaaaggacctatgggaccactatttcttgattaatttaagtaaaaatcataaactttttattaatgcatggatatgaccctctatatctgtgggttctgcatctgtggattcaaccagtctcggcttgaaaatattcatacaaaaaaaggatagttgtgtctgtaataaacatgtacagacttttgtcttgtcattattccctaaccaatacaatataacaatcttttacataacatttacattgtattagatattataagtaatctagagataatttaaagtacaccggaagatgtccagaggttatgtgcaaatgtgatgccattttgtatcaggggcttgagcttctgtggattttggaatccatgagaaggtcttggaaccaatctctaacaggtactgagagacaactgtactctcctatcatcaacacagaagagaggtggcacagagaagaaatgcatgggcagaaaaattgcaaagcatagatgagtcatcttttagaaagtgattttgtgtagttatttggaagcataaataaaacataagtattaatatatttgtctttcaaattttttatagacattaaaaaataagtgcaatgatagaaaaatccagtaacaggctgggcacagtggctcacacgtgtaattctagcactctgggagaccgagacaggaggatcacttgagcccaggagtttgagaccaaactgggcaacatagtgagaccctgtctctattaaaaaaaaaaagaattaaaataaaaattcagtaacaattttacaaagaaattgtatacatttttaagcaataagttgaatacctatttttatttttatttattttttttgagacggcgtctcactctgtttcccaggctggagtgcagtggtgcaatctccgcttactgcagcctctgcctcttgggttcaagccattctcctacctcagcctcctgagtacctgggattacaggtgcacaccaggcattgcattattagtagagatggggtttcactatgttggccaggctagtcttgaactcctgacctcaggtgatccgcttgccttggcctccctaagtgctaggattacagatgtgagccactgtgcctggccagaattgctctctttaattaagttaacctattagctgatgtcacagattttttttttttttttagacaagaatcttcctctgtcacccaggctggagtgcaatggcacgatctcggctcactgtaacctctgcctcccaggttcaagcaattctcctgcctcagcctcccgagcagctgggattacaggtgcctgccaccaatcctggctaattttttatactttattaatagagatggggtttcaccatgttggccaggctggtctcaaactcctgacctcaaaggatccacccaccttggcctcccaaagtgctgggattacaggcgtgagtcaccgtgccaggccatgatgtcacaggtgattttaataagtgatgggctatttcagataaatatgtcataaaagtgacttgcaaaaatgacttgctaaggggcagcgggtagcttgtgtcatcagtatattgccagtgtcctacacagtgcctaatctactacaggcagtccaatatttgccgaatgaatgacccatatcatttatttttaaaatgtttgtccttggaaggaaacagcaatttctttaataaaaaagtgaagcattctagctaaagtctttatatagtctgaagagaaaagagtttgtgagttatagccaaaaggagtagcagattagtagttttcaaagagaaaacatagaaagatctacccatgcatcatatgactaacataaaagtcctaacctaatgcaccacatattacctgactttagagtagaagagctagagattgagtcaatgattgttttataaaacccattcctattttttccagttatctccttatgacagaattattgtctcctgacaataattcaaggcaaactcaaaacacaaattcaaatttcttttcttttcgtttttttttttttttgagacagaatctgttctgttgcccaggctgtagtgcagtgtcgcgatcttggctcactgcaacctccacctcccgagttcaagtgattcttgtgtttcagcctcccaagtagctgggattacaggcacaagccaccacacccagctattttttgtatttttagtagatacggggtttcactatgttggccaggctggtcttgaactcctagcctcaggtgagccacccacctcggcctcccaaagtgctaggattacagctatacgccactgtgcccagcccaaaacttgaatttcttaagaaaaaatattgtaggtacatatgcagtttttgaacaattttgctataaacatagaaaatattggccgggcgcagtggcttataccactttttttttttagacaagaatcttcctctgtcacccaggctagagtgcaatggcgcgatctcggctcactgtaacctctgcctcccaggttcaagcaattcttatttggcttataccactgcgcctggccaggagggcgagatcagcctggctggccaggagttcgagaccagcctggccaacatggcgaaaccccatctctactaaaaatacaaaaattagccaggcatggtggcgtgtgcctgtaatcccagctcctcggaggctgaggcaggagaatagcttgaacccgggaggcagaggctgcagtgagccaagatcaatcacaccactgcgctccaatctgggtgacagagcaagactccatctcaaaaaaaaaaaaaaaaaaaaggatatattgccaattacctctttttcttgttttttttttttttttaaaaaaaactaaagtataaaaatgaggaaaatatgcatttgctacggaattacttatatttagagaagcagatcaaagaagtaggaattaaggtaaagaatatatacataccgcatgtattgttatttaagcactaacaagtcacatgcatttcaagacatgcagggttgttctgtgacatgagacaaggatattttgcagaagaaagacttcttcaagtactacctaaaataaagttatagctaatgttaggtcttaataacaacttacttttaaatgcttatttaatcaagaggttgtttgttaaacagttacttaaggtctacactgcaacttttaaaataatgtaatccaaggtattggattacaatgcctaatgtaacgcaggcaaggtcagtattaactatggtccaattaacactttttttgggcctcagtttcttactctgtaaaatgagggtgctggtggtattactagtgagattaatcactttaatgtttgttagagatacctccaattgaatatgaacttgtttcacatcaaacttctatatctctgcagcaagtttctgatttattaagagcttaggcagcctgggtagtcattcatatctaagcataaattagtttatgaaaaagataagctaagtggtcctttgcctgatggcggtgaaccctggatgagcacctgatgatgacagatgtgtgtgctctaggcagataggagagtgggtgctctagtggtaggcagaatgtggaggcatctgaagacacaacgcaagacagaaaggaaaactttgaaaatgagaaagagactgaaaggcaaactctgcctccaacattttgcctagaagtggcctcaacttttgacaacatttttagcacaagtattgcatttgacttaatttattttcaattttccttctctttctcctaggttcctatacaaataaaaacaggatatatgaattatggtaccatgggagctgttctgatgggatcaaattattggcaaaaagcattaaaaataaagctgaagttatctggaaattgtctctttaggagttttaagcctgactgggtctgactcaaagcactgacacccccccaccacccgccaatccagtgtggggcactgatgccccgattttgctggaaagaactcttaatgactaagacaactgcctcaaagaaggcatgccacttccatgaaatatttgggagcaatgccaatatctcattgtggaaaattaatctttactatttcaaaccggtggagtcagcagtggctctaaatagggtaaggaggcaaagattctttctgtatagccttcaagcagcaacacggagcaagaacctaactaaggatgcaaggtacagcctatcaggctgcccatcctcctgcctgctttaaaaattttcttctctgttctgctacatgcaatttttgtaatttaaaattttaattttggaaaaattaatacatgccttataaaactttcaaatggtacaaaatgttagagtgaaaagaaatcttctcatccttgaccctgaggcctccttcccaggaacacttaatgtcatcagatgactgcatattcttccagatgtattctgtgtagatacatgcatatgtgaaactcctcctctgaaatgaaagctcatagaggattgggagtagtgtctactttggtcactgctttatgcccagtgcctagaacaaagcctggcactgatgctcaatatatatcccaaaagtggaatatagtcttgtccacttttttttttgagccagggtcttgctgtgttgcccagattggagtgcagtggcacaatcacagctcaccgcagcctcgacctcccaggctccagggatcctcccatctcagccccctgagtagttgggaccacaggcggataccgccacgcctggctaactttttaattttctgtagagattgtgtctccctacattgcccaggctgctttcagactcctgggctcaagtgatcctcccaccttagcctctcaaagtgctgggattataggcatgaagccaccatgcctggcctccactttatttttaacatattaataagtatagctctacttcattctttttactggttacacagtaattcattgtatagatatactataatttatttaactaatttcctattgatggataggcaggtggtttccaaccttttgccaccctcccacccaaaaatgcctgcagtgaatgttcttttacatatacctttgtgcacattcctggaaatggaactattggataagaaggcacgtgcattttcacttttttttttgagatggagtctcgctctgttgcccaggctggagtgcagtggcgcaatcttggctcactgcaacctctgcctcccaggttcgagcgattctcctgcctcagcctcccaagtagctgggattacaggcacactctaccacacccagctaatttttgtatttttagtggagacggggtttcaccatattggccagactggtctcgaactcctgacctgaagtgatctgcccacttcagcctcccaaagtgctggaattacaggcatgagccaccacacccgggcctgcattttcacttttgataacagttgatagagaagttgaatgatttccattcccagcaataatgctggtttttccatgcttttgccaagttgttttgtgtttgctaatctgatgagtgaaatatgatgtctcatttttaatttctctttatgaataaaattaagtattctcatagacttaaaggccatttgtagttttttgttagtgggtgcttatttatgaatttggcccatttctagggatatgtcattttcattattggttagcaagtcttcatacatgttacaaacatttttcccgcttatttgctttacctaggttttcagatctttttgctgtaggatttttaaaatgacaagatattgaaagaataagatcatttcttgcacatttgaaggcttgtcctgtattggggtaataatgactgacagcccattatatctcagctgttccttttacaatgtgcccgtcctgtccttttactctaaacctacatgttccagtttctgagttttatgaatttaactttggtactgcttaccaaagatctgtgttataaatatttatgtaataataacatatgctgaaaacaaataaaaatgcttaaggtagagcttatagaatatatataatcatcatgagtgttgccacaatgtagaagaaagaactctggccagagatctatattcaaacaatgtcatattatccttataagcaaaaagaagggactggactgaactagatagagcttaaggtcattgggctttactgttctctttatttcatctatcattttttatttcacttttttgtttttaattgtggtaaaatacacataacataaaatttaccatcataacaattttcaagtgtgttgttcagtaaagtacgcttacactaccatgcaaccaatctccagaactcttcatctggcaaaaatgaaactctatacccattggtcaacaattccccttttccctctcacttcagcctctggcaatcacccttctactttgtctctattaatttgactactccaggtacctcacataaatggaattatacagtatttgtctttttgtgactggtttatttcatttagcataatgtcctcaaggctgatacatgttggtgcatgtctcagaattttcttcctttttaaggctgaataatattccatttcattttttttttttttttttttgtagagcagggtcttgctgttgctcaggctggtcctggcctcaagtgattctaccaccttggcctcccaaagtgttgggattacaggcatgagccactgtgcctggcttccatatatgcatgtattcattttgtttatccatttctctatgtatggacatgtggcttgcttccatctcttgtctattgtacatggctgctatgagcatggctgtacaaatatttctttgagactgtgctttcaattctttcagacctatatacccagaaatctattaatcattttttaaatataactaaaacaagaaattaaaattaaacatcttaccatagccttcctttccgtatgcaaatgaagggggtataactacttttcgcttttctccagggcacatatctgtcatagcaatgtctaggccttttatgacttgcccaacaccaagaacaaaccatttggggtggccttcattttgtgtccggctataacaaaaagcaatacttaagtaaactgatttcaagaaatcaaacttgaaaatacagctgggcatttaaaattggagtcctctctaaccatcattcccatataatcactctttctaaaacccttaatggggtgtttgactcaaacttccctataatcaccagaaagaagtatgatttgcccaaagttaatcattaacagccatctcattttttaaaattgttatctttacaaaaactattcaacagttaactttttaatgggtctccagcccctaactaggtgcatggcttgtacaaagaactcatttaactccctgggtttgttgtaaaaaaatgatagggcagttttagcctcaaaaagtcattttaatagtaatttaaaatggtatattttcttattaaattctaatgatataatttattaaattcttattaaattataaaattgtataaattcttattaaatttctctattttattctaaatggatggaactgtttttcccagtcctatctttacagggtaaagaaaagattctccctctgagtaataagccatcaattaaatcagagtaggcaccaggtggaatgagggagcagggcccaccagaagtcaccagggaagtaactgtttttcttgatagaaagtggccacaacctataaaaatcgtgcttctgaaggccagaattaaatctctttattccatgtattcctccgtaaagactcaatacttctggcaagggaaaaatgtgaacatccttataggcagaaccttgatttaattctggaggtcccaagggtaatggtggtggttgatgtgtgtgtggatgtatcgtatttttgataatttattgccacaacattttcaatactttaaataaaaatattcagtttattagagaaacactgccatataatgtgattttttttaatgaataaagggctcaacttttaccgttaaaaaataaaaccccaaccaaccaaccaatgaggcttccgcttggtggaggcaggcaagattttgtgcaactggacgcacgggcagctcgcagcatttcctacctgcagtagaatttcgagccgtctttagccaggtagccgtcataatgggcatttagtaggtctcccttcttgcttgtcttagagcagttttctggacgatgcaaaacttctattttcacttcttcggtgctctcctctttcttttgtctctgagcagtaaaaaggccccacagataaaagaaaacaatgaatctgaataagaaatgcatggtttttggcatcggctccagcagaacactgctctccctcccgcgtgtcactcgcgccccgtggatgtcccgcggccgagttccgacgcgtggcaggcgttgtcctgcgtcacaaagggccggggcggggccatagatgcggccccgccctctcatggccccaacccctccgcctcccgcagcgggctcagcgcggttaacgctgtttctaggccctcgggctggctgtcctcagtctttaagatcgcaacgcacactcgctccgcttcttctcgctaaacccgcgtattttacagcaggtttcctcagggttcggtgacaacattcgcattttctaaaatgaaactggcataagacgaaataaacagcctgggatgtcgtagagtcagggaatatggttgtcatttctggaagcaaaaggcttctaagacccctagggaacgagcagatagatactggggggagggagaggcatgctggaaaaggagcgtaaaaaataggctggcggtggctttctgggtgcttcggaggtgtccttgaagcgcattctcaggtcggaatcttgcattcagaggttccaggctgagtcgcacaacctgaaggccagcccgatgcaacgaaactgcggtaccgcaactcctctgcctggctgcaggcgtttccgagagccgacctccacaattcagcatcctccgctggcttgcatttcttttccccgccactcggggccgcccttgattcgagggcctctggtagtgcggggaatgttcttttgacttttttgtaccatcccatgggatacgtaattgtccacatcagtcaagaaaacttgagtattgggcatgttgtcccaatctcacagctaatacgcagcagggatttggtcaaatctgtgtgacaacaccacttcaccaccaattttagtatgaaaacctttaaaatacacagaaagttgaattctacagtaaactctcctacacccaccatctggatcctgtcattgaactatattatatttattacatatccatccatcactctatccatccatcaattcgccttgtttccaagtgaatacccaaagactacccaaaccagaaaaccagcaaaggccttctgcattcgcctggattaagttctgggagtagaggtgctattctacctcggtgatgcgaagaaaagccgcagcactgagcctgattgatgtgctttgcttaaagtttgcaaaattccataaacctgaaaattactgtcgattatgcaagatgacaattgcgtccaagcaggagtttcaaaaatcataaaagctagggggaagtccccatttctagactaaaattccgaagtcgagttccatgttttatattctaaataaaattgtggctatccaaggttatcggcgtgatgacagttccttgggggccctcgccattccttgtcagaggaccccgtctgctgcacattgccttcctaggagataatttcagaccccttgaatatgaggaaaatacgaagcaaacagaaataggaaggcttttatgtatttttgaagaaaaaacaggattttatgtaaaataaaaacaggatttcatgaagaaacaggatattatgtatttctgaagaaaacccaggaaaacccgagagaactaagtgcccgcgggatgagtgtgcgggcagctcctccttaggtaggcaccggggctgcgcgcgcagcggagctcgaaggtcttgtcccccgggggcggtcagcctgggccttggcggccaaggggaaacttgggagcctcgggactgttggccaccggcccgtgggaggagtaaaggcggccctggctggcaggccgagggtgtgacgcgccggcccgccctcctcgcgcagcctccggctaggcggcgaggccgcaggccgcgcccgctccttcagccccgccgccggggaggggtttcccgggacgatccggcccctttcatccaggaagtgaaatcgacgtcggggtcaatgaaaacaaacggggagcccagggggaaggaaggcaggcgaggaagaggcagcgccggggcgccggagggagcagccgggctgcggaagcgcgagcaggaggccggtcgcgggcgcatttttgccgttgtcgcggccgccgccgccgaggcttacccgggaatgtctgggcccgcgcctcgcggcccccaagctccacgctgcgcccgctgtcccggcctctaaaggccgccacgtccctgcggcgcgcgcaggcagaaagcggcttcgtgccggcggagggggcccgggcgggccgggaggggctgccccaggccctgcgcctaccccatcaccgcggccggcgccgggccgggaggatgcgcggtgtggggctctgaagcatggagggggtgttgtacaagtggaccaactatctcacaggtatgggggctcgtgtgatgagggaagaggggagaggcggggggctgctgagaaggcgggtcggggctcctcttcctccgtctggcctccgcggaccctcagagcgaattcgctctactcgattccagggcttgttgagtccttctggcctcttcaggggagggtttgaggctgcgcaccttctagagggtgggaagtgcacctgccacttctttgctagtgtaataatactaatccttgcctcctgtagcctcaggaacaattctcagtcaccctacatgtgttgttgcgatctccgtccttattcacacttagtattcatactttaagagcattttgttaataactgagttgtcggagtattggactggaatggaccctttaattgtttcaactacaagatttaattttaattcttttttgtatttcttttaatttccttaacattttatttaaaacgttgtcttgttgaggttgttcaagcttagcgagcatgattttggaagctgtccccagataatattctcttagggattgtcattgaagtatccttacgttggggaattctgttaactgagaaatagtggaagaaagtgtcaatacacagaaggggaacaggcaagtcactttcacctgtgaagtgggttggaaggaaaaactttgaagaaatgagagaccagcaggaaagggccccttaccatgacattggcagcctgtaggcttatttaaaagctccttaaatttgagttgtagtccaatctctgccatcaaccaacaatgaaggcaagtcagttattctttcaggacctcagtctgataaggccagggtgattagttattttgccccgggatgccttccaactccagaattccatgacctcactaagtgagaagatggttttaacataaatttgaacagtaaacagattttttggggggggggggtctagcataataggcaaatcatgacttgctgcccacttcttcgctctgccaaaagtatcacatccctcagtaattgtgtggtactctcgacttgtgtccacctgatcttgtgcaaaatgtgcaggtaaactttttaaggcataagcactgagctacagttatacctgctttttgatttattagaatgctaaagccagatttgtagcagcaaatgcttttaacatttatgatacacagatgttttattttgttcaaactaaaaactcaatttatttctataagtgacatgttttaacgggaaacatttaaaagttagataaatattttttattgggcattttcattttggccattgtgagagcagttatactgtttggttgaggtatagtgttaactgttaaagacagtagagtgcttcatgcttgtaatcccagcactttgggaggcggaggtgggaggattgcttgctcaagaccaacctgggccacatagggagacgtggtctctactaaaaaaacaaaaacaaaaacaaaaaacagctaggtgtggtagtgcacacctgtagtcccagttactgaggaggcggaggcgaaaggattgctttagctagagaaatggaggctgcagtgagctaggatcagtgagctatgattgtacccacacacttcagcctggctaacagagcgagatcctgtctcaaaaaaaaaaaaaaaaaaagacattagcttgtatgctttgagatgcaaatgctcatctcattgcaagtgttcctaagcatggtgttgtggaaccattgggccattactgagatgagtcataatttaagagttgagatgaaacctgggcttggtggcgatttccttatctcctatggtactaaataaccaggggttgagcttttaatcacatgtgatttagattttagtctttgcagggcatttagtcaacttctagtatgcattgtagaagctggttgaaaagaaatcttttgtttggaagaatttatttttaaaagttaaatttgggtagatggtgtgctgattattaattttagttcatcttaggtcataagaatgagcagctgttcatactaagtgatctttaagtgtaatgatagtgttgttcaggcacggtggctcatgcctgtaatctcagcacattgggaggctgagataggcagatagcttgaggtcaggagtttgagaccaacctggccaacatggtgaaaccctgtccctacaaaaattacaaaaaattagccaggcatgatggcatgcacctgtagtcctagctacttgggaggttgaggcatgagaattatttgagcctgggaggcagaggttacagtgagcccacattgtaccactgcactcaaaccttggcgacagagcgagactctatctcaaaaaaaaaaagtgttatttgagaatcctttgtagagagtaagaatttcagtaacattttgtagtttgagataaaaagaattaaaaaaaaaaaagaattttaaaaagggaatacctgtgaatctttttcacagatattaccctctgttatataagtgtgtgaaccaattagaaattgttttattaaatatttcttcaaaaagtgtgtagagataattaacaggcttgattatattaatgtgttcaaccactcacctttcacgttgctgcaaattctaaatgaatcattttgcccaatatttgttttaaagagatattgaattgcagtactgcaggcttgcaaaatcataatttgtcctataggcacactagacctgggtggaggaatgtattttcaccaccccctgcttataatttgtttggcaaggtaaattagtgtttggaaagataatgtttttatcatttccatgcatgatcaatacaatatactctcaaagatatattgtatgtctatactctcatggttaataggaaatatctgcagggtgtgatggcccacatctgtaatcctagcactttgggaggccaagatggcaggattacttgagtccaggaatttgagaccagcctgggcaacatgatgagacttcgtctctataaaaaattaaaaaattagccaggcatggtggcacttctgtagtcctaactacttgggaggctgaggtgggagcaccttttgagcctaggaggttgaggctgtggtgagccatgttcatgccactgcacttcagcctgggcagcagagtgagatcctgtctcaaaaaaccaaacaaaacaacagcaacaatccctgaaatatctcacttttggggtattcattcattcatttatttattcagtcacttgagaaatagatttttttggtacctcttatgtgccaggcaccattctagttgctgggaatgcagtgatgaacaagataaagtccatgtaccaaaataacttaccttctaatttgtttaggtctcactagggaatactctgttgtttcataaaaaggaatcttccaggaacctgaaagttgctggtttttagttgctttagatatctctctttctgaactgtattactgcattccctgccttcctaaacagggttacaaagtaaaatttaatctttttgatgactcagtgttgtcatttcaaaagtgttacagataaatccttttggggaattaagtcctggatctgtattaaagtgtaaggatgactgacccatctcccctctcggcactatctgaccctggaaagatcaaattgatcatgtggcaggctatggcaaaagtgaccgggatacgaacatccatggtttaaaatgtacattttagccatgaatatttgtgctgaattgttatttaatagtcatggaaagaacaaggacagtcacactgctcccagcatggtcaccatgttaatagtcagtgaactgttgtaaattagtagcatgcttgataagactccggggaacaccaagtttggcttcaaagaggagtgggaattgggtgccaaggaaagtcatcatccttgtcgtcagctttggcatggagccaagtctgtgatagatgtgagctctagtcactgaataaatatcaatcgaacaattgcagtttctaggatttcaaccctagctgtgcaactgcagacaagggaagagggggtcatatggggaatctgtgttctcaccatagggtatgtagcttctatttaagagactggaattcatttagcactcattgtgtttaagggagtttgcttagaaatatgtattttataagaggcacattgcagaattagagggctaggtggcacctgagaggtcatcttgttcaacctacacattttagggactgggaattttagagatttattgaaatgaaaagatttgtccccagggtatgattatccattaaagaatgatactataggtaaggctagaacccttgtcttctgtggcttttcccataatatcgtaaccccaactctgttcctttttaggaaaagagggcagttatgctatacccggtttagggctattactgaggatgggccttatgggttgttaatgagaacactgtgagctagaattagaagtattactccccgtgtttttgctgctctggagcttgctccagaaacctctcccaataaagtggagactgatgcaaaaacatttttggtaaggcttggtgattgaaaatttcattatcggaatgttatttgagagccaagaaataatgtggatggcaggttttgaaatcacagttttctatgtggtgaaagtaatgtgtttccaattgaccttttgttatttatggtctttttaggctggcagcctcgttggtttgttttagataatggaatcttatcctactatgattcacaagatgatgtttgcaaagggagcaaaggaagcataaagatggcagtttgtgaaattaaaggtaagtgaatatacagaattagaggaattggaggttagatagtcaagggttcttcagcatactccagacgaggaaaaaaagcatttctaaccacgtagggatcatctaataccatttatatccttagcagtcaggagtggcatttcatcacagttaacacaattaaacacagtttttgataattctccctctacaaatgtatttttgaatggaaataacttttgctagtcttccaatttggatttgacaaacaatttcttgtggatactactttagtgtccaccttcagtctataagcattctatttcattattgttgtaattaatagaaagatattgtaaaagttggaggctgaactctaaagatgatggggccagctctgtagggttttgataaggtatgaagttggagtcataaactctggttctttgctgaatttggaggtaagttcctctgggtgatagagatggtttccttttcttccaaaaggggagaaataaagcaataggtcctgctgtaattttcgtgaaggaagattttatggaccattgattcatttgtgtgtgtggttggagtgtgtggggtggaggcgaaatcagataaaatggcagtgaaaaggactgaattcttcaaagagagtgaaggaaaaactagagcaccaggggagtgactgttaaactccttcctggtcgttttcatttctccactctagcttgaatacttgtccttcatgaagtgtgtttcctttgacgtggtgagctctgggtcatagctatcaaacagtcttcctgaaaggtagcgattaatctgactttaattgccatacataagtgttgtcttttaatgttttataaatggaataattcagtattttcttttgtgtctggcttcttttactcaacatcatgtttgtaaaatttatctatattgttctgtgtaacagtagttcagtcattctcattgtacagtattccattgtgtgaatatctcacaattttggtatccattctagtactgaaggatttttgggttatttccgttttgggactacagtgactaaagctgccataaacattcttacacatttattgaacatatgtgtgcatttctgtttagtgtatctctagaagtggagtggaatgctaaggcactgaatattcatactttcagctttaatagatgttaaagaaaaaagtattcttgacacgttgaaatggtatggcaaactttatttaggactattgtgatagatttagggactattgcattggaggagagaaattgggctcaactccaagtacaaggaaaagtgggaatttatagccaaggagcagggttagggggagacagtgtcagtggagggaaagttactaaaaggtaagtggggggattctggctaaactgacctaacaggattcttgctgaaggcaggctgaggccagggtgatcagacattgctgggaaatggtagggaatgaagaatgtggtcagatatcaagggcgggtgatgaaatatggtgttaggggattctggctaaactgacttagtaggattcttgctaaaactggattctacaaggatggagaaggaagcctaggtgagtacaggattcaaatgagcctgactaaaatttggtcaagaagagaatctttttctttttttcttttttttcttttcttttctttttttgttttttttgagacaggttctcactctgttgctcaggctggaatgcagtggtgtgatcatggctcactgcagcctccacctcctgggttcaggtgatcctcctacctcagcctcctgagtagctgggaccagaggcacatgtcactatgcccagctaatttttatgttttttgtagagatgggatttcaccgtgttgcaaaaaccaggctggtcttgaactcctgagcttaagcaatctgcccgctttggcctcccaaagtgttggaattactggtgttagccactgtgcctggccaataatctttttcacagataatgccagatgttttccaaagtgattatataaattttttctgcaatcgatcagagtattagggttccagttgttctgcatctttgccaaaacttggtattatccatttaaaaaattcggaatatttctggtgtttgtagtggtatctcatggtggttttttacttgcatttcttcaataactaatgatgttgaatacttttttagatgttagccatttgaatgtcctcttgtcgggagtgttagctcatgtctgtaatcccagcagtttgggaggccaaggcaggcagatcgcttgtgctcaggagttcgagaccagcctgggcaacaaaatgagactcctgtctccacaaaaaggaaaaaaaaaaagggttgaatgttgtcttcttttgaagtcctctttcaagtctttggcccattttctaactttggctatctttcatgttgatatgtaggagttctttgtatagtctggttgagtctttgtgttgcagatgttttcttccactgtgtagtttatgttttcattttgttcatgataccttttgaggaacagaagttcttcatttcagtgaaatccaatttgttaatttcttttattggatccttttatgacccactgaagacatcttctgtgttactttcttgaatgtttattgttttaccttttatatttaggtctatagtaggtctgtacttgacttaatagcaacctttcccccatggggatacctttgtcacaaagcaagtgaccatgtatatgtgagtctttttctagactgtctattctgttctgtggccctgtttttgttgttgttgttgttgttgttaatccttgtgcagatattacattgtgttaatttctttagctttattctctttgtatctgatagccaaagtctcctaactttagttctttttcagtactgtcttggctattgtaagccctttgcatttccttacagattttagaacttgcttataaatttccacagctatctgctggaatgtttggaattgtgttgaatctacagatcaatttgaggagaattatattcttgatgatattgagtcttctgttccattaactctgtttaattagatatttaatttctctcagtaatgttttgtagttttgtgtttagaggtcttgtccatcttttctgatgttttggaagcatcatttttaagtttgttgccttttcaggtgacaactttggaggggaccacccttgattggatgcataaattctggtatgtttaaaaatgagtcatcttattttagtttcatcttgtagcaacatcattagaaattagagcattgctttcttttaaagtaggtattggtgctttcactagtattggcaagtagcaaggaagagttactcttatagctttaggagttcagtagttttaccctagcctagaaatcttttgcattcataattgattgttgcatggttgtatgtttcagtgtctgcaactaagaatgacccatataagtagaataataagatagcaacatttctgtggcacttacttgccataatacactaaacatctggtcaatatttatagcaattaattatttaagttggggcttctgccagattttgctgggaccctcataatttggctcctcccagcttgtccattcatgaatatgaatttgttttcttttcttttccttcttttttttttttttttttttttttgagacagggtcttgctctgttgcccagtctggagtgcagtggtatgattgtagctcactgcagcctgtactgggctccagcgatcctcttgcctcagccttccgcctcccaagttgctgggtctacaggtgctgggagtacatgcttgcaccactatactggctaaacgagtatgaatattactttgcattacaatggaagcctctatttatgcttgtttcctaatattctcagtacattctgtgtttattttctcatttaagcttcttctcattcattttcttaaccaaatcccgctttcatcaaacccttcttcttgaagcctttttaaattactttctctcataattacacaagaaatctctgcaccaaagagttaaacatatgtgtattctgattgtttttggtgtgtcagtttgtttcttggttaaattgtcaactgtatagaagcaaagacaccttttttcttcccctctatcttctcttctactagcactgctctgagctgagtaaatatttgttgatgaatgacagcttaacacaaattttgttttacaacaaagacttgggattggctcatcataattcctgattagctctcttttctcagagcatcaaaggaggtgtgtgtgtgcaggagaagaggtagaaagaggggaagagatgaatgtcttcaaaatatacatgccttccatgtgttatgctatgatccataattaagggcatatcatagagttacttttctgacagaaggtggctgtagttgtcatttattacattccttctatgtgtcaggcactatatatgaaaacaaagactttgttttcaaggaaatcagtaaaaaatatgtgatagtgtaacattcattgcagttgtatttaataggataagtggccccaaggtgggggagggctgtcacttctcagtagttagtatgtccctgttttctttttcatactctgtcatcgctttggcaccattgttaccccgggtctatatgagaatgttgatttggggagtgccactgggtggcccctcagggagcagcactgcctgcatcatgaatgatagttcaatgtttttggtatatgaagcatctgatactgtgtgattagatgattatttgattacccttaaattacttaagtctataactgtatttcccctttgtttatcatcatagttcattcagcagacaacacaagaatggaattaatcattcctggagagcagcatttctacatgaaggcagtgaatgcagctgaaagacagaggtggctggtcgctctggggagctccaaagcatgtttgactgatacaaggactaaaaaagaaaaaggtaactataaacttttcccttgtggtgagagtactttcttaaatataaatataaatgtaactaaattagcctgtccacttttagtatctatcccaaggaaataattagaaatgtagatttacgtatatctttatcatagtaaacattttgtaaaagctataaatttaggggaatggctcaataaactctttctttcttttttttttttttttttgagatggagtctcactctgttgcccaggctggagtgcaatggcgcgatctcggcttactgcaacctctgcctcctgggttcaagcgattctccagcctcagcttcccgagtagctgggattacaggtgcctgctaccatgcctggctaatttttgtatttttagtagagacggggtttcaccatgctggccaagctggtctcgaattcccgacctcaggtaatccgctcgcctcggcctcccaaagtgctgggattacaggcatgagccactgcgcccagcctaaactcgtgctttcactggctgatatatagacagtaagatgttgaaaaggaatttcaatgtgagaaaatgcccagggttaaatgatcattgaaaaaagcaggattcagaattatgtgtattgttagtattcattggctggcttaggaaaggtatgtaagaattggtcagattgttacctttggaagtggaatttgtgggaaggagactcagttgtcactgtatataccctttggtatcttttgactttaccatgtacgcatattgccaattcaaaaagatttttagaaactgaaagcaaagcaaatgatttatgttattagttcaactatatacagatataatgtgaaaatgacaatttcttgatagtgagattatagtttgtcttagttcattttctgttgctttgacacaatacttgagactgtaatttataaagaaaagaggtatgactcatggccctagaggctggaagttcaagattgggcagctgtatctagttggcttctggtgagggcctcatgctgcatcatagcatggcggaggaagcaagggaaagcgggtgtgtgcggaaagagatcaaacccaagaggcagcctcgatttataacaacccgctctcatagtaactaatctagtcccaagaggttgagaactcactcactcctttgacgacctaatcacttgttaaaagtactactttcctaacactgccacactggggacccagactcaacatgagttttgctggaaacaaacgatattcaaaccatagtacagttatttgatttttcttttctatattttttctatttttcaaaattttttattaagtatgtattacttatataattaaatgcaaattaattacattagtgaaagcaagtaaattataggtattgagaaatgaaggctgaggattgaatttataacaattttgaaatatatgaaaacattacagaatatagctacaggtaggataagaaggaatgaatattcacaatagctaaaagatggaaataacccaaatgttcattggtagaggaatggataaacaaaatatacaatagaatattactcagctttaaaaagcaaattgtgacacatgctacactgtggatgaaccttatagacattacaataagtaaaaaaagctaatcatgtggggtggggggaggggggagggatagcattggtagatatacctaatgctagatgacaagttagtaggtgcagcgcaccagcatggcacatgtatacatatgtaactaacctgcacattgtgcacatgtaccctaaaacttaaagtataataatgattaaaaaaaaaaaaaagctaatcacagaaggacatatagtctatgattccacttatatgaaatacccagggcagtcatacttatacagacagaaaatagaatgttggtttccagggcccagggggaggtggaaacagggttagtgtttagtgggtacagaccttcagctggggaagatgaagacgttctggagatggatggtggtgatgattttacaaatacgaatgtacttaatggcacattttgaagtgaatacttaaaagtggttaaaatagtaaattttatgtttatgtatactttaccacagttttttttaaaaaggagaaagaataggcttaaatatgagcaggaattgatttaggttagattaaatgcgcagatagagctgctttgtccattctggcaaaagtggctttgtggctaggaccagagagcaagaccactggggcctggcccagggagtgtggagaagcaccagaaatttactctatgaattttcctcctctgtagcttatacttctagtttaaaaggtattggcttgtgagtggctgagattatggctggatgtttagtttgtctggacatactaaggaagaaagtatgctcttaataaaaaattttgaaaatagtataatgtgagaatgaaactgaaagaaacagaagaaaataaatgaatgtttataaacaatagttttaattacataaaaatttaaaacttctgtaagccaaaataaagaaaactgaaaggaagctaacagatctggataaggtatttgcagtatataagatagaggaaagattactatctttaatttgtaagaacttttacaaactatcagtttatattgttaagagaaaaaccaacatcagaactggaaaaaatgtataaaggacaaaataaaaaagcaattcacaaaagaaaaccaagcactttttaaatggaagatgagtaatggaatggaaatatcctgtataaaacatccagtggtcatcatcctatctctggaaatcacctaaacatggcaggcatataactgtcagctttttcccaattatctgaagagaagatgtttccttagggctcttgtatcctgtttccaaggtctcacatttcttgagctataggtatttatattcattgcttttttaaatgattacattttgttacattgctcaaagaatatgaaaatgatctaactgtatatttatgtatattcttttcagaaataagtgaaaccagtgaatcgctgaaaaccaaaatgtctgaacttcgcctctactgtgacctcttaatgcagcaagttcatacaatacaggaatttgttcaccatgatgagaatcattcatctcctagtgcagaggtagagcgaagaggatctcttcacgtgtggttatgctttggagtactctggggggatcctcagtcattccataagatgacaggcattttcacattgagttattttcagcttttctgggttctgcctactgtatactatctggaaatctgtagcatcttctcgattgtgtctgtgtggccagagaagaacatgaagtagcatatttctccaggggtcaaggcttgtctttgcagccagtctgataatttggaggttggagtggggaagaagcattccaggctttgttctccaggctagcggcataaattcactggacagctgctattctctttttttggtaataaggtccctgcttcaactatgagagttgataacttatctttatgaaataacttaaaacaaatccttctcagaacagtgacttaggaatcaaaactcagattagtaggatcgggctataataggctcattcttcatggtaaaataggaccagtgagctataccactctctgggtgaaaggccagcatgttgcctgtccctttttgcctaacttggtagaagtggggcaagaaatcttcctatttcttctgtggccttctcctgttggggaggaatcttgtgtaagaagcccaaggacaaactgaccacaagctccctggaggtagttgacctcacacttgctacagcagctcagtgacagtattagggacccaggcttgttccatccttccactctgccattcttggtgtgttgagtttttctcctaatgccccaggtgtcaagatgactgtcaagctcacaaagaggcaggaggcagtggggttgccagggtagagagagtccttctcaacttgctgtgcttggttttgaatcgggaaacaaaaatcccagaaattccctagccaacttctcatcttttttttttttttttttttccggctcaaaggaaactaggaaaaaatgagcatttagtaaagagtgttggaatagccatgactaggttagatcagtctctattcatcccccaggatcagggcactttgcgatcctgaacaaaattgggctttttactctatcaaggaagaagtgggagaatggatagagggtaggcatgaattgtactgccactaattaactctaagggtattccatgtctgtgtccacttttgggaaagtgaaaattactgtttaggttagatttctctaagataaacttttgtacacagtttttcaatatgataattaaatgcaaagcttattttttcttagaatctagtttcatacattgtttaggagacaggcatttcttatacatagatgttttaatgttttcttttttctttttttgccccagcttaattttctaaggtactgtattttaaataaatttgaacataacatagtaatgtgtctgttggagatgtcttattatttaatgataaggttgtatatgattccatgtagttgtatgcaaatctgttcaagtctttgtgtaatttttcagaacatgaatgaagcctcttctctgcttagtgccacgtgtaacacattcatcacaacgcttgaggaatgtgtgaagatagccaatgccaagtttaaacctgagatgtttcaactgcaccatccggatcccttagtttctcctgtgtcaccttctcctgttcaaatggtttgaacttcttgttttggttttttccctcagtagtaatgttgcatgtggttttcgtttcattttggtatttatttttaagggtggaagcaggcagttggggggcggggaacagctaacaagttgaatttttttgtttgtactgtttcatattcgagcttcttagctgatgagctgagcacttgtgctagtgtcctcattcccttctccttggaggggctgtgcatggcctgcccacaggctgcttcatccattttccccagtgtctaggaaaatattacaaagtgctgtgacaaagaaaaagttggggagctctattctgcttggtaagaattacacaatggaatgagattttagtcacaatggggtacaattacgtatatctttaaaggagttagaaggaatttgaaacatattccggtgggaacggtattctctactaagcatttggatctgaaccctcagagtagctgatcttcagtttcttcatgtgtaaaaatacagtgtatatcagagagtcactgcaaacgatctgacctgcttactgttaggtgctcagtgttagtttcttacttccttattgctcagaacaagtcctctttttgccaggggtggcagattcgttgtcctttctgagctaataaatttgctctagcatgctgttagaaatttgtaggtgagataagctttaatgagacttcaagtttattgcatcaaagtgtttttaggagtccatttataggagtaagaatgccaccttgttgctgtttcagcaattacctgaagatctatttgttaggagaatagggtctaacttcttcctaggttctcttacctatcccagcaaatttagttatgagatttagtaaagattattgcctagatttatttagagaattgttttctaatcagtatttgatgggctaatagtttcctctgaggcaagcgtaccatgaaaatgagttttatggccagattaatttgggaattgctaggttaacttaaatgatatgaattgggtttgatgggacttgtcacagcctttttacttatttatttatttatttttttagagacagggtctcactctgttacccaggctggagtgcagtgacaccatcataactcactgcagcctcaaactcccaagttccagcctcctgagtagctgggactacaggtgcacaccacggtgcctggctatgttttttaatttattatttgtagagatggggggggtctcattttgttgcccaagctggtctcaaactcctggcttcaagctaagtttttaaatttattttttgtagagatggagtctcattttgttgcccaggctggtctcaaactcctagcttcaagcagtcctcctgcttcagcctcccaaagtgttgggattacaggcataagccaccatgcccagccgtcacaccctcttttatgctgaagtgtattatgaatctctgagaggtggaagtgtagtgtacagtgttgctgaaatttatttgacaattgagcccgttatatatatacacaaataaaataaatatatatataaatactatatatgtatatattttctttttttgaaatggagtcttgctctgtcgcccaggctggagtgcagtggcgcaatctcagctcactgcaagctccgcctcctgggttcatgccattctcctgcctcagcctcctgagcagatgggaccacaggcgcctgccaccatgcccagctaattttttgtatttttagtagagacggggtttcaccatgttagccaggatggtctcgatctcctgacctcgtgatctgcccgccttagtcttccaaagtgttgggattacaggcgtgagacactgcgcctggcccattttatgtattttttaataccatcttacaggactgtggtgtggtgttgagtaaaacatagtttgacaatgttgctttttaggacaattgtagatatgctataaactgttaattaacaagtatgtgtgaacaaagaaaccagtgttttgagatggatgtgtagtgctgtgttcctgaggttgatagacaaagggtacactttttttttttaagctgtactttttagagtcaaatgcagtaaaacacctcagagttgccttgcttctgcattgaacttctcaggaaatcccttatgttacaaatgctctgtagtccagagaagtcaatgcgtattttacatataagaaactaaaataattattagttctagagacaaatagcatggaaagtaaggtcagacaatcttcatgttttttttttaaataacattgtttatttatttatatgaaaaacttacatttatttatatgaaaaataaagctgaaaatttgagtattccaaaacaatttaatctgatctttgtaagtgctttaatctgatctttataagcactttatatagttaatctcaatgaattcatcttagagtaaacttgcatttaactttatttcaagttgtcataaaagttcagacaaccatcactggacctacagattgagtgattattatagtggggatgtccttgggttagtaagcctaaaggaagtaatttctgttaaaggagatgttagtggccatttgcatcttaatgtcaatcttatcagatgttcccagactacaaactgggtgggtcatatctcttagcatttcaactggtatttctcagagcaactagtggctcatgttccaaatatagaaggcatttgcataacatcaatgttagacctgggcttgttagactcttgggctcatgtatacaaaagcaaccaccctaaacctttagtataatctttgtttttctgctaccatgttaaactttgaaataatcagttttacttggctgcctccctttatattttgatggagtagttggatcttccaaattatgtttagtatttatcatattttttaaatgttctgcttaattaggtattctttatttttttaaatatatgttttggaaatccactgagacttagggttcttcttctgagttctttaaagtcttgaattattaatgctgttttccatgaaaaccacactttagaacatttgtatatcagctacctaaataattaatgataaagagaagctttgctgccagactctactactgtcctttaaaaaagagatatttattagaatattttgtggcttgctagatactccttttttatcacatttatatcttatttatagttatataccctgttttttatatttgtatacacacacatatatatgtattatgtataaaatttggttttcacttttgaaaaaagaatccagcatgtttttggtgtgtgttgaaaaagattccaattaatggttattagggagaaagcttgatgttgtactaattatgttgcttgagtctgtgaaagattaaatttttttttgccagttatctttttctctgagtaaatttatgtttattatgataatagtaaattagagctgcatgattctacttgacatatggattatgctaatttttttttttttttccaaaatttctagatgaagcgttctgtcagccaccctggttcttgcagttcagagaggtaaaagaaccttttcttctgactaagttctctcaaattatatccatctagggaagttctttgggcctttaacaagtggtgtggaatgtaaactctgtatgggttaggtctggttcaaaaccagcattttatctctcagtatttatctcctagtatttagtataagggcctggcctcagtaggtagtcagtaaagaaaaaaatgaatgaattaaccagcaaggtaagcacgttgccagccattttaccttttttagatgtttgaaatgcagtcatatattgaagaatgacttttccatcaatgatagactgcatatgtgacagtggcctcataagattataataccatatttttactgtactttttccatgtttaggtatgtttagatacacaaataccattgttacagtcacccacaacattcagtacagtaacatgcagtagaagtttgtagcctaagaacaataggctataccacatagcctacatgtgtagtaggctatactagctagttttgtgtaagcacgctctgtgatgtttgcacagtgacagaatcacctagcgatggatttctcagaatgcatccttgtcattaagagacgcatgactgtatatcaagtgatggttagacagaagtacatttttgatgtgttgagactccacagctagggctcattttacctcagctgtttatagcatcatctattcatgctgagctgttgtttcattaagagagaaagatcttgctgaagagagaaaaccacttgatattttaaagtacatattcatatcaatacgtttaaaaattttaccttctggatagatcttaccaaaatgctaagttgttaaactattattttgttaggtaatagtcctttaagttgctatggttgtcttatttagttctttggaaagtgatttaattatagtgacattggcatttatttctctatatttggactgttaaatgctgttttgtcatgttttaattttttcccctgatgattgtataatctttgattaaactgtcaaatactcagaggaatccaatgatgtatatatccaaccttgtcagggaatcaagagtcccaccaactgaattttccagaaaaatggaagcttaatcaatttttgaccaacttttatttttatgaaagaaatttttctatcctttctacctcataaaataataattttaaaatcttatttgtttcctgatgaatcaaggttgtcattaagtacagtaaagttgggctgttacaaaaatagtagctgagatgctgttaggtggtggtgatttgcttctctgtttaaatttttcagacagatttttaaaagagtttttctaggcccctttttgccatctttatcttctcttgctgttgtcagtgagtctacctctagctctatgaactccttgcccatctctttcagtctgctggttttgatcagatatggattgacttaaaatacatgcattcatgaaacctatgacttctagttttcaaacatttgtaaaccgactgatatgtctgctctctggagtctcccctacagaagtcactacttcttcattgtacccctcttccttttagttcagctcagaagccatattctccaggttaccagctgtcttctaaatgggttcacttgtttttgacttctgagtagaatgttgctaacacgggacgttgagcataaaaataattcttttttcacttaaagagaagtcatttaaaattccagttgagtgtgtttttgtttatgtaaggccttacaatttaatgctttttacttaatttgcaggagtagccactctataaaagaaccagtatctacacttcaccgactctcccagcgacgccgaagaacctactcagatacagattcttgtagtgatattcctcttgaagacccagatagtaagtgacatagattctgtctctttctttggcatattcagcaaaattactgtggggctctgtaatttctggaaatgaagtatactgactgaacattgtactttgtttctttgattccttaattcagaggtaagcaaacagcgctcaatcaatgaaagctcatatatccccttacaaacaggtttgttactaactaaggagtgctgaggattgctttgtaaatatcgtatctcagatatatatttatagaatatcatgatcttttaccaccactaggacttaaaaaacattttagaagaaggcatgaattgttagcaggattctaggggaaaataaaggcaagttccaagttcatataaaagtcagcattgttactttactaaaatacctagaaatggctaaggaaaagaattttgtctggtagtcacagtgaattatagtagcattcattcctctacctttttcttccttattaaagaggcagcatactgtgattgaatgtttttaggaaaggttttgtgatttatgttaaaatttttaaatttttctcttcagagaagaagctttgaaagtgtgtcagaatatctagtaagatagtagtgaccatgatttgcagtgaacacaaatatagtcttattattacatctccattaatagacttatactctccaagtctctactatttctcaggaagcatgtgggatagaaactatgtacaatttccaattaaggaacaggtcgtgttccaatagttagttcatttgtaagtcagttgtttggaaaacagattttatttttcttgtggaaatgacatgataagtggtggttagctctttggatagctaaccattctttggaagagcccagtgaattcatagtatggctgaaatgggacaaaacaatggtgtatttctagcatttgagtgtattgaaaacactgattaagctggagttgttttatgtaaccagaaagttaaacaggtttagttcatacatatggcaattttaaaaaggattgctggtcatttttggatttttaggagttgatagaatctttttttttttttaatgcccactttttttttaaactgaattaatcatctatttattaatatatggcactattctatgctcattaacattttgaatttaaattgagatgtgggtggagaaatgaaggaaagaaaccgggaaggggaagggagaaagaaactttcttgggccaatcaagcaagacctggaagagaagaggaggagaggaggagggttaaagaggttgagtatgtgaaaaaagttatctgaggcaggtaagatagactctgattctctttattctttatgccttttacacatgactcttaatccagagttcatgaaggagttctgtatgctaccttgtagttttaagtgcgacatctttttttttttttaaggggatcatttgtgattactaaaataatttttttaaagccatccatttttctttagaattcttttcttctagttactctagtcctgaatatttgaaaacaattttcaaaagatctaggtgtacatgctctattatatttagcatcccccagtttaactgttatggactgtaacaaaactagtctcacacacacacacacgcacgcacacacacacacgcgcatacatatagttcacttctctagaacatctttaaattagcaagtatagactaggtcagaaattttatccttagattttttcctgtttatactagtttagtgtttcaattagctgacaaagcaaagattgaattagtgctctttccagaaagtatatattttgcaattggcagtcttagttgaaagttgttactcaaaaatattcttcttgtgagatgcaactgcttctattttctttaacaagctttttcaaaaagtatgaaagtaataaatgatgatggtaaactcaaactatatatataaaggtacaactgccttagaacaggactatgccagtgtagtcagctgtgttaacatggagttgcagtgatagttctgtgagctgcattacaaatggagaaatgggatctttcagtatgaggtaccttgtcagctttgctcagaaagtcttagaatgaaaagaggaatacctgaatttagtcctcgttctgttaccaattgtgtgatcttgggtaaggcatgtatccttttatgggtcttggtttctttgcctaggaacaaggaggatattaacagcattaaaataggctgaaaaagcaatagttaattaataaagattaaattcaattcagcaaatatttattgactacctattatgtgccaaccatgattctagcagtgaacaaaacaaaaatctctacttcaggcaatttcatcatttatcttatgaattctgatgtttctccttgtggctgttgatactctagtctaaaagttaagttttcctgcatgaaacaaacaaggaaatacaaaattagccagaagctaaaggaatttcatgtccctgaacaggaaatttaaaatgttctttcacagaggactggagttaatattgacaggatgtttaacgtttttatcaatgtcttcataggacctgttcactgttcaaaaaatacacttaatggagatttggcatcagcaaccattcctgaagaaagcagacttatggccaaaaaacaatctgaatcagaagatactcttccatccttctcttcctgaagaaactgaagtgtccaacttcctctaagtattgctatgcaaaagctgctgtaattaaactattgttatagggagtagttttttcccttaggactctgcactttatagaatgttgtaaaacagacaaacaagaaaacaaaccacatacttttgaagtgtattttatctttatatagtttgtttgcaagagtattttcctaataacttcacagtatgaatgtgcatcttttttttttgaacaaatgatggtgtaacattttgacatccataaggacaaatgtagatatttttcttaaaaactctgaggggactgacagcatggtcagggtgtattgtagcttataaacatgaaatcttataaggtttcagtttgacagaagtgtgatatatgtaacttgtgccatggaccaaatggtcactttaccacagctaaaaatgagttacgatagcagcttgatggtgattgtattgtattcctttaatcaaaaaggaaacacaatattctaagtatctttagcccaaataccatgacatattgagcatctttaaataaccagactgtattgtccttcatatgtgaagttgacactactgatttgtcaataccaaattttgggttaaagtgtttaatttttatgtatttattttcttgttgcctcaaaagatgattgcattctaacttttgtgacctaccaaatttaagatgtgtatacgttgttctttacgttgttctagaaaagagattttaatgctgtagtgactttgctcacttacactagagaaataaacaactttcaatggaagagaattttagtgctttttttttcctaaaatagatattaagctgctgttgtaaagtattgtttgcagctctttccaatatctagagacatttttatttatgaatatttatacaaaaaggaattctgtcaagatgactgctctatatcacttgagaatggcattatttaattaaagaacaaatagcattttttggtagtgcctgtccatacctattgtcattgtttgccttgtaatctgtttttttgaattcattttgggctgatagttttgtttaaggttttggataaggagcactttaaaacaaactggtgtgttgtttttaagttaatcatatgtttaataaatgcgtggtttttgcattcaaacacatcatataatacattgtattttttacattcattgatattctgtctaatctttattaggcactaatataattctaatggatttgagtttgtttgtatatttaggcctgctggtgaagacacaaatgaagcataatttttgttgcctgtgagcttagaatggtgtgacctatttcattttatttcaatttatcttgtaagtttatgtgggatattttaaaataattaatatttggtatttgtttaaaaaactgtaattataggccttccatcttaagtttaagatggacataaacagtctatacattaatatgtgtttgggtaaactgtatgctacttgaagtgtttgtaattttaaataacacacaggtcatcagactactctatattcagtggagtctttgcctgctcataagttgtacttcatatgtctaatttgaaaaaaaaagtttgataatgtagtaagttatgacgttgagcaggtaatcaggtttttcttgttttttttttttttttaaattttgtagtaagaacttgcacagtattaagaccatgaaggtcagggtgctattgattgggagttttttctggtagtgagtttttttgcagtaataggtttataaggaaaacaccgtaacaagcttttgaacttatagaaaataatcacatccattttctattgctttacccaaatagatgggttcgtgaagagttttctgtgaatattttaaaaatacaatgcaattatttctggtttgtatcattttttcccccttaaaacaggtccttgaacaggtttgcggtatccctaagtatgtcttttgttatgacttggagccactttttgttgttattgttaggaaccaaacacatctgtgaaatcattttttttgtgggagtataaatatatcttgaattatatccaggttttgatcagtgaattagtagcatgaagaaacctataaagcttaagggaaccttgcattttgaggagtcctttattttcaagtgtgcctgacttttttgaattttaagaaaaagatgaaccatataacaattctgtaagaattttagcttgtcaagttgttctatactttatagaaaaattattggttattattagttattagtagtcccttttttttgctttgtctaggtcatggggttattgagaaacatgaaaagttattgagaaatttggaggttctcttggcagcctatcagtgatcttctaagcaaaagcagtgcttgtttttcatttcaagtgcttgctcactattctttgggaatcgcaggcctccatgactaaagggattttgatacaattcttttataaatgagctgaatttgaattttcttacatcatatgggattattgcatgatcttcagtcaggaaaaatccagaaatggatgctattgcttaaacttaaattccaaggcagaagatagagtatcttcatttccacagatgccctagaacctttgaccttgaattgtagtttttcagtatgtattatcacatttagaaatgtaaaaatcacaagatctcaggaaatgcgcccttgtgatatgttaataccagattgctgtttacactaattccatatacatgataataccactaatttggactctgctagttcttttatttaataaggcacctctaggtctgtactttgagccttgatctgggtacttggtacagagggagtgtcctggcctgaaagaaagccagattaggctgcaggagttcctttgaggaggtctgtcttttaataaccctggcgggtaaatgaatggtaggtagctggtaggtaggccttcttgttcatgtctttctgtctccccaatccactctttgaattcatgttgaattcttaacttgaaattctgttgttttttttttaattttagctttctttttattaaactagttaatgtacatagtttgaaaaaatcaaatagaactaaaaggtttatagtgaaaaagtgtagttccctcttccccagtttagcattccaaagacaaacacttggaactcttagtggtttgtgttagtatttaccttcctgtttgaaaatgttatactactttttgttgacttatcaatttcagaaacagtttctcgaataccttttatggtagacaggatttactttacttaaactctccacctcccacatttttcttcccccacccctcccaaaatagatttatattcacacaacttttagttagaacaaactttttgtgaaatagatagacataaatgtagttcactgatgtaccacatggttaactatcattatttcctttttactagaatgttattttttctggggttggtattgcctgattttcaaatttgcttagtttttaatgtacctgtcacaatgactatccaaaggcttaaatgctgaaaaacatcagataatcgtatcaattctcttaaaaaagtttttaaaaatattttgtcatcctttagggacatttcttccacagtccttcatcttctgccatttgtactgttgccctccaggcctgttctatggttcagcagtcattctgaaactccctttagtttttagtctcacattaggttttttttttttttttttttttttttttttttttttggcaaagctcctccaccagtaacttcctaagaaaaggtgcatagaaagtaaagattttaaggctttacaggtctgaaaatgtctctactcttgattggtagtttggagtctggaaaataacatgccttcagaattttaagggcaacatttcattgtcttaaggcatttagtttttctgtgagaattctgataccgttcctttacctgggatctgtttttacactctgtaagcttttaggaacttctcattacttctgatgtttcataataatatgtgggtctttattcattcatcttgatggctacttgacttggtggaatctttcaatttagagatttgtctgcttcagttctgggtgtgtgtgtgtgtgtgtgtgtgtgtgtgtgtgtgtgtgatctttttgacagttttctctcttccattttctttgttctatctttctagaatttctgttatttgaatgttggacctcccagagttggaccgcctctaaatttaaaaagctttttctctctagttgttccttaagttatattatctttgttctttttgttatcctccagctcttctgttgaattttctttatatatatattttaatttctaagaggtcttttttttctgtttcatttcataaaaacctatttttattttatagattaactgtttccccatatctccctgaggataaaattaagatttttttcttacatctttcctgtttcttgaatggttctccccctcccccaccatgtttctgctttctatttatttgttttgggctctttcattctgaagcctttcttagaaatcatctattcatattagtcatgtattaaaaagctaatgtcataggtctttatatgtgggcagggtttataagttgtctaaagggccatcaggtagagttggccttttctgttgaggtcccctaaatttcagtggaggtcttctctttggggccagtttctctagaaaactgggtcctgatagtagggtaagaaaagacagctgaggaccccaagatttgtatgatgacttttacttaatccctctatcttcatcctctctcatgcccatccggccccaccccccaaatcctcctctggctgctgaccctcaggttcagtttttcctgtcagtggaggttgagggtggggcgtaggctggctgtggagagtaggggagaggacctgggttccagttgctctttatacagacttctagtcctgatttcagccctatacctcactctcatcttctacaatacctagtgcttccaagtcctgaacttagtagaggtttggtggggtgtgtttttgggcttctcccttttgggtacttaggctttaacttcctccactctgctaggttaggtattgcacttcctcctggtttttatctgtataaactttgttaaaatctcatggctttgtcgtctgtgcttttttgtggattaatactatttatattcctttaatatcttttggtggtttggaggtagaggaaataaattcatgtggttggtttgtatgtttcactgaaagtctagatttaaattctaatagtgtataaaaaataaaaattctttagtattaatttgtaattcattctagtgatttttaattcatatggttttactgtactacctacctcatagggttgtgaggattagaagaatcaattcataaaaagcagttagaaaagtgctgggcacgtagtgtgttgaataagtgttagttattaatattgtttactatcattattattattactactatcagtttttttttttttttctgagacagggtctcactctttcacccagtcttgagtatagtggagtgatctcagctcactgcagtctcgacctcccaggctcaaatgatccttttacctcagcctcccgaataactaggactacaggcatgcaccactactcctggctaatttttgtatttttttgtagcagcagggttttgccatgctgttcagactgatctcaaactcctgggctcaagggatctgcctgccttgactttccaaaattctcggattacaggcatgagccacactgcactctcctatctctctcaattcagtaacctgtttattcttgagtgaaaatgtttcaccataggaagaattactaatatatgggaaaatctagtgtttgataatgttgaccctacattttttttggacagtctctgtcgcccaggccggagtgcagtggcgcgatcttggctcactgcaacttccacttcctgggttcaagcaattctcttgtctcagcctcctaggctacaggctaggactacaggtgctcgccaccatgcccagctaatttttgtatttttaatagagatggggtttcatcatattagtcaggctggtcttgaactcctgacctcaggtcatctacctgccttggcctcccaaagtgtcgggattacagatgtgagccaccgtgcccagccgaccctgcatttaactagacttcatatgaaatgttcaggtgttaggtgttatctttctaagaaacattcaagccttaagaaatccaatcagttatagttactttaaaagttttaaaaagagtataacaattttgatgtgcttttaagctttattggtattatattttgtttttatcatataaatatgaagtataggagataagataatgcagatgatgtttgttatgccttacctaccgccagtagatgtaatactcttaatacatggagtacagaaatagtagattcccttcattcccagtgcaacagtgttgggaggtggggcctaccaggaggtgtttaggtcatgtgggtaccaccctcatgaatagattaatgccgccgtgtaaagggcttgtgggcgtgggtgaacactctcctgctcttctgccaaatgtctctcccttccaaaggacgtagtgctctacatagtgttggaagcgagagactgagccctaacatgccagtgccttatcttggatttctcagcctccaaaactgtgaaaaaataaattttcattctttatggtaaattcccatcactgtatccataacctcttgtaaatagttgtacacctttcagaaaatgttgtggacttacataagcaaaatgcctgcatttatttcataggtaaaattttaatctattttctaatcaaagtgttttggggaacatttaatttaaatactatgttcaatttttttaatggtctgcttcagattttttttataagttaatgttttaaaacaaaataattgtgttctaggtagaagctactctgagtttaggtttttaaatctctttcagatattttaagtatcttttttgtgtctggattcagagaggtatgataatgagattctcttctagaggggaagtgggagtaggtaaccatactactctttctacggctacagagccgcatactcgaaggagggagatttttatttgtaaggacatttgtattatctttcattaaagtagagtcccatgggcgtggcaaatggctgtaaataaagtaaaagtggctaaagaaaacagtgcctgctattagcttgatgctggcattttcttctttccctggatgtgactgttattgtctttattgggtccccttattatctgctttgatatccatctctggaactttgatctctaattttttttttttttttttgagacagagtctcactctgtagcccaagttagagtgcagtgacacgatcttggctcactgcaacctccacctccggggctcaagcaattctcgtgactcaacatcccaaatagctgggactgtaggcacgcaccaccatgcccagctgatgttttgtatttttacaaaaatttttcaccatgttggccagggtggtctcaaactcctaagctcaggagatccgcctgcctcagcctttgaaagtgctgggattacaggcgggagccaccgtgcccgacctgacctctccatctttggcgtccttatgctgcctcttctccaaatacatgttggccagggtggtctcaaactcctaagctcaggagatccgcctgcctcagcctctgaaagtgctgggattacaggcgggagccaccgtgcctgacctgacctctccatctttggcgtccttatgctgcctcttctccaaatacagtaactaatctagtatattttcataggatagaatttgccctttctgtcccataatatgttcctcttccccaaaaagttttttgttggtctctttggtaataaaacatttagagcatttactgtgggccaggtgctttacctcatgttagccttataacagagatgcggaagtacaggactaccagtgcagccaagatgcacagcaccaggattaactcatgagactgattagaatgatgaatatcttattgtatcctgaaacattaagcctttaagttatccctttatttagtatttaaattcacatgcttcttgatttttttggactagcattagttgttgaataaataaataattcagaatgtatccacaaaacctagaatatatgacagggtggattcagttttgcttagttactgtagataaaccaaataaattaatgtaaagggatattaatgcattaagcaattttttttgacataaatgaagggttgtttccatgggtaatatattcagaatattaaagatgagtaaaatgtatgactataatgaattccttcttcacttttactctggcaaggtgggaggagggtgctgttgataatctctgtgcttttgcaagtttggcacaaagacttttactcacttaaatctcaatataaagtatattgccagatctggcagcatggggacaattaggaacaaaggagagagaatagaatcagccatcaggagctataaccacactcttctttctcaaccttttctggtattagtaggcagaactccttttggatgcggtgaagcattttatgagtgaacaatggtgagtcatgtaatgaaaggagatgttctaggaaaacttttcagtcccgctcagtgctgccatctttttctcccagcactctggacttaaaattctgagagaacagggtatttcccacccttcctcttactttttgaaagcaatacctgagttattaagcaatcatttagacagtatgaataaaccaaaattcaccttgacactccatcccctagaggtaaccattcttttctagtatatattcttccagacctttttcctgtgtattgacttttaaatagatgtacattgcaatagtttggattagctcatccatagcagggtggttaaataaacagtggcacttttttttttttgagacagagtctcaccctgtcgcccaggctggagtgcaatggcgcgatctcggctcactgcaacctttgctttccaggttcaagcgattctcctgcctcagcctcccaagtagctggaattacaggcgagcaccaccatgcctggctaatttttgtatttttggtagagacggggttttaccgtgttggtcaggctggtctcgaatgcctgaccttgtgatctgcctgccttggcctcccagtgtcaggatcctggccccagtggcacatttttatgatgcatctggtactaaagaaggagctggctttatgacctttacttgagtatttttttgtgtgtgacagttgaacaattctgacccctattattgttggctggacaggcattttctttttaattcctctatgcaaggaactgtggattgcttttttctggatagctagaacgaggccattttctttcaaaagacagtcctagagtttccagtggttttctttaattgtgtatgcgtgagtgtgacagtgtgtgtgcctgtgtctctatctgtgcatgcatctgtatgcacagtttcttagttgtggacaatgcaacttggaatcattttagttttccaattgattttaaaagtttatctatagaagatgagacaaatttgctgtagaagttaccactacttggtcaaaatagagagttgtgggtttttttttttgtttgacaacaatcaaaagtatggcctacagatagtaagggttaaccacccagatttttgtcagataatatatacatgtccatgtaattaaaagtcttcatttgacaaatttatatggtaaatgagcataaaatgaatatcttttcagtattagaacatttctgtttatgccctattccagtggtatttgtggtcgctaggggttgctgggttatccaagtgattcagcatgccttcagaattggcatcctcgggtgattgtccatagcctcttgcaatggtgcctcatcttggggaggctttagaacacagctctcatttagcttattattgatttttttttcttgttttgcagttgttggctagagaaaagtgtgtagcaataagtacgcacacttactgtggtttaccatcatgaccatggatagcaaactgcctttttttttttttttaactcctgtgtcatctctgatgttgtggctaattttaagactttgatttttcagctaggattagcggagaatgacctacctacttgattaatgatgtctgcatgggcttactaagagggtgtggggaatggtggcaggggtaactatcatcgagaatatagggcaatgggtatattctaactttgcataactttgctagattatatatatctttactcacaataagcaaagttgaacaacttaaaattgattccctgttttctgttttcactatccaactaggatgaactcttaagttcatacatatactttaaaatgggaacaaacatagcctgtcatgtctttatttaggctaagtgcatatgtatgtataagtaatgtgtatatccttcacttattaatagtgccttcatgaattcaaagacccttgtcacatggtgctcaggaaaaaaaaagtgccaatattctttttttttttttctctaagaagtactagtttaggtaagtgaaattcaatagcatatcagtgctttaccttagtcactttttgtgttttgatcacccttagtcatcactggagagaagagtttgaattcatttgtggttttgctttagtggcaaacctccttacagggatgagttgccctccattctccttgccatatttggttaatctaggccatgacctttgaggggaaaaggcacagattgcaacttttctttcctgcttttgtgaatcaggccatgttcacgcagggtccttgaaggtgacttgagtgaggaagctatataccgatgacttaccaatttttggtcttataacattctctctctttttttttttttttttttgtagcatatggcttcctctactgtatgttggcatttgccacttttggggatttgactcctgcaggtatttttttttttttcttttgggggagtgtgacggcagtggatatagtcttagatgatgtttttaatagttcaagtccattagtgtcttactctagagaaaacgaaagactcactgtgtgagttttcttgccctctggttttcagaattctgtgtagtttctcaacatttcctttctacctgtcctgaagagctcttatggaaatcatggttgaatgttagtaaatttctaagagctttccaatgttgtctataattagccaaaaaaagacatatgaacttttctcattctgtctacctttttaaaattttattcactttatctttttctccagttttgatagatgattatagagttccccaaaatggccttcttactatttctatattaggtatattatttcagaaaagaaaataatcacttgggaatggcggtgagttcagggggtctgttaaccatttaatttaggattgtttatacatttatttacctcttttaaaaaatttcttcagttaatattcattgaccactcactaagtgttatgttgctagtatttatctttgctttctaattatttttttgtaatttttttgctttctaattcttgagtgaatttaaaactcactgctttattatttaatatcttagatacaatgactatcttaattataattggctttccaaaattttcactttttttcagttaactagttgaatagtatttatcattcacatttgcaccctaactattgttttaacctaaacataaataagcaagcattagaaagtagcataattgctgttaaaatagtcttttctttgcgtgtttaaatattgttagaaacataagcacatgaatttttttggccttttaaatgtctttattgtagctagttataagatgtatatatagcttatatatgtgtatatacacatacatatatatatatacatacatatatatacataaaatgattcttgcaaaagtagttatgggtatttaagtgaaaaatttgtaagtttagaagttaagaaattggaaataatggaattggtttaaaaagctagtctctaaattaacttagaaacctaatagcaaatacagattttgattgctataactaaacactttaattttgaaaaagtttcagaatagaatttctattcccaggggaaaataaacttcatttaaaaatatatgtatacttattttgtgagtatttttttcttttccaaattccaaaaggtgtatactctatatttttgtcataaaaattctgcttgtcgaaaatattgtagtaattttataaattcaataaaacctgagtgatgtgaacagtgtgggggaaaatgtttaataaatttgccatgccactgagaaaaacttaaatacagcatgttttgaaagtttgaggaagcgtaacactttgctttttaaaaacgtgactggtttgctgcacatttaaatttaaaagctggttggctattttaagattagtgctgtgatgtgagaaaagatagtagtgatgatagctaacctttaaacgaaagcatacagtgcatcaccttatttgtttagatcaggagttctccatcttggctgcacattacaaacccccagggtgcagccaggcacagtgattcacatctgtaatcccagcactttgggaggcagagttgggcggattgcttgagctcaggagttcaaaaccagcctgggcaacatagtgaaacctcatgtctccaaaaaaaaaaaaaaaaaaaaaaaagagctggacgtggacgtggtgttgcttgcctgtagttccagctactcgggaggctgagatgtggggattgcttgagcccgtgaggttgagggtgcagtgaactgtaattgcaccactgcactccggcctgggcaacagagtgagaccctgtctcaaaaaaaaaaaaagaactcccgccccgcagggtgcatttaaatttcctaggttcatgggtaggttgacgcagaccaattatagcaacacctctgggggcaaggtgagacccaatcatcagtattttttgaaagtttttcagtgattccaatgggtagccagctttgcaaaccattgagctggatggaaattctcaattctgattgttgcattttagaagaggtgggggatgtgtgtttctatgtgtatatagatagatatagatctatctcttttatatatctgtctcactaaagtttgtggccatcgtctagcagtcagaaaggccaaataggtccttattagcatgggccgaggttcccttgggggttgttagaaatgcagaatctcagcatccccatcccagatctgctgaactagattctgcgttttcaaaagttccttcggtgattgctacacactttaaagtttgagaagcactactggaggtgatattagggtaaatgtagatctccatacaccctgccttttgcttctctctggttttctgactaaagttttgacatttttatgtggggttggaaaatgaagctagtactatgtgctcacatcagcagattaatagctgtggtgagtttctgatctggagcagatgtgaaggagacgactgccatcaccacaaaactccactcttccctcagatggggaaagagaaaacagctcaaagaatggtcactgggctgaaggcagtgctctttcagtctcttctctcaactaccctgtgtgttaaggaaaaataagaagtacagtacttgcaaggatactgctttatacatgcctttgagaattctctggaagagaaagctacttccctttaagtaagaaatgtactcatcccagtgtcaaactgcaattaataaagccaaatcctccaagttctctggaataatttctatacaatgccctgcactcagaaacctttcttatagtggctacaatcccgtatcttaaatatttcaagaactctcagtctgcttccctctgtctcaacccctaccaagaaataggcagattattttgctaggatgctttcttcctgcaatgattgaacgattcttttgtgtgaatactatagggtccagtagtgtagtttctgggaagctctcccattgctgtcccttcacgtgacacgctgggtcaggtaagcaccctatttcctgactatatttcagatgccagttaagggttcagcatctctggcctgagctttctgagaagaggaattccctacactagaaatgaaggactttttttacaggaagcaacctgatggcattttgctgttgaccctgccctggaactacaatgattctcaaagtggaaaagagccctcttctccctaatcaagcactctcttgcctgctcaccctccagcaggtttggttcttggtgttttgaaggggtggaaagacaacactgataaacagagacctggcctctagttccagctctgttgctaaccatgtgactctgggcatgttattcaaagacctggatctcaatattctccattttgagctttctttctggggtctcattctcttccccttagtggtcctttaggtttttaggacagagcatctcagcctcccacctggtcttggcctcatgggcctggtggtgtcccttctctttggcttctttgggttgtggcagggatatggaagtgaaggggaaacagctggcctgccttatgcatgtgggccgaatttcttggcaagttggagaacgaggaatacctgtgtccctcatctgaccaaaagctaaaagttgattatggtggtctcagaagtggcagctgacaacaaaaagctgcattcattcatgtgctacatcccttcataaggctgagaccggtgtctgacagaggcccctcaacatcgctggagacttctataactcagggaattcgtatctattgcatatagcaagaagtattcatccttgaggctctgctggttcaggaaccacaaggttcattggcagcagcctctcctggatgcagaaggaaaggaaattctgagcatcgagcctttgtagggtttcaaaaatggagttcatcactgcctctttttagggggaactatgtgtaggtatttctcaggtggcttagacatcccaaggaacagagttggggaaatactgacccagagataccaaaaagcacaaaaccaaactctcactttttataatttcaaataaaaacccacgggccaatctattttcacaaatcctatctatctagtctgctgcctcgtagacacatgtaggacagcatttcttaaacttttaaagccactggcatctttgtaaatgaaacctaaaaaatatacatagacacagtctcagggaaccttgtggatcactaacaatctcaggataagcatgagtttcatgtttggaatcccgacctttaggccacactatcttttgcagagaattcttacaagattgagaagcattggcatagctgcccattcctcttacctgctttccatctcttcttaaaatagagcaggagtgaatgggtatcatctccatcggctgtattcttgacacggcatcctcagcggaacttggtttgctgggcaggactcttctacctcttcactgccaatgccatagcagtggcctttgtcacttaaaaggttttgggcagtaaggtgtcctcctatatccatcccttgctgccacttttcctatgcctgggaagtctaacagattggcttcattgacatgcacccccaagtcccatgaaaatcttaggaaagacctttccacgattgcctataacctcccagggctataattaaaagggacatcatgggttagaaatttggtggtaggtgaagtcttcctgtgagtggaattctataggcggaaataagctctttgatgtagaaagcaaacaaatgtcatagctttctcagaacagctaaagacttggtaaaaataaaattttatcaagtctctagttgacttaaatctctttagtgattcccttacctcttagggaaaagcccaaactctattatatggtatatgaggccttctgcaaggtggccttgcctcttgcacccagcccttcaaaggttgttccactataatcttttttctactaaatttaaaaaaaattttctttaaacttttttggatgtattgtgccatcctttgcccctaggtctctgcaggtgcaaaggtcctctgcctggaaagtgaggcctgccccttcttatcccatattttaggttgcagcttttgcctgtttgcccctttctctgactggataagatgcctcagcaatgtgctcccaaacactccagatttctttgatcatagcacttaacttcatttcttagaggatattcagttgcctcttcaaccaagatctattcctttccacatcttcagtgtttccacctcatatagcctgtctcaacctgcattatgcatagcaccaatgaaaagcaaattctgtcttcaaataaatttggggaacactgtgtcacctcctggaaacataattcatagctcataaaagactgagaaatcctgtatagagaagaaaaattacccaaattctaagtttattaggctgtggaacagtttttccacaacatcttgaagagcagagtttgggaaacattgacccagaggtaccaaaatgcataaaggcaagttttcatattttataaccttagaataaaaacccatgggccagtctattttcaaaagtcctacttaagtagcagtcactattttctcctattacaaggaaatgactttctctacctgaatttctcaaaattacgtttggggcagagtaaacaaaactgaaaattactttttctttctggagcacgatcataaaacaatcttcttgaatcagtcaccatggagatatcaatttaacctgttattttatgggctgtttctggtttaacaacctctatggttcatcgtttctggtttaacaacctctatggttcatctacataatcagctactattggatagagaaaaaatctgtcttttcagaaattccctcagaacacttactataaagaggtgctgttccatgtccgccacatctagggtgacaggttggattatgtccctccctaagagatgttggactcataacctcaagtacctcaggatgcgaacttatttggtgataggctttatagaggtaattaagttgaagtggagtaactaggatgagcctcagtagtatgactggtatcctaaaatggagaaatttggacacagacatgcaggaaaaatgtcgtgtgaacatgaaaatagccatctacagaaaaggagagaggcttaggagagattcttccctcagagttctcagaaggaaccaaccctgccaacaccctgattttggacttccaacctccagagctgcgagacaatacatttctgttgtgtctgccactcgatttatggtactttgttccagcagtgctagaaaatgaatacactagtcccctctgatctgtggtttcactttctgctgtttctgttacccatagtacagtacaataagatatatagagacagagagatcacattcataaaacttttattatagtacattgttatattctattattgttgttaatctcttactgtgcctaatttgcctaatttataaattaaactttttcataggtatgcgtattagtccattttcacgctgctgataaagacatacctgagactgtgtcatttataaagaaaagaggtttaattgactcacagttccacgtggctgggaaggcctcacaatcatggcgaaggcaaggaggagcaagtcacatcttacgtggtgtcagggaagagagaaatgagaaccaaacaaaaggggtttccccttataaaaccgtcagatcttgtaagacttattcactaccatgataacagtatgggggaaacggctcccatgattcaattatctcctaccaggtccctctcacaaggtggaaattatgcgagctacaattcaagatgagatttgagtgaggacacagccaaaccgtatcagcatgtacgtataagaaaaatcatggccaggcgtggtggctcacgcctgtaatcccaacactttgggaggccgaggtgggcagatcacgaggtcaggagatccagaccatcctggctaacaaggtgaaactctgtctctactaaaaacaaaaaattagcctggcgtggtggcaggcgcctgtagtcccagctacttgggaggctgaggccagagaatggcgtgaacccgggaggcggagcttgcagtgagccgagattgcgccactgcactccagcctgggtgacgagtgagactccgtctcaaaaaaaaaaaaaaaaaaaaaaaaggaaaaatcatagtatttgtaggattcagtactatccacagtttcaggattccactgggggatcttgggacaggttgcccaagaataaaggtggcctgccgtacatctaatgagtaccagtgagacctaggctaggtcccctctaaagtgctgcttctctagtccctagcttcaatattctgtactgtggtccctaacagaataatgattgctggtatttattgggtgctctgctaagcgctgttctgagttttacaagtagtaacttgtctaatcgtcacaataatactgtgaggttgctgctgttattctcattttatggacgagaatgtcaaagaatggagaagttgggtaacctgccccaggtgaagtaagttagtaaacagcagttcctagatttgagcggggccctcagggttttgaatgcagacatgtaattgcaacatgattcggctgatcatgtagccagggtgtggggtttataaaatagacgtgaataaaaaaaaggggcaggatgacagtgaagcttgctcatgggttttgtggagggcgtagattggaaccaaaaagcacgcctcggcttggtgctccctgtcgccctctgttgacatggggagagaagagcgggtctgactcggaaatgacgccataatgctgaggaaccactcctggcgttgcggaaggtggggtgtggggccggaagaccctccccccgcgtcttcagaggagcgctgtttctggaggagttaggggaaggaggctgcctggtaagccaggaaaggggcttctggccgttctgttggagcgcctctgactgacttcccccatgtgtccgtgtggccacaccgtgctactttcagaggcagtgggcttttcgctaagggataaaaagaagtaaaaccttgcctttagcgcagctctccttcactgggcagattgctctccctccccactctcccaggcccaaattggatctcagcgcctgggagctccaactttagcaagtgcgaaatcctgtcttcggttttggaattttcatccgcacagactatatcagccacggataggatatgtgagaataccagcatgtcaaggctgggaatcatccttaggcatcacctagccagtcctgcctctcattttaaggtaagaataggcatttaacattgtaagatgatgtagtgggttctgttggcatcacttagatgcccaggaaatgtgtattcttccatcgatttctcgattgttcactgtttggctgcgttagtccacggagaattgtcctggccaacaggcacccctcttcacttgggaaggtttatttccctcttccatccctcctcagcccctcagcttatagcctgtagccattgactggttggtaagggggtacaaaatgtcagcccccttgctcctagatggaaccaactctgtggtacgattgaagctccctgtgagatctggctgaggcttctgctgagaccacattcgtgctcagcttgcttcctctgccctatctgctggctgccccattccctttttccctgagagtaataatccctcaaagaatttctgagacaagaatccccgtctcaggctctgcttttagggaatctgacttaagacggaaaacttgctgaataaattaatgaagacccaggatttttctctggagaatgaaaactgacagtacatttgcttcagctttggtcacctgtacctacattaaggaggtgaatttaggcaaataacatcataggcttataattatgattaacaaattgaagtggacaaatacagatatttttggcattattttattaccaagtctagatcagttgtttaaaaagcatagtagaatgacactatttaaaatagtgtcagtcttccatatactgtcattctaccatgcttttaaaacaactgatctagacttgggaataaaatagttctttagttctgaggtcctttatttgttctgtctcaatttggagctgcagtagccaatatggactcagattcacaactgatcattttccctgaagttgtccttttccgttcactatgctctttgagggacagtatctataccgtgttaatcatctttgtattgttccctgtggtgtttagcacaaaagattgtgaattgtagatgttcaaaatccatcaaagatattgaatcacagctgattccgagttgaatcagctctcctaaaaatatttttcttgatatatttagaagataaacttttggggataaatatatccatgagaactatatctaggctttttaaacaaaattgctgaatacatctaacgataatttaaacatttgcttaaaagaacttattagcatgggctgtttttttttattttttattttattattattatactttaagttttagggtacatgtgcacaatgtgcaagttagttacatatgtatacatgtgccatgctggtgtgctgcacccattaactcgtcatttagcattaggtatatctcctaatgctatccctcccgcctcccccaaccccacaacagtccccagagtgtgatgttccccttcctgtgtccatgtgttctcattgttcagttcccacctatgagtgagaatatgcggtgtttggttttttgttcttgcgatagtttactgcgaatgatgatttccaatttcatccatgtccttacaaaggacatgaactcatcattttttatggctgcatagtattccatggtgtacatgtgccacactttcttaatccagtctatcattgttggacatttgggttggttccaagtctttgctattgtgaatagagctgcaataaacatacgtgtgcatgtgtgtttatagcagcatgatttatagtcctttgggtatatacccagtaatgggatggctgggtcaaatggtatttctagttctagatccttgaggaatctccacactgacttccacaatggttgaactagtttacagtcccaccaacagtgtaaaagtgttcctatttctccacatcttctccagcacctgttgtttcctgactttttaatgattgccattctaactggtgtgagatggtatctcattgtggttttgatttgcatttctctgatggccagtgatgatgagcattttttcttgtgtattttggctgcataaatgtctttttttgagaagtgtctgtttgtatcctttgcccacttgttgatggggttgtttttttcttacacgtttgtttgagttcattgtagattctggatattagccctttgtcagatgagtagattgcaaaaattttctcccattctgtgggttgcctgttcattctgatggtagtttcttttgctgtgcagaagctctttagtttaattagatcagcatgggctgttttgaacttgagttgccttatctatctatgatcgtttttgtgatacacgaagatgcatacttccccaccccagaatttcacagaaaacaaccagccacacattttgaggtgcagatagcttgctttattttgttgttactatctcaaggaggtccaacaattataactaacaattgaatttatacttgcatgaaaagaactacatcaaattgacattttgggcaattagtaatattgtttaaaatttaacaacagctttattttgttgttgttctttactttttgctgtggctcattgcttaggtgcccaggtttttcaggtgcaattaaaatttagaactaccacacaaaggcattggctgcactctgggacctccaagagttggcactgctctggcataggaatacttgaatagcttggttaaatgaagggatggccaggagatgttacttttccaagctattcaggcactccttatgtcagagacagcgtaaaatgagcgaacaaagtgttggccgttacactttgctctggtaatatttgtcatgataattttgtgtgacatcatcagagaaaatgtaagacgttaaagtgttgcttacaggagggtaaatgcaaacatcaccaatgccttacatttctgattcagtaggtattggtgcacatatcaagtgatatgcacagcatcattctcttttaggtggacaggacatcttcaatggggattttctcaacccactgaggcatacttagacatcaacagtatgttgaggcacaaagattgattaaatgttgagcagggtattcgttccataagaaactttctcctaccaacagttagtttcaaaacttacattgtaaaatgtcataaaataaatggtacaaaactttataaccgttaatccggctatatacagtatgtacatgtcactagcaaatgtattatattcttaggtcaacaattatgaaaagattgaaatgaatatttttgaactttgactcatttaggttgatacaaaactacttttttttctttaaatatttacagttcagaaagattagtccgtgtgaaacgtttgcgaaaagttaagaatgagtgtagagtataagggcacaggccctcttaaatggatcgaatatgtatattcacagtggcagagtcagatccaaattcattccctaaactcagggtataaagtccaccatcttgtttctgtacgtccatgatgatcagggttgtcaggtcatctgtgttttcaatgtggaacctcccctgttcttgactgtggatttttcttccaccacaggaccatgttacttctggggtaggctcacccgtgaaagcacaggctactgttagaactttgccttcatcaatgctgatatcagatggaagagcttcaattttaggcggaattcctttatggaacaatgacaaaaaaaaggtcttagaatcactgaaaaaaataaagatttgctttctactgaattgtgtgtactaaagactacaccatgttacttggcttgtctacctctaccagtaattttattgctcacctcttatgcctgctttaagcattttactagttgagctttccagttgtgtcatattagatattcccataaagctgctggaactcatttctacaaaggactcttgcatggaggacatgctttgggcagacatgcttgcaaatttcatctcagtcatgctgctagcactgctgctgctgaaactgctgaaggaggcctcctgcttggaggcagacatttggactgactgagacgagaagcttccttgcaagcttgtgtcaccacttgttctcaatactacctctctggaaggttcttcaactagagctgtggagcatagcagatacacagtgaacatcaatgacatctggttaattgatgacatatgacgctgacttacagaaatggaaacttcaacacacacacagcagcataacccaaacaatttgctgttgaagcataagcaaatacatatatacatacatttgtcaagagctagctcaatgtctccaaaacatgaatccttatatttctatcattacattacatgcaggtgctaggaatcactaggagaaaaatgattagtcatatagaaagtaattgacatattgtgcatcctgcaaataaatgttacacggcagttggtagctttactttgaaatgtaatctatccaagtttctgtgtagctataaagaaagtttgactacaagaatgaattcacatcagttggctgtccctctttcacatggaatttaataaggcttcttagagttttctgtgcttgaaagagaggcaaaaaaacgatctaaaggccttaaacatgtaaggaagaagggtgaggagatacttacgaaggaccattaaggaagctgtagctgaacactggccacggaaatttttggccttaattgtgtactttccactgtcgctgactgatgcatttcggatttcaagggagtatacatttctggagcggcttatgctgacatttgaagaaatagaaatctaagacaaaggaaaaagaaaagaaatgttgaagttcttcagatgtggaagacatggtattttagtttttcttcaataatatattcataattaaacttactggcaggttgtttttaaaccattcgatttcaggggatggctcgccactgatttcacaagtaaagagaacattttgtccttcattaatattttgagatctaggctgtgagatgaaggctggagcatctgagagttctttgctcagtgtcaaatcatactgacacttgacgattccttccttggttttgcttatgcaggtgaggattccttcatctctgtgactggcttgcttgatggttagggtctgatcgctgcctgagacaccatatcggtactcctcagagttggtaagctctacgccattcagtacccatttcacatcagtggcaccagcaatgttggcttttaaaaccagtctttgaccttcgtttatgctcatctgagtagaaaatgctttaatctcagcatgagttctgacttcttctgatgcctgtgatgttttagtgatttcctcatggacaatggatttttccagggaggttgctgctgatttcttgacttcttcagaaatcagaacctttgaagcttcctctttgagggctaacttttcttgagattttgcctctgacatcttaatttcttcagaccttagggctttttgggaaatttcctcttggacaacagctttcttctgaggtgtaatttcagaagtcttttgtgtagagactttctgtgcctcagtatcttttatagctaaaaaagaaacctctgtaaggcaaacttaattagaaagagacccccaccttttactcttctagattctgcgtgtgaaaaacataaaaagaaaaaaagtcaacttcttcatgcaatgtaggtaatacctaatactttctcagttccacttttggaaaattatcatgtgtgacttttgagatcactgtaatgattccttaaactaaactgagccaaagatgattcatatgacttaaggaaaaaagtcttgaaaagaatagtcaacggatttaggagataagtggatttgggagattttgagtaaccaaaacattaaattatctttcagaagattgaaatgaaagcaaactaattttaattggtaaaatagaaatagttctttaattaactttgcactgctttggaaaattagcaactgtgaaggtttaggcaagtagtgccattttgtatattcactgactttattcttaaatattcctgggagcaggggctgacactatggaatcttatataataccacatataactaggtacttaataactgctttttatgctcatagaaaagcatatgctaacttcaaatgtgtgtttctgctttggtgtacaaattgtattctggaattaggaaaataattttattttaatactttcttgtatgtgtatataaggggggatgtttgaaaatatttccctaatattatcttctgaagaaatgtgggtaaaaacaaaagccaacctaccttttattgttaatttgcagctagaggacacagatccagctgaattttttactgtacaagtataaagtccactgtcagaagtatcagtcttatgaatttctaagaagaaccctcccttgtcttcagagagtttatatttacctccttgtgtaatggcctgtagaatgcaaatgatttgtgttttaaaaagtgatttcattttaagctttttttgggaagctgaatttagaagataaaatattttagaagataaaagaaagagacatttaagaactggttacctttccatcttttgtccagatggcagttggccggggttctccagtagccttaactgcaaatttagcaacactgtctgaagaaacagttgtatcctgcaacccagtaacaattactggttttgaggaaattggttcaggagcttttggttcagtttttctggttactgttgactcagtggttttctgatctgatttcttagtttctgatatttttgataccttctcatggatactcttaaaggcttgccccataaattgtaagttggttttagacgttccaccttcaccagaaatctcacaaacatattctccttgatcagattcagtgaggttattgattttgagctcataggtaccatctgctgaataatgaaactggaaatgcccattttccttcagtttcttgccatctttataccaggtgacctcttttgcccttaatacactgctttcaaccacacaggtcagttttgcaatctctttagaagcttctgctttcaggaactgagtaatctttggtggggcagagactgggaggtgctgaactttctctgttggtgttggttttgtctctgtgggtgatacggctttcgggtgagaaggttctggagatttcactcgttttggagacttaactgcttctggggatttcacccgaggctctggggatttgactcttggtggtgatgtcacagccttttcagttaccctggccttttgaatagtcagagtgaactctgcttcttgtttcccttcactgttttctaccaccacgctgtaattgccctcatcggaagcctggactgaagagatctcaaaggttgatttgtactttgtggtggtcacttggtggcgggcagaagtacttagcacttgtcctttacgcagccaggtcacagttggtaccggctcaccatcggtgtcacaagaaaaccttgcagactcgccctcgtagacggtcatggaccgtggctttgttagaattcttgctgccaaagtcgtcttgatctttctggttgtggatttttcttccagtgacttttcttctaatgcagcacttttcatttctgcagatgcagagtgttcatatgaggagagactttcccttgtctccgtcatctgtgatttcacttccctgacagaagacgaagcttccatctcagatgttttcttaaatgatgaaacagcatacgcctctgttcttgtcagctcagggaaaacagatctggggacctcttcatctctgcgttgggaagcataggtggtataatcccctcctgtcacgtccaacgttgcatagtcagaagcttcgcccttgtagttggtgcacacagcacggtaggttccactgtcatcagtatgacagtccagaatttccagggtgaggactccactcgtgttggtgtaatgaatcttactgctttcttggagttccacaccattgtggtaccatttaacctcggcagttggcttagactgaacatttaaaataaaacgtgtattttggccacatggtaccctgtgcgagcgcattctcagtgtgattcgaggggcatggtccagtgtgaaaggctgctgactcaaaacttcatacttcctttctgatgtcttctgagtttttaaagcagctttcatggactcatacctggaaaagatatcaaatcttgcagacctctcaaatctcgagagtgatctctcactagacacagggctgggggatcgtgggcgagttctctctggagtaggtgaccttctttctgtgtcatcttcgtattcctcagccggttgtggacgtgaccggatcagctcagacactggcctcattaactcaatataagttggagacagggagcgccgtcgtctcagtagtctagacgcagatgaggatgattctctttgagcatgttttgagatttcgtattcttcctcaatttctgttatttctgtcacttctctttgtcgccttgatttctttctagacttttcctcctttgacatgaagtcaagttcgcttttgtattctgagagatgctgggtggtcgtaactgggcgaagcaactcttcatcctccctctcagccatgattctttgccgttgctttggctgtctgtacgcagcctgggcatgccgttccctcagttctgcataacttgtactagcttcagccttcgttgggatgtgataggttgaatacctgaagtcttttcttgtttcctccaccttgacatgagcttgtggtgaagagtaacgtaggctagaaagctcaaagtgtggagggcttcgacttgggggtgaagctgaaaaacctaactcaagctcttcttcaagacgcagcctctcttcctctgttcttttcattgctaagtagtcatcaatggggaggagtaattcttcatcagagatgtccccaagagaacgtcttctaggtcggtagtaaaagtcataatcaggagaaggtgtacgccggcgggctggtctcactatctcaagatcatcttgggacagtttaggaatacgccatttaggtctgtattgatctgtaatgcgtggaagaggcatcacatagaactgttcccatcttgaaaggcggatgcgcttgggtcgtttctgtacaactctgtcaagtttcccaggcatttcatactgatcacgtatctttttataccacttcatgtcagacatgggcacgaactgcttgatgcgttggtcttcttctatggtagtctgcttatacttgcgtggctctggtacatcataaggcatccggagttttctctcctccttcttttcttctatctcaagtctgaattccccttttacagtcttggtgcttacagccggtttataaaggacagcagcttctctcagagcctctttagctacctgtgtcagtggtacactttcagttccagaaagaatttcagccattctgagggttttgtcaatttgtttttgtacgtgtcgctcatgctcctccttactcttgaattcctgtttcttgtacctcaggcgttccacttgtaggtgagcctggcagctggtggacccagctgtgttagtggctgtgactctataataacccgtgtcttcaggcaaagtgtccctgatgtgcagagcataataatccaagccttcatggataatttcaatgttaggcccgagggacagtggctgaccatctttctcccattttaatgttggtggggggatgccagacactctgatctcaaagcagacactttggccttcttggcattctgcatttgccagtaaccttttgaacatgggtcttaaggtactatctgttggaggtgggtgtagggttactgtcagctttgctttacagctgtcttcaccatatttgttccttgccacaacagtatattcagcgtcatcatctgtagtgacactgttgattgttaattggtaaagacccttgtctgactcaaatgtgtacttcttgtcattgtcacctggtttgattttctgacctgatttataccatgttacatgaggctctgggtggacagttatagttactccaaaccggacattttcacctacataagctgtcttattatagagaggcagggtaaattctggtggcctttccaggagtctcattgtgtctgttctgcgcttaattttcttcatggttctacggcagtaatagtcatagacttctctcacacctttaacaaatagctctgcataagaactgtcttcaccatagtcattgactactttgcatctgtaggtaccatcatctaatttggtaatgtctttgacatagaggatggccactccatcttcgtaggtgatttcgtatttctcactgttctccagctgtcggacgccaaagtaccaagtcacttgggtagactgatcataattttcaattttgcatacatatttgacatgtcctccttcttcaccaactgcatgcattatctgcccagaaactgggccaatttcaatggatgccactttaactttagcaacactcactcccttctgagatcgaattgcaccaccacaggagatccgggctgctgacacaaccatgttgaggtctttcttgatcagggtgtggtaataacgccggtgttttaatgttctgataactttagtactgactctttctatcttctgcttcaaccatgggtgctggagagcctccgatgctgtcatgcgagatttcctctctttcactaacaaccggtcaacaaaatccatggcttcaatgctaatctctttgaatgcttcctcatcgaaagtatattcagcattcatgatattctcaatgatctgttggttagtttcagccaggaatgggttgataccactcaatagcacatataccagtgttccaagtgaccacatgtctgtggctgtgctgacaacatcatgctggtggacttcaggtgcatagtattctggggcagtgaatagaagcctgaagttgtcccctggtttcagctgacgggcttgaccaaattctatgattttaatggtagagcttcttctggtttggtaaatgatattttctggtctaatgtcaaagtgtccaatattatgactgtgtaaaaactgaagtgcttcacagacctggtgaacataacttacaatttctctttcattaagttcaaaagcacttgtgttaatgcgctcaaatatgtcaagtcctgatataaactcaaagatcataactaattcttccatgctttcaaatgattcatggaggtgtaagatgtttctatgcctagcaatattcagaatggaaatttccttctttaccaaaacctgatcagtccctttgactttaacaaatttggccatgtatgtcttctttgaggatgtttcaacacaacgatggacaattccaaactcaccacgcccaagatcttcagcaatcatatatttctcatagagttccttggttgaagagtgagatgctttagtcatggagacttccctggtttcatctacctcttcatcatagttcatagctctggtcttatcttctttggttatggttggttctgaaggctctgaaggcttgctcagaccaaatttattttcagctattacccggaactggtaacttgtttttccaaataagttgatcacggtataacgtgtttctcgggcctgtcctacacggagccatctttctgcagtagttgcacatttttcaacaatgtagttggtgattttgctgccaccatcagaggctggctcagtccatgttaagttgacagaatctcgtgagacatcactaactttgactcctctgggtgggtcaggaacatcagccacatccagttcaactgtcttctgatcaattccaaatctgtttttagcacagaccacatagaaaccagcatcttttctctctaccccattggggaaaacaagtgatgtgaaggatcttgtgacaataacttggtagtggccattattgtcaatgagatcttgtcctttctgccaggtgatcacaggatctggtttgccactgaaaggaatcttgatgctgaccacttcacctcggagagcatgaactgctcccatgccttcaagagttttaggtaagtgtatcttagctggaactgtatcagaaaaaaaaaaaaaaagaatataatttagcaacatctaacagtatgtgtttaagtgcaatagcctccacccccaagttaataactcatttagcctcaacttgatgataatttatttatttttaccttccacttccaaggaggcagtgccagacacagatcccccttggttggtagctctgacttggtaaactgtggcatcatcatctgtgacacttgcaatgatgagctggtggtagccacccttaaattcttgaatcctatattttaatccatctgcaatgatttctttgccttgtctgtaccatttgacgataggttttggatgaccagtcactttgcagaccaaggtagcattgctctgatatctgacatttagatttctcagttcctctttaaagtgtggtgcctgaattgggacatcagatttgggagtgatgggttctgatatttcactccattcactttccccacctagattttcacatttcacacgaaactcgtattcaagaccttcaataaggtttttcactgaaaagacagtttctcgaatttcttctgttgtcacagaaatccatttattctgcttcttctcacgcttctcaaggtagtaatttctaatctttgcacctccatcactggcaggtggcttccaggccacaacacaagaatcttttgtgacagcagtaatagttggtttgccaggagcacctggcttttctattaaacaaaaaaaagatttgagtcatgagatgaaacaggcagctttattaaagcttatttttttaaaaaagaatgttatatgagtccaaaattttgttaaaaaatagctattccagaaagatgaaattggttactttatactaagacatatcaaaaaccaaagttctatttttacaatggggttaggatatatatttctccttttagatatgcaaacattcaattaaagtgaaagaaaaggcacttgtactttatctgaatctttgctatttcctttcaaaatttctttctgtttaaaagaattttatgcaaagatggaactttaccataggaagatacagaaatcaagttgtactcaccaaatggactcttaatgatcacaactgaggacacttctagagggtcactgatgccgaaagtgttctgagctgaaacccggaagtaatagccagcattttctgtgaggttcacaattctacaggttgtcactgagatggctgaagacaccaattgccattcagccccctccttggcctcacatttttccaccacatagttggtgatccaggagcctccgtcatctgcgggtggtttccagctgatcactgcggagttcttcaatagagcttcgatcacaattggtcctgtaggtttgtctggtttatctgttgggggaaaatacaattgtggtggttttcatagtgtgtttttgagatttttttttctttaaaaataaaaagcactgaaaataaaaataaaataccttgtatttccacatcaaggatggcatcaactgttccaaaaacattgctgagctggactttgtatttcccagcatgagtcttacgttggacattcttcatgacaagatgagtatagtgctcagtgttttcaatagtaatgttttctgagttttgcaaaagtttctgaccatggaaccaagtcatggcaggtactggacgaccaatgtacataacatgaagccgaagtgtggaacccacagctccataatatttctctttcagtgggtaaccaggatggaactgcggtgttgcttgcaggagaagcttactactggtttctacttctccaacctcattggtggctatgcaggtataaacaccttcatcttcctgttcctctgtcattactgtaagagtgtgtgtgcgtccatctgaagacattttgtatttccggctttgtatgagctctttaccaaatctgtaccatttaatgtcaggaagaggccttccaacaatctggcatgagagttgagcagcttcacccaattttgtggtaacatccttcatttctttgcgtattcctggggcctctccagctgaacaatatgaaagataatattaagtgactgttaatactcaatctgtaatcctttgtccttgtatatcaggaatgaatttaccttatttactgacacataccatgatttacatattagcctaattcttaaaaactctttgaagtgattttcctaggatcatatggtaaatagggattcaatgagcacatcgtcacattttatgtagagtgtttttttctctttatgattggaaggggattaataatgtataggcttttaagggactgtaaattctctctataattctgtagtattcttgcccttacttaggttcattgaagtggcatacaattgttgacctttcaaatcttgttgggaaatatttttaaaaagaaaccattgcattagagggaattactcaaggaaagtgctcagttcactccatctaacatctgctgaggttgtgtgcttggaatggtttcctgtagaacttgtcatatttcctgtgtgtgtacttgcttttctttcttaacacttgctctccaataaagctttccagggttctacttagtatagagggggaattagccttaacttgtttagtttgtaaatcataagtagagaaccaaaggctacttacatgtgagtttagtctttatagacatagcagttctgcgaggtctgctcagcccagtctcattctcagcaaaaaccctgaattcatactcagtagcttccagcaaacctcctattgtgaattgcttgtccttaatacgttccttattgctcttcttccaggcactgtctccagactgtctatattcaacccagtatccaagaatttctttaccaccatcacattcaggtttctcccactgtagagtgacactatctttggatattgaaagaatctcaagttctcctggttggcttggtttatctgaaatattttaaaataatgaaaagggagtcagctttactggtgaaataaaaggaccaaacatggcttgcttctttaatttaaccccttcttctgaattccttaccaaatggatctttgcaaacaactggttcagaagcagggctggtctcactcaggccaacatcattctgtgcgatgatgcggaactgatactcagcatcgggaacaagccctgtgacagtgtacattgtggtggtgatctgagtcttgttgtgtctgacccacttgtcagtggatgtctctttgcgttcgatgtagtagcctgtgactctagaaccaccatcatctttgggccgggaccaggacaagctaacagaactcttggttacatcgagtacttctggaggattgcttggaggttctggaggatctgtaaatataagtggaaagcacacatgtattagaatacagtcccaagtattataagccaatgactttcatttaaaaacagaaaagtgctgaaataatgtttataattttgtggttgaaagggcacttactcaatggtgtttttggtgtgactggttcctcagatttcaagggtttgcttatgccaaactggttttctgctgaaacacggaaatggtattctacattctctttgaggccttttaccaccagagatgtacctcggactctggaatcaatggtataccaggcggctttaggcacttctcgtctctcgaggatgtagcctaagatgtcagcaccaccatcatcagcaggaggtctccagctgaccctcacagagcggacttggatgtcatcatattccagtggcccttctggactgttgggacttcctatcaccctgaccttgatgtagacagccttcttgccacatttattttccagaaccaggtcataagtgccagaatcacccctgtctgcttctttgatcacaagctcagtgtgtgtttcagatgttgcaatcatggcacgcttactaatatcctggccttccttggtccatttacatattgggaatggttttcctttgattggtatggtaagtctgatgacgccaccttgccttacaaagataccttcttggtatctttcatcaagttcataatcaggatattctggaaaaaaaggtagggtttcaatttagcatttggggtagggggactaagaaataagtctatggcaattattgcagaaagcaaatgatcatatgtctcaccaagcatttcagtgactttgactgttcctggtacctcagcaggctcaccaggtccaccagcattacaagctaggacgcggaacctgtattctgcaccctgaggtaggtgtgttagagtatactctcgaatcttggttggagtggtgttacacttggtccattcatgttgatctactttttgcatttcaatcaagtagcctgtgactttagatcctccttcatcttctggaacactccaggccagggagactgatgtccttgttgtatcagtaactcttgggttttgtggctttcctggaggagctgagaataagaataagaatatactggttaaagttgctgcaaagttgaaaattagctgtgccacctaacaaattcaatgagttgttgaaacggactgttaacattagcctgtttttttgtcttgtgaaaattttattcatggctgggtgtggtggctcatgcctgtaatcacagcaagttgggaggccaaggtgggcagatacttgaggtcaggagttagttcaagaccagcctggccaacatggtgaaaccgcgtctctactaaaaacataaaaattagccatgcgtggtggcaggcacctgtaatcccagctactcaggaggctgaggcagaagaattgcttgaacctgggagacagaggttgcagtgagccaagatcatgccactgcactccagcctgggtgacagagtgagactctgtctcaaaaaaacacaaaaaaacaaaagaaagaaaaaagaaaattttattcattttatcagctaaaaatacttaacattttttcactttcctttctcttaaatgtgcttcatttgtaatcactattattatcttacatttatcagcagtttttaaagtgcttccagaaatattaacttgttttaaaattttaagtgtgatagaaagcatatattatgaatctcatcttaaagaagtggaaattgactccagagaagaatattaaaaattatttgccagaaatcgctagcagctggggtggggaagggactgattacaaacggacacaagggaactttacggggtaataaaaatattccacattttgattgtggtggtgattacaaaacagtacatttttcaaaagtcatagaactatatatttcaaaaaggtgaattttcccacatataaattgtaactcaatcaatttgactgatacaaaatgtccttaccaattggatccatggcaacgatgggtttggaaggacgacttggtttcccagaccctcttgcattaatggctgtgacacggtgttcatattctaagccttcagtaaggccagtggagcggtaccgtgtcattgtcacaggtactttatttacacggacccatcgatctgctctcacttctttgcgctccacaatatatccagtcacttgggagccaccgtcatcctctggtgggtaccaagtaagtgtcatgccatcacgggaaacatcaaatatctgtaatgtttctgggggtccaggaatacctgcagcaagacagaggttaacacgatatggcaatatgaatacgttaaaacaatgactcatatatttgtgttttccttaggttttggttggtattttaaaaggtacataaggcacatgactatttttccaatagtttcacttttgtactatttgtaaattttaatttaaatcatttaattatttaattatttttattaaaaatttttgacttttagcttcaggggtacatgtgcagtttgttacatgggtatattgcatgatgctgaggtttaattttgtactttccttgctgttcctcattttcttcaattctacatttattaagcatgcactctgtatttttttctcactataacattgccagtcctccttcctttcctctcttcctccttcccttctctcttttcttccttccattcctttcttcctaactccctcctcttctctttcataagagtgaagatattaaaaaaaaaatcaagcctaagtgtgttgaaaacctctgagaaaaggaggtttagaaacctgagaaaaggaggtttagaaaccttagaaagaccacagggttaattttgtgacctatttttatttacattagggcatattaaaaacaaattcttttttgttaacattcagaatcagaggtggggagagtggtggaagggcctgtggacttacggatgctgctgcgacactctatgacctcagactgcaagtaagagccaatcccgaagcggtttgttgcagccacacggaacacatactcatttccttcggtgagtctggtaaacttaaacgtggacctagtcactgattcagaaacgggcagccatcctggacgatgagcgtcacgttgttctaccacataaccactcagtggagcaccaccgtccaattcaggtggttcccaggaaatggtaattgatgtagcatcaatttcatcaatcttaataggtcctgttggtggaccaggcttgtctatgaaagagaagaaatacaggaaattaatttttacttcaaatcaaaattgggtgactgaacatcaacttgcttgtatctttgtcacacatccttaccaagaatgataactttaatggtttctgaagtagttccggtaacattcttcaattcaagtgtgtattctccagtatctctgatagtggtttcacggatggttaatttagctactttagtgtgagtttcaactgtgacacgctctgattctctcagtttagaaccagcaaagaaccaggaagcagcaggaggtggacggccagcaataggtatcaccagctctactggtctgccagctgggacatggatggtcttctgaggcattgtagaaagatcgattgttggcaacactatgggaaagaaatcaggcatttattcttaagcattatttttatggtaaattgttacgaattctgaatgttttcattttactttactttttttttttttttggctatttggtacatacctctgaggtcttgtacagtcacggctgtgacagtctctcttggttctgacacacctttctcattttgtgcccttattctaaataagtattgttcaccttcatttaaggaagtaacagtgtgctctaggactgtgggttttaaggtgacaaccttcatccatctctctgtgccagctttgcaggcctcgagaacatatccagtgagtcggctaccaccatcgtagagtggtttttcccaggcaagggtaacagtggatttggtgacatcgaccacttctagctttgcaggcaccaaaggcacttctgagaccagtactgcatcagatgtttcacaaggttctccaatgccataaatattttctggcagcactctgaaatagtacatggttccttctacaagtccagaaattctgtaaagtgtcttgctgcatttggtagttactgttttgaatgctctcatagcagcttcacgcttctcaacgatgtaattgttgactggagctccaccatcaatcgtgggaatttcccaagttatagtcacagaatctcttgatacttccttaactttcactgaaggacagggaccaggagtatctgaaaaacagaatgaaagattcatatttcctatttgcctgatagctttttttttcttggggaaatataatcaacatagttcctttctagagaggtgatcaatcataggtcaagctatattgttttagaggatctactcattgtatagccaattttaagtaaaatgcttaccatagactttaacaaggactgttgctgatttcttgccagattggttttcagcttcaattgtgtattttccagcatcgtaccgattaactttgtccactattagcaatgagtagctctcagtggtgtcaataattgcccggcttgcaaggtcaatgccctgcttgctccacgttatgacaggaggtggtcttccagatacagacaccatcaagcgcaaggaggccccagccctgatggtcacagtcttctttagatcatctgcaagctcaagatctggtatttctggaaagttaatgacaaaatttaattaattcatggacaggtgtgagaagaaaataattcacctaaaagcttctgtgataaatacctattctttccacgggctcaatttcagcaattgattcgctgtattcgctcatacccttcacgttcacggcagcaactctgaaggaatatttctggcccattttaaggtctggcacagtgaattcagtatttcttattgtggcattggtatgcactcggtaccactgatcagtgtccttctcttgcatttccagaacatatcctacaatgtcagtaccaccatcgtacatgggtttggtccatgccaaactaatgctgtgtttggtggtatccacaactcttggagcagaaggtggtccaggggtatctgtggaatttaaaaagtgagatgcagatattaggcaaataaggaaatgttgagatttgtattttttgttttcaagactcacaaaggcattattgctcttgtccacactcaccaagataatctttattaactgggctcctgatattataggacagcacagagtgccacattataatttaatattattatcttaagaattaaattgctttaggaaagtagatatttcttccctacttctttggccagctttactgtgtgttctctattagctaagctcattacttaaagtacccattcttagggacttttctttagttgcttatctttcactgggttagtatcacttgccaccaatacatttctaatgaatacaagaattggtttccttagcttccccaattcagtcccagtgactattcctttatagttcttgggctcagactctgtaaaaggatttgccacttatttttgaagctcttgtcacaattactttgtcagtaacttatgaaaccactagaaactgtatgttcctgctaaacctcttcttaaaaggagttttgccatttttcttttcagttattacagtacaatgcatttttctctaaggaaaatttataaaatagattcttttcatattgatagaatattttttcattaattggaaaatgctgtacaacttttagcaattctaattgctaacttaacagatgtaatagttaaaatgttctctgacttaagctatatttatgatcatgcaaataagcatgtgcttttctagaccattcataaattctaaaaattcttagagattgtgtgttggaaaattatctgtcatatagttttgaggagcattgtatttatgtatgattcttggagctcacatgatggttctctgcatgagatgaagttggaagcttcgctgggctcactgttaccagctgcattcactgcggtcacccggaactggtaatcacaaccctccatcaggctggtcaccttcagcctggtatcatacaccacatagtctttgttgacacgtgtccagcgcaggctcttcttctcacgtttgtctactaggtagttgctgatttcattgccaccatcagattcaggttttgtccactgaatgatgatatgctctttgccagtcccaacttcttcaggtatgccgggtggtgatggaatagctgtttatgaaaataaggatgatgagaattgcacaaaattactattgataagactgcccttctcccttctccccctgattctattacatttcaactgtcaaattatttaaaagtgttaatacttactgaatgagtttctggctacaattggctctgattcaacaggcacaccagggccatatttgtttactgccctcactcggaatatgtactcattgttcttgatgagcctggtaacgacataggatagggttgggcattcgccttcaacaatcacccagttgagcctgctagtctcgcgtctttccacgatgtagtgagtgatttctgctcctccgtcttcctgcggaaggctccaggctaaagtgcacttctcctgtgttactctgctgacggtgagctttccacatgggccaggggaatctgaaacaggtgtaatgacaagccatgatgaagatcattctttctgcccacactggaaaatgctatataaatgtgagaacatttgacatgcttaccaagcactttgaccatgacagacacggccttggtcccgctggcatttttcactgttaaagtgtattttccactgtcacttctgtcacagaacttgatcacagcagttgctcgtttgccagtatactgcaaagagactttttcacagagatctagctccttgtctcctttggtccagataattttgggttcaggtttgccaccaactgcagcatccagaacaagatcagaacctgctctgatggtaaccagatcaccgtgtaatcgggcatccagttcggctttgggtggagctgtcagtaggcaaaacagatatgaatgaatatctgagagtttattttcacataaattgagataattttaaaaaggagaatgttgactatttcctaccgtattcatctcggcaagtgacagggcctgtagattcagaccctttgctaattacgcctgctgcattcttggctaacacacggaactcataagtgtctccttcactgagagcagtcacggtgaagaaattgtcagatacaatggtgtagttgcacttcagccagcgaccatctcctacctcactgactggcttacgctctatgatgtagcccacaaccttgctgcctccatcatacgctggggcagaccaaatcagtgatactgttgatcttgtgacatctgtcacctctggtctgcctggtgcatctggaagggatgcaaaaataaggttaaaatataccactctgagttctactagaatcagtaataataaacaaatatgcccttaaattgtgatacataccaactggattttgagccattataggtcttgaagcttcgctggccttgctaacacctgcagcattgagtgcataagttctgaactgatattccagtccttctactaaaccagttactttgtagttgcactctaagcatggcactttgttttctttcacccaaagaattgtattacgttctttcttctcaacccagtagccaatgattttactgccaccatcgtggtagggttcttcccaacgaatagacatggcattggcagacacatggtagacctcaggtctggtaggagcgcttggtgggactaaatataaacaaaggtattaagtatgaatacaattttataaaattcaggggaaacatttaataatagagactttgaaataggatttttatttttcttaccaaatggatgttcagcaattattggtgctgattctagaggtttgctgacaccaaatctgttctctgaactgacacggaaagaatattccatgtattttgtgagatgagtgactttaatttgagtgcgcttgacactggaattgacaagctgccaagctgttgtacccgattcacgcttttcaactatgtaattagtaatttcagtgcctcctccatctttaggttctccccatgacaggacacacgattcagctgagacagatgagacctcaatggggccggttactggacctggccttccaatgaccacaactgtgacgctaaatgttttaacaccagctgtattttccagggtcaagaagtatcttccagagtcacctctcatgctgtcctttacagtcagtgtggttctgtcttttgttgttgtaatgctcactcgatctgtctctttaagtctcatttcttccagtttccatgttactttgggggcaggacgaccactgattggtacgtcaatggtaaatgggcttcctgctttgcaagttataagctgattggtaattccagtgaggtcagcagtgggctcgatttgaggctccttaatgatgacagaagagaaggcttctctgggttcactatagccagcatcattcttggccttcacacggaattcatattcagttttctcaacaagacgctctactgtgaaagttagctgtttggtgtgaccagcttcaacccagaagtcagatcccttttgtctcatttcaagcaggtagccagtgatccggctgcctccatcgtggtcaggtttaagccaagctaagactgcggaggatttgctagtatcaacaacatcaagtctcctaggtggagcaggctgttctgtggctacaattggttctggcatttcatagggctcaccaacaccatactcatttactgcagaaacacggaaatagtacggaacaccttcggccaggtcattgaccttgaagatctgacgagtgcatttttcactgataacctgccaactacggcgacttgcctctcgtttctctaccacataatgatggattcgggcaccaccgtcaagaagaggggcatcccacatcaatgtagcagatccccgggtcacatctttgaaggtaattgggccaggtgggcctggagtgtctagcactttcacggtgaatgtgattgacttactaccactgttgttttccacagtaagggtatatttccctgcatcatttctgttgcagttttccacagtgagggtgctgaaggaatctgttgtatggatatcagcccgaaggctaaggttagagtctggtttgctccacacagctgtaggagtaggtctaccttggtaggcaatgaagaggcgaatactggccccagctctaacaacatgagtctgtttgaagtttgcatctatgtctaactcaggagctgttaaccggtcaactgctttaattgtgccagtcacttcacagctgtcgccttttccagcaccattgatagcactaactcggaatttgtattcttcacctgcttgtagatcagtgactgtatatcttgttttcacacatgcctctgcattcaccttgtgccagtctcctaagtcggccttacacatttcaataatatacccaattatttccatgccaccatcaaacactggtttggaccattctaagctcacagttgtctttgatgtgtctgttactttgaccactgtgggaggacctggtgggttgacgggctctctacatttaatgagtcttgagatgccacttgcaggtccaactcctgcagcattttcagccatgacatggaattcatactcattgccttctgtcagaccagtgactttgaatcttgtttcagagattggtcgtttgctgatcacttttacccatcttgtgcttttcttttctcttctttcaaggatatactgttgaatttcactgccaccatctgattctggccttgcccatgtcagggtaatgctgttgcctgttatgttgctaggttctggaatgccaggggcatcaggaacagctgtaaaacaaaaacaaaaccccaaatcaattagatgcatttgcttggaaggttaaacttttgacatagtaccgcttagtaaaaacgcaaacttactatattgtatttgagcaaccactggatcagaatcaagtggcctgccaacaccaaacttgttaactgcagaaacacggaattggtattcattgccgtttattagtttaatggcagtgtaactttgggcttcacatttatcctcaattagtgcccaggcaagtctgctggtttcccgtttttcaatgatgtagtgggttatgggagcacaaccgtcattgagtggggcatcccaccacagagtcatcttctccccagtaatattggtgaatcttattggcccaactacttttcctggtgtatctataagaaaaagtttctagagttagtttctttttccttgtccattaaaatacaactaggcatgtctctaatccaagttcataaattgtagcattaagaagctattttaaaagtaccttgtactttcactttaatttctgcttttgcagaaccagatgcatttttggcttccactgtgtatacaccacgatggtcccgagtagcatctctaacaaataggctggtggatccaagtacgtcggttatttccatattcatcctcttttcgatttccactccatctttgaaccaagttactcgaggcactggtcttccttgtaccaaagctttaattctaaggctctctccggacttaataatgagaccatcaaagtattcagggccaaactctactattggtggaactataaaagaaagagaaatactatgtattagtttggcttaataaagacatacataaatatatatttttcagtagtgccatatcacaaggccaggaagagtagtgacttctactgtgctaccaaagcctattttgaaagtaggattgataattgagaatttggactatggggttaaatatttgcctattattattccctttgtaatgcctgtcatgtttttaattttgcattgctctttgtaaaaaggaaagtgaaacatttacagatcatgtacttcctaatactgctgcacagtcacacaagttcttttaagaggccatcagctgcattcaagcaaggggatgattgtgttgttggatgtatgttgtattttaataacttcagtaaagatggacacttattctcgagaaccttttctttatgtactgttaagtggcgaaaattacaaagctaaaaactcattcccacttgctgcatgctctttatatgggaatggagtgaaataatagaaaaaataattgatgccaattatttttttcttcttttcatctgaaaggtagaaagacataattcatccacttagcaaccttgggtaatttgtttctgttaccattttacaggccaggggccaaatgtgttttttaaaaatgtgaatgctcttagtctcattggaaataagttgtaaatgcttaccattttcatctcttgtcataataatgccagaagactgtgagggcgggcttatagttccaacagcatttcttgcaattattctgaactcatagcgatccccaggactgagtcctgtaactgtgtactgacattcactgacgtcagtaaagttgcatctcacccagcgttcatttccttgccgtttctcaatgctatagcccacaatcttactgcctccatcacgcaatggtgggttccatttaagtgtgatggtttcccgggtgacatcaatgtagtcaggagtgccaggtgggtctaaaaaattataaggaaggtaaatgcatcattacatttgtaaccaggtcttaatcatccatggaagaacaatacaattattctataattttaataaataagtaaaatttttataataagtaatttattcaatctcccaaactcatattggtcattaatttcaactttccatttcatagtctttaaaatgaacttcaaattagtttattagactgacttaaaataattcctcttgctttacatgaccagttctctagtgacaagaagatatgtaagaaggtgatgcagagaagaaaagcattccttgatatatttgtttctaatatgttcaattgctaaactaaatgtatttgaataataatcacttacctactggagaaacagctaaggtaaatttgcttgggtcactaggtgagcttaggccagcagaattttcagcatatacacggaattggtaatccagaccttctaccagtccagtggctctatattctcttccagagattggtgatgtattaactttttgccagaggatgctatttctttctttcttttcaacatggaatccagtaacttctgaaccaccatcataaactggagcatcccaagttagtgacatgccatcagaagtcacattgtatataactggctttcctgggggaccaggaatcctgaactggtgttttgccacaataatgcttgagacaagtggttggctgactccgtatctgttttctgctctcactctaaactggtactcagcatctttgactagattaggaactttgaaagtcgttctggcaacacttgaacacaccatcttccagttagtttgtgaagtttcccgcttctcgatgctgtaacaagtaatttctcctcctccattatcttcaggtacatcccatgacaggatgacactatcagccttgatttcatcaaatcgaatgggtcctttgggctttgatggtgggccaagggtgatgactgtaatggggactgcaattctacacactgcattatcaagaataacagtgtattttcctccatgctccttcttggcattcttaatactcaaagtaattttgttttcagttttactgaagcgaacaaattcactttctttcagtggcaagccatctttcagccaactgatggatggtttgggttttcccttataaggtaattcaaggtgcacattgtgcccaattctcacagtgacttgtgccccagggatatctgacaggtcaacttcaggtgtaataataagttctttcactgtaattggcccaatagtgacaggatcactcagtcctttctcatttttggcaaacactctgaactccaggactgactgctccttaagttggctaacctcaatttcacatgtcttacttatgccagcgtgggaccacgtctgttcacctttacctttcctttctacaacatattctgtgatgacgctaccaccatcaaagtcaggtttggtccagctgaggatgacagatgtctttgttgagtctttcattgagagatcacgtataggagctggtacttcagcagccttcactggctctgtagtttcacagggttccccaattccaatttcattttctgcaagaactctgaagaagaatggagtcttctccgacaaatctattagcttgaaggatgtgctagaacatttgtgtgacacgacagaccatgttctcttggtggcatctctcttttcaatgacataattaattattggagatcctccatcaatgagaggaggatcccagagcaaagtgactgtgcctcgagaaacatgtttaacctgtagtttctggcaggcagctggtgtgtcaagcactttaacactcacagttgaagacttaggttcaccaactccattttctattgtgagaatatattttcctgtatcattgcgagtaacttgaggaatggtgagtaatgaggatgaatcagtgttttcaatgctgtatctggcatcactgccaagattcttctcatcttttctccatgtgacagtaggtggaggtctgcctttaaagggaatcaacacttgtacatcttcaccagctttggcaataacagaagttctgagagccacatccaggtcaatctctggtgcctctgtagacataaaatggatacatacagtgaattttaaaagcaaaaaagagtgatttcctggaagtatgcttattaaaaaacataatcaaaccagtaggtacataccaagtatatctttagcttgtacaggttcattcatttctataggttctccttgtccagcacagtttacagcagatacccggaagtagtaattgactccaggtttcaggttggataccacatattctgtagttctgacctctcctttggtagagacagtagtccattcctcttcctctccttgtcttatctcgacaacatacccagtaacagcactgcccccatcatagacaggcttactccagccaagggtgatggatgacttggttgaatctgcgattcttatcttagcaggtggacctggaggatctggaatggccattcacaataaaataattacacaatcatgtacaatttagtcacacaggtgaatatagaagacacaggtgaagatgctgcaggtatgagcacttaccaataggatcagcagctttgtagaattcagatggttcagaaaatggaccctgtccagcagcgtttacagcacaaactctgtattgatagtcactgttttctgtgagtcctgttactttttgtctggtgtcacggatagtctcttttagtactttaaaccatcctaggctcttcttgtctcgtttttcaaggaaatagccacttatatcactaccgccatctgcaattggcctgctccatacaacagtcatcgaattcttggtaatctttgtcacttctggtatgcctggtggcccaggtgtaactatttagaaaggaagggaaaacaaggtacaagaatccacattactgataaattatacctttgatgttcgcattctttccaagaacattggttttattttttatatttttcaccttgtgaaaaggatggtaatgagacaggtgttatataaaagaaaattaaagcatatgcacaggttagcgtagtttatttttaaatttttcacgtttcagttttctaatgaaatcatgtctcaccaaatgcgttcttggctacaacggaatcagattccagtggctcgccaattccatatttgttcacggctcggacccggaagatgtattcatttcctttgataattttggtggttgtaatgatgcactcttccaaatgttcagacaccatagaccacacaacgcggcttgtctcacgcttttccacaatgtagtgagtgatttttgcaccaccatcatcagctggaggccgccagagaagggtgatcttctcagcagttacagtcttaaattcaattggtccaccaggtgggcctggtttgtctatcagtgaaaggacaaaacacgatgttagtacttctttaaagcctacttgttcaaaattactaagctttaggcaaatgtaatatgacagtggtctgtattcagcacctaccaaggatctgtactctgatggtggctgaggctgagcccatggcattccttagttttaattcatagcatccactattaaggcgatcggcatctttgatgagtatagatgcgaggtccgtggtattttcaacacacaccagtgcattggtttgtaattctttatcatctttataccactcaatagtaggcgcaggtttgccagaaatgccagctctgagcttcacagatgtacctgctctgtatttgacaacttctgtatattctagaggcaaatcaattacaggaccacctgcaagaaaaacagatgagaaatatttaaaatattataaggatggaaaaaaaaatagttgcaccaaccttaaagtaaggtcattggccattattaaattatacacacacaccatcattataattctatgcaattattatttaaaaattaaaaatttataggccactcttctatctcagatggggtagaaagactgtgagttgtgcagggacttaagcaccttttacatgtgttttaaagtccattagttgctttattccagtgaagaaatgggatatggtagtgagaacatcatggaagaagctgttaaaacatttcctttcactttagcttttctttccttttcttctacgcacctcctattctttttcttttcccatcccagttcactgatatccaagtgtggatggttcatgtcagacacttaaagtctgaattctctacccacagagctacataattactggacagattttctgccatgctgtttggaattatcaagaaagataactaaattcgacttgctttatactctcataaacactgattcagtatccacaaagcctgattcataaataatgaacagccctgagattctcagcatgaagatggaagtggatacttttgcccagacactacagtggctcaattttctcttagcaaatggagatcttttaggtaaagtgtcacaggatacctgactctcatgacgttttaattttcaaaacattgttgagttgaatgtgccacttattttccagaatggtgaagaatacgcattttggactaaccatgatagagagggctctgaagtctgtctgtctgaattcccactccatccctaacggggaagttacaaaagcactctcagcctcagtttcccttctataagatggctaatatgagggctgtgagaactaagggaaagaattcatgaaaattcctcaataaatgttagctgctgctaatactatcatcatcaaagtctgtgtttagaccaggcatggtggctcacacctgtaatcccaacactttgggaggccgaggtgggtggatcacctgaggtcaggaggttgagacctgcctggccaacatggtgaaactccgtccctactaaaaatacaaaaaattagctgggtgtggtggggcatgcctgtaatcccagctactcaggtgactgaggcacgagaatcgtttgagcccaggaggcggaagttgcagtgaaccaagaccgtgccactgcactacagcctgggcgacagagtgagactctgtctcaaaacaaacaaacaaacaaacaaacaaaaaaaaaaaaaccaaaaaatgaagtctctgtttagtctgtggcttatttaagagcaatattctctaggaactcaaccatggtttaattattgactctgataatttaaaacagaatgaaagcaccaactcatacaatcaatcataaaaggttgaagttggaaaggcccatagatatcctgaggtctaaatctctcactttacagtcaagtcaagagggctggaaaggtatttaaggaattttcctcagactcccagctagtccataatttcttccaaaaaccccattaaggcacagagtaaaagttattctataggattagaaccaggaaaaggtatgcggaaatactgagttaaatagcaattttgattcaaagtgctaagcatgcttaccataagaatcgatgcaagtaatgggccctacaacctcagatggattgctaatggaaccaacagcattcctagcaaagacacggaattcatactgggaattctgagtcaagccagagatgatgaattgagtttcagtaacattggtgaagctggccttggtccatctgccatctggaaggtcacgtctctcaacaatgtagcctgtaatcttgctacctccatcgaaagctggttgttgccatgaaaggctgacagagttctttgaaatatcagtgatacgaacatttcttgggggttctgtggtaataagagaagcagattagcggcacttataatattttgcttcgcagaagtaagatttgcatttttgttatcagaactgcccttcccatgacaaatacgtaccacaagcatcaattgccaagactggttcagaaggatggctaggttttccaactccagcagcattttctgcatacaccctgaattcataaataagtccagcactgattgttgtgactttgaagtgagttgtgcggatgaccagtttgttggctttttgccataaaatactgtttctgtctttcatttccaggtgatagcctacgactgcactgcctccatttgacactggttcatgccagcccacagtgatgctttctcgagtaacattagtgacccatggtgtagatggtggtccaggtgttgctacaaaagagagaaatcctatagattagtacagacaataacacatttatggtaaaagaaaacctggatctttgaaaagttggacaacttactgtatggtagtttgacagtcacacaagctgaatctatatgatcactgatgccaaagcggttttctgccttgatgcggaattggtattcttctcctgtggtcagtttcatgactttcatcatggttcttgcaactgttgcagacacttcagtccacactgcagtacttgtttctcttttgagtagaatgtagttggtaacttgacttccaccgtcatacttaggtggctcccatttgagagtcacactttcttcagttatatcactaataacaacagggccagttggaggaccaggcctgtctagcacaacaatgttaatgaaagctttggttgtaccactggagttggcagcagtgatttcatatctcccagcgtcagctgtaacactttctttgagattgatggtcaggttctcagcagtaatttcggtattaaatctcatggttgccttaagggggacaccatctcttgataaggtcactttgggaagtggttttccagagattggaatgtcaactttaaggtttgaaccagctctaacatatacagtgtgacttgggaaattcttcatatcaatttcaggtggttctgaaaaatgagtatagaaagtgaaagtgaaaaagtgtttctgaaaattaacataaatcaatgcaaataatttcaaattttgcttctacacaaaattagacatacctagttgctccttaataagaacaggaagcagaagctctctcgggtcactcaggccagcttgattttcagcaaacactcggaaaaagtattcagaattctctctcagaccggaaacaacgtgatgggttgactttgccactgcacatttaacccagtttttctgtcctttttctagtgcttcaacgacatagtgtacaattctgcttccgccatcatgttcaggcttcagccaggtcagggaaacactgtctttggatatacttgttactccaagtttttcaggtgggcttggtttttctaagaaaacaaagcatcaaaagaaagtgaataattattacagcacttttaaatgtgcactcttcatgtattgtcaaaagaaaacttttaaatgaaggccatatttttatgttgattttagtcttcctttttacataacccattttgcttctgaaccaaccaaggctcccacaagctatgtcattacatgctatagcattcaaatccaaattaagggtaaaatgaccagattaaatgataaaatttactccaaattcaccatggggataaaaaagaggaacaagatgaacaatcttttaaaaaactttatatacaatttctgtacacacgcacatacacacatatgatatatgtcatacacacatactatatatatataatctgtgtatatatatatataaacatgtatacctacatatatatacagttagattcaataatacttaaattcaacatatattatccaattttagctacgtaaatttctgtttttttaatcaatgaaagactcttcactagagattccattttgtgccatagtatgaatagtttggggtgtgaagggtgtgaacccaaaagcatttaagatgaaataacgactaattagaatgactcacactattctagcaaaattaacgtggatatgtagaatttccttattcttaaaacatacctgttatttttactccttcctttgtttcagctggtataccaacaccaaactcattttctccagagactctgaagtaatagatagctccttcttgtaaattggtaactttgtaggagaggcggttacagttgttggtcacagagacccatgctttcttgctggcctcacgtttttctatgtggtaattcttcactggtgctccaccatcgttttcaggaacatcccaggataacactgcagactctttggttacatcttgcacagtaatgttggttggaggacctggggtatctaaaactttgacaactaaggtcagtgaagcagcactcaaaacattctgaattgttaatgtgtactttccagagtcatttctgttggcattttcaatggtcagtgatgtacgagagtctgtggtatcaacataagctctagtacggaggtcagtgtctggcttactccacaagacattgggtactggtcttcctcggaaaggcacagtcatggtaaatgaggcaccagccttgacaatcaaggtcttcctcatttcactgtcaatatcaaataaaggttcttcttctctttcctttgctatctgagggtcagagctatcactggggtcactagcaccaaccttattgacagattttactctgaaaacatattcagctcctgttgttagtccgcttattgtatattctgtccctcgtaagctctgaatggaagttttccagtcagtgtcatcagattttttgtattctacagtatatccagttatcggggccccaccatcaaacagcggcttaacccaggcaatagttatagttgtcttgcctgagtccacaattttgggtttggatggaggagatggtaggaacactggatcttctgccctaattaagggagaggtttcacttggaagacttaggccagcagcattttctgcataaacacgatattcatattcacatccttcccgaagtcctgttgatttcactcttagatcataaactggttttttgtttacacgcacccatcttaggctatttttctctcgcctttcaattatatatccagatatttcactacctccatcactctcgggtcttgaccagcaaagtgtcatagattctttggtcacagaagtaatttccaaagacgtgggtggacttggaactgtaaatggatctagtgcctttatagctacactctctaggggctcaccaacaccatatttattaacaccagttactctaaatatatattcattgcctttgagtaacttggttactttacaggatgtcatctgtaactctccttcacatattgtccatgcaaggtggcttgtttcacgtttttctacgatgtaatagtcgatatctgcaccaccatcttcttggggacgtccccaggaaagagagcatttctcagcagtgaggccatttatttcaagtggtcctgctggtggaccaggcttatcaagtactttgcaattaacggccacagaccgagtgccggcaacattcttcagtgttagtacatattgcccagtgtctcgtcttatacagtctttaactgttaacaaagtatgattgtctgttgagatgatttctgttcttgctctttcttcaatttctataccatccttggcccaggaaattactggcagaggtcgccctgcaatgtctgcatttatcttaaggacctctccagctttgacaacaataacgtctcggaacttgacatccatcataactcttggaggctcaacatcatctttaactataataggcccagtggattcagatggctcactaactgagtcagcagcattccttgcaaaaacccggaattcataacgctgatcttcagtaagttcagttacttcaaagtatgtttcttgtatattagtataattgcacttcagccaccggccatctggtagttctctgcgttcaacaatgtatcctgtgatcttagctccaccatcataatgtggtttagaccatttaagtgacactgattttcttgtgatatttgtgacttcaggttgtccaggagggtcacaaggatctcttgcagggactggttcacaagatttactgcatttaccaattccagcaatattttcagcatatacacgatactcatacatcagtccttcatcaaggccggagactttcatttgagtatcagcaatgaggattttatttgcttttgaccaaagaatgctgcttctttctttatactcaagatgatagccaattactcgacttcctccatcattaactggcacttgccaggttacaagcatggtagattttgtggcatgcacaactttaggagtaccaggaggacctgggggactgaatggatactctgcaacaacagctgaagattcactgtaggagctctttccatagcggttttctgcacaaacacggaactgatactcacttcctgttgtcaggcgaactattttaatggatgttcttgcaactgcttgtgaaactatgtgccatgttgtagaggtggtttctttcttttcaacaatgtaattgctaatttggcagccaccatcatattctggaggattccaagaaatggttatgctgtcacaactaacctcatcaatacgtataggacctggaggtcctggtctgtcaaggacaattatagtaataggaactgttatggatccagcactgtttgaaacacataattcataagttccaacatcttcctttgaagcttccttaatagatagtgatgttacagtctttgaagaagaaacattgactctagttgtctctttaagagtctgaccatcttttctccagttcacagtagcttgaggtcttcctttgaatggcacatcaatcttaagttgttctctagcctttacattgaaagtatggaaaggaagctcaactgaaggctttatttcaatatcccttgcaattactggcactccaagttgtcttggatcacttcttcccttttcgttaactgcagctaccctgaagacatactcttctcctgcagttaagccagatatagttgcttctagagtcttaacttgtgtgcaggtgctccacttttcactccctttagtctgcatttcaaccacataaccagtaattttgctgccaccatcactttctggtttctcccacttaattgtagctgtattacgggtcacatcaacaagagttactcttccaggtgggaggggtggttcagacactttaacgggttctgttgtttcagctggcaaaccaatcccatattcattggaagccaagactcggaagtagtaagaacatccttcttgtagattttcaattctgaaagtagttttagtgcaattatttgtaatggtagcataggcttttcttgtagtttctcgtttttcgacaatgtagtttgtaatcttagctccaccatcaataagtggtggttcccaggacaacgtcactgagtctttcttcacttctcttatggtcaaattcacaggggcacttggtgagtcaagaactctgacgttaacaaaagctgttttggagccactattattttctaatgtcagattataccgaccactgtcaaatctggtaacattatcaatcaccaacattgtaaatgagctggtcacctctatctgagccctgtcagtgagaatgccttctgccttttcccatttaacttcgggttctggtcgacctttgatagtgacaaataagcgtaaagtagcacttgcacgcagaacgaccacctttctgagatcagcatcgagttctatttctggtggctctatcctctcctgagcaaccactgagccaggtagagttgcaggttcacctacaccttcagaattgatggcacaaatacggaagttatattcagtgttttctttaagcttggtcactgtgaactgctttccttgtaatcctgttggtggagtgcaggttgtccattcatccgcagcagcttctttgacctctacaacatagcctttaacaggtgcgccaccatcataaattggcttactccatgccagggagacagaagatctggaagtgtccgtcacttttggattgcttgggggacctggtggatacaaggcatcacacgcacggtagaaaacagatggctcactaggttctcccacaccagctgcattttcagcagcaactctgaattcataggaatggccttcggtaagaccagttaccctgagccgcagatccgttaatgttttcttgttgcacttggtccatctaacgccttccttatctcgtttttcaagaatgtagccctcaatttcggtacctccgtcgtctactgggcgtgcccatgttactaccatagaatctttggtgattgctgagacttcaggtgttgagggaggacctggtggcttataaggattacaggccgtaacaggcccagattccaagggctctccaattccatatttattcacagccatgacacggaaaatgtactcattaccaggaagaagtttagtaactttgtagttaagggcctgtacctcagttgaaacctgggtccaagagagtcggcttgtctccctcttttcaatgatgtaatgtgaaatattagcaccaccatcttgcaaaggtgggttccatgccaggtaacatttttccgcagtaactccagtaactttcagaggcccttcaggaggccctggcctgtcaagtacctttacagtgatgggtatagactttgtaccaccaacattgctgagtttcagaatatattgtcctccatcagtccgtatacagtctttgacaacaagagttgttttctgaatagtagatttaatttccattctagcagctgtttcttcaagttcttttccatcttttgaccaaacaacatcaggtataggtttgccacggatgtcggcttcaagaacaaaagtctctcctgcatgaacaacgatgacatctttatattttggatccagagaggcatttggtgcatcaatttcatctcttgcagtaatggcaccactactatcagatggttcactaaagtttccagctgcatttcttgcaattactctaaattcatatctttggtcttctacaagtccactcactgtaaattcagtttctaatacgttggtaaagctggctttcatccagcggccatcaggtagatctttcttttctacaatataacctgttattttgctaccaccatcataggcaggtttcttccatttcagtgtgacattgtttcttgtaataacaatggcttcagggcgaccaggtgggtcacatggatcacgagcaacaaagcattctgacactttgctaggcttgccaatgccaacaatattttcagcagaaactttgaactcatactcaaggccctcatcaagcccagttgttttgaatttggtgtcctgaatgggggtcttatttaacttgacccataaaatactgttcttttctttctgttcaagatggtagccaataattttggtgcctccatcattcactggctcatgccattgcacaagcatctgatcttttgagattgatgtcacaaaaggagttccaggtggtccaggttctttaaatggatattgtacaataactgccttagaatccagtggggcactttttccatacctgttttcagcaaaaattctaaactggtactccgtgcctgttttcagtttggttattttaattgttgttcttgcaactgttgctgataccatgtgccaagtggtggtggttgtatctcgcttctctacaatgtagttgcttatttggcagccaccagtataggctggaggttcccaagatatgactacaaagtctgcactaacttcatcaaaccgaactgggccaactggaggtccaggcttttctaaaacgataacactgagattttctgttgctgtgcctgcactatttgttgccgttacggtgtattttccaaagtcatctttgttaccttctttaatgtgcaaaacagttgaggtagctgtttcttcaacgtttactcttgttgtctgtttaagaggctcaccatctttgacccaagaaatgttaggtcttggtcggcctataactggaatttctattttaagatcttctccagcttggatactatatgtgttaaatggtaactttaaactaggctgtatagtcaagtccttggctatgacaggaacacccaacactcttggatcgctttttcctttctcattataagccttgacacggaactgatattcttgtccagaactcaaaccagtaacaactgcattacagactttggattcagccacaatgctccatttttcagttcctttgggctgcatttcaacaacgtaccccaggactctgctaccgccatcatgttcaggtttctcccacataagtgatgcactggtctgggacacatcagtgagtgtaacctttcctggtggggaaggaggttcagcagctttcacggcatcaacagtttccactggaacaccaactccaaattcattttcagccatgactctgaagtaataaatggctccttctgtaaggttttccactttaaaacttgttttgctgcatttactactcacattagcatacgcttttctggttgactcacgtttgtcaatcacatagttcttgacctttgcccctccatcaatgatgggtggctcccataccaggaaggcagaatcttttctcacttctttgactgccaaattctgtggtggtcctggagtgtcaagaactttcacagttacaaaagcagactttgatccactgctgttttccaacttaagaatgtattttccagcatcatttctatcacagttatctattgatagttgggtatagtttactcccttttcaatttggaccttatctgtgaattc

SEQ ID NO: 27 - DNA, 182508 bp, Homo sapiens
aagagagtgaaggaaaaactagagcaccaggggagtgactgttaaactccttcctggtcgttttcatttctccactctagcttgaatacttgtccttcatgaagtgtgtttcctttgacgtggtgagctctgggtcatagctatcaaacagtcttcctgaaaggtagcgattaatctgactttaattgccatacataagtgttgtcttttaatgttttataaatggaataattcagtattttcttttgtgtctggcttcttttactcaacatcatgtttgtaaaatttatctatattgttctgtgtaacagtagttcagtcattctcattgtacagtattccattgtgtgaatatctcacaattttggtatccattctagtactgaaggatttttgggttatttccgttttgggactacagtgactaaagctgccataaacattcttacacatttattgaacatatgtgtgcatttctgtttagtgtatctctagaagtggagtggaatgctaaggcactgaatattcatactttcagctttaatagatgttaaagaaaaaagtattcttgacacgttgaaatggtatggcaaactttatttaggactattgtgatagatttagggactattgcattggaggagagaaattgggctcaactccaagtacaaggaaaagtgggaatttatagccaaggagcagggttagggggagacagtgtcagtggagggaaagttactaaaaggtaagtggggggattctggctaaactgacctaacaggattcttgctgaaggcaggctgaggccagggtgatcagacattgctgggaaatggtagggaatgaagaatgtggtcagatatcaagggcgggtgatgaaatatggtgttaggggattctggctaaactgacttagtaggattcttgctaaaactggattctacaaggatggagaaggaagcctaggtgagtacaggattcaaatgagcctgactaaaatttggtcaagaagagaatctttttctttttttcttttttttcttttcttttctttttttgttttttttgagacaggttctcactctgttgctcaggctggaatgcagtggtgtgatcatggctcactgcagcctccacctcctgggttcaggtgatcctcctacctcagcctcctgagtagctgggaccagaggcacatgtcactatgcccagctaatttttatgttttttgtagagatgggatttcaccgtgttgcaaaaaccaggctggtcttgaactcctgagcttaagcaatctgcccgctttggcctcccaaagtgttggaattactggtgttagccactgtgcctggccaataatctttttcacagataatgccagatgttttccaaagtgattatataaattttttctgcaatcgatcagagtattagggttccagttgttctgcatctttgccaaaacttggtattatccatttaaaaaattcggaatatttctggtgtttgtagtggtatctcatggtggttttttacttgcatttcttcaataactaatgatgttgaatacttttttagatgttagccatttgaatgtcctcttgtcgggagtgttagctcatgtctgtaatcccagcagtttgggaggccaaggcaggcagatcgcttgtgctcaggagttcgagaccagcctgggcaacaaaatgagactcctgtctccacaaaaaggaaaaaaaaaaagggttgaatgttgtcttcttttgaagtcctctttcaagtctttggcccattttctaactttggctatctttcatgttgatatgtaggagttctttgtatagtctggttgagtctttgtgttgcagatgttttcttccactgtgtagtttatgttttcattttgttcatgataccttttgaggaacagaagttcttcatttcagtgaaatccaatttgttaatttcttttattggatccttttatgacccactgaagacatcttctgtgttactttcttgaatgtttattgttttaccttttatatttaggtctatagtaggtctgtacttgacttaatagcaacctttcccccatggggatacctttgtcacaaagcaagtgaccatgtatatgtgagtctttttctagactgtctattctgttctgtggccctgtttttgttgttgttgttgttgttgttaatccttgtgcagatattacattgtgttaatttctttagctttattctctttgtatctgatagccaaagtctcctaactttagttctttttcagtactgtcttggctattgtaagccctttgcatttccttacagattttagaacttgcttataaatttccacagctatctgctggaatgtttggaattgtgttgaatctacagatcaatttgaggagaattatattcttgatgatattgagtcttctgttccattaactctgtttaattagatatttaatttctctcagtaatgttttgtagttttgtgtttagaggtcttgtccatcttttctgatgttttggaagcatcatttttaagtttgttgccttttcaggtgacaactttggaggggaccacccttgattggatgcataaattctggtatgtttaaaaatgagtcatcttattttagtttcatcttgtagcaacatcattagaaattagagcattgctttcttttaaagtaggtattggtgctttcactagtattggcaagtagcaaggaagagttactcttatagctttaggagttcagtagttttaccctagcctagaaatcttttgcattcataattgattgttgcatggttgtatgtttcagtgtctgcaactaagaatgacccatataagtagaataataagatagcaacatttctgtggcacttacttgccataatacactaaacatctggtcaatatttatagcaattaattatttaagttggggcttctgccagattttgctgggaccctcataatttggctcctcccagcttgtccattcatgaatatgaatttgttttcttttcttttccttcttttttttttttttttttttttttgagacagggtcttgctctgttgcccagtctggagtgcagtggtatgattgtagctcactgcagcctgtactgggctccagcgatcctcttgcctcagccttccgcctcccaagttgctgggtctacaggtgctgggagtacatgcttgcaccactatactggctaaacgagtatgaatattactttgcattacaatggaagcctctatttatgcttgtttcctaatattctcagtacattctgtgtttattttctcatttaagcttcttctcattcattttcttaaccaaatcccgctttcatcaaacccttcttcttgaagcctttttaaattactttctctcataattacacaagaaatctctgcaccaaagagttaaacatatgtgtattctgattgtttttggtgtgtcagtttgtttcttggttaaattgtcaactgtatagaagcaaagacaccttttttcttcccctctatcttctcttctactagcactgctctgagctgagtaaatatttgttgatgaatgacagcttaacacaaattttgttttacaacaaagacttgggattggctcatcataattcctgattagctctcttttctcagagcatcaaaggaggtgtgtgtgtgcaggagaagaggtagaaagaggggaagagatgaatgtcttcaaaatatacatgccttccatgtgttatgctatgatccataattaagggcatatcatagagttacttttctgacagaaggtggctgtagttgtcatttattacattccttctatgtgtcaggcactatatatgaaaacaaagactttgttttcaaggaaatcagtaaaaaatatgtgatagtgtaacattcattgcagttgtatttaataggataagtggccccaaggtgggggagggctgtcacttctcagtagttagtatgtccctgttttctttttcatactctgtcatcgctttggcaccattgttaccccgggtctatatgagaatgttgatttggggagtgccactgggtggcccctcagggagcagcactgcctgcatcatgaatgatagttcaatgtttttggtatatgaagcatctgatactgtgtgattagatgattatttgattacccttaaattacttaagtctataactgtatttcccctttgtttatcatcatagttcattcagcagacaacacaagaatggaattaatcattcctggagagcagcatttctacatgaaggcagtgaatgcagctgaaagacagaggtggctggtcgctctggggagctccaaagcatgtttgactgatacaaggactaaaaaagaaaaaggtaactataaacttttcccttgtggtgagagtactttcttaaatataaatataaatgtaactaaattagcctgtccacttttagtatctatcccaaggaaataattagaaatgtagatttacgtatatctttatcatagtaaacattttgtaaaagctataaatttaggggaatggctcaataaactctttctttcttttttttttttttttttgagatggagtctcactctgttgcccaggctggagtgcaatggcgcgatctcggcttactgcaacctctgcctcctgggttcaagcgattctccagcctcagcttcccgagtagctgggattacaggtgcctgctaccatgcctggctaatttttgtatttttagtagagacggggtttcaccatgctggccaagctggtctcgaattcccgacctcaggtaatccgctcgcctcggcctcccaaagtgctgggattacaggcatgagccactgcgcccagcctaaactcgtgctttcactggctgatatatagacagtaagatgttgaaaaggaatttcaatgtgagaaaatgcccagggttaaatgatcattgaaaaaagcaggattcagaattatgtgtattgttagtattcattggctggcttaggaaaggtatgtaagaattggtcagattgttacctttggaagtggaatttgtgggaaggagactcagttgtcactgtatataccctttggtatcttttgactttaccatgtacgcatattgccaattcaaaaagatttttagaaactgaaagcaaagcaaatgatttatgttattagttcaactatatacagatataatgtgaaaatgacaatttcttgatagtgagattatagtttgtcttagttcattttctgttgctttgacacaatacttgagactgtaatttataaagaaaagaggtatgactcatggccctagaggctggaagttcaagattgggcagctgtatctagttggcttctggtgagggcctcatgctgcatcatagcatggcggaggaagcaagggaaagcgggtgtgtgcggaaagagatcaaacccaagaggcagcctcgatttataacaacccgctctcatagtaactaatctagtcccaagaggttgagaactcactcactcctttgacgacctaatcacttgttaaaagtactactttcctaacactgccacactggggacccagactcaacatgagttttgctggaaacaaacgatattcaaaccatagtacagttatttgatttttcttttctatattttttctatttttcaaaattttttattaagtatgtattacttatataattaaatgcaaattaattacattagtgaaagcaagtaaattataggtattgagaaatgaaggctgaggattgaatttataacaattttgaaatatatgaaaacattacagaatatagctacaggtaggataagaaggaatgaatattcacaatagctaaaagatggaaataacccaaatgttcattggtagaggaatggataaacaaaatatacaatagaatattactcagctttaaaaagcaaattgtgacacatgctacactgtggatgaaccttatagacattacaataagtaaaaaaagctaatcatgtggggtggggggaggggggagggatagcattggtagatatacctaatgctagatgacaagttagtaggtgcagcgcaccagcatggcacatgtatacatatgtaactaacctgcacattgtgcacatgtaccctaaaacttaaagtataataatgattaaaaaaaaaaaaaagctaatcacagaaggacatatagtctatgattccacttatatgaaatacccagggcagtcatacttatacagacagaaaatagaatgttggtttccagggcccagggggaggtggaaacagggttagtgtttagtgggtacagaccttcagctggggaagatgaagacgttctggagatggatggtggtgatgattttacaaatacgaatgtacttaatggcacattttgaagtgaatacttaaaagtggttaaaatagtaaattttatgtttatgtatactttaccacagttttttttaaaaaggagaaagaataggcttaaatatgagcaggaattgatttaggttagattaaatgcgcagatagagctgctttgtccattctggcaaaagtggctttgtggctaggaccagagagcaagaccactggggcctggcccagggagtgtggagaagcaccagaaatttactctatgaattttcctcctctgtagcttatacttctagtttaaaaggtattggcttgtgagtggctgagattatggctggatgtttagtttgtctggacatactaaggaagaaagtatgctcttaataaaaaattttgaaaatagtataatgtgagaatgaaactgaaagaaacagaagaaaataaatgaatgtttataaacaatagttttaattacataaaaatttaaaacttctgtaagccaaaataaagaaaactgaaaggaagctaacagatctggataaggtatttgcagtatataagatagaggaaagattactatctttaatttgtaagaacttttacaaactatcagtttatattgttaagagaaaaaccaacatcagaactggaaaaaatgtataaaggacaaaataaaaaagcaattcacaaaagaaaaccaagcactttttaaatggaagatgagtaatggaatggaaatatcctgtataaaacatccagtggtcatcatcctatctctggaaatcacctaaacatggcaggcatataactgtcagctttttcccaattatctgaagagaagatgtttccttagggctcttgtatcctgtttccaaggtctcacatttcttgagctataggtatttatattcattgcttttttaaatgattacattttgttacattgctcaaagaatatgaaaatgatctaactgtatatttatgtatattcttttcagaaataagtgaaaccagtgaatcgctgaaaaccaaaatgtctgaacttcgcctctactgtgacctcttaatgcagcaagttcatacaatacaggaatttgttcaccatgatgagaatcattcatctcctagtgcagaggtagagcgaagaggatctcttcacgtgtggttatgctttggagtactctggggggatcctcagtcattccataagatgacaggcattttcacattgagttattttcagcttttctgggttctgcctactgtatactatctggaaatctgtagcatcttctcgattgtgtctgtgtggccagagaagaacatgaagtagcatatttctccaggggtcaaggcttgtctttgcagccagtctgataatttggaggttggagtggggaagaagcattccaggctttgttctccaggctagcggcataaattcactggacagctgctattctctttttttggtaataaggtccctgcttcaactatgagagttgataacttatctttatgaaataacttaaaacaaatccttctcagaacagtgacttaggaatcaaaactcagattagtaggatcgggctataataggctcattcttcatggtaaaataggaccagtgagctataccactctctgggtgaaaggccagcatgttgcctgtccctttttgcctaacttggtagaagtggggcaagaaatcttcctatttcttctgtggccttctcctgttggggaggaatcttgtgtaagaagcccaaggacaaactgaccacaagctccctggaggtagttgacctcacacttgctacagcagctcagtgacagtattagggacccaggcttgttccatccttccactctgccattcttggtgtgttgagtttttctcctaatgccccaggtgtcaagatgactgtcaagctcacaaagaggcaggaggcagtggggttgccagggtagagagagtccttctcaacttgctgtgcttggttttgaatcgggaaacaaaaatcccagaaattccctagccaacttctcatcttttttttttttttttttttccggctcaaaggaaactaggaaaaaatgagcatttagtaaagagtgttggaatagccatgactaggttagatcagtctctattcatcccccaggatcagggcactttgcgatcctgaacaaaattgggctttttactctatcaaggaagaagtgggagaatggatagagggtaggcatgaattgtactgccactaattaactctaagggtattccatgtctgtgtccacttttgggaaagtgaaaattactgtttaggttagatttctctaagataaacttttgtacacagtttttcaatatgataattaaatgcaaagcttattttttcttagaatctagtttcatacattgtttaggagacaggcatttcttatacatagatgttttaatgttttcttttttctttttttgccccagcttaattttctaaggtactgtattttaaataaatttgaacataacatagtaatgtgtctgttggagatgtcttattatttaatgataaggttgtatatgattccatgtagttgtatgcaaatctgttcaagtctttgtgtaatttttcagaacatgaatgaagcctcttctctgcttagtgccacgtgtaacacattcatcacaacgcttgaggaatgtgtgaagatagccaatgccaagtttaaacctgagatgtttcaactgcaccatccggatcccttagtttctcctgtgtcaccttctcctgttcaaatggtttgaacttcttgttttggttttttccctcagtagtaatgttgcatgtggttttcgtttcattttggtatttatttttaagggtggaagcaggcagttggggggcggggaacagctaacaagttgaatttttttgtttgtactgtttcatattcgagcttcttagctgatgagctgagcacttgtgctagtgtcctcattcccttctccttggaggggctgtgcatggcctgcccacaggctgcttcatccattttccccagtgtctaggaaaatattacaaagtgctgtgacaaagaaaaagttggggagctctattctgcttggtaagaattacacaatggaatgagattttagtcacaatggggtacaattacgtatatctttaaaggagttagaaggaatttgaaacatattccggtgggaacggtattctctactaagcatttggatctgaaccctcagagtagctgatcttcagtttcttcatgtgtaaaaatacagtgtatatcagagagtcactgcaaacgatctgacctgcttactgttaggtgctcagtgttagtttcttacttccttattgctcagaacaagtcctctttttgccaggggtggcagattcgttgtcctttctgagctaataaatttgctctagcatgctgttagaaatttgtaggtgagataagctttaatgagacttcaagtttattgcatcaaagtgtttttaggagtccatttataggagtaagaatgccaccttgttgctgtttcagcaattacctgaagatctatttgttaggagaatagggtctaacttcttcctaggttctcttacctatcccagcaaatttagttatgagatttagtaaagattattgcctagatttatttagagaattgttttctaatcagtatttgatgggctaatagtttcctctgaggcaagcgtaccatgaaaatgagttttatggccagattaatttgggaattgctaggttaacttaaatgatatgaattgggtttgatgggacttgtcacagcctttttacttatttatttatttatttttttagagacagggtctcactctgttacccaggctggagtgcagtgacaccatcataactcactgcagcctcaaactcccaagttccagcctcctgagtagctgggactacaggtgcacaccacggtgcctggctatgttttttaatttattatttgtagagatggggggggtctcattttgttgcccaagctggtctcaaactcctggcttcaagctaagtttttaaatttattttttgtagagatggagtctcattttgttgcccaggctggtctcaaactcctagcttcaagcagtcctcctgcttcagcctcccaaagtgttgggattacaggcataagccaccatgcccagccgtcacaccctcttttatgctgaagtgtattatgaatctctgagaggtggaagtgtagtgtacagtgttgctgaaatttatttgacaattgagcccgttatatatatacacaaataaaataaatatatatataaatactatatatgtatatattttctttttttgaaatggagtcttgctctgtcgcccaggctggagtgcagtggcgcaatctcagctcactgcaagctccgcctcctgggttcatgccattctcctgcctcagcctcctgagcagatgggaccacaggcgcctgccaccatgcccagctaattttttgtatttttagtagagacggggtttcaccatgttagccaggatggtctcgatctcctgacctcgtgatctgcccgccttagtcttccaaagtgttgggattacaggcgtgagacactgcgcctggcccattttatgtattttttaataccatcttacaggactgtggtgtggtgttgagtaaaacatagtttgacaatgttgctttttaggacaattgtagatatgctataaactgttaattaacaagtatgtgtgaacaaagaaaccagtgttttgagatggatgtgtagtgctgtgttcctgaggttgatagacaaagggtacactttttttttttaagctgtactttttagagtcaaatgcagtaaaacacctcagagttgccttgcttctgcattgaacttctcaggaaatcccttatgttacaaatgctctgtagtccagagaagtcaatgcgtattttacatataagaaactaaaataattattagttctagagacaaatagcatggaaagtaaggtcagacaatcttcatgttttttttttaaataacattgtttatttatttatatgaaaaacttacatttatttatatgaaaaataaagctgaaaatttgagtattccaaaacaatttaatctgatctttgtaagtgctttaatctgatctttataagcactttatatagttaatctcaatgaattcatcttagagtaaacttgcatttaactttatttcaagttgtcataaaagttcagacaaccatcactggacctacagattgagtgattattatagtggggatgtccttgggttagtaagcctaaaggaagtaatttctgttaaaggagatgttagtggccatttgcatcttaatgtcaatcttatcagatgttcccagactacaaactgggtgggtcatatctcttagcatttcaactggtatttctcagagcaactagtggctcatgttccaaatatagaaggcatttgcataacatcaatgttagacctgggcttgttagactcttgggctcatgtatacaaaagcaaccaccctaaacctttagtataatctttgtttttctgctaccatgttaaactttgaaataatcagttttacttggctgcctccctttatattttgatggagtagttggatcttccaaattatgtttagtatttatcatattttttaaatgttctgcttaattaggtattctttatttttttaaatatatgttttggaaatccactgagacttagggttcttcttctgagttctttaaagtcttgaattattaatgctgttttccatgaaaaccacactttagaacatttgtatatcagctacctaaataattaatgataaagagaagctttgctgccagactctactactgtcctttaaaaaagagatatttattagaatattttgtggcttgctagatactccttttttatcacatttatatcttatttatagttatataccctgttttttatatttgtatacacacacatatatatgtattatgtataaaatttggttttcacttttgaaaaaagaatccagcatgtttttggtgtgtgttgaaaaagattccaattaatggttattagggagaaagcttgatgttgtactaattatgttgcttgagtctgtgaaagattaaatttttttttgccagttatctttttctctgagtaaatttatgtttattatgataatagtaaattagagctgcatgattctacttgacatatggattatgctaatttttttttttttttccaaaatttctagatgaagcgttctgtcagccaccctggttcttgcagttcagagaggtaaaagaaccttttcttctgactaagttctctcaaattatatccatctagggaagttctttgggcctttaacaagtggtgtggaatgtaaactctgtatgggttaggtctggttcaaaaccagcattttatctctcagtatttatctcctagtatttagtataagggcctggcctcagtaggtagtcagtaaagaaaaaaatgaatgaattaaccagcaaggtaagcacgttgccagccattttaccttttttagatgtttgaaatgcagtcatatattgaagaatgacttttccatcaatgatagactgcatatgtgacagtggcctcataagattataataccatatttttactgtactttttccatgtttaggtatgtttagatacacaaataccattgttacagtcacccacaacattcagtacagtaacatgcagtagaagtttgtagcctaagaacaataggctataccacatagcctacatgtgtagtaggctatactagctagttttgtgtaagcacgctctgtgatgtttgcacagtgacagaatcacctagcgatggatttctcagaatgcatccttgtcattaagagacgcatgactgtatatcaagtgatggttagacagaagtacatttttgatgtgttgagactccacagctagggctcattttacctcagctgtttatagcatcatctattcatgctgagctgttgtttcattaagagagaaagatcttgctgaagagagaaaaccacttgatattttaaagtacatattcatatcaatacgtttaaaaattttaccttctggatagatcttaccaaaatgctaagttgttaaactattattttgttaggtaatagtcctttaagttgctatggttgtcttatttagttctttggaaagtgatttaattatagtgacattggcatttatttctctatatttggactgttaaatgctgttttgtcatgttttaattttttcccctgatgattgtataatctttgattaaactgtcaaatactcagaggaatccaatgatgtatatatccaaccttgtcagggaatcaagagtcccaccaactgaattttccagaaaaatggaagcttaatcaatttttgaccaacttttatttttatgaaagaaatttttctatcctttctacctcataaaataataattttaaaatcttatttgtttcctgatgaatcaaggttgtcattaagtacagtaaagttgggctgttacaaaaatagtagctgagatgctgttaggtggtggtgatttgcttctctgtttaaatttttcagacagatttttaaaagagtttttctaggcccctttttgccatctttatcttctcttgctgttgtcagtgagtctacctctagctctatgaactccttgcccatctctttcagtctgctggttttgatcagatatggattgacttaaaatacatgcattcatgaaacctatgacttctagttttcaaacatttgtaaaccgactgatatgtctgctctctggagtctcccctacagaagtcactacttcttcattgtacccctcttccttttagttcagctcagaagccatattctccaggttaccagctgtcttctaaatgggttcacttgtttttgacttctgagtagaatgttgctaacacgggacgttgagcataaaaataattcttttttcacttaaagagaagtcatttaaaattccagttgagtgtgtttttgtttatgtaaggccttacaatttaatgctttttacttaatttgcaggagtagccactctataaaagaaccagtatctacacttcaccgactctcccagcgacgccgaagaacctactcagatacagattcttgtagtgatattcctcttgaagacccagatagtaagtgacatagattctgtctctttctttggcatattcagcaaaattactgtggggctctgtaatttctggaaatgaagtatactgactgaacattgtactttgtttctttgattccttaattcagaggtaagcaaacagcgctcaatcaatgaaagctcatatatccccttacaaacaggtttgttactaactaaggagtgctgaggattgctttgtaaatatcgtatctcagatatatatttatagaatatcatgatcttttaccaccactaggacttaaaaaacattttagaagaaggcatgaattgttagcaggattctaggggaaaataaaggcaagttccaagttcatataaaagtcagcattgttactttactaaaatacctagaaatggctaaggaaaagaattttgtctggtagtcacagtgaattatagtagcattcattcctctacctttttcttccttattaaagaggcagcatactgtgattgaatgtttttaggaaaggttttgtgatttatgttaaaatttttaaatttttctcttcagagaagaagctttgaaagtgtgtcagaatatctagtaagatagtagtgaccatgatttgcagtgaacacaaatatagtcttattattacatctccattaatagacttatactctccaagtctctactatttctcaggaagcatgtgggatagaaactatgtacaatttccaattaaggaacaggtcgtgttccaatagttagttcatttgtaagtcagttgtttggaaaacagattttatttttcttgtggaaatgacatgataagtggtggttagctctttggatagctaaccattctttggaagagcccagtgaattcatagtatggctgaaatgggacaaaacaatggtgtatttctagcatttgagtgtattgaaaacactgattaagctggagttgttttatgtaaccagaaagttaaacaggtttagttcatacatatggcaattttaaaaaggattgctggtcatttttggatttttaggagttgatagaatctttttttttttttaatgcccactttttttttaaactgaattaatcatctatttattaatatatggcactattctatgctcattaacattttgaatttaaattgagatgtgggtggagaaatgaaggaaagaaaccgggaaggggaagggagaaagaaactttcttgggccaatcaagcaagacctggaagagaagaggaggagaggaggagggttaaagaggttgagtatgtgaaaaaagttatctgaggcaggtaagatagactctgattctctttattctttatgccttttacacatgactcttaatccagagttcatgaaggagttctgtatgctaccttgtagttttaagtgcgacatctttttttttttttaaggggatcatttgtgattactaaaataatttttttaaagccatccatttttctttagaattcttttcttctagttactctagtcctgaatatttgaaaacaattttcaaaagatctaggtgtacatgctctattatatttagcatcccccagtttaactgttatggactgtaacaaaactagtctcacacacacacacacgcacgcacacacacacacgcgcatacatatagttcacttctctagaacatctttaaattagcaagtatagactaggtcagaaattttatccttagattttttcctgtttatactagtttagtgtttcaattagctgacaaagcaaagattgaattagtgctctttccagaaagtatatattttgcaattggcagtcttagttgaaagttgttactcaaaaatattcttcttgtgagatgcaactgcttctattttctttaacaagctttttcaaaaagtatgaaagtaataaatgatgatggtaaactcaaactatatatataaaggtacaactgccttagaacaggactatgccagtgtagtcagctgtgttaacatggagttgcagtgatagttctgtgagctgcattacaaatggagaaatgggatctttcagtatgaggtaccttgtcagctttgctcagaaagtcttagaatgaaaagaggaatacctgaatttagtcctcgttctgttaccaattgtgtgatcttgggtaaggcatgtatccttttatgggtcttggtttctttgcctaggaacaaggaggatattaacagcattaaaataggctgaaaaagcaatagttaattaataaagattaaattcaattcagcaaatatttattgactacctattatgtgccaaccatgattctagcagtgaacaaaacaaaaatctctacttcaggcaatttcatcatttatcttatgaattctgatgtttctccttgtggctgttgatactctagtctaaaagttaagttttcctgcatgaaacaaacaaggaaatacaaaattagccagaagctaaaggaatttcatgtccctgaacaggaaatttaaaatgttctttcacagaggactggagttaatattgacaggatgtttaacgtttttatcaatgtcttcataggacctgttcactgttcaaaaaatacacttaatggagatttggcatcagcaaccattcctgaagaaagcagacttatggccaaaaaacaatctgaatcagaagatactcttccatccttctcttcctgaagaaactgaagtgtccaacttcctctaagtattgctatgcaaaagctgctgtaattaaactattgttatagggagtagttttttcccttaggactctgcactttatagaatgttgtaaaacagacaaacaagaaaacaaaccacatacttttgaagtgtattttatctttatatagtttgtttgcaagagtattttcctaataacttcacagtatgaatgtgcatcttttttttttgaacaaatgatggtgtaacattttgacatccataaggacaaatgtagatatttttcttaaaaactctgaggggactgacagcatggtcagggtgtattgtagcttataaacatgaaatcttataaggtttcagtttgacagaagtgtgatatatgtaacttgtgccatggaccaaatggtcactttaccacagctaaaaatgagttacgatagcagcttgatggtgattgtattgtattcctttaatcaaaaaggaaacacaatattctaagtatctttagcccaaataccatgacatattgagcatctttaaataaccagactgtattgtccttcatatgtgaagttgacactactgatttgtcaataccaaattttgggttaaagtgtttaatttttatgtatttattttcttgttgcctcaaaagatgattgcattctaacttttgtgacctaccaaatttaagatgtgtatacgttgttctttacgttgttctagaaaagagattttaatgctgtagtgactttgctcacttacactagagaaataaacaactttcaatggaagagaattttagtgctttttttttcctaaaatagatattaagctgctgttgtaaagtattgtttgcagctctttccaatatctagagacatttttatttatgaatatttatacaaaaaggaattctgtcaagatgactgctctatatcacttgagaatggcattatttaattaaagaacaaatagcattttttggtagtgcctgtccatacctattgtcattgtttgccttgtaatctgtttttttgaattcattttgggctgatagttttgtttaaggttttggataaggagcactttaaaacaaactggtgtgttgtttttaagttaatcatatgtttaataaatgcgtggtttttgcattcaaacacatcatataatacattgtattttttacattcattgatattctgtctaatctttattaggcactaatataattctaatggatttgagtttgtttgtatatttaggcctgctggtgaagacacaaatgaagcataatttttgttgcctgtgagcttagaatggtgtgacctatttcattttatttcaatttatcttgtaagtttatgtgggatattttaaaataattaatatttggtatttgtttaaaaaactgtaattataggccttccatcttaagtttaagatggacataaacagtctatacattaatatgtgtttgggtaaactgtatgctacttgaagtgtttgtaattttaaataacacacaggtcatcagactactctatattcagtggagtctttgcctgctcataagttgtacttcatatgtctaatttgaaaaaaaaagtttgataatgtagtaagttatgacgttgagcaggtaatcaggtttttcttgttttttttttttttttaaattttgtagtaagaacttgcacagtattaagaccatgaaggtcagggtgctattgattgggagttttttctggtagtgagtttttttgcagtaataggtttataaggaaaacaccgtaacaagcttttgaacttatagaaaataatcacatccattttctattgctttacccaaatagatgggttcgtgaagagttttctgtgaatattttaaaaatacaatgcaattatttctggtttgtatcattttttcccccttaaaacaggtccttgaacaggtttgcggtatccctaagtatgtcttttgttatgacttggagccactttttgttgttattgttaggaaccaaacacatctgtgaaatcattttttttgtgggagtataaatatatcttgaattatatccaggttttgatcagtgaattagtagcatgaagaaacctataaagcttaagggaaccttgcattttgaggagtcctttattttcaagtgtgcctgacttttttgaattttaagaaaaagatgaaccatataacaattctgtaagaattttagcttgtcaagttgttctatactttatagaaaaattattggttattattagttattagtagtcccttttttttgctttgtctaggtcatggggttattgagaaacatgaaaagttattgagaaatttggaggttctcttggcagcctatcagtgatcttctaagcaaaagcagtgcttgtttttcatttcaagtgcttgctcactattctttgggaatcgcaggcctccatgactaaagggattttgatacaattcttttataaatgagctgaatttgaattttcttacatcatatgggattattgcatgatcttcagtcaggaaaaatccagaaatggatgctattgcttaaacttaaattccaaggcagaagatagagtatcttcatttccacagatgccctagaacctttgaccttgaattgtagtttttcagtatgtattatcacatttagaaatgtaaaaatcacaagatctcaggaaatgcgcccttgtgatatgttaataccagattgctgtttacactaattccatatacatgataataccactaatttggactctgctagttcttttatttaataaggcacctctaggtctgtactttgagccttgatctgggtacttggtacagagggagtgtcctggcctgaaagaaagccagattaggctgcaggagttcctttgaggaggtctgtcttttaataaccctggcgggtaaatgaatggtaggtagctggtaggtaggccttcttgttcatgtctttctgtctccccaatccactctttgaattcatgttgaattcttaacttgaaattctgttgttttttttttaattttagctttctttttattaaactagttaatgtacatagtttgaaaaaatcaaatagaactaaaaggtttatagtgaaaaagtgtagttccctcttccccagtttagcattccaaagacaaacacttggaactcttagtggtttgtgttagtatttaccttcctgtttgaaaatgttatactactttttgttgacttatcaatttcagaaacagtttctcgaataccttttatggtagacaggatttactttacttaaactctccacctcccacatttttcttcccccacccctcccaaaatagatttatattcacacaacttttagttagaacaaactttttgtgaaatagatagacataaatgtagttcactgatgtaccacatggttaactatcattatttcctttttactagaatgttattttttctggggttggtattgcctgattttcaaatttgcttagtttttaatgtacctgtcacaatgactatccaaaggcttaaatgctgaaaaacatcagataatcgtatcaattctcttaaaaaagtttttaaaaatattttgtcatcctttagggacatttcttccacagtccttcatcttctgccatttgtactgttgccctccaggcctgttctatggttcagcagtcattctgaaactccctttagtttttagtctcacattaggttttttttttttttttttttttttttttttttttttggcaaagctcctccaccagtaacttcctaagaaaaggtgcatagaaagtaaagattttaaggctttacaggtctgaaaatgtctctactcttgattggtagtttggagtctggaaaataacatgccttcagaattttaagggcaacatttcattgtcttaaggcatttagtttttctgtgagaattctgataccgttcctttacctgggatctgtttttacactctgtaagcttttaggaacttctcattacttctgatgtttcataataatatgtgggtctttattcattcatcttgatggctacttgacttggtggaatctttcaatttagagatttgtctgcttcagttctgggtgtgtgtgtgtgtgtgtgtgtgtgtgtgtgtgtgtgtgatctttttgacagttttctctcttccattttctttgttctatctttctagaatttctgttatttgaatgttggacctcccagagttggaccgcctctaaatttaaaaagctttttctctctagttgttccttaagttatattatctttgttctttttgttatcctccagctcttctgttgaattttctttatatatatattttaatttctaagaggtcttttttttctgtttcatttcataaaaacctatttttattttatagattaactgtttccccatatctccctgaggataaaattaagatttttttcttacatctttcctgtttcttgaatggttctccccctcccccaccatgtttctgctttctatttatttgttttgggctctttcattctgaagcctttcttagaaatcatctattcatattagtcatgtattaaaaagctaatgtcataggtctttatatgtgggcagggtttataagttgtctaaagggccatcaggtagagttggccttttctgttgaggtcccctaaatttcagtggaggtcttctctttggggccagtttctctagaaaactgggtcctgatagtagggtaagaaaagacagctgaggaccccaagatttgtatgatgacttttacttaatccctctatcttcatcctctctcatgcccatccggccccaccccccaaatcctcctctggctgctgaccctcaggttcagtttttcctgtcagtggaggttgagggtggggcgtaggctggctgtggagagtaggggagaggacctgggttccagttgctctttatacagacttctagtcctgatttcagccctatacctcactctcatcttctacaatacctagtgcttccaagtcctgaacttagtagaggtttggtggggtgtgtttttgggcttctcccttttgggtacttaggctttaacttcctccactctgctaggttaggtattgcacttcctcctggtttttatctgtataaactttgttaaaatctcatggctttgtcgtctgtgcttttttgtggattaatactatttatattcctttaatatcttttggtggtttggaggtagaggaaataaattcatgtggttggtttgtatgtttcactgaaagtctagatttaaattctaatagtgtataaaaaataaaaattctttagtattaatttgtaattcattctagtgatttttaattcatatggttttactgtactacctacctcatagggttgtgaggattagaagaatcaattcataaaaagcagttagaaaagtgctgggcacgtagtgtgttgaataagtgttagttattaatattgtttactatcattattattattactactatcagtttttttttttttttctgagacagggtctcactctttcacccagtcttgagtatagtggagtgatctcagctcactgcagtctcgacctcccaggctcaaatgatccttttacctcagcctcccgaataactaggactacaggcatgcaccactactcctggctaatttttgtatttttttgtagcagcagggttttgccatgctgttcagactgatctcaaactcctgggctcaagggatctgcctgccttgactttccaaaattctcggattacaggcatgagccacactgcactctcctatctctctcaattcagtaacctgtttattcttgagtgaaaatgtttcaccataggaagaattactaatatatgggaaaatctagtgtttgataatgttgaccctacattttttttggacagtctctgtcgcccaggccggagtgcagtggcgcgatcttggctcactgcaacttccacttcctgggttcaagcaattctcttgtctcagcctcctaggctacaggctaggactacaggtgctcgccaccatgcccagctaatttttgtatttttaatagagatggggtttcatcatattagtcaggctggtcttgaactcctgacctcaggtcatctacctgccttggcctcccaaagtgtcgggattacagatgtgagccaccgtgcccagccgaccctgcatttaactagacttcatatgaaatgttcaggtgttaggtgttatctttctaagaaacattcaagccttaagaaatccaatcagttatagttactttaaaagttttaaaaagagtataacaattttgatgtgcttttaagctttattggtattatattttgtttttatcatataaatatgaagtataggagataagataatgcagatgatgtttgttatgccttacctaccgccagtagatgtaatactcttaatacatggagtacagaaatagtagattcccttcattcccagtgcaacagtgttgggaggtggggcctaccaggaggtgtttaggtcatgtgggtaccaccctcatgaatagattaatgccgccgtgtaaagggcttgtgggcgtgggtgaacactctcctgctcttctgccaaatgtctctcccttccaaaggacgtagtgctctacatagtgttggaagcgagagactgagccctaacatgccagtgccttatcttggatttctcagcctccaaaactgtgaaaaaataaattttcattctttatggtaaattcccatcactgtatccataacctcttgtaaatagttgtacacctttcagaaaatgttgtggacttacataagcaaaatgcctgcatttatttcataggtaaaattttaatctattttctaatcaaagtgttttggggaacatttaatttaaatactatgttcaatttttttaatggtctgcttcagattttttttataagttaatgttttaaaacaaaataattgtgttctaggtagaagctactctgagtttaggtttttaaatctctttcagatattttaagtatcttttttgtgtctggattcagagaggtatgataatgagattctcttctagaggggaagtgggagtaggtaaccatactactctttctacggctacagagccgcatactcgaaggagggagatttttatttgtaaggacatttgtattatctttcattaaagtagagtcccatgggcgtggcaaatggctgtaaataaagtaaaagtggctaaagaaaacagtgcctgctattagcttgatgctggcattttcttctttccctggatgtgactgttattgtctttattgggtccccttattatctgctttgatatccatctctggaactttgatctctaattttttttttttttttttgagacagagtctcactctgtagcccaagttagagtgcagtgacacgatcttggctcactgcaacctccacctccggggctcaagcaattctcgtgactcaacatcccaaatagctgggactgtaggcacgcaccaccatgcccagctgatgttttgtatttttacaaaaatttttcaccatgttggccagggtggtctcaaactcctaagctcaggagatccgcctgcctcagcctttgaaagtgctgggattacaggcgggagccaccgtgcccgacctgacctctccatctttggcgtccttatgctgcctcttctccaaatacatgttggccagggtggtctcaaactcctaagctcaggagatccgcctgcctcagcctctgaaagtgctgggattacaggcgggagccaccgtgcctgacctgacctctccatctttggcgtccttatgctgcctcttctccaaatacagtaactaatctagtatattttcataggatagaatttgccctttctgtcccataatatgttcctcttccccaaaaagttttttgttggtctctttggtaataaaacatttagagcatttactgtgggccaggtgctttacctcatgttagccttataacagagatgcggaagtacaggactaccagtgcagccaagatgcacagcaccaggattaactcatgagactgattagaatgatgaatatcttattgtatcctgaaacattaagcctttaagttatccctttatttagtatttaaattcacatgcttcttgatttttttggactagcattagttgttgaataaataaataattcagaatgtatccacaaaacctagaatatatgacagggtggattcagttttgcttagttactgtagataaaccaaataaattaatgtaaagggatattaatgcattaagcaattttttttgacataaatgaagggttgtttccatgggtaatatattcagaatattaaagatgagtaaaatgtatgactataatgaattccttcttcacttttactctggcaaggtgggaggagggtgctgttgataatctctgtgcttttgcaagtttggcacaaagacttttactcacttaaatctcaatataaagtatattgccagatctggcagcatggggacaattaggaacaaaggagagagaatagaatcagccatcaggagctataaccacactcttctttctcaaccttttctggtattagtaggcagaactccttttggatgcggtgaagcattttatgagtgaacaatggtgagtcatgtaatgaaaggagatgttctaggaaaacttttcagtcccgctcagtgctgccatctttttctcccagcactctggacttaaaattctgagagaacagggtatttcccacccttcctcttactttttgaaagcaatacctgagttattaagcaatcatttagacagtatgaataaaccaaaattcaccttgacactccatcccctagaggtaaccattcttttctagtatatattcttccagacctttttcctgtgtattgacttttaaatagatgtacattgcaatagtttggattagctcatccatagcagggtggttaaataaacagtggcacttttttttttttgagacagagtctcaccctgtcgcccaggctggagtgcaatggcgcgatctcggctcactgcaacctttgctttccaggttcaagcgattctcctgcctcagcctcccaagtagctggaattacaggcgagcaccaccatgcctggctaatttttgtatttttggtagagacggggttttaccgtgttggtcaggctggtctcgaatgcctgaccttgtgatctgcctgccttggcctcccagtgtcaggatcctggccccagtggcacatttttatgatgcatctggtactaaagaaggagctggctttatgacctttacttgagtatttttttgtgtgtgacagttgaacaattctgacccctattattgttggctggacaggcattttctttttaattcctctatgcaaggaactgtggattgcttttttctggatagctagaacgaggccattttctttcaaaagacagtcctagagtttccagtggttttctttaattgtgtatgcgtgagtgtgacagtgtgtgtgcctgtgtctctatctgtgcatgcatctgtatgcacagtttcttagttgtggacaatgcaacttggaatcattttagttttccaattgattttaaaagtttatctatagaagatgagacaaatttgctgtagaagttaccactacttggtcaaaatagagagttgtgggtttttttttttgtttgacaacaatcaaaagtatggcctacagatagtaagggttaaccacccagatttttgtcagataatatatacatgtccatgtaattaaaagtcttcatttgacaaatttatatggtaaatgagcataaaatgaatatcttttcagtattagaacatttctgtttatgccctattccagtggtatttgtggtcgctaggggttgctgggttatccaagtgattcagcatgccttcagaattggcatcctcgggtgattgtccatagcctcttgcaatggtgcctcatcttggggaggctttagaacacagctctcatttagcttattattgatttttttttcttgttttgcagttgttggctagagaaaagtgtgtagcaataagtacgcacacttactgtggtttaccatcatgaccatggatagcaaactgcctttttttttttttttaactcctgtgtcatctctgatgttgtggctaattttaagactttgatttttcagctaggattagcggagaatgacctacctacttgattaatgatgtctgcatgggcttactaagagggtgtggggaatggtggcaggggtaactatcatcgagaatatagggcaatgggtatattctaactttgcataactttgctagattatatatatctttactcacaataagcaaagttgaacaacttaaaattgattccctgttttctgttttcactatccaactaggatgaactcttaagttcatacatatactttaaaatgggaacaaacatagcctgtcatgtctttatttaggctaagtgcatatgtatgtataagtaatgtgtatatccttcacttattaatagtgccttcatgaattcaaagacccttgtcacatggtgctcaggaaaaaaaaagtgccaatattctttttttttttttctctaagaagtactagtttaggtaagtgaaattcaatagcatatcagtgctttaccttagtcactttttgtgttttgatcacccttagtcatcactggagagaagagtttgaattcatttgtggttttgctttagtggcaaacctccttacagggatgagttgccctccattctccttgccatatttggttaatctaggccatgacctttgaggggaaaaggcacagattgcaacttttctttcctgcttttgtgaatcaggccatgttcacgcagggtccttgaaggtgacttgagtgaggaagctatataccgatgacttaccaatttttggtcttataacattctctctctttttttttttttttttttgtagcatatggcttcctctactgtatgttggcatttgccacttttggggatttgactcctgcaggtatttttttttttttcttttgggggagtgtgacggcagtggatatagtcttagatgatgtttttaatagttcaagtccattagtgtcttactctagagaaaacgaaagactcactgtgtgagttttcttgccctctggttttcagaattctgtgtagtttctcaacatttcctttctacctgtcctgaagagctcttatggaaatcatggttgaatgttagtaaatttctaagagctttccaatgttgtctataattagccaaaaaaagacatatgaacttttctcattctgtctacctttttaaaattttattcactttatctttttctccagttttgatagatgattatagagttccccaaaatggccttcttactatttctatattaggtatattatttcagaaaagaaaataatcacttgggaatggcggtgagttcagggggtctgttaaccatttaatttaggattgtttatacatttatttacctcttttaaaaaatttcttcagttaatattcattgaccactcactaagtgttatgttgctagtatttatctttgctttctaattatttttttgtaatttttttgctttctaattcttgagtgaatttaaaactcactgctttattatttaatatcttagatacaatgactatcttaattataattggctttccaaaattttcactttttttcagttaactagttgaatagtatttatcattcacatttgcaccctaactattgttttaacctaaacataaataagcaagcattagaaagtagcataattgctgttaaaatagtcttttctttgcgtgtttaaatattgttagaaacataagcacatgaatttttttggccttttaaatgtctttattgtagctagttataagatgtatatatagcttatatatgtgtatatacacatacatatatatatatacatacatatatatacataaaatgattcttgcaaaagtagttatgggtatttaagtgaaaaatttgtaagtttagaagttaagaaattggaaataatggaattggtttaaaaagctagtctctaaattaacttagaaacctaatagcaaatacagattttgattgctataactaaacactttaattttgaaaaagtttcagaatagaatttctattcccaggggaaaataaacttcatttaaaaatatatgtatacttattttgtgagtatttttttcttttccaaattccaaaaggtgtatactctatatttttgtcataaaaattctgcttgtcgaaaatattgtagtaattttataaattcaataaaacctgagtgatgtgaacagtgtgggggaaaatgtttaataaatttgccatgccactgagaaaaacttaaatacagcatgttttgaaagtttgaggaagcgtaacactttgctttttaaaaacgtgactggtttgctgcacatttaaatttaaaagctggttggctattttaagattagtgctgtgatgtgagaaaagatagtagtgatgatagctaacctttaaacgaaagcatacagtgcatcaccttatttgtttagatcaggagttctccatcttggctgcacattacaaacccccagggtgcagccaggcacagtgattcacatctgtaatcccagcactttgggaggcagagttgggcggattgcttgagctcaggagttcaaaaccagcctgggcaacatagtgaaacctcatgtctccaaaaaaaaaaaaaaaaaaaaaaaagagctggacgtggacgtggtgttgcttgcctgtagttccagctactcgggaggctgagatgtggggattgcttgagcccgtgaggttgagggtgcagtgaactgtaattgcaccactgcactccggcctgggcaacagagtgagaccctgtctcaaaaaaaaaaaaagaactcccgccccgcagggtgcatttaaatttcctaggttcatgggtaggttgacgcagaccaattatagcaacacctctgggggcaaggtgagacccaatcatcagtattttttgaaagtttttcagtgattccaatgggtagccagctttgcaaaccattgagctggatggaaattctcaattctgattgttgcattttagaagaggtgggggatgtgtgtttctatgtgtatatagatagatatagatctatctcttttatatatctgtctcactaaagtttgtggccatcgtctagcagtcagaaaggccaaataggtccttattagcatgggccgaggttcccttgggggttgttagaaatgcagaatctcagcatccccatcccagatctgctgaactagattctgcgttttcaaaagttccttcggtgattgctacacactttaaagtttgagaagcactactggaggtgatattagggtaaatgtagatctccatacaccctgccttttgcttctctctggttttctgactaaagttttgacatttttatgtggggttggaaaatgaagctagtactatgtgctcacatcagcagattaatagctgtggtgagtttctgatctggagcagatgtgaaggagacgactgccatcaccacaaaactccactcttccctcagatggggaaagagaaaacagctcaaagaatggtcactgggctgaaggcagtgctctttcagtctcttctctcaactaccctgtgtgttaaggaaaaataagaagtacagtacttgcaaggatactgctttatacatgcctttgagaattctctggaagagaaagctacttccctttaagtaagaaatgtactcatcccagtgtcaaactgcaattaataaagccaaatcctccaagttctctggaataatttctatacaatgccctgcactcagaaacctttcttatagtggctacaatcccgtatcttaaatatttcaagaactctcagtctgcttccctctgtctcaacccctaccaagaaataggcagattattttgctaggatgctttcttcctgcaatgattgaacgattcttttgtgtgaatactatagggtccagtagtgtagtttctgggaagctctcccattgctgtcccttcacgtgacacgctgggtcaggtaagcaccctatttcctgactatatttcagatgccagttaagggttcagcatctctggcctgagctttctgagaagaggaattccctacactagaaatgaaggactttttttacaggaagcaacctgatggcattttgctgttgaccctgccctggaactacaatgattctcaaagtggaaaagagccctcttctccctaatcaagcactctcttgcctgctcaccctccagcaggtttggttcttggtgttttgaaggggtggaaagacaacactgataaacagagacctggcctctagttccagctctgttgctaaccatgtgactctgggcatgttattcaaagacctggatctcaatattctccattttgagctttctttctggggtctcattctcttccccttagtggtcctttaggtttttaggacagagcatctcagcctcccacctggtcttggcctcatgggcctggtggtgtcccttctctttggcttctttgggttgtggcagggatatggaagtgaaggggaaacagctggcctgccttatgcatgtgggccgaatttcttggcaagttggagaacgaggaatacctgtgtccctcatctgaccaaaagctaaaagttgattatggtggtctcagaagtggcagctgacaacaaaaagctgcattcattcatgtgctacatcccttcataaggctgagaccggtgtctgacagaggcccctcaacatcgctggagacttctataactcagggaattcgtatctattgcatatagcaagaagtattcatccttgaggctctgctggttcaggaaccacaaggttcattggcagcagcctctcctggatgcagaaggaaaggaaattctgagcatcgagcctttgtagggtttcaaaaatggagttcatcactgcctctttttagggggaactatgtgtaggtatttctcaggtggcttagacatcccaaggaacagagttggggaaatactgacccagagataccaaaaagcacaaaaccaaactctcactttttataatttcaaataaaaacccacgggccaatctattttcacaaatcctatctatctagtctgctgcctcgtagacacatgtaggacagcatttcttaaacttttaaagccactggcatctttgtaaatgaaacctaaaaaatatacatagacacagtctcagggaaccttgtggatcactaacaatctcaggataagcatgagtttcatgtttggaatcccgacctttaggccacactatcttttgcagagaattcttacaagattgagaagcattggcatagctgcccattcctcttacctgctttccatctcttcttaaaatagagcaggagtgaatgggtatcatctccatcggctgtattcttgacacggcatcctcagcggaacttggtttgctgggcaggactcttctacctcttcactgccaatgccatagcagtggcctttgtcacttaaaaggttttgggcagtaaggtgtcctcctatatccatcccttgctgccacttttcctatgcctgggaagtctaacagattggcttcattgacatgcacccccaagtcccatgaaaatcttaggaaagacctttccacgattgcctataacctcccagggctataattaaaagggacatcatgggttagaaatttggtggtaggtgaagtcttcctgtgagtggaattctataggcggaaataagctctttgatgtagaaagcaaacaaatgtcatagctttctcagaacagctaaagacttggtaaaaataaaattttatcaagtctctagttgacttaaatctctttagtgattcccttacctcttagggaaaagcccaaactctattatatggtatatgaggccttctgcaaggtggccttgcctcttgcacccagcccttcaaaggttgttccactataatcttttttctactaaatttaaaaaaaattttctttaaacttttttggatgtattgtgccatcctttgcccctaggtctctgcaggtgcaaaggtcctctgcctggaaagtgaggcctgccccttcttatcccatattttaggttgcagcttttgcctgtttgcccctttctctgactggataagatgcctcagcaatgtgctcccaaacactccagatttctttgatcatagcacttaacttcatttcttagaggatattcagttgcctcttcaaccaagatctattcctttccacatcttcagtgtttccacctcatatagcctgtctcaacctgcattatgcatagcaccaatgaaaagcaaattctgtcttcaaataaatttggggaacactgtgtcacctcctggaaacataattcatagctcataaaagactgagaaatcctgtatagagaagaaaaattacccaaattctaagtttattaggctgtggaacagtttttccacaacatcttgaagagcagagtttgggaaacattgacccagaggtaccaaaatgcataaaggcaagttttcatattttataaccttagaataaaaacccatgggccagtctattttcaaaagtcctacttaagtagcagtcactattttctcctattacaaggaaatgactttctctacctgaatttctcaaaattacgtttggggcagagtaaacaaaactgaaaattactttttctttctggagcacgatcataaaacaatcttcttgaatcagtcaccatggagatatcaatttaacctgttattttatgggctgtttctggtttaacaacctctatggttcatcgtttctggtttaacaacctctatggttcatctacataatcagctactattggatagagaaaaaatctgtcttttcagaaattccctcagaacacttactataaagaggtgctgttccatgtccgccacatctagggtgacaggttggattatgtccctccctaagagatgttggactcataacctcaagtacctcaggatgcgaacttatttggtgataggctttatagaggtaattaagttgaagtggagtaactaggatgagcctcagtagtatgactggtatcctaaaatggagaaatttggacacagacatgcaggaaaaatgtcgtgtgaacatgaaaatagccatctacagaaaaggagagaggcttaggagagattcttccctcagagttctcagaaggaaccaaccctgccaacaccctgattttggacttccaacctccagagctgcgagacaatacatttctgttgtgtctgccactcgatttatggtactttgttccagcagtgctagaaaatgaatacactagtcccctctgatctgtggtttcactttctgctgtttctgttacccatagtacagtacaataagatatatagagacagagagatcacattcataaaacttttattatagtacattgttatattctattattgttgttaatctcttactgtgcctaatttgcctaatttataaattaaactttttcataggtatgcgtattagtccattttcacgctgctgataaagacatacctgagactgtgtcatttataaagaaaagaggtttaattgactcacagttccacgtggctgggaaggcctcacaatcatggcgaaggcaaggaggagcaagtcacatcttacgtggtgtcagggaagagagaaatgagaaccaaacaaaaggggtttccccttataaaaccgtcagatcttgtaagacttattcactaccatgataacagtatgggggaaacggctcccatgattcaattatctcctaccaggtccctctcacaaggtggaaattatgcgagctacaattcaagatgagatttgagtgaggacacagccaaaccgtatcagcatgtacgtataagaaaaatcatggccaggcgtggtggctcacgcctgtaatcccaacactttgggaggccgaggtgggcagatcacgaggtcaggagatccagaccatcctggctaacaaggtgaaactctgtctctactaaaaacaaaaaattagcctggcgtggtggcaggcgcctgtagtcccagctacttgggaggctgaggccagagaatggcgtgaacccgggaggcggagcttgcagtgagccgagattgcgccactgcactccagcctgggtgacgagtgagactccgtctcaaaaaaaaaaaaaaaaaaaaaaaaggaaaaatcatagtatttgtaggattcagtactatccacagtttcaggattccactgggggatcttgggacaggttgcccaagaataaaggtggcctgccgtacatctaatgagtaccagtgagacctaggctaggtcccctctaaagtgctgcttctctagtccctagcttcaatattctgtactgtggtccctaacagaataatgattgctggtatttattgggtgctctgctaagcgctgttctgagttttacaagtagtaacttgtctaatcgtcacaataatactgtgaggttgctgctgttattctcattttatggacgagaatgtcaaagaatggagaagttgggtaacctgccccaggtgaagtaagttagtaaacagcagttcctagatttgagcggggccctcagggttttgaatgcagacatgtaattgcaacatgattcggctgatcatgtagccagggtgtggggtttataaaatagacgtgaataaaaaaaaggggcaggatgacagtgaagcttgctcatgggttttgtggagggcgtagattggaaccaaaaagcacgcctcggcttggtgctccctgtcgccctctgttgacatggggagagaagagcgggtctgactcggaaatgacgccataatgctgaggaaccactcctggcgttgcggaaggtggggtgtggggccggaagaccctccccccgcgtcttcagaggagcgctgtttctggaggagttaggggaaggaggctgcctggtaagccaggaaaggggcttctggccgttctgttggagcgcctctgactgacttcccccatgtgtccgtgtggccacaccgtgctactttcagaggcagtgggcttttcgctaagggataaaaagaagtaaaaccttgcctttagcgcagctctccttcactgggcagattgctctccctccccactctcccaggcccaaattggatctcagcgcctgggagctccaactttagcaagtgcgaaatcctgtcttcggttttggaattttcatccgcacagactatatcagccacggataggatatgtgagaataccagcatgtcaaggctgggaatcatccttaggcatcacctagccagtcctgcctctcattttaaggtaagaataggcatttaacattgtaagatgatgtagtgggttctgttggcatcacttagatgcccaggaaatgtgtattcttccatcgatttctcgattgttcactgtttggctgcgttagtccacggagaattgtcctggccaacaggcacccctcttcacttgggaaggtttatttccctcttccatccctcctcagcccctcagcttatagcctgtagccattgactggttggtaagggggtacaaaatgtcagcccccttgctcctagatggaaccaactctgtggtacgattgaagctccctgtgagatctggctgaggcttctgctgagaccacattcgtgctcagcttgcttcctctgccctatctgctggctgccccattccctttttccctgagagtaataatccctcaaagaatttctgagacaagaatccccgtctcaggctctgcttttagggaatctgacttaagacggaaaacttgctgaataaattaatgaagacccaggatttttctctggagaatgaaaactgacagtacatttgcttcagctttggtcacctgtacctacattaaggaggtgaatttaggcaaataacatcataggcttataattatgattaacaaattgaagtggacaaatacagatatttttggcattattttattaccaagtctagatcagttgtttaaaaagcatagtagaatgacactatttaaaatagtgtcagtcttccatatactgtcattctaccatgcttttaaaacaactgatctagacttgggaataaaatagttctttagttctgaggtcctttatttgttctgtctcaatttggagctgcagtagccaatatggactcagattcacaactgatcattttccctgaagttgtccttttccgttcactatgctctttgagggacagtatctataccgtgttaatcatctttgtattgttccctgtggtgtttagcacaaaagattgtgaattgtagatgttcaaaatccatcaaagatattgaatcacagctgattccgagttgaatcagctctcctaaaaatatttttcttgatatatttagaagataaacttttggggataaatatatccatgagaactatatctaggctttttaaacaaaattgctgaatacatctaacgataatttaaacatttgcttaaaagaacttattagcatgggctgtttttttttattttttattttattattattatactttaagttttagggtacatgtgcacaatgtgcaagttagttacatatgtatacatgtgccatgctggtgtgctgcacccattaactcgtcatttagcattaggtatatctcctaatgctatccctcccgcctcccccaaccccacaacagtccccagagtgtgatgttccccttcctgtgtccatgtgttctcattgttcagttcccacctatgagtgagaatatgcggtgtttggttttttgttcttgcgatagtttactgcgaatgatgatttccaatttcatccatgtccttacaaaggacatgaactcatcattttttatggctgcatagtattccatggtgtacatgtgccacactttcttaatccagtctatcattgttggacatttgggttggttccaagtctttgctattgtgaatagagctgcaataaacatacgtgtgcatgtgtgtttatagcagcatgatttatagtcctttgggtatatacccagtaatgggatggctgggtcaaatggtatttctagttctagatccttgaggaatctccacactgacttccacaatggttgaactagtttacagtcccaccaacagtgtaaaagtgttcctatttctccacatcttctccagcacctgttgtttcctgactttttaatgattgccattctaactggtgtgagatggtatctcattgtggttttgatttgcatttctctgatggccagtgatgatgagcattttttcttgtgtattttggctgcataaatgtctttttttgagaagtgtctgtttgtatcctttgcccacttgttgatggggttgtttttttcttacacgtttgtttgagttcattgtagattctggatattagccctttgtcagatgagtagattgcaaaaattttctcccattctgtgggttgcctgttcattctgatggtagtttcttttgctgtgcagaagctctttagtttaattagatcagcatgggctgttttgaacttgagttgccttatctatctatgatcgtttttgtgatacacgaagatgcatacttccccaccccagaatttcacagaaaacaaccagccacacattttgaggtgcagatagcttgctttattttgttgttactatctcaaggaggtccaacaattataactaacaattgaatttatacttgcatgaaaagaactacatcaaattgacattttgggcaattagtaatattgtttaaaatttaacaacagctttattttgttgttgttctttactttttgctgtggctcattgcttaggtgcccaggtttttcaggtgcaattaaaatttagaactaccacacaaaggcattggctgcactctgggacctccaagagttggcactgctctggcataggaatacttgaatagcttggttaaatgaagggatggccaggagatgttacttttccaagctattcaggcactccttatgtcagagacagcgtaaaatgagcgaacaaagtgttggccgttacactttgctctggtaatatttgtcatgataattttgtgtgacatcatcagagaaaatgtaagacgttaaagtgttgcttacaggagggtaaatgcaaacatcaccaatgccttacatttctgattcagtaggtattggtgcacatatcaagtgatatgcacagcatcattctcttttaggtggacaggacatcttcaatggggattttctcaacccactgaggcatacttagacatcaacagtatgttgaggcacaaagattgattaaatgttgagcagggtattcgttccataagaaactttctcctaccaacagttagtttcaaaacttacattgtaaaatgtcataaaataaatggtacaaaactttataaccgttaatccggctatatacagtatgtacatgtcactagcaaatgtattatattcttaggtcaacaattatgaaaagattgaaatgaatatttttgaactttgactcatttaggttgatacaaaactacttttttttctttaaatatttacagttcagaaagattagtccgtgtgaaacgtttgcgaaaagttaagaatgagtgtagagtataagggcacaggccctcttaaatggatcgaatatgtatattcacagtggcagagtcagatccaaattcattccctaaactcagggtataaagtccaccatcttgtttctgtacgtccatgatgatcagggttgtcaggtcatctgtgttttcaatgtggaacctcccctgttcttgactgtggatttttcttccaccacaggaccatgttacttctggggtaggctcacccgtgaaagcacaggctactgttagaactttgccttcatcaatgctgatatcagatggaagagcttcaattttaggcggaattcctttatggaacaatgacaaaaaaaaggtcttagaatcactgaaaaaaataaagatttgctttctactgaattgtgtgtactaaagactacaccatgttacttggcttgtctacctctaccagtaattttattgctcacctcttatgcctgctttaagcattttactagttgagctttccagttgtgtcatattagatattcccataaagctgctggaactcatttctacaaaggactcttgcatggaggacatgctttgggcagacatgcttgcaaatttcatctcagtcatgctgctagcactgctgctgctgaaactgctgaaggaggcctcctgcttggaggcagacatttggactgactgagacgagaagcttccttgcaagcttgtgtcaccacttgttctcaatactacctctctggaaggttcttcaactagagctgtggagcatagcagatacacagtgaacatcaatgacatctggttaattgatgacatatgacgctgacttacagaaatggaaacttcaacacacacacagcagcataacccaaacaatttgctgttgaagcataagcaaatacatatatacatacatttgtcaagagctagctcaatgtctccaaaacatgaatccttatatttctatcattacattacatgcaggtgctaggaatcactaggagaaaaatgattagtcatatagaaagtaattgacatattgtgcatcctgcaaataaatgttacacggcagttggtagctttactttgaaatgtaatctatccaagtttctgtgtagctataaagaaagtttgactacaagaatgaattcacatcagttggctgtccctctttcacatggaatttaataaggcttcttagagttttctgtgcttgaaagagaggcaaaaaaacgatctaaaggccttaaacatgtaaggaagaagggtgaggagatacttacgaaggaccattaaggaagctgtagctgaacactggccacggaaatttttggccttaattgtgtactttccactgtcgctgactgatgcatttcggatttcaagggagtatacatttctggagcggcttatgctgacatttgaagaaatagaaatctaagacaaaggaaaaagaaaagaaatgttgaagttcttcagatgtggaagacatggtattttagtttttcttcaataatatattcataattaaacttactggcaggttgtttttaaaccattcgatttcaggggatggctcgccactgatttcacaagtaaagagaacattttgtccttcattaatattttgagatctaggctgtgagatgaaggctggagcatctgagagttctttgctcagtgtcaaatcatactgacacttgacgattccttccttggttttgcttatgcaggtgaggattccttcatctctgtgactggcttgcttgatggttagggtctgatcgctgcctgagacaccatatcggtactcctcagagttggtaagctctacgccattcagtacccatttcacatcagtggcaccagcaatgttggcttttaaaaccagtctttgaccttcgtttatgctcatctgagtagaaaatgctttaatctcagcatgagttctgacttcttctgatgcctgtgatgttttagtgatttcctcatggacaatggatttttccagggaggttgctgctgatttcttgacttcttcagaaatcagaacctttgaagcttcctctttgagggctaacttttcttgagattttgcctctgacatcttaatttcttcagaccttagggctttttgggaaatttcctcttggacaacagctttcttctgaggtgtaatttcagaagtcttttgtgtagagactttctgtgcctcagtatcttttatagctaaaaaagaaacctctgtaaggcaaacttaattagaaagagacccccaccttttactcttctagattctgcgtgtgaaaaacataaaaagaaaaaaagtcaacttcttcatgcaatgtaggtaatacctaatactttctcagttccacttttggaaaattatcatgtgtgacttttgagatcactgtaatgattccttaaactaaactgagccaaagatgattcatatgacttaaggaaaaaagtcttgaaaagaatagtcaacggatttaggagataagtggatttgggagattttgagtaaccaaaacattaaattatctttcagaagattgaaatgaaagcaaactaattttaattggtaaaatagaaatagttctttaattaactttgcactgctttggaaaattagcaactgtgaaggtttaggcaagtagtgccattttgtatattcactgactttattcttaaatattcctgggagcaggggctgacactatggaatcttatataataccacatataactaggtacttaataactgctttttatgctcatagaaaagcatatgctaacttcaaatgtgtgtttctgctttggtgtacaaattgtattctggaattaggaaaataattttattttaatactttcttgtatgtgtatataaggggggatgtttgaaaatatttccctaatattatcttctgaagaaatgtgggtaaaaacaaaagccaacctaccttttattgttaatttgcagctagaggacacagatccagctgaattttttactgtacaagtataaagtccactgtcagaagtatcagtcttatgaatttctaagaagaaccctcccttgtcttcagagagtttatatttacctccttgtgtaatggcctgtagaatgcaaatgatttgtgttttaaaaagtgatttcattttaagctttttttgggaagctgaatttagaagataaaatattttagaagataaaagaaagagacatttaagaactggttacctttccatcttttgtccagatggcagttggccggggttctccagtagccttaactgcaaatttagcaacactgtctgaagaaacagttgtatcctgcaacccagtaacaattactggttttgaggaaattggttcaggagcttttggttcagtttttctggttactgttgactcagtggttttctgatctgatttcttagtttctgatatttttgataccttctcatggatactcttaaaggcttgccccataaattgtaagttggttttagacgttccaccttcaccagaaatctcacaaacatattctccttgatcagattcagtgaggttattgattttgagctcataggtaccatctgctgaataatgaaactggaaatgcccattttccttcagtttcttgccatctttataccaggtgacctcttttgcccttaatacactgctttcaaccacacaggtcagttttgcaatctctttagaagcttctgctttcaggaactgagtaatctttggtggggcagagactgggaggtgctgaactttctctgttggtgttggttttgtctctgtgggtgatacggctttcgggtgagaaggttctggagatttcactcgttttggagacttaactgcttctggggatttcacccgaggctctggggatttgactcttggtggtgatgtcacagccttttcagttaccctggccttttgaatagtcagagtgaactctgcttcttgtttcccttcactgttttctaccaccacgctgtaattgccctcatcggaagcctggactgaagagatctcaaaggttgatttgtactttgtggtggtcacttggtggcgggcagaagtacttagcacttgtcctttacgcagccaggtcacagttggtaccggctcaccatcggtgtcacaagaaaaccttgcagactcgccctcgtagacggtcatggaccgtggctttgttagaattcttgctgccaaagtcgtcttgatctttctggttgtggatttttcttccagtgacttttcttctaatgcagcacttttcatttctgcagatgcagagtgttcatatgaggagagactttcccttgtctccgtcatctgtgatttcacttccctgacagaagacgaagcttccatctcagatgttttcttaaatgatgaaacagcatacgcctctgttcttgtcagctcagggaaaacagatctggggacctcttcatctctgcgttgggaagcataggtggtataatcccctcctgtcacgtccaacgttgcatagtcagaagcttcgcccttgtagttggtgcacacagcacggtaggttccactgtcatcagtatgacagtccagaatttccagggtgaggactccactcgtgttggtgtaatgaatcttactgctttcttggagttccacaccattgtggtaccatttaacctcggcagttggcttagactgaacatttaaaataaaacgtgtattttggccacatggtaccctgtgcgagcgcattctcagtgtgattcgaggggcatggtccagtgtgaaaggctgctgactcaaaacttcatacttcctttctgatgtcttctgagtttttaaagcagctttcatggactcatacctggaaaagatatcaaatcttgcagacctctcaaatctcgagagtgatctctcactagacacagggctgggggatcgtgggcgagttctctctggagtaggtgaccttctttctgtgtcatcttcgtattcctcagccggttgtggacgtgaccggatcagctcagacactggcctcattaactcaatataagttggagacagggagcgccgtcgtctcagtagtctagacgcagatgaggatgattctctttgagcatgttttgagatttcgtattcttcctcaatttctgttatttctgtcacttctctttgtcgccttgatttctttctagacttttcctcctttgacatgaagtcaagttcgcttttgtattctgagagatgctgggtggtcgtaactgggcgaagcaactcttcatcctccctctcagccatgattctttgccgttgctttggctgtctgtacgcagcctgggcatgccgttccctcagttctgcataacttgtactagcttcagccttcgttgggatgtgataggttgaatacctgaagtcttttcttgtttcctccaccttgacatgagcttgtggtgaagagtaacgtaggctagaaagctcaaagtgtggagggcttcgacttgggggtgaagctgaaaaacctaactcaagctcttcttcaagacgcagcctctcttcctctgttcttttcattgctaagtagtcatcaatggggaggagtaattcttcatcagagatgtccccaagagaacgtcttctaggtcggtagtaaaagtcataatcaggagaaggtgtacgccggcgggctggtctcactatctcaagatcatcttgggacagtttaggaatacgccatttaggtctgtattgatctgtaatgcgtggaagaggcatcacatagaactgttcccatcttgaaaggcggatgcgcttgggtcgtttctgtacaactctgtcaagtttcccaggcatttcatactgatcacgtatctttttataccacttcatgtcagacatgggcacgaactgcttgatgcgttggtcttcttctatggtagtctgcttatacttgcgtggctctggtacatcataaggcatccggagttttctctcctccttcttttcttctatctcaagtctgaattccccttttacagtcttggtgcttacagccggtttataaaggacagcagcttctctcagagcctctttagctacctgtgtcagtggtacactttcagttccagaaagaatttcagccattctgagggttttgtcaatttgtttttgtacgtgtcgctcatgctcctccttactcttgaattcctgtttcttgtacctcaggcgttccacttgtaggtgagcctggcagctggtggacccagctgtgttagtggctgtgactctataataacccgtgtcttcaggcaaagtgtccctgatgtgcagagcataataatccaagccttcatggataatttcaatgttaggcccgagggacagtggctgaccatctttctcccattttaatgttggtggggggatgccagacactctgatctcaaagcagacactttggccttcttggcattctgcatttgccagtaaccttttgaacatgggtcttaaggtactatctgttggaggtgggtgtagggttactgtcagctttgctttacagctgtcttcaccatatttgttccttgccacaacagtatattcagcgtcatcatctgtagtgacactgttgattgttaattggtaaagacccttgtctgactcaaatgtgtacttcttgtcattgtcacctggtttgattttctgacctgatttataccatgttacatgaggctctgggtggacagttatagttactccaaaccggacattttcacctacataagctgtcttattatagagaggcagggtaaattctggtggcctttccaggagtctcattgtgtctgttctgcgcttaattttcttcatggttctacggcagtaatagtcatagacttctctcacacctttaacaaatagctctgcataagaactgtcttcaccatagtcattgactactttgcatctgtaggtaccatcatctaatttggtaatgtctttgacatagaggatggccactccatcttcgtaggtgatttcgtatttctcactgttctccagctgtcggacgccaaagtaccaagtcacttgggtagactgatcataattttcaattttgcatacatatttgacatgtcctccttcttcaccaactgcatgcattatctgcccagaaactgggccaatttcaatggatgccactttaactttagcaacactcactcccttctgagatcgaattgcaccaccacaggagatccgggctgctgacacaaccatgttgaggtctttcttgatcagggtgtggtaataacgccggtgttttaatgttctgataactttagtactgactctttctatcttctgcttcaaccatgggtgctggagagcctccgatgctgtcatgcgagatttcctctctttcactaacaaccggtcaacaaaatccatggcttcaatgctaatctctttgaatgcttcctcatcgaaagtatattcagcattcatgatattctcaatgatctgttggttagtttcagccaggaatgggttgataccactcaatagcacatataccagtgttccaagtgaccacatgtctgtggctgtgctgacaacatcatgctggtggacttcaggtgcatagtattctggggcagtgaatagaagcctgaagttgtcccctggtttcagctgacgggcttgaccaaattctatgattttaatggtagagcttcttctggtttggtaaatgatattttctggtctaatgtcaaagtgtccaatattatgactgtgtaaaaactgaagtgcttcacagacctggtgaacataacttacaatttctctttcattaagttcaaaagcacttgtgttaatgcgctcaaatatgtcaagtcctgatataaactcaaagatcataactaattcttccatgctttcaaatgattcatggaggtgtaagatgtttctatgcctagcaatattcagaatggaaatttccttctttaccaaaacctgatcagtccctttgactttaacaaatttggccatgtatgtcttctttgaggatgtttcaacacaacgatggacaattccaaactcaccacgcccaagatcttcagcaatcatatatttctcatagagttccttggttgaagagtgagatgctttagtcatggagacttccctggtttcatctacctcttcatcatagttcatagctctggtcttatcttctttggttatggttggttctgaaggctctgaaggcttgctcagaccaaatttattttcagctattacccggaactggtaacttgtttttccaaataagttgatcacggtataacgtgtttctcgggcctgtcctacacggagccatctttctgcagtagttgcacatttttcaacaatgtagttggtgattttgctgccaccatcagaggctggctcagtccatgttaagttgacagaatctcgtgagacatcactaactttgactcctctgggtgggtcaggaacatcagccacatccagttcaactgtcttctgatcaattccaaatctgtttttagcacagaccacatagaaaccagcatcttttctctctaccccattggggaaaacaagtgatgtgaaggatcttgtgacaataacttggtagtggccattattgtcaatgagatcttgtcctttctgccaggtgatcacaggatctggtttgccactgaaaggaatcttgatgctgaccacttcacctcggagagcatgaactgctcccatgccttcaagagttttaggtaagtgtatcttagctggaactgtatcagaaaaaaaaaaaaaaagaatataatttagcaacatctaacagtatgtgtttaagtgcaatagcctccacccccaagttaataactcatttagcctcaacttgatgataatttatttatttttaccttccacttccaaggaggcagtgccagacacagatcccccttggttggtagctctgacttggtaaactgtggcatcatcatctgtgacacttgcaatgatgagctggtggtagccacccttaaattcttgaatcctatattttaatccatctgcaatgatttctttgccttgtctgtaccatttgacgataggttttggatgaccagtcactttgcagaccaaggtagcattgctctgatatctgacatttagatttctcagttcctctttaaagtgtggtgcctgaattgggacatcagatttgggagtgatgggttctgatatttcactccattcactttccccacctagattttcacatttcacacgaaactcgtattcaagaccttcaataaggtttttcactgaaaagacagtttctcgaatttcttctgttgtcacagaaatccatttattctgcttcttctcacgcttctcaaggtagtaatttctaatctttgcacctccatcactggcaggtggcttccaggccacaacacaagaatcttttgtgacagcagtaatagttggtttgccaggagcacctggcttttctattaaacaaaaaaaagatttgagtcatgagatgaaacaggcagctttattaaagcttatttttttaaaaaagaatgttatatgagtccaaaattttgttaaaaaatagctattccagaaagatgaaattggttactttatactaagacatatcaaaaaccaaagttctatttttacaatggggttaggatatatatttctccttttagatatgcaaacattcaattaaagtgaaagaaaaggcacttgtactttatctgaatctttgctatttcctttcaaaatttctttctgtttaaaagaattttatgcaaagatggaactttaccataggaagatacagaaatcaagttgtactcaccaaatggactcttaatgatcacaactgaggacacttctagagggtcactgatgccgaaagtgttctgagctgaaacccggaagtaatagccagcattttctgtgaggttcacaattctacaggttgtcactgagatggctgaagacaccaattgccattcagccccctccttggcctcacatttttccaccacatagttggtgatccaggagcctccgtcatctgcgggtggtttccagctgatcactgcggagttcttcaatagagcttcgatcacaattggtcctgtaggtttgtctggtttatctgttgggggaaaatacaattgtggtggttttcatagtgtgtttttgagatttttttttctttaaaaataaaaagcactgaaaataaaaataaaataccttgtatttccacatcaaggatggcatcaactgttccaaaaacattgctgagctggactttgtatttcccagcatgagtcttacgttggacattcttcatgacaagatgagtatagtgctcagtgttttcaatagtaatgttttctgagttttgcaaaagtttctgaccatggaaccaagtcatggcaggtactggacgaccaatgtacataacatgaagccgaagtgtggaacccacagctccataatatttctctttcagtgggtaaccaggatggaactgcggtgttgcttgcaggagaagcttactactggtttctacttctccaacctcattggtggctatgcaggtataaacaccttcatcttcctgttcctctgtcattactgtaagagtgtgtgtgcgtccatctgaagacattttgtatttccggctttgtatgagctctttaccaaatctgtaccatttaatgtcaggaagaggccttccaacaatctggcatgagagttgagcagcttcacccaattttgtggtaacatccttcatttctttgcgtattcctggggcctctccagctgaacaatatgaaagataatattaagtgactgttaatactcaatctgtaatcctttgtccttgtatatcaggaatgaatttaccttatttactgacacataccatgatttacatattagcctaattcttaaaaactctttgaagtgattttcctaggatcatatggtaaatagggattcaatgagcacatcgtcacattttatgtagagtgtttttttctctttatgattggaaggggattaataatgtataggcttttaagggactgtaaattctctctataattctgtagtattcttgcccttacttaggttcattgaagtggcatacaattgttgacctttcaaatcttgttgggaaatatttttaaaaagaaaccattgcattagagggaattactcaaggaaagtgctcagttcactccatctaacatctgctgaggttgtgtgcttggaatggtttcctgtagaacttgtcatatttcctgtgtgtgtacttgcttttctttcttaacacttgctctccaataaagctttccagggttctacttagtatagagggggaattagccttaacttgtttagtttgtaaatcataagtagagaaccaaaggctacttacatgtgagtttagtctttatagacatagcagttctgcgaggtctgctcagcccagtctcattctcagcaaaaaccctgaattcatactcagtagcttccagcaaacctcctattgtgaattgcttgtccttaatacgttccttattgctcttcttccaggcactgtctccagactgtctatattcaacccagtatccaagaatttctttaccaccatcacattcaggtttctcccactgtagagtgacactatctttggatattgaaagaatctcaagttctcctggttggcttggtttatctgaaatattttaaaataatgaaaagggagtcagctttactggtgaaataaaaggaccaaacatggcttgcttctttaatttaaccccttcttctgaattccttaccaaatggatctttgcaaacaactggttcagaagcagggctggtctcactcaggccaacatcattctgtgcgatgatgcggaactgatactcagcatcgggaacaagccctgtgacagtgtacattgtggtggtgatctgagtcttgttgtgtctgacccacttgtcagtggatgtctctttgcgttcgatgtagtagcctgtgactctagaaccaccatcatctttgggccgggaccaggacaagctaacagaactcttggttacatcgagtacttctggaggattgcttggaggttctggaggatctgtaaatataagtggaaagcacacatgtattagaatacagtcccaagtattataagccaatgactttcatttaaaaacagaaaagtgctgaaataatgtttataattttgtggttgaaagggcacttactcaatggtgtttttggtgtgactggttcctcagatttcaagggtttgcttatgccaaactggttttctgctgaaacacggaaatggtattctacattctctttgaggccttttaccaccagagatgtacctcggactctggaatcaatggtataccaggcggctttaggcacttctcgtctctcgaggatgtagcctaagatgtcagcaccaccatcatcagcaggaggtctccagctgaccctcacagagcggacttggatgtcatcatattccagtggcccttctggactgttgggacttcctatcaccctgaccttgatgtagacagccttcttgccacatttattttccagaaccaggtcataagtgccagaatcacccctgtctgcttctttgatcacaagctcagtgtgtgtttcagatgttgcaatcatggcacgcttactaatatcctggccttccttggtccatttacatattgggaatggttttcctttgattggtatggtaagtctgatgacgccaccttgccttacaaagataccttcttggtatctttcatcaagttcataatcaggatattctggaaaaaaaggtagggtttcaatttagcatttggggtagggggactaagaaataagtctatggcaattattgcagaaagcaaatgatcatatgtctcaccaagcatttcagtgactttgactgttcctggtacctcagcaggctcaccaggtccaccagcattacaagctaggacgcggaacctgtattctgcaccctgaggtaggtgtgttagagtatactctcgaatcttggttggagtggtgttacacttggtccattcatgttgatctactttttgcatttcaatcaagtagcctgtgactttagatcctccttcatcttctggaacactccaggccagggagactgatgtccttgttgtatcagtaactcttgggttttgtggctttcctggaggagctgagaataagaataagaatatactggttaaagttgctgcaaagttgaaaattagctgtgccacctaacaaattcaatgagttgttgaaacggactgttaacattagcctgtttttttgtcttgtgaaaattttattcatggctgggtgtggtggctcatgcctgtaatcacagcaagttgggaggccaaggtgggcagatacttgaggtcaggagttagttcaagaccagcctggccaacatggtgaaaccgcgtctctactaaaaacataaaaattagccatgcgtggtggcaggcacctgtaatcccagctactcaggaggctgaggcagaagaattgcttgaacctgggagacagaggttgcagtgagccaagatcatgccactgcactccagcctgggtgacagagtgagactctgtctcaaaaaaacacaaaaaaacaaaagaaagaaaaaagaaaattttattcattttatcagctaaaaatacttaacattttttcactttcctttctcttaaatgtgcttcatttgtaatcactattattatcttacatttatcagcagtttttaaagtgcttccagaaatattaacttgttttaaaattttaagtgtgatagaaagcatatattatgaatctcatcttaaagaagtggaaattgactccagagaagaatattaaaaattatttgccagaaatcgctagcagctggggtggggaagggactgattacaaacggacacaagggaactttacggggtaataaaaatattccacattttgattgtggtggtgattacaaaacagtacatttttcaaaagtcatagaactatatatttcaaaaaggtgaattttcccacatataaattgtaactcaatcaatttgactgatacaaaatgtccttaccaattggatccatggcaacgatgggtttggaaggacgacttggtttcccagaccctcttgcattaatggctgtgacacggtgttcatattctaagccttcagtaaggccagtggagcggtaccgtgtcattgtcacaggtactttatttacacggacccatcgatctgctctcacttctttgcgctccacaatatatccagtcacttgggagccaccgtcatcctctggtgggtaccaagtaagtgtcatgccatcacgggaaacatcaaatatctgtaatgtttctgggggtccaggaatacctgcagcaagacagaggttaacacgatatggcaatatgaatacgttaaaacaatgactcatatatttgtgttttccttaggttttggttggtattttaaaaggtacataaggcacatgactatttttccaatagtttcacttttgtactatttgtaaattttaatttaaatcatttaattatttaattatttttattaaaaatttttgacttttagcttcaggggtacatgtgcagtttgttacatgggtatattgcatgatgctgaggtttaattttgtactttccttgctgttcctcattttcttcaattctacatttattaagcatgcactctgtatttttttctcactataacattgccagtcctccttcctttcctctcttcctccttcccttctctcttttcttccttccattcctttcttcctaactccctcctcttctctttcataagagtgaagatattaaaaaaaaaatcaagcctaagtgtgttgaaaacctctgagaaaaggaggtttagaaacctgagaaaaggaggtttagaaaccttagaaagaccacagggttaattttgtgacctatttttatttacattagggcatattaaaaacaaattcttttttgttaacattcagaatcagaggtggggagagtggtggaagggcctgtggacttacggatgctgctgcgacactctatgacctcagactgcaagtaagagccaatcccgaagcggtttgttgcagccacacggaacacatactcatttccttcggtgagtctggtaaacttaaacgtggacctagtcactgattcagaaacgggcagccatcctggacgatgagcgtcacgttgttctaccacataaccactcagtggagcaccaccgtccaattcaggtggttcccaggaaatggtaattgatgtagcatcaatttcatcaatcttaataggtcctgttggtggaccaggcttgtctatgaaagagaagaaatacaggaaattaatttttacttcaaatcaaaattgggtgactgaacatcaacttgcttgtatctttgtcacacatccttaccaagaatgataactttaatggtttctgaagtagttccggtaacattcttcaattcaagtgtgtattctccagtatctctgatagtggtttcacggatggttaatttagctactttagtgtgagtttcaactgtgacacgctctgattctctcagtttagaaccagcaaagaaccaggaagcagcaggaggtggacggccagcaataggtatcaccagctctactggtctgccagctgggacatggatggtcttctgaggcattgtagaaagatcgattgttggcaacactatgggaaagaaatcaggcatttattcttaagcattatttttatggtaaattgttacgaattctgaatgttttcattttactttactttttttttttttttggctatttggtacatacctctgaggtcttgtacagtcacggctgtgacagtctctcttggttctgacacacctttctcattttgtgcccttattctaaataagtattgttcaccttcatttaaggaagtaacagtgtgctctaggactgtgggttttaaggtgacaaccttcatccatctctctgtgccagctttgcaggcctcgagaacatatccagtgagtcggctaccaccatcgtagagtggtttttcccaggcaagggtaacagtggatttggtgacatcgaccacttctagctttgcaggcaccaaaggcacttctgagaccagtactgcatcagatgtttcacaaggttctccaatgccataaatattttctggcagcactctgaaatagtacatggttccttctacaagtccagaaattctgtaaagtgtcttgctgcatttggtagttactgttttgaatgctctcatagcagcttcacgcttctcaacgatgtaattgttgactggagctccaccatcaatcgtgggaatttcccaagttatagtcacagaatctcttgatacttccttaactttcactgaaggacagggaccaggagtatctgaaaaacagaatgaaagattcatatttcctatttgcctgatagctttttttttcttggggaaatataatcaacatagttcctttctagagaggtgatcaatcataggtcaagctatattgttttagaggatctactcattgtatagccaattttaagtaaaatgcttaccatagactttaacaaggactgttgctgatttcttgccagattggttttcagcttcaattgtgtattttccagcatcgtaccgattaactttgtccactattagcaatgagtagctctcagtggtgtcaataattgcccggcttgcaaggtcaatgccctgcttgctccacgttatgacaggaggtggtcttccagatacagacaccatcaagcgcaaggaggccccagccctgatggtcacagtcttctttagatcatctgcaagctcaagatctggtatttctggaaagttaatgacaaaatttaattaattcatggacaggtgtgagaagaaaataattcacctaaaagcttctgtgataaatacctattctttccacgggctcaatttcagcaattgattcgctgtattcgctcatacccttcacgttcacggcagcaactctgaaggaatatttctggcccattttaaggtctggcacagtgaattcagtatttcttattgtggcattggtatgcactcggtaccactgatcagtgtccttctcttgcatttccagaacatatcctacaatgtcagtaccaccatcgtacatgggtttggtccatgccaaactaatgctgtgtttggtggtatccacaactcttggagcagaaggtggtccaggggtatctgtggaatttaaaaagtgagatgcagatattaggcaaataaggaaatgttgagatttgtattttttgttttcaagactcacaaaggcattattgctcttgtccacactcaccaagataatctttattaactgggctcctgatattataggacagcacagagtgccacattataatttaatattattatcttaagaattaaattgctttaggaaagtagatatttcttccctacttctttggccagctttactgtgtgttctctattagctaagctcattacttaaagtacccattcttagggacttttctttagttgcttatctttcactgggttagtatcacttgccaccaatacatttctaatgaatacaagaattggtttccttagcttccccaattcagtcccagtgactattcctttatagttcttgggctcagactctgtaaaaggatttgccacttatttttgaagctcttgtcacaattactttgtcagtaacttatgaaaccactagaaactgtatgttcctgctaaacctcttcttaaaaggagttttgccatttttcttttcagttattacagtacaatgcatttttctctaaggaaaatttataaaatagattcttttcatattgatagaatattttttcattaattggaaaatgctgtacaacttttagcaattctaattgctaacttaacagatgtaatagttaaaatgttctctgacttaagctatatttatgatcatgcaaataagcatgtgcttttctagaccattcataaattctaaaaattcttagagattgtgtgttggaaaattatctgtcatatagttttgaggagcattgtatttatgtatgattcttggagctcacatgatggttctctgcatgagatgaagttggaagcttcgctgggctcactgttaccagctgcattcactgcggtcacccggaactggtaatcacaaccctccatcaggctggtcaccttcagcctggtatcatacaccacatagtctttgttgacacgtgtccagcgcaggctcttcttctcacgtttgtctactaggtagttgctgatttcattgccaccatcagattcaggttttgtccactgaatgatgatatgctctttgccagtcccaacttcttcaggtatgccgggtggtgatggaatagctgtttatgaaaataaggatgatgagaattgcacaaaattactattgataagactgcccttctcccttctccccctgattctattacatttcaactgtcaaattatttaaaagtgttaatacttactgaatgagtttctggctacaattggctctgattcaacaggcacaccagggccatatttgtttactgccctcactcggaatatgtactcattgttcttgatgagcctggtaacgacataggatagggttgggcattcgccttcaacaatcacccagttgagcctgctagtctcgcgtctttccacgatgtagtgagtgatttctgctcctccgtcttcctgcggaaggctccaggctaaagtgcacttctcctgtgttactctgctgacggtgagctttccacatgggccaggggaatctgaaacaggtgtaatgacaagccatgatgaagatcattctttctgcccacactggaaaatgctatataaatgtgagaacatttgacatgcttaccaagcactttgaccatgacagacacggccttggtcccgctggcatttttcactgttaaagtgtattttccactgtcacttctgtcacagaacttgatcacagcagttgctcgtttgccagtatactgcaaagagactttttcacagagatctagctccttgtctcctttggtccagataattttgggttcaggtttgccaccaactgcagcatccagaacaagatcagaacctgctctgatggtaaccagatcaccgtgtaatcgggcatccagttcggctttgggtggagctgtcagtaggcaaaacagatatgaatgaatatctgagagtttattttcacataaattgagataattttaaaaaggagaatgttgactatttcctaccgtattcatctcggcaagtgacagggcctgtagattcagaccctttgctaattacgcctgctgcattcttggctaacacacggaactcataagtgtctccttcactgagagcagtcacggtgaagaaattgtcagatacaatggtgtagttgcacttcagccagcgaccatctcctacctcactgactggcttacgctctatgatgtagcccacaaccttgctgcctccatcatacgctggggcagaccaaatcagtgatactgttgatcttgtgacatctgtcacctctggtctgcctggtgcatctggaagggatgcaaaaataaggttaaaatataccactctgagttctactagaatcagtaataataaacaaatatgcccttaaattgtgatacataccaactggattttgagccattataggtcttgaagcttcgctggccttgctaacacctgcagcattgagtgcataagttctgaactgatattccagtccttctactaaaccagttactttgtagttgcactctaagcatggcactttgttttctttcacccaaagaattgtattacgttctttcttctcaacccagtagccaatgattttactgccaccatcgtggtagggttcttcccaacgaatagacatggcattggcagacacatggtagacctcaggtctggtaggagcgcttggtgggactaaatataaacaaaggtattaagtatgaatacaattttataaaattcaggggaaacatttaataatagagactttgaaataggatttttatttttcttaccaaatggatgttcagcaattattggtgctgattctagaggtttgctgacaccaaatctgttctctgaactgacacggaaagaatattccatgtattttgtgagatgagtgactttaatttgagtgcgcttgacactggaattgacaagctgccaagctgttgtacccgattcacgcttttcaactatgtaattagtaatttcagtgcctcctccatctttaggttctccccatgacaggacacacgattcagctgagacagatgagacctcaatggggccggttactggacctggccttccaatgaccacaactgtgacgctaaatgttttaacaccagctgtattttccagggtcaagaagtatcttccagagtcacctctcatgctgtcctttacagtcagtgtggttctgtcttttgttgttgtaatgctcactcgatctgtctctttaagtctcatttcttccagtttccatgttactttgggggcaggacgaccactgattggtacgtcaatggtaaatgggcttcctgctttgcaagttataagctgattggtaattccagtgaggtcagcagtgggctcgatttgaggctccttaatgatgacagaagagaaggcttctctgggttcactatagccagcatcattcttggccttcacacggaattcatattcagttttctcaacaagacgctctactgtgaaagttagctgtttggtgtgaccagcttcaacccagaagtcagatcccttttgtctcatttcaagcaggtagccagtgatccggctgcctccatcgtggtcaggtttaagccaagctaagactgcggaggatttgctagtatcaacaacatcaagtctcctaggtggagcaggctgttctgtggctacaattggttctggcatttcatagggctcaccaacaccatactcatttactgcagaaacacggaaatagtacggaacaccttcggccaggtcattgaccttgaagatctgacgagtgcatttttcactgataacctgccaactacggcgacttgcctctcgtttctctaccacataatgatggattcgggcaccaccgtcaagaagaggggcatcccacatcaatgtagcagatccccgggtcacatctttgaaggtaattgggccaggtgggcctggagtgtctagcactttcacggtgaatgtgattgacttactaccactgttgttttccacagtaagggtatatttccctgcatcatttctgttgcagttttccacagtgagggtgctgaaggaatctgttgtatggatatcagcccgaaggctaaggttagagtctggtttgctccacacagctgtaggagtaggtctaccttggtaggcaatgaagaggcgaatactggccccagctctaacaacatgagtctgtttgaagtttgcatctatgtctaactcaggagctgttaaccggtcaactgctttaattgtgccagtcacttcacagctgtcgccttttccagcaccattgatagcactaactcggaatttgtattcttcacctgcttgtagatcagtgactgtatatcttgttttcacacatgcctctgcattcaccttgtgccagtctcctaagtcggccttacacatttcaataatatacccaattatttccatgccaccatcaaacactggtttggaccattctaagctcacagttgtctttgatgtgtctgttactttgaccactgtgggaggacctggtgggttgacgggctctctacatttaatgagtcttgagatgccacttgcaggtccaactcctgcagcattttcagccatgacatggaattcatactcattgccttctgtcagaccagtgactttgaatcttgtttcagagattggtcgtttgctgatcacttttacccatcttgtgcttttcttttctcttctttcaaggatatactgttgaatttcactgccaccatctgattctggccttgcccatgtcagggtaatgctgttgcctgttatgttgctaggttctggaatgccaggggcatcaggaacagctgtaaaacaaaaacaaaaccccaaatcaattagatgcatttgcttggaaggttaaacttttgacatagtaccgcttagtaaaaacgcaaacttactatattgtatttgagcaaccactggatcagaatcaagtggcctgccaacaccaaacttgttaactgcagaaacacggaattggtattcattgccgtttattagtttaatggcagtgtaactttgggcttcacatttatcctcaattagtgcccaggcaagtctgctggtttcccgtttttcaatgatgtagtgggttatgggagcacaaccgtcattgagtggggcatcccaccacagagtcatcttctccccagtaatattggtgaatcttattggcccaactacttttcctggtgtatctataagaaaaagtttctagagttagtttctttttccttgtccattaaaatacaactaggcatgtctctaatccaagttcataaattgtagcattaagaagctattttaaaagtaccttgtactttcactttaatttctgcttttgcagaaccagatgcatttttggcttccactgtgtatacaccacgatggtcccgagtagcatctctaacaaataggctggtggatccaagtacgtcggttatttccatattcatcctcttttcgatttccactccatctttgaaccaagttactcgaggcactggtcttccttgtaccaaagctttaattctaaggctctctccggacttaataatgagaccatcaaagtattcagggccaaactctactattggtggaactataaaagaaagagaaatactatgtattagtttggcttaataaagacatacataaatatatatttttcagtagtgccatatcacaaggccaggaagagtagtgacttctactgtgctaccaaagcctattttgaaagtaggattgataattgagaatttggactatggggttaaatatttgcctattattattccctttgtaatgcctgtcatgtttttaattttgcattgctctttgtaaaaaggaaagtgaaacatttacagatcatgtacttcctaatactgctgcacagtcacacaagttcttttaagaggccatcagctgcattcaagcaaggggatgattgtgttgttggatgtatgttgtattttaataacttcagtaaagatggacacttattctcgagaaccttttctttatgtactgttaagtggcgaaaattacaaagctaaaaactcattcccacttgctgcatgctctttatatgggaatggagtgaaataatagaaaaaataattgatgccaattatttttttcttcttttcatctgaaaggtagaaagacataattcatccacttagcaaccttgggtaatttgtttctgttaccattttacaggccaggggccaaatgtgttttttaaaaatgtgaatgctcttagtctcattggaaataagttgtaaatgcttaccattttcatctcttgtcataataatgccagaagactgtgagggcgggcttatagttccaacagcatttcttgcaattattctgaactcatagcgatccccaggactgagtcctgtaactgtgtactgacattcactgacgtcagtaaagttgcatctcacccagcgttcatttccttgccgtttctcaatgctatagcccacaatcttactgcctccatcacgcaatggtgggttccatttaagtgtgatggtttcccgggtgacatcaatgtagtcaggagtgccaggtgggtctaaaaaattataaggaaggtaaatgcatcattacatttgtaaccaggtcttaatcatccatggaagaacaatacaattattctataattttaataaataagtaaaatttttataataagtaatttattcaatctcccaaactcatattggtcattaatttcaactttccatttcatagtctttaaaatgaacttcaaattagtttattagactgacttaaaataattcctcttgctttacatgaccagttctctagtgacaagaagatatgtaagaaggtgatgcagagaagaaaagcattccttgatatatttgtttctaatatgttcaattgctaaactaaatgtatttgaataataatcacttacctactggagaaacagctaaggtaaatttgcttgggtcactaggtgagcttaggccagcagaattttcagcatatacacggaattggtaatccagaccttctaccagtccagtggctctatattctcttccagagattggtgatgtattaactttttgccagaggatgctatttctttctttcttttcaacatggaatccagtaacttctgaaccaccatcataaactggagcatcccaagttagtgacatgccatcagaagtcacattgtatataactggctttcctgggggaccaggaatcctgaactggtgttttgccacaataatgcttgagacaagtggttggctgactccgtatctgttttctgctctcactctaaactggtactcagcatctttgactagattaggaactttgaaagtcgttctggcaacacttgaacacaccatcttccagttagtttgtgaagtttcccgcttctcgatgctgtaacaagtaatttctcctcctccattatcttcaggtacatcccatgacaggatgacactatcagccttgatttcatcaaatcgaatgggtcctttgggctttgatggtgggccaagggtgatgactgtaatggggactgcaattctacacactgcattatcaagaataacagtgtattttcctccatgctccttcttggcattcttaatactcaaagtaattttgttttcagttttactgaagcgaacaaattcactttctttcagtggcaagccatctttcagccaactgatggatggtttgggttttcccttataaggtaattcaaggtgcacattgtgcccaattctcacagtgacttgtgccccagggatatctgacaggtcaacttcaggtgtaataataagttctttcactgtaattggcccaatagtgacaggatcactcagtcctttctcatttttggcaaacactctgaactccaggactgactgctccttaagttggctaacctcaatttcacatgtcttacttatgccagcgtgggaccacgtctgttcacctttacctttcctttctacaacatattctgtgatgacgctaccaccatcaaagtcaggtttggtccagctgaggatgacagatgtctttgttgagtctttcattgagagatcacgtataggagctggtacttcagcagccttcactggctctgtagtttcacagggttccccaattccaatttcattttctgcaagaactctgaagaagaatggagtcttctccgacaaatctattagcttgaaggatgtgctagaacatttgtgtgacacgacagaccatgttctcttggtggcatctctcttttcaatgacataattaattattggagatcctccatcaatgagaggaggatcccagagcaaagtgactgtgcctcgagaaacatgtttaacctgtagtttctggcaggcagctggtgtgtcaagcactttaacactcacagttgaagacttaggttcaccaactccattttctattgtgagaatatattttcctgtatcattgcgagtaacttgaggaatggtgagtaatgaggatgaatcagtgttttcaatgctgtatctggcatcactgccaagattcttctcatcttttctccatgtgacagtaggtggaggtctgcctttaaagggaatcaacacttgtacatcttcaccagctttggcaataacagaagttctgagagccacatccaggtcaatctctggtgcctctgtagacataaaatggatacatacagtgaattttaaaagcaaaaaagagtgatttcctggaagtatgcttattaaaaaacataatcaaaccagtaggtacataccaagtatatctttagcttgtacaggttcattcatttctataggttctccttgtccagcacagtttacagcagatacccggaagtagtaattgactccaggtttcaggttggataccacatattctgtagttctgacctctcctttggtagagacagtagtccattcctcttcctctccttgtcttatctcgacaacatacccagtaacagcactgcccccatcatagacaggcttactccagccaagggtgatggatgacttggttgaatctgcgattcttatcttagcaggtggacctggaggatctggaatggccattcacaataaaataattacacaatcatgtacaatttagtcacacaggtgaatatagaagacacaggtgaagatgctgcaggtatgagcacttaccaataggatcagcagctttgtagaattcagatggttcagaaaatggaccctgtccagcagcgtttacagcacaaactctgtattgatagtcactgttttctgtgagtcctgttactttttgtctggtgtcacggatagtctcttttagtactttaaaccatcctaggctcttcttgtctcgtttttcaaggaaatagccacttatatcactaccgccatctgcaattggcctgctccatacaacagtcatcgaattcttggtaatctttgtcacttctggtatgcctggtggcccaggtgtaactatttagaaaggaagggaaaacaaggtacaagaatccacattactgataaattatacctttgatgttcgcattctttccaagaacattggttttattttttatatttttcaccttgtgaaaaggatggtaatgagacaggtgttatataaaagaaaattaaagcatatgcacaggttagcgtagtttatttttaaatttttcacgtttcagttttctaatgaaatcatgtctcaccaaatgcgttcttggctacaacggaatcagattccagtggctcgccaattccatatttgttcacggctcggacccggaagatgtattcatttcctttgataattttggtggttgtaatgatgcactcttccaaatgttcagacaccatagaccacacaacgcggcttgtctcacgcttttccacaatgtagtgagtgatttttgcaccaccatcatcagctggaggccgccagagaagggtgatcttctcagcagttacagtcttaaattcaattggtccaccaggtgggcctggtttgtctatcagtgaaaggacaaaacacgatgttagtacttctttaaagcctacttgttcaaaattactaagctttaggcaaatgtaatatgacagtggtctgtattcagcacctaccaaggatctgtactctgatggtggctgaggctgagcccatggcattccttagttttaattcatagcatccactattaaggcgatcggcatctttgatgagtatagatgcgaggtccgtggtattttcaacacacaccagtgcattggtttgtaattctttatcatctttataccactcaatagtaggcgcaggtttgccagaaatgccagctctgagcttcacagatgtacctgctctgtatttgacaacttctgtatattctagaggcaaatcaattacaggaccacctgcaagaaaaacagatgagaaatatttaaaatattataaggatggaaaaaaaaatagttgcaccaaccttaaagtaaggtcattggccattattaaattatacacacacaccatcattataattctatgcaattattatttaaaaattaaaaatttataggccactcttctatctcagatggggtagaaagactgtgagttgtgcagggacttaagcaccttttacatgtgttttaaagtccattagttgctttattccagtgaagaaatgggatatggtagtgagaacatcatggaagaagctgttaaaacatttcctttcactttagcttttctttccttttcttctacgcacctcctattctttttcttttcccatcccagttcactgatatccaagtgtggatggttcatgtcagacacttaaagtctgaattctctacccacagagctacataattactggacagattttctgccatgctgtttggaattatcaagaaagataactaaattcgacttgctttatactctcataaacactgattcagtatccacaaagcctgattcataaataatgaacagccctgagattctcagcatgaagatggaagtggatacttttgcccagacactacagtggctcaattttctcttagcaaatggagatcttttaggtaaagtgtcacaggatacctgactctcatgacgttttaattttcaaaacattgttgagttgaatgtgccacttattttccagaatggtgaagaatacgcattttggactaaccatgatagagagggctctgaagtctgtctgtctgaattcccactccatccctaacggggaagttacaaaagcactctcagcctcagtttcccttctataagatggctaatatgagggctgtgagaactaagggaaagaattcatgaaaattcctcaataaatgttagctgctgctaatactatcatcatcaaagtctgtgtttagaccaggcatggtggctcacacctgtaatcccaacactttgggaggccgaggtgggtggatcacctgaggtcaggaggttgagacctgcctggccaacatggtgaaactccgtccctactaaaaatacaaaaaattagctgggtgtggtggggcatgcctgtaatcccagctactcaggtgactgaggcacgagaatcgtttgagcccaggaggcggaagttgcagtgaaccaagaccgtgccactgcactacagcctgggcgacagagtgagactctgtctcaaaacaaacaaacaaacaaacaaacaaaaaaaaaaaaaccaaaaaatgaagtctctgtttagtctgtggcttatttaagagcaatattctctaggaactcaaccatggtttaattattgactctgataatttaaaacagaatgaaagcaccaactcatacaatcaatcataaaaggttgaagttggaaaggcccatagatatcctgaggtctaaatctctcactttacagtcaagtcaagagggctggaaaggtatttaaggaattttcctcagactcccagctagtccataatttcttccaaaaaccccattaaggcacagagtaaaagttattctataggattagaaccaggaaaaggtatgcggaaatactgagttaaatagcaattttgattcaaagtgctaagcatgcttaccataagaatcgatgcaagtaatgggccctacaacctcagatggattgctaatggaaccaacagcattcctagcaaagacacggaattcatactgggaattctgagtcaagccagagatgatgaattgagtttcagtaacattggtgaagctggccttggtccatctgccatctggaaggtcacgtctctcaacaatgtagcctgtaatcttgctacctccatcgaaagctggttgttgccatgaaaggctgacagagttctttgaaatatcagtgatacgaacatttcttgggggttctgtggtaataagagaagcagattagcggcacttataatattttgcttcgcagaagtaagatttgcatttttgttatcagaactgcccttcccatgacaaatacgtaccacaagcatcaattgccaagactggttcagaaggatggctaggttttccaactccagcagcattttctgcatacaccctgaattcataaataagtccagcactgattgttgtgactttgaagtgagttgtgcggatgaccagtttgttggctttttgccataaaatactgtttctgtctttcatttccaggtgatagcctacgactgcactgcctccatttgacactggttcatgccagcccacagtgatgctttctcgagtaacattagtgacccatggtgtagatggtggtccaggtgttgctacaaaagagagaaatcctatagattagtacagacaataacacatttatggtaaaagaaaacctggatctttgaaaagttggacaacttactgtatggtagtttgacagtcacacaagctgaatctatatgatcactgatgccaaagcggttttctgccttgatgcggaattggtattcttctcctgtggtcagtttcatgactttcatcatggttcttgcaactgttgcagacacttcagtccacactgcagtacttgtttctcttttgagtagaatgtagttggtaacttgacttccaccgtcatacttaggtggctcccatttgagagtcacactttcttcagttatatcactaataacaacagggccagttggaggaccaggcctgtctagcacaacaatgttaatgaaagctttggttgtaccactggagttggcagcagtgatttcatatctcccagcgtcagctgtaacactttctttgagattgatggtcaggttctcagcagtaatttcggtattaaatctcatggttgccttaagggggacaccatctcttgataaggtcactttgggaagtggttttccagagattggaatgtcaactttaaggtttgaaccagctctaacatatacagtgtgacttgggaaattcttcatatcaatttcaggtggttctgaaaaatgagtatagaaagtgaaagtgaaaaagtgtttctgaaaattaacataaatcaatgcaaataatttcaaattttgcttctacacaaaattagacatacctagttgctccttaataagaacaggaagcagaagctctctcgggtcactcaggccagcttgattttcagcaaacactcggaaaaagtattcagaattctctctcagaccggaaacaacgtgatgggttgactttgccactgcacatttaacccagtttttctgtcctttttctagtgcttcaacgacatagtgtacaattctgcttccgccatcatgttcaggcttcagccaggtcagggaaacactgtctttggatatacttgttactccaagtttttcaggtgggcttggtttttctaagaaaacaaagcatcaaaagaaagtgaataattattacagcacttttaaatgtgcactcttcatgtattgtcaaaagaaaacttttaaatgaaggccatatttttatgttgattttagtcttcctttttacataacccattttgcttctgaaccaaccaaggctcccacaagctatgtcattacatgctatagcattcaaatccaaattaagggtaaaatgaccagattaaatgataaaatttactccaaattcaccatggggataaaaaagaggaacaagatgaacaatcttttaaaaaactttatatacaatttctgtacacacgcacatacacacatatgatatatgtcatacacacatactatatatatataatctgtgtatatatatatataaacatgtatacctacatatatatacagttagattcaataatacttaaattcaacatatattatccaattttagctacgtaaatttctgtttttttaatcaatgaaagactcttcactagagattccattttgtgccatagtatgaatagtttggggtgtgaagggtgtgaacccaaaagcatttaagatgaaataacgactaattagaatgactcacactattctagcaaaattaacgtggatatgtagaatttccttattcttaaaacatacctgttatttttactccttcctttgtttcagctggtataccaacaccaaactcattttctccagagactctgaagtaatagatagctccttcttgtaaattggtaactttgtaggagaggcggttacagttgttggtcacagagacccatgctttcttgctggcctcacgtttttctatgtggtaattcttcactggtgctccaccatcgttttcaggaacatcccaggataacactgcagactctttggttacatcttgcacagtaatgttggttggaggacctggggtatctaaaactttgacaactaaggtcagtgaagcagcactcaaaacattctgaattgttaatgtgtactttccagagtcatttctgttggcattttcaatggtcagtgatgtacgagagtctgtggtatcaacataagctctagtacggaggtcagtgtctggcttactccacaagacattgggtactggtcttcctcggaaaggcacagtcatggtaaatgaggcaccagccttgacaatcaaggtcttcctcatttcactgtcaatatcaaataaaggttcttcttctctttcctttgctatctgagggtcagagctatcactggggtcactagcaccaaccttattgacagattttactctgaaaacatattcagctcctgttgttagtccgcttattgtatattctgtccctcgtaagctctgaatggaagttttccagtcagtgtcatcagattttttgtattctacagtatatccagttatcggggccccaccatcaaacagcggcttaacccaggcaatagttatagttgtcttgcctgagtccacaattttgggtttggatggaggagatggtaggaacactggatcttctgccctaattaagggagaggtttcacttggaagacttaggccagcagcattttctgcataaacacgatattcatattcacatccttcccgaagtcctgttgatttcactcttagatcataaactggttttttgtttacacgcacccatcttaggctatttttctctcgcctttcaattatatatccagatatttcactacctccatcactctcgggtcttgaccagcaaagtgtcatagattctttggtcacagaagtaatttccaaagacgtgggtggacttggaactgtaaatggatctagtgcctttatagctacactctctaggggctcaccaacaccatatttattaacaccagttactctaaatatatattcattgcctttgagtaacttggttactttacaggatgtcatctgtaactctccttcacatattgtccatgcaaggtggcttgtttcacgtttttctacgatgtaatagtcgatatctgcaccaccatcttcttggggacgtccccaggaaagagagcatttctcagcagtgaggccatttatttcaagtggtcctgctggtggaccaggcttatcaagtactttgcaattaacggccacagaccgagtgccggcaacattcttcagtgttagtacatattgcccagtgtctcgtcttatacagtctttaactgttaacaaagtatgattgtctgttgagatgatttctgttcttgctctttcttcaatttctataccatccttggcccaggaaattactggcagaggtcgccctgcaatgtctgcatttatcttaaggacctctccagctttgacaacaataacgtctcggaacttgacatccatcataactcttggaggctcaacatcatctttaactataataggcccagtggattcagatggctcactaactgagtcagcagcattccttgcaaaaacccggaattcataacgctgatcttcagtaagttcagttacttcaaagtatgtttcttgtatattagtataattgcacttcagccaccggccatctggtagttctctgcgttcaacaatgtatcctgtgatcttagctccaccatcataatgtggtttagaccatttaagtgacactgattttcttgtgatatttgtgacttcaggttgtccaggagggtcacaaggatctcttgcagggactggttcacaagatttactgcatttaccaattccagcaatattttcagcatatacacgatactcatacatcagtccttcatcaaggccggagactttcatttgagtatcagcaatgaggattttatttgcttttgaccaaagaatgctgcttctttctttatactcaagatgatagccaattactcgacttcctccatcattaactggcacttgccaggttacaagcatggtagattttgtggcatgcacaactttaggagtaccaggaggacctgggggactgaatggatactctgcaacaacagctgaagattcactgtaggagctctttccatagcggttttctgcacaaacacggaactgatactcacttcctgttgtcaggcgaactattttaatggatgttcttgcaactgcttgtgaaactatgtgccatgttgtagaggtggtttctttcttttcaacaatgtaattgctaatttggcagccaccatcatattctggaggattccaagaaatggttatgctgtcacaactaacctcatcaatacgtataggacctggaggtcctggtctgtcaaggacaattatagtaataggaactgttatggatccagcactgtttgaaacacataattcataagttccaacatcttcctttgaagcttccttaatagatagtgatgttacagtctttgaagaagaaacattgactctagttgtctctttaagagtctgaccatcttttctccagttcacagtagcttgaggtcttcctttgaatggcacatcaatcttaagttgttctctagcctttacattgaaagtatggaaaggaagctcaactgaaggctttatttcaatatcccttgcaattactggcactccaagttgtcttggatcacttcttcccttttcgttaactgcagctaccctgaagacatactcttctcctgcagttaagccagatatagttgcttctagagtcttaacttgtgtgcaggtgctccacttttcactccctttagtctgcatttcaaccacataaccagtaattttgctgccaccatcactttctggtttctcccacttaattgtagctgtattacgggtcacatcaacaagagttactcttccaggtgggaggggtggttcagacactttaacgggttctgttgtttcagctggcaaaccaatcccatattcattggaagccaagactcggaagtagtaagaacatccttcttgtagattttcaattctgaaagtagttttagtgcaattatttgtaatggtagcataggcttttcttgtagtttctcgtttttcgacaatgtagtttgtaatcttagctccaccatcaataagtggtggttcccaggacaacgtcactgagtctttcttcacttctcttatggtcaaattcacaggggcacttggtgagtcaagaactctgacgttaacaaaagctgttttggagccactattattttctaatgtcagattataccgaccactgtcaaatctggtaacattatcaatcaccaacattgtaaatgagctggtcacctctatctgagccctgtcagtgagaatgccttctgccttttcccatttaacttcgggttctggtcgacctttgatagtgacaaataagcgtaaagtagcacttgcacgcagaacgaccacctttctgagatcagcatcgagttctatttctggtggctctatcctctcctgagcaaccactgagccaggtagagttgcaggttcacctacaccttcagaattgatggcacaaatacggaagttatattcagtgttttctttaagcttggtcactgtgaactgctttccttgtaatcctgttggtggagtgcaggttgtccattcatccgcagcagcttctttgacctctacaacatagcctttaacaggtgcgccaccatcataaattggcttactccatgccagggagacagaagatctggaagtgtccgtcacttttggattgcttgggggacctggtggatacaaggcatcacacgcacggtagaaaacagatggctcactaggttctcccacaccagctgcattttcagcagcaactctgaattcataggaatggccttcggtaagaccagttaccctgagccgcagatccgttaatgttttcttgttgcacttggtccatctaacgccttccttatctcgtttttcaagaatgtagccctcaatttcggtacctccgtcgtctactgggcgtgcccatgttactaccatagaatctttggtgattgctgagacttcaggtgttgagggaggacctggtggcttataaggattacaggccgtaacaggcccagattccaagggctctccaattccatatttattcacagccatgacacggaaaatgtactcattaccaggaagaagtttagtaactttgtagttaagggcctgtacctcagttgaaacctgggtccaagagagtcggcttgtctccctcttttcaatgatgtaatgtgaaatattagcaccaccatcttgcaaaggtgggttccatgccaggtaacatttttccgcagtaactccagtaactttcagaggcccttcaggaggccctggcctgtcaagtacctttacagtgatgggtatagactttgtaccaccaacattgctgagtttcagaatatattgtcctccatcagtccgtatacagtctttgacaacaagagttgttttctgaatagtagatttaatttccattctagcagctgtttcttcaagttcttttccatcttttgaccaaacaacatcaggtataggtttgccacggatgtcggcttcaagaacaaaagtctctcctgcatgaacaacgatgacatctttatattttggatccagagaggcatttggtgcatcaatttcatctcttgcagtaatggcaccactactatcagatggttcactaaagtttccagctgcatttcttgcaattactctaaattcatatctttggtcttctacaagtccactcactgtaaattcagtttctaatacgttggtaaagctggctttcatccagcggccatcaggtagatctttcttttctacaatataacctgttattttgctaccaccatcataggcaggtttcttccatttcagtgtgacattgtttcttgtaataacaatggcttcagggcgaccaggtgggtcacatggatcacgagcaacaaagcattctgacactttgctaggcttgccaatgccaacaatattttcagcagaaactttgaactcatactcaaggccctcatcaagcccagttgttttgaatttggtgtcctgaatgggggtcttatttaacttgacccataaaatactgttcttttctttctgttcaagatggtagccaataattttggtgcctccatcattcactggctcatgccattgcacaagcatctgatcttttgagattgatgtcacaaaaggagttccaggtggtccaggttctttaaatggatattgtacaataactgccttagaatccagtggggcactttttccatacctgttttcagcaaaaattctaaactggtactccgtgcctgttttcagtttggttattttaattgttgttcttgcaactgttgctgataccatgtgccaagtggtggtggttgtatctcgcttctctacaatgtagttgcttatttggcagccaccagtataggctggaggttcccaagatatgactacaaagtctgcactaacttcatcaaaccgaactgggccaactggaggtccaggcttttctaaaacgataacactgagattttctgttgctgtgcctgcactatttgttgccgttacggtgtattttccaaagtcatctttgttaccttctttaatgtgcaaaacagttgaggtagctgtttcttcaacgtttactcttgttgtctgtttaagaggctcaccatctttgacccaagaaatgttaggtcttggtcggcctataactggaatttctattttaagatcttctccagcttggatactatatgtgttaaatggtaactttaaactaggctgtatagtcaagtccttggctatgacaggaacacccaacactcttggatcgctttttcctttctcattataagccttgacacggaactgatattcttgtccagaactcaaaccagtaacaactgcattacagactttggattcagccacaatgctccatttttcagttcctttgggctgcatttcaacaacgtaccccaggactctgctaccgccatcatgttcaggtttctcccacataagtgatgcactggtctgggacacatcagtgagtgtaacctttcctggtggggaaggaggttcagcagctttcacggcatcaacagtttccactggaacaccaactccaaattcattttcagccatgactctgaagtaataaatggctccttctgtaaggttttccactttaaaacttgttttgctgcatttactactcacattagcatacgcttttctggttgactcacgtttgtcaatcacatagttcttgacctttgcccctccatcaatgatgggtggctcccataccaggaaggcagaatcttttctcacttctttgactgccaaattctgtggtggtcctggagtgtcaagaactttcacagttacaaaagcagactttgatccactgctgttttccaacttaagaatgtattttccagcatcatttctatcacagttatctattgatagttgggtatagtttactcccttttcaatttggaccttatctgtgaattcaccttcctctcgagaccaagtgatctcaggcgttggacgacctttgaatggaatgtgaattctggcagatccaccagctcttacaacaattccttttcttaattcggagtcaaggtcaagttcaggtgcttcaagtttatcttctggtttcacagtaccaggaactgatgtagcctcacctaaaccaactttgttgagggcacagactcgtattttatactcttggtgttcagtgagttttgaaatttcaaatcgagtgactctcaggccagtctgtggagtaactatttgccattcttcttcatctgctttacagatttctactacatatcccaagatctcactgccgccatcatagatgggtttaccccaggcaagtgtgattgaatttttagtggtgtctacaatgtgtgcattggtaggtgggccaggtttgaacacaggatcacaggctttataataaactgtagctggacttggttccccaactccagcagcattttctgcagagaccctgaattcatactcatgatcttctgttaatcctgtcactcttagacgcaaatctgtaatgcggcgtttattacattttatccatcgaatgccacttctgtctcttttctctacaatgtaaccaataatctcacttccaccatcactatctggacggttccaacagacggtcatggagtctttggcaatatttgtgacttccaagctttttggtggtccaggaagcacaaatggatttttcattagtactggtgcagattccaaaggctctccaacaccatatttgttgacagccattatacggaaaacatattcattaccttctaagagtttggtaactttcagagaattggtcacaacttctgaagcaacaacagtccaggcaagtcgactggtttctcgcttttcaacaacatagtgagaaatgtcactgccaccatcttgaagtggtggagaccatgttaaagagcatttttcagaagtgactccagtaacctggactggcccttctggaggtcctggtctatctaatacttttacatttactgggaatgacttagaacctgcaacattggaagctcttaaaatatactgcccaccatcaattctaattgcatcttttacaataagtaaagccttgaaatctgtgttctttatttcacatctagcagattcttcaatttccttatctcctcttaaccactcaatggtaggtaggggctttccatggacatcagcctcaagtctgaatgtttctccagcatttaccacaattgtgtctctgaattttggatccattgaaattcttgggagttcaacctcatccttggcagttattggtccagtactgtcagagggtttacttattgcaccagctgcattctttgcaatgactctgaattcatatctttgatcttcagtaagacctgacacagtaaattgagtttcaatgacatttgtaaagctagctttcatccaacgaccatcaggcaaatcacgtttctctacaatgtagcctgtaatcatacttccaccatcatacacaggtttggtccactgtaaagtgatttcatttcttttaaccattattggttctggggttcctggtgggtcacagggatctctggctacatagcattcagaattcttgcttgctttgcctacaccaacaatattttcagcatacactctgaattcatattcaatgccttcttcaagattctgtgctttgaattgggtgtcatgaataatagttttgttgacctttgtccacaaaatactgtttctttcttttctctccaggtggtaacctatgacggggcttccaccattgttgactggttcatgccactgtatgaccatggagtctttggaaatggctgtggcaaatggtgtacctggagggcctggttctttgtagggatattgagctacaattggatcagactctaaggcaaagctttgtccatatctgttttcggcaaatattctaaattggtattctgtaccagttttcagtttggtcactttgagtgtagttctagcaacagtagcagaaacaacatcccatactgtggtggttgtatctcttttctgaacaatgtagttggtgatttggcagccccctgtatataatggagggttccaagataatgtaatactttcagcactgacgtcatcaaatttaacaggtccttttggaggatcaggtttatctagagttacaatttcgatggatgctgtcttctgaccaacaacattggcaactgtgattccatattgtccaccatcatccttatgagtttctttaatactgagtgtggtgagatccagtgaatcggtaacattgattcttgtggtctgcttcagtgggagaccatctttagtccaggtaatggttggcttaggacgtccagaaattggcacttctattttcaaatcttggccaacctgtacactgtaactactgaatgcaggttttacatctggctcaattaccagatctttggcaactattggaactgcaagggaccgaggatcacttctccccttttcatttacagcaacaactctaaaaagatattcttccccttgagttaggttggtaattactgcctgaagagactttactcgagcacactctgaccatttctcactgtgtttagcttgcatttccacaatatactgaatgattttactgccaccatcatgttcaggttttgtccaactcagagagacactgtttctggtgacatcatccacagttatttttccaggaggttgtggcacttctgcaaccttaattggatcagcagtctgggcaggaaggccaataccatactcattctcagctgtgactctaaagtaataactgcaaccttcttggagctgatcgattttccaagaattcttatggcagttagttacaacagcagcatatgattttcttgtggcttcacgtttctcaacaatgtaattttttattttggatcccccatccaacaaaggaggttcccatgtaattgatactgagtctttggtgatttctgtgactttcaggttaacaggtggacttggcgtgtccagaactctcacagtaacaaaggcagactttgttccactgctgttttctaatgtaagcgtatattttccactatcatatcggttgacattgtcaagaacaagagaggtgaaactgctagtgacatcaattatagctgcatctcggatttcaccatccacctttccccatttaacttctggtgtaggacgaccttttataggaacaaataaccttaaggagccacctgcccttatatttatgattttccttagttctaggtcaagatcaatgtctggtgcttctaatttttcttcaactataataggtccagggacgtcagcatgttctccaactccagctttattaatagcacagatacggaagttgtattcatgcttttccaacagcttctctacttctatgtttgttttattaattcctgttggtggagtgcacattgtccattcaccaacactcacatcacatttttcaacaatgtatccttgaatttcacagccaccatcatatattggtttgctccaagaaaggaatactgaagatctggttatgtctatgactttggggttgtttgggggtcctggtttataaataggatcacaagccttttggtaagcagaaggagggcttggttcactaagtccagcagcattctcagcagaaactctgaactcataatcgtgattttctatgagtccagttactctcaggcgcaactctccaatcagacgcttatggcatcttgtccatctaatgccttctttatcccgtttctcaagaacatatccaagaatttcactaccaccatcagatgctggtctttcccatacaacaatcattgagtccttggtcactgttgtgacttctggagcttttggtgcatctggtactacaaatggattcttggcaactactggctcagattcaagaggttcaccaacaccatatttgtttactgccattatacggaaagtatattcattgccttcaagaagcttagtaaccttgcagctgagagtctgcacattggcatcaaccacagtccaaactaagcggctggtttctctcctttccacaatataatttatgatgtcactcccaccatcctgaagtgggggtttccaagctagtgtgcatttttctgctgtaactcctgagataacaacaggtccttcaggtggccctggtctgtcaagaaccttgacattcacagtaactgatctttctcctgcaacatttttggccttcagtatgtaatttccactgtcgacacgtactgcatcttttacactgagactggtggcaaagtcggtgctctttatttctaatcgagctgtgtttgaaagctcctgatcaccttttatccactgaatggttggtattggtttgccataaatatctgcatcaaccttgaatgattcaccagcatgaaccacgattgtgtctttgtattttggatccatacttattcgtggtggatctacctcatctctagctgttattgctcctgtgctttctgaaggctcactaaacactcctgcggcatttcgggctataacccggaactcatatctgtgatcttcaactaggccagttacttcaaaatgagtgtcaataatatttgtaaaactggctttcatccaacggccctcaggtaattctttcttctcaacaatataaccagtgatcttgcttccaccgtcataggtgggtttcttccactgaagagtcacagaattccttgtgacaatgattgcctctggccgtcctggtggatcacatgggtcacgagccacataacattctgatactttactcggcttgccaatgcccacgatgttctctgcagagactctaaattcatattcaacaccttcttcaaggccagttgtcttaaacttggtttgaggaataggtgttttattcaacttaacccagaggatgctatttctttccttgcgttctagatgatagccaatgactctacttcctccatcactgattggctcattccattgtacttccatgctgtccctggaggacagtgtgacaactggagtgccaggaggaccaggaactttgaatggatattgggctacagtaggctctgaattgaggtaggtactcttcccatatctgttttcagctgcaattctaaactgatattcacatccagtcttcagtctgcaagcctttattgttgtccttgcaactgtagctgatacaatttgccaggtggttgtggaagtgtcccgtttctcaacaatgtaattattgatagaacttccaccatcatacttgggtgggccccaggaaagagtaatactatcagctgtcacttcatccattttaactggtccagttggaggccctggtttgtcaagaacgataacattaagggtttcaatagcttcaccagctgagttagtcagtttaaccacataatggccaacatcttctcggcaggcgtcctttattgtcagtagtgaattattttctgtgctctctgcatttactctagttgtctgcttcagtggtacattatctttatgccaggttacagctggggtagggcggccaatgaatggaacatcaacttttaggtcttcacctgccagtacagtgaaagtattgaacaggagtttgaaggctggtggaatgacaagatctttggcgatcactggcacactcagttgtctaggatcactgatgcccttttcattctgagctgaaacacggaaagagtattcttcaccctgaattaatccagtgatagtggcttcagtgaccttgactgtggcacacgtggcccatttgtcactgcctttggtctgcatctccacaatgtagcctagaattcggctgcctccatcatgctctggtttctcccaagagagtgacacactatttcttgtgacatccatcaaagttatttttcctggaggaagaggtcgttctgatgctttcacagattctgcggtttcagcaggcagcccaatgccatattcattttctgcgagaaccctgaaatagtagctacagccttcttgaagctggtctaccttccaggaagtcttgtggcagtttgttgcaacagttgaatatgcttttcttgttgattcccgcttttcaacaatatagttcttgatttttgaacctccatcaaggagaggtgggtcccatgtgagtgtgacagatgtcttagtgacctcttttaccttcagatcctgtggggggcctggtgtatcgagaactctaacattgacaaatgcagacttgctgcctgaactattttctacagttagtatatatttgccactgtcaaatctgtttacatttccaacaataagcagggtgtaagagcttgtggattcgatgctagctttatctaaagattctccatggtcccgggcccacttcacctcaggtgcaggccttcctttgatgggaacaaaaagtctcagggtgcagcaggcccttatagtaacaactttgcgcaggtcagcatccagttcaatttctggaggcagcattctgtcttcagcctttggagttccaggaacaagggcaggttccccaagtccttcggaattcatggcatagatgcggatcttatattcctgattctctgtgaggccagtgatagtatacgaagttgccttgagtcctgctggtggagtgacaatctgccattcatcttcctctggcagggcaatctcaaccatatacccagtgatttctgaaccaccatcatagataggtttattccaagcgattgaaatggatgatctgcttgtatccagaacacgtgggttacctggtggtccaggtttaaacacagtgtcacaagccttgtaaaatggactggtaggacttggtgcactaattccagcagcattttcagccataatcctgaactcatattcatgtccttctgtcagtccagacactttatatcttaaatcagtaagagtttttttgttgcatttaatccagcgttggccagctttatcacgccgttccacaatataattgatgatttcacttccaccatcagaatcaggatgtccccagcagacaaccatcgaatctttagtaatagttgtcacttcagggtttttgggcggatcagggggtccataaggattcactgcaagcacaggctctgattccagtggctctcccactccatatttatttacagccatgacacggaatatgtattcattgcctttcaagagtttagtgacctttagctttgttacttggacttctgaggctacatttgtccatgccaatctgctggtttcacgtttctgtactatgtaatgatcaattttggcacctccatcatccagtggagggaaccatgatagtacacacttttctgatgtcacttcagttacagccaaaggtccttcaggtgggcctggtctgtcaagaactttgacattgaaaatgtgtttagcaaagccaccaggattagtcgctgtaagggtataggcaccactatcccttcttgttgaatctttgtttaccagattagtagagaaatctgcaatttttatttctaactttgctgtgccttccagctcttttccatctttgctccattccattgttggaggtgggcggcctgaaacatcagcttccagtctgaatgcttcacctgcttttaatataaccgtgtccttaaatttaacatccacctttatctttggtgcctcaacatcatccctgcaagtgatagcatcagatggctcagatggtggactgatggcacctgcagcatttttggcgatcacacggaattcatatgcagcatcttctgttaggccactgactgtaaattcattctccaaaatgttgctgaagttggccttcagccaccgtccattaggaaggtctctcttttcaacgatataactggtaattttaaagcccccagtatattcaggcttagcccatttaagtgttactgtgtgtcttgtaatatttagaggtactggttttccaggtgggtcaatgggatccagagccaacataggttctgatggcttgcttggcttacttttgcctgccatgttttctgcaatcacccggaactcataagcaataccatctgtaagtccacttgatttgaaaatgttgcctggtactaaagctttgctcacagtctgccagagaataccatttcgttcttttctttcaacatgatatcctaaaatggggcttccaccatcagaaagtggctcatgccagctaattgtcattgaatccttggtaactgcagttacctgaggggtaccaggaggtccaggaaccttaaatggatagttggcaactatgcatgctgatgtgatgcctggtccaactccatatctattctgagcttttacacggaactgatactctaatccagtagtaaggcgggtggctttataggtagtacgtataacggtggttgctaactcaacccaggtagtactgtcagtctgccgcatttccactacatagttgcttattggtacaccaccatcgttctcaggtgggtcccaagagaaggttacaaaatcagatgaaacttcatcaaatttgattggtccagtaggtggccctgggatatcatggacttgaatggtgatgacatcaccaacctctcctacaatgttccttgctgttaatggatagggcccactatcacttctgacacactcattgatatttaaaatggttgaagtcgctgtggtttcaaaattaactctctgtgtctgtttaagaatttggtctccttttttccatgtcactgtgggcttcggtcgaccgagcactggaatttcaactttgatgttgtcaccagctttggcaatgaccagtttctgatagatgccacggagatccagctctggaagcattgtctgctccttgacaatgacgggtctgctttctctaggggcacttctccccgcgctgttcactgccatcacttggaaggtatattcctctccttcagttagattcctcacaacacattctaaccctttcacggttgtgatgtgggtccactggtcagagccttttctttgggcttcaatcacatagccagtgatcttgctgccaccatcgtgtttgggcttaggccatgccaggctgacggtgctcttagttatgtccatgatgttaaggctgtctggtggagatggtgcttcagaggcttttacgggctctgtagtttctgttggctcaccaattccatattcattctctgccatcactctgaagaaatattcacacccttcagacaagccggtaactttatatgtgcatttatggcacttagtggtggctgtggaataagatttccgtgttgcttcacgtttctctacaatgtagtttgttatacgtgagcctccatctatcagagggaggtcccagtgcagggtgacactgtcctttgtgatgtctgtaggccgcaggttgaggactgggcctggcgtgtccaagactctgacgttcacaaagccacttttcttcccagccgggttttcaatggtcatgacaaatttaccggtatcatatctgttacattctgggataatcagaagagtaaatgattccgtattttcaatgttggctcggtttttcaggttgatgttatctttggtccatgtcacttcaggagcaggacgacctttaattggcacaaatatcctaatactgagtcctgctctaacaacaagtgttcttcgaagctcggcatctagttcaaaatcaggagccatctcccgttctacgatttcaacatctggaatcaccgctggctccccaacacctgcatcgttgatggcactgattctgaagttgtatttttctttagtctgaagatcaggaacaacgaactgagtgattctgagggcggttcctgtggtatcttttatccaggcctcgtctcctactttttgatgctccacgacatagccagtgatttcaagtccaccatcataatgaggcttgccccatgccaaagaagcagatttcttggtagtatcagtgacatgcggatttgaaggtggtcctggaggatctgagaaagaaacaaagacacaaaagtatatattcagagtttggcttttgggtaatttagataaaatattggcactctggaatgaacggtgttgaaaaagacaaatactaacatgctgcatctttcatcagaacagaatctgaagcctcactgggtggaccaattcctgctctgttttctgcactgacacggaattcgtaggtgcttccttcttgcagtcctgttactttgcacctgagatcggaaactggtgtttttattgctctcacccatcgcaggcttttcttttctctcctttctacatgatatcctgtaatttcgctgccaccatcatccactggccttttccagctgacagtggcagtgttcttagtgacatttgatacctctggtttttcaggagggccagggggacctgaaaaggaagcaaatttattagaaatccatgatttcctaaactctgctataaatgtttccatgtcaattccctcacatgctctacataccaaatctgtctaccattttgacaggttcagactgtacaggttctcctttgccatagtggtttacagctgagacccggaagatgtactcatttccttggataagtttggttgccacatgcctgcaagactgaatatcttcagaaaccactgtccacaaaagtcggctggtttctctcttttcaagtatataggacttaattggtgagccgccatcttccaagggaggtgtccatgtaagtgttgctttttcagcagaaacattactgatttcaacaggacctgggggaccaggtacatcaaggactgttaccttcacatgttccaccttcgtgccaaaaggattggtagcagtgatggtatattcacccgcatcttttctagtggcatacttgatagtaagcatggaagatgttggggttgaagttatctgagtgatatctgatggtctaatgtcttttcctgccttggaccaacttgattttggaaggggtttgccaagaatgctaatggcattcaaaacaatggtatcccctgctttaattgttagcccatcttttattgtgggatcaaggacaattgttggtgcctctgcaaagaaaaaaatacattttaatcagaaaaggaaggaggcttaatttgctttaaaaaaaaaagtacataaaaagtaaaatggacctaccgtattcatccttgcaaataatggtttctgtactttctgatggagcactgatagcacctgctgtattctttgctctaattctgaattcatattttccaccctcaacaaggtcagttacagtaaaggcacattctgggacattaacatggttggctttcatccaagacttcgaaggtagatctcgcttctccactatatatccagttaacttatgaccaccgtcatatttaggttcagtccaaatgagagtcactgaattccttgttatgttaataacctcaggttttccaggaggatctaaaacataaaagcaaaaccagtcaaacaaataccagttttcttcatgtaaaacatgcacctgggtttttcttcatataatgacttaccaattgggtccagtgccacaacaggctctgatggtaggcttggcttgcccacacctgctaaattgattgccataactcggaattcatattcaagaccttcagttaatcctgtcactttaaagtctctcatccttatcggagtcttgttagctctcttccacaaaaggctgtttctttccttgaactcgagatgataccctacaaaagacccagggatgtatcaagtataaatgcagcttgattttacaatatatatgtgttgcccaaattatttatacatatccatatatattgaacaagtagtcattcttgctagtatctatacttttattacccaagcatagtgccattttttttttcctcttggaatatgcatagttgttgtcttttttggtgaacaattttaacttacaaaaatagatattataattaagaaatactttattaactattacattaggatattttcaataaaattaaacattaaccatatgtactgaaataaaaacacatttctgtataagcagataatgttatcgataagcacatgttcaactgttctcagggaaatatttgtgaggaatcttgatgtaaaagctgtaggataagaacaaacaaaatacctgtaattggagaaccaccagttttcttggggtcagtccaagttagagatactgaatcgtgtctgacatccacaatattgggaggtgggggagcatcaggcacatctagaaaaaagtagataatgcaagatttataataagaagcctcctcaaaaccgtgttttgctttacgtcttctgaatttaagacacttaccaaatggatgtctcgcaacaattggctccgatttcaggccttcccctacaccatatttattttcggcactgaccctgaaggtatattccatgccctcatgaagtctggttactctaaaggtggttttctggacagctgaggcgcacgtcacccacttgttgttcacagaatccctcttctctaggatatagttggtgatttcagaacctccatcatcctttggaggagcccactttaaggtcatggcttctgctgtgacttcatcaaatttgattggtccagtggggatgccaggcttgccaacaacctttatggagatagttccttccttggtgccagcaacattcttaagtgtgattgtgtattttccagcatcagatttttggcaatcgtacactataagagttgtgttaaccgcagatgactcaacactgactctagtgtcagttgctagaggatcttcccctttcttccaggagactgatggagctggcttgccttttatggggatcttaagccggaagttgctgttttctttagccaagtagcacaaatcaggtagaccctttaagtcaagatcaggagccactgtaaaatagcagagataaattactgttatttttaaggccaggcgattaactttttcaaatagttctagcttttaacggatttttagataagctagtgagtgggacacaagagtgcactttcgatgacaataaaggaaaaatgaagatgtgtgcatagagccttaccaacatcatcccttgccacaacagtgatttcgcttggggttccttctccattttcattctcagcactcactctgaaggtatattccttcccttcagtcaaatcttttgcagagtactgtaggcttaaggatttcataactcgttgccacttattttcttcagtcaggaaatcaactacatatccaataatccgacttccaccatcactgtgaggctttttccagccaatgctacaggatgacttagatacagacctcactttcaggtccacaactggtccaggagtttctaaagcaaaggagaaatgataagtgtaagccccatataacaaaggaaggatataactcaaaatgatgggatgatggttcatttgcttacgggaagctttgacagcatcacgagtttcaccgggatcaccaatgccatactcattttcagcaaacactcggaagaagtaggattttccctcctccaaattagctactctgaagcttgttttggagcactcagttgtcactgtagaccaggatttcctctctgcatcacgtttttgtaccacatagtttatgatggggcttccgccatcaataatgggaggctcccaggtaacataagcagagtctttggatatttccttaacagtcacattgacaggtggcccaggagtatctggataaatagtaggtaaataagaaatgaatgtgtaaaaaatacataagctattttaaaatatatatgattcttttttgaaatagacttaccaagcactttcacaacaatggtatattcctttttaccacagctgttctccagggttaagatatattttcctgcatcatatttgttcacattttcacagcgcaagaaagtgtcaaagtcagttgactttatgtccagtccaatcctgtctcttagattgacatttggtttagaccaagtaatctttggaggtgggcgtccttttactggtacatatagtctcatagtaactccagcacgtaatatgagtgtcttccttaagtccgcatcaagttctccctcaggtggaactgtttaattttgggtgaagaagttaaataaaaatttaatagtcaaatgtatttccagggactggccttgtcactcctaaaatacatttattttctagagctgatttcttgttctttaaaacttccttaatacaatcctcaaaatcatttttctgttctgtactaattgttgatctttccattttccactatgctttaggcttaaccaggttttccccccggaggatctgtacctcctctttcatgagccttatgtactctgaaatgctacatatattaaaaggaaagtagacgattgatttttggctccctttcattcttgttttttcctttctatattccatgaaggtattctgccacatattctagctctctttattatttcatagtaggaagaaaagtacctggagggtgacatataatatcaagtaattcaaataaaggggaaattatcatggaggataagcaaatagaagaaataagaagaagggaaattaagatggagagcccaccagtcacatacttagggagatggtggattggaaaacagaaaccctaagaatagtaaatagctcactacttagttaaaaggcctctttattcctaaaataaaattcttacattccaataaaattctctcatttcatgtcttttgaagacaggaaattcttatatatatgaaaagcttttcaaaaccacaaatcatgtgcatttgatttgcctgttccacaataccgtaaagtacccacccagctctcctaaaaagtactcttggagttaccagctctacaccttgttaataaattaatctacctaagggagttctagtctccctcttagaatatgattaataggaaaagccttatgtactccccctggtaatacttacttaagatgtccttgggatagtgtttatctggcacatcactggggtcactgtatccaatcttattaacggcatacacacggaattgatattgtgtgtcttccatcaggccagtaacctcaaagcgggttttctgtagattctgtggtaagttgcacctcacccagttatcggagtcagcccgttttacttcaacgagataaccaatgatagggctgccgccgtcataggctggcttgccccaagatagactcacagagctgcgagttgtatcatatactttagggaaagccggtgggccaggaggatctgagaataaataatgataggaaattttcatgaaaacttccttcctgggtgtttaatgctgcttttaacacaggatatggaactcgttcatgaacacttacactgagggtcccgagcataagcggccttggatgcgtcactgggtttgcctggtccagctttatttatagctgtaacacggaactcatattcggtaccttcttgaagacctgttgcttttaatgttctttctataataggttttctgttgaccttagtccagttaacagcctgggtttcccgcttttcaagcaaatagccagtgatgggtgagcccccatcatctgctggtggcttccagctgactgtcatgtgatctttggttatgttgctaataacaggaggatcacagcgtcctggtgggtctgcagaaattgattgaaaagttaatttcccaggctaaaagataattttaaaaaataaaatgaaaaaccaccgggaaatgttcctaccatatgggtttttggcaattgctggttcagtgaagactggatcgcctactccatatttattttcagcacaaatacggaactgatactcatggccctctataagtttctccacgctgcagctggtgataggcacagttgcagagacttgagcccagttgggcctgcttgtttcacgtttgtcaacaatatagttggtgatttctgagcctccatcttcaagaggcggttcccaagaaagcatagcacgatctgaatacattttgttgattttaacagatgctggaggacccggtttatctgaaggaataaggaagaagagtgaatatgtggaatggggaatgagtatagagtagaggtctggagacctgggctgcagtctttctattgtcaatttcctatatgacctaggaggttagttaattttttagaatcttagtttcttcacttgtaaaattaggtaattgaaatatgtgatttctaaagctctttttaactctaaaacgtggttctgtcataagaataattctgtgcataggaaatacacattagaatatgaatgtcttctcccacattattctgtaaatcctatttacatcccattatccaaagtaaaatatgggattccaatgaagtttattagttacctaacactttaagcttaatggtggctgatttagaaccacttgaattttcagcagtaatggtatagtctcctgagtccttccggttcacgctgaatagctccaaggtgcacagattccgctgcatggccatctttatgccttctgctggttttagcagtgtgccatcttttttccaagaaactgttggcatcggtttaccaaaaacagtagcatccaagcagacattagttccagctttcacagtaagcaaagatttcatagccacactcaggtctatcctgggagggactggaaagaaataagataaaggacttaatgtatgcaaagctatattatgtaatccttattaataatagtgggaaattcatatgctgcttctttcaagaatggaattttagtgttatttcattttgtttatttttaatagacaaataataactgcactattgaataactattgaaattatatagttgccacagttgtgtatcttgctttttaatttagcatgttattatgattctccataatcataatgtttgtgtctatatacaaaacatcattttaattttccttttttccttaggtgtatatttagttttttattaggaaaaatgaccatcatgaatgctgttacatctttgcctataatactcagcagaatcttaccattttctgcgaggatagtcactggatcagaaggttcagaaggtgggctaatgtttaccgcggtcctggcaatagctctaaattgatactgagctttctcttctaggccagtagctgtgtactcttcctggggaatctggtgaggtgcagtattgcaccgtacccatttatcaccaggaagtttgcaagcttctacgaaatagccaataattttactgcctccatcatgctttggacgagcccagatcagagatacagtactcttggtgacatcaataacctcaggtttcccaggaggatctaaaacaaaaagaggtacactcaccatttatcttaccagcagaagtttaaacttccatatttcacattatcatccctgctgctaagtaacaagctcaacaggaagacaattatcccattttaataaccgtccaactagtatgcacttttgagtccttgctgtatgctttaaaggaaattatatgtccttttctttttttaatatgtcatcttcattgtaagagatagaacatattcttaaatgggagttgtaatcttcagatctctactactctctgtgtcttggagtccaaatcttagactccgagatttaaatgtgcctccataatactaaaacaacaacaacaataaaaaaaccccaaaacttaccaactggcattcttgcagttacatattctgtgggtttgctgggtgggctggatccagctttgtttagggcatagattctgaatgaatactcaagaccttctacaaggccagcacaaggatattcagttgaccggacaagagtatcattggctttcacccacagcaaactgtttctttccttgcgttcaatcagataaccaataatggggctccctccatcactatctggtctgtcccaagcaacaaaaatacagtccttgttgactttggtgactcgtgcattctttggttcactaggaacacctggagatgaagacaaggaagatgtcagtttctacattaagtaacaaactagaaagaaaacaactttttttctccttcacaaaaacataccaaatgggaactgcgcaaccatctttggagatgtgagaggctctgaaatgccaaatcggttttcagcacggacccggaagatgtactcctggcctgggatcagctttccaaccctgcaggaagtttttgtgactgaagctagagccgtgacccagtcacctcggcttacatcacacttctccactatataattggtgatgttactgcctccgtcctccagagggatgtgccatgacagggagcaagcatcagcgtctatatcagaaatgtcaaatggaggctgaggggggccgggggcatctacatgaaccaagaggaaagaaatgtaagaacaaggatttgatacgtaaaaatatttctgagcttcatatttagatggccatttgtctaatacttaacttacccatgactacaactttgattttctgagtgtctgtcccagaactgttctctgctgtgaggctgtagtaaccactgtctttcctagtcacatcttttatgatcagaattgaagagctgtctgctttatgcactgccaggtggctggatgtgacaacttcatcttctccttttttccatttacaggtgggatgaggctttccatacacatgggcttcaattcggagttttttcccagctttgatagttatttgctctggcataaggatctttggtggcactgaaagtaaaatgaaaagatattaattttgggaaggtggataagtttcttctggtggagagctatactggtgcaaattaatgcttgtattaccaccaattttttttaatatatactttaagttctgggatacatatgcagaatgtgcaggcttgttacataggtatacatgtgccatggtgatttgctgcacccatcaacacatcgtctacattaggtattctcctaatgctatccttcccctagcctcccaacccctgacaggccccagtgtgtgatgctcccctccctgtgtccatgtgttttcattgttcagctcccacttatgagtgagaacatgtggtgtttggttttctgttcttgtgtttgctgagaatgatggtttccagcttcatccatgtccctgcaaaggacatgaactcatccttttttatggctgcgtagtatcctgtggtgtaaatgtggtgccacattttctttatccagtctgtcattgatgggcatttgggttggttccaagtctttgctattgtgaacagtgccacaataaacatacatgtgcatgtgtctttatagtagaatgatttataatcctttgggtatatacccagtaatgagattgctgggtcaaatggtatttctggttctagatccttgaggaatcgccacactgtcttccataatggttgaactaatttacactcccaccaacagtgtaaaagctttcctatttctccacatcctctctagcacctgttgtttcctgactttttagtgatcaccattctaactggtgtgagatggtatctcattgtggttttgatttgcatttctctagtgaccagtggtgatgagcttttcttcatatgtttgttgtacagccaatatttttaaaaacacagaatagggtagaaaacataagaatgcacatgataataaatgggtattgtttcaggaaatgttttttagttatatatgtgtttgtataagtttatttactgtgtgtttttggcccactcatgtgtttgaaagccactgttctctactgtttttcaagaatttctagagctagattcctcagggagaaatgtctacatataaaagaagaaattctaataaacttaccacatgacataaatgaagcaaagactacttacacagttgttctttggcttcatacactccttcagcttctcttggcaaactgactccaacagcatttctggccgctactctaaatttgtatttctttccttcctttaggccagtgacaacaaggctcagatcttttaccactgagtactctgtccagcgatctgcaggctgctcttcttctctgtaactagtgatgtagccatcgattttagcacctccatcacgtaggggaggtaaccaggctaaggtggcactgttcttggtcatttcagtcacttctaatttccttgggggatccggctcacctagaagaaaaacataatttagaagattacctaggtaacctaatcaaatcccctttgttaatgtacataagagttttagtatggatttgctccaatgtacatagaacctgtagttcagtacattaaaagcaaaacatataagatgagacagatcaaaaaagtgtttcatgagtgagatagatatttattacactatttcggtctctacaaatgaaatctctttcagaagtggattaaaatggtattagtatcttgaccttgctaaaataggagactggggttaaaaggaggaagaaagcataatacttacttagaggatctgatgcaagcactggttttgggacatctgttgggacgccagggccatattcgttgacagcagttactctgaagtaatactcattcccagggacaagattggttacatggaagcttgttttcttaacttctggggtaacggtcgaccatgtctttctgtctgcctcacgtttctccacgatataatgtgtcacttggctcccaccgtcgttttcaggaggggcccaggacacatggcatgatgttttagtgacatctgaaacttttaaatcagacacaggcccaggagtgtctgtaaagaatcataaaatcagatatacatgtctcctcagcatccctattaacaaattcatttttgaagtgggagggagaagcattttagtaacccacctaatactctgacatttacgaatacagccttttctcctgctgggttcacaagtgttaaggaatattttcctgagtcatcacgggtagaattggggatgacaaggaaggccatagtgtcaaccagatcaacttgtccttttctgaccacattatcaatgccaacttttcgccaagtgactttaggggctggtcgtcctctcactatagcaaagagacgaatagggcatcctgctctcactatgaccagtttcctcatgctggcatccaaatcaatctccggaggttctgcaaatgacattaaggtcattaattgatttttcagaatgtggggaaatcataagaaattaagtgtgaatgaatcacatgctaagggaaggacttacctagtatttctttaggtttgatagcttcctttagctctgcagggcgcccaataccaacttggttttgggcacacaccctgaactcatattcctggttttcatccaagctggtaacagtgaattccttgcgtacaagctgtgctgcagcattacaccgtttccagccttcatcaggagacgcatctgctatttttggtctcatttccacaacatatccaatgatcggtgcaccaccatcatagactggttttccccacccaagagttatggaatgtttggttgtatcaaccactctgaaattggttggtggaccaggtggctctgaaagtaaaatatacatatagttaactactactagtgatacttcaatgtgtaattttatatagcctattctcagttaatcaaatataggtcatccaatttttcaattagtgtcctctttattttccttcataaaaatgagaatctactattgtttgtaccttttaggtattttggtaaaaggtctatttggaaaaatatttgctaaatacagtttggatgttacagatttagatgttacattaacttatttatcgaatacttctgtgcttgagattaagagttgctgtaatatcagaaaaaacaaggacatcctacctatggggtcttttgccaccaccggtcttgaaggcaagcttggttctccaattccaatttcattttctgccttgacacggaactgatattcatggtctgggaggagattctgtactttcatacgtctctcagggattgcactcttgttgacagggacccatcgtgttgaatgcttttcctttttctccaaaaagtatccagttatagactttccaccatcatattcaggtggattccaaaccacagtcatctcttctttgcttactttagtgacttctgggggatcagggcgaccaggtttatcatacttggttttggctatgactggtttactttctgttggaggccctgtgcctattttattttctgcacggactctgaaaatatattcatttccttctatgagacgtgttactgtagtaccaggtgtcaagacagtagcagaataggtagaccaaaccattcgctttgtctcacatttttctagaatataattttggatttcacagccaccatcatcttctggtggatcccagcaaacagtacacctatcactggacacatcaacaattttcagatttctcacaggaccaggcttatctaaaacattgacagtggcataggccacaaaactgccagccgtgttagttgccgtaactacatatttacccccatcacttcgctttgctttagtaagagaaaatttagatgaatcagcacgggtatcaatcttgacccttggtgatcttgttaagtctgtagcgtctttgtccttggtccatgcaacttctgggaatggtttgcctctaacccctgcctcaagcctaatggtgtcccctgctttgacagttaggaccccacttaatttcagatcaagtactggtttttgtaagtcttctttcacaacaacttcctctgtcttcacccagtcactttccccaccttcattctttgtttgcactctgaactcataaatctggttttcaacacatctgtcaaccatgtagtgagtttctttaatgcttcctttatgcactctttcccagtcatcggagcccttaagccttctctcaacatgatatgacagatttggactgccaccatcatagtcaggcctccgccactttagatagacaaatgtctttcctttatctgcaatgtgaaggttttcaggctcacctggtctgtcaatagggttaatagccagaatgggagtttttgtttcgatggttggcccaacacctactttattctctgcacaaactcggaaatagtattcattgttggctaaaaggttggccttgattaatcgtttagtgacatctgatgcaacaattgaccagcctttctggtttggtttgcgatattctactatgaagtttgttatttctgagccaccattatctagtgggttttcccaagaaattgtacagttctctttggttacattggtaaccttcaaattctggcaaggcccaggtctgtcaaggacgttaacgatggctgaaccttgggcatgtccactgctgttcttagctgagatgatatacttgccatgatcagctctaacagcttctttaatttgtaactcaacacgaggtagatcctgaataaggtccaccctcttttctcggaccaatactttgccttccttagtccaagttatgtctggttcaggtctgcctttgactcgagctagaatgcggatagtttggcctactctcacggtaataacatcacgacaagtaacatcaagttctacttctggaggatgaaggatatcttttgcaatcacagattctgctagttctcttggctcaccctctcctacaatattagctgcctttatacggaatctgtactcatttccttcaattagtccaggtaccctaaaggcacattgcctaatgagttcatctttattaatcctgttccattgtgctgtgccaggtttctgacattccactacatatcctagaatggggctaccaccatcactgagaggctttgtccacaccaaatcagctgtttctctgctcttgtctttcagtttaggattaataggtggtccaggtggtttgatgggccggcaagcttttattggatcagaacttggggatggtttgcttagtcctgcaagattttcagcaaaaactctaaactcatatgtatttccttcatagagtccagtcactctgaacttcaggtcagcgataggtgttttgttgaccctcacccatttgccagttacttctcgacgttccatatagtagccagttattggactgccaccatcagattttggcagggtccaagacactgttgctgcattttcagtaatgtcagtaaccactggtttaccaggaggagacggaggactaaatttatgcttagcaacagtaggtgtggagtcaaggggaggaccaacacctatcttattctctgctctaactcggaaaacatattcacagcccttctgcagatgtgggattttcagctttgtcttactgcttccggaagagacaacaccccacgtgtctttccttgtatcttgtttctcaacaatataatttatcacagggcttcctccatcatccttaggtggctgccatgagatagtcatgtgttcaggagtaacatccagaatattaataggacctgttggtggcccaggaacatcaagaacagtaagatgtacggctactgttttgctaccggctgcattggaaactgtgatttgatattccccagtgtctctccttaagcagttcttaatggtaagtactgatgagaagttgtctgtttcaactgtgtagtgctcatcggttttaatctcactcccatcggttgtccactttgcagtaggaacaggcacacctcttataatagcagggaatctgactgtggttccagcctttaccacaagaccttcaattaatttcacatctagctccacggatggaggcactgaaaagtaaacatgaaaaaattagattttgattttcacctatatgaataattttaaaaagaaataaggtaatactgctagtccaaaaattacctagtttttcttgacattctatcgggatagttgtgtcagggagaccaagacccacaatgttttcagcttttacacggaatctataggtctttccttgttgtagtccagtaaccacacactctaagtttgtcacagtcttaaatttaatccagtcctgggtgccttcttcttgatattctaccaaatatccagtgattggagaaccaccatcacgatccggcttattccagactagggagacttcagtcttgtcaacatctacatggtgcaggtccttgggtggccctgggggatcttttcaaagaagaagttatgatgaaaaagtaatattcttaaagacagtcaaacaatagttttgtattcagagaaagcaacttacggagaggatccaaagccttgattggttttggtgtttcaacaaaaggaccacgtccatactggttctccgcagctactcggaagaggtactggttgccttcattcagatgcttagcgaagtgactctttttctttgatgtagctgagagaggtgaccactgggcgctggcaacatctctcctctcaaccacataattggtaataacagaaccaccatcatccagtggttctttccaagtaaggtaacatgaatctttcctaatttcactgacttccagatctctaggtggcccaggtttatctaaaaagtgttaaataacagtttgataagtaattttatccatataagagctcaaaattatcaaaatttatttttaatggcctaagtagtaaaattcttacctaatacaagtacttttactgagacagtttttgaaccagctggattctccactgttaaagaataaattccaccatcttcatgggcagcattacgaatttcaagcttgctaccaactggagtcacatcaattcttgctttagttggagcatctctgtcttcttttttccaagttacttttgggaatggcactcctttgatgatggcactaagtcttagagtatcaccaactttaatgtgttgttctcttgccatgttggcatcaagaatcaactcagggggttctagaataaagagaacagaacactcagatttgatccataatgcagattacaattaaacacatacaatcagacatctattttccttgcaaacacaagtgagagcattttactcaccaagcctgtcttttactaggactggctccggaacatgagctggatctgattcaccagctgcattgactgctaacactctaaacttataggtttgaccgtcccgaagaccggtgactttatatttagtttcaggacatgactcaggggtgtgattggctcttctccactcttcatctccaactttctggtactcaacaatataacccagaatcttgctcccaccatcatgacgtggtggctgccaagttagatcgactgaattgcatgttgtatctattgcttcaggattaacaggtggacttggtttagctaaaaaataaaagtaaaaaacgaattagcatatagctgaaaacaaagttagataacatgaaaactgaataaatccattaatactataccaattggatctttagcaaagactggtttggatggtgggcttggatctccaataccaatttcattttctgcagaaacccggaattcatactgacatccttctagaagatcaggaaccctaaatttagtgtatggatgaataggatctttggtaactctagcccatcgtttagacatagtttctctcttttccaggatgtagtttgtgatgggttttcctccatcatgtggcttattccaggttactaatgcagagtctttggtaacttctgtaacaattggctgatcaggtgcatcaggaacccctgtaacaaatgttggaaaatgcgttagaaatttatttctttatattagttttatcaagcattgaatcactaaaaagaaacataatgcatactgaaacgatctttggctttcattgaatcagacaccagaggatcacttattccatacagattttcagcatgtatccggaaaatataatcttttccttcaagtagtttagaaactttgcatgttgttttagcacttgcagatgtcactggcatccagacgtctttacccacttccttcttctcaataatataattggtgattttactgcctccatcatctaaaggaggcttccaagagataaccatgtaatctttggtcacctcatcaaaactaactggtcctactggtggtccaggacggtctgcagaaaaaaaaaatcatggcacaaaatgttattgccatttctgcttttgaaagaacagaagatctattctttccactaaataagacttaccaacaacattaacttgacagaaacctttcctagagcctgtactgttctccacaaccacacagtatttgccggaatctgaacgtttggccttgatcttctctaaagcaagtgttgctggtgtagtctttatatgagtgcgatcatcttccagcacatcagcttcatctttgaaccaggaaaccttaggctttggtttgcctgagtaacggccagtgagggcaaaagcttcaccaactcgaatcgtgagcttatctctgaagtcgaggtgaagcgttgggggtgctaaaatttgtaattataaaggcaagtcatttttattgatgtcttattacaaatctacaaatgtgcaagtttcagaagtataaattgtagtagacacatacccagctcatccttgcaagtaattggtttggtgcaaaatgatggtttgccttgtccaacaatgttgacagcactgacacggtactcataggtatcaccttcttttaagcctttaacagtgtattttctgctaagcaagttgtcatttgtaactttgtggaacttctcagtcccaatgagccgactttctaggacatagttaataatttctgacccaccatcatacttaggaggattccaagtcaaagttacagtatttttagtaacttctttgacttccaggtcttcaggacgctctggtacagctgcgaatataagtataggaattgtggtagaaaaaaatgtcacattaagaatgtagtaggatgtagtgaatattccttttctgaagattgcatttaaacattaaactctctgctcccataaatagcaaaagagatctcatcataaaactattagagttaaaaaggacccaatacaattgaatttcttcacttgacagatgaggaaatagaggtttgttgaggcaaaataatttaggaaaggtcttcagaattggtagttttagaagtaggaaaataattcagtttctattaatgccattaagtgggaaattaaaaaaaaatctgtgaggtatagatggaagaaatttgataaatgaactaggagtggtaatgccagcactttcggaggccgaggcaggtggatcacttgaggccaggagtttgagaccagcctggccaacatggcaaaaccctgcctctactagaaatagaaaaattagctgggcatggtggtgcatgtctgtaatcccagctactcgggagactgagacacaagaatcacttgaacctcagaggtggaggttgcagtgagccaagatcatgacactatactccagcctcggtaacagtaagactatgtgtcaaaacaaaaccaaaaagaaaaaaaaaaacaaaaagaaattcaatgaattatacatatttgtaaaatctctttcacaatcactgtccaaatactaccaaatcagatactgagtagttgtgtgataactgcttgtcaagtgaatgaaatgtacggcatttatacacatattttttcaccatagtcttgtactaaatgagtaaagaagtgattaagtatacatttttttttttttacttacttattggctctctgataacaagtgcctctgatgtctcaacaaatggacccatgccaatactattttcagccgcaattcggaaaaagtaggcttttccttgaatgagaccctggacagtagcattttgtcgggtaactgtatatgtcactggggtccatgctctgcggtcagattcacgcttttcaatgacataattggtgattggagagcctccatcatcttctggagaaaaccatgtcagtttgcaggactcattggttaggttgtgagctaggaatggtgttccaacgggacctggaacatctggaaataagaagaaaataattcaagctgtttgccttcaatgaaagataatgctcaacacttgtttttttaaaaggagacaaaaatgttgttttgaagaaagtaaggttttgtgtctactaattgagttagtttttccttctgctatctagtcaatacaaaaacagtcaaccactttttttttttttttttttttttgagatgggagtctcgctctgtcacccaggctggagttcagtggcacaatctcagctcactgcaacctccgcttcccaggttcaagcaattctcctgcctcagcctcccaagtagctgggactacaggcatgtgccaccataccaggctaatttttgcatttttagtagagacagggtttcaccatgttggtcaggctggtctcgaactcctgacctcaagtgatccacctgccttggcctcccaaagtcaggggattacaggtgtgagccatagcatcaagccccatatttgttaatgaagtaggtttgcaacagttattggttaccatggttttagtagaggctgaagggaaaataaaaatgctttttaaaagcaatttgtgagttggacaggagggagctgggaggcaagcatgcagagggatacaagagatgggtaagagtggcatagtcagtttctatgtccagtttcctctgcaggggaaacggagagagagatggtttatttctggatgaccagtggatcaacaagcagcataggaggccccaaatttcagaatgactttgaggaggttgcaaataattaacgtggaaatgtaccagttctcaaattaaagtaataaccattaggcaaaagagctttaggtgcttgaaactaacctgaaagtttgtggggctactgcttaatgaaatatttttccttatgccattcttatattaattatattcaacatagaactggcaattttcacataaaaactgtggctggagtattgttgtgcctagagacatgcttagaaagagccctgagtggaaaggcttcgtgttctgagcaaatcactggactaaagcctccagtgagagccatgaaaaagcctcatagagttcaactctatattcagtgactagaaatgcaatattgataaccaactatgatgcttctcttcaattagaatactgaaacccttcaaacaggtttttgcattattatgataatttagcgataggggtagagtctcatgatgtgaaatggtcagcactggcaaattgttaaacattcatgtacagtttaaggaaagttgcagattgttaaacattcatgtacagtttaaggaaagttgcttctatgaaaactatataacaacataatagacactatgggggcaagttctataaaaaagccatatttattctgggccatgattcagaatacatattcatggccttctagcaatttgagaattgtgtacatgcactctttaggttcactggaaacatggatgcatgtcttcttgttagcatctgttttctcaattatataatttgtaaacttacacccaccatacagaatacacatagaataaaaaagtaaggaggaaatttttaaaaattctaataatgttcaacatgattatgggtgatttttcttattttccaaaatgtttgttacacagcatacagcatagctttgtgtaaatataataagaatgttggtttaaaaagttgcacagacaaattgaaagtatttacctaatacatcaacaataattgtcttctttctttctccgcttcatttttggcaagaagagaatagacgccttgatggctcctctggcagttcttgatgaccatggatgagctaatggctgtggtctcaatggtggcttcttgaggtaaggttctttcattcatgttccaggtgacggttggaggaggctttccagacacataggcaatgattcggatcacccctccagcatggacaacaattctatctctgacactggcatctagctgaaggtcaggtgaaactggaagcaattgaaaattacaaatgtgatttttccccttcaatctgaaacataaatactgatggcataaggaaggattgataattaccaagtctgtccttcatttcaatgacatctgtgacctctccaggttctccaatgccagcaatgttgactgctctaactctaaatttgtagaatgctccttcctttaatcctgtcacaacaagctttgttcctctcacttctttatctttaccctggggagaaatcatagacattttataattagaatagttctttgtagcttcttgctttaatggcttcctaaagcatcaccagcagcctatttaactgtttactctgggaaaattgttgctggtttaggttttagggatcagatattacaggcaacactgaatggaataacttggcaggagttatgctttaaaattattgtcaaatgattaaaccttgatttatttattccacattccagggtttataaccaaaagattagtaataacatgacttaacttttgattcgatttctgacattaacagatgtttggaatgtgagttaaaattatgctattttcctgatttcttaatccaaaaagtatagacagaagttaatgggattgagaataactatgacattttttagtttattcatagtgcatttccttagtgccaagttttcctaccttttcccattcttcttttccttcttctttatattcaacgatgtatccagttactttggatccaccatcttttagtgggggagaccactccagatctgcagatgatttagtccaatctgtcactttgggaaatggaggaccaggaggggctgcaaagagccagtatacgttagtattcttgacttttccaaggcacttttggaaaataagatttaaaaaaaaggaatggtttccaggcttaccaattggatctctagcagtcgctgggtctgatggcagacttgctggacccacgccagcagcattgattgcatatacccggaattgatagtcggaaccttcaataagaccagtcactttataagaaacacccaaagtcatggctttgataggatctcggttaactctcttccatctctttgaagtggtgtctttcatttccagccagtaccctgtcacaggagagcctccatcatattctggctcttcccagttgacagtcatggagttacgagtcacgctgctaactgttggtttatctggtgctccagggacagctgtgaaaaagatcatattgattataagaaatttaaaaaaaaagtaaaaatggctttgtatgtgaaaatgttctcctacttacagaagaggtttcttgctgtttcaggttcactgtcaagaggttctccaatgccatatttattctgggccatgattcggaatacatattcatggccttctagcaatttgggaatcgtgtacgtgcactccttaggttcactggagacatggacccatgtcttcctgttagcttctcttttctcaattacatagtttgtaatcttagacccaccatcatctttaggtggaaaccaagatagtgtcatttgatctgctgaaacagattcaaattttatgggtcccactggagggccaggacgacctaaaatggtttaaagaaggaaccctttatcactcagatgattttaaagccaaatgttatttatgaacagaaaaacaagtaattttaaccaaaccatgcagtctttacccaggacattcagtctcatctcctttgatgctgttcccagattatttacagctgtgatggtatataagccagtgtcactcctgcgagactgcggaataactaaagtgcaagtatcatctaccaccagtttgttgacatgggtgtcatagagaacaggttctttgttatcaggcttctttggaggagctttaaaccaggttagtgtcgggaatggcacacctttaattttggccacaatgttaacattggttccttcttcaacctccatgaattcttttagatcaattgatggtgggcctagattatttaaaaaaagttgtcattaggagcaaaaagcattgagggatagaaagtagaattcacagttactataaagttgtttggatccactgtaggcagactttgtagctcagcccaatataaagaatggttctgtctttaacactattacgctagtttggggagcaggtacacggggtcagcatcttttattggatctacatgtggctatgtatctgtgcttgcctcactttatttggcatcattatgcatgtaatgatgtgtattattatattctcatatcctgacaaaagggaagagaggagattgtagtaggagagtatcatgggatactctctttaatatttacacagaattatgaagggatacacaagaaggtgaattccccttttaagaaatataactgttaataaaaggaaagcaattttccattttgcacaaatttaggacagaaatattcaaagagggtagtgactacagtttcttcacacttagatgagagaataaacaaatacacaacagtagtgatggtaattatcagaggaagaattattaccatatatatatatatatatatatatatatatacttcattaaaatggatatatcttttctcatatagagaaataaaaacttgattgtgaagataaatgggtctcagcagttgctaagaaaatgactggttactttctgtcccttttgaggagcatgcagagaaattgctttagcctctgataaataaaacagactgcgaggaaaattacagcgaggaaattacagacatcatctcctttgaacagggaaaaggtaacaggtaagggaatgtgaaaattctgtggaaattgaaggaatgagtaattaagtaatgtgcccatgtctacattcaagccatagtagcttcctaaggtacagatatagctcttttaattgtgaactattattgaacacctaggaaggcagctgtaaggaggacattctttgtcagtacattggtacttacatgtctggtctttgacagtcacagggccaacagtggctgaaggcttgctgactcctgcagcattgacagctttgactcggaattcatattccccaccctctactaggtcttcaacagtaaattgcagttcttccacatcacgcttattgcactgcctccaggcttctttctttgtcccagtagggtcccatgcaaggcactcaacaatatagtgggtaacaggggagcccccatcattcttcgggggtttccatgacagatgcactgtgttctttgtgatgaggccaatcttgagtttaataggaggatcaggaggatctgtaaaaataattaaaggaagtattaagcgttgtttataataatatacttcaattttgagaagatattttaaatttagattttaaagcttacatatcggatctctggcagtggtcctctgaatggtttccacaggtgggccaataccaaaacggttttctgctcgcacacggaagaaatattgctgttcagagaggagatcaggcactacaaatgtggtgcttccacagtctggattgactttggtccaggcttttccatcaatagtcctcttctcaataacatagcctttgatcctgtctcctccatcgtcgtctggcatcttccatgaaagtctgcaactaccccttgtgatatcactgactttcagatctttgggtgggcctggtacatctgttggatgtaaatcacaatataagcaacgttccttaaatgcttaaaaataatttgtttttattctgtagcaactttcaaagtctttcttacccatgactttaactctgcaatttgcagtcttttgtcctgctttattcttggctgtgatgctgtatttgcctgtatgagatcgtttacactccggaataataattactgaggagttttcagcagtctccagctgtacaaagaaaatagtagtcatacattgaatgaaatcatagcaatattgaagtcaaccatattctgaattattttaattattatttttttacctgtgcatcttcgggtatgtcatgaactccatcctattagaaaaggagacagtcagttgtagtataaatactccttatagtgattcagtggaaaaaagaggagaatggttattttcctaccttcattgctttctttgcctttccatcaaattcccaagatgattttggtgttgggcgtcccttgatgacagcaggaatcctaatctgtgagccagctttacaaaccagacagtcctgtgctccaatgtcaatgaaaacttctggttcctctgtaataccacatacaatttaacaggatttagctcatatttgtcaaaagtaattgaaatatcttcagtaaattaatcaatttcataataagatcaaaagaggaatacataaactgagtaagtactagtaccttgaatatcagtggcagggatctccccagttgtatcacttggttcagattcaccagcttcattgacagctttcactctgaatctgtacttcctgagctctttcagattaggcaccacacattcacaggtagttataagtttgtctggttcatttactcttttccagtcagtagtaccttcttcttgcatttctacaatgtatcctttgattgggctgccaccatctttggctggaggtttccatcctagtgagatgcttgacttcgttttatctttaacttctgggcaagaaggtggccccggtggaactaataacaaaagaaaaaaaaaagcttcatcagattttgaagctgatgaagtgctggagtcttttactacacatgatcatatattattttaatctattaaaatattaaaatagaaatgctaaaaggaaatacagttgccttctagagaagagaaataaaggaaatggtctattttcctttagcattaatgcaaaaacagagaaagcaaacaactaactgggaatagaaagactacttcctatcttgttagatttacattctatttatacatgattggtaaaaaactactttacttttgagatccctttgaagaaattctacaatagcctttactgaaaacatgatttaaatttaatttgccacaatatgaaaatttaaaaaggattccatcaatagctagtaaacctttgaacacaaactaatcttaatgccctttagggacaggatcagtgtctacaataatcccataacaatcctttacctttctgaaagtgctttacaattacagaaattcttttactgtacttgtctttttaatcttaacttttccccctccagtggttaatatagatccttgcacaaagcacatgttcaatactagtttgcaaatgaatgaataactacctcattatataggtatatatgctccacatagcacttgagtatttaaaattttctttttaacaaataattgaatttttcttctatagagaatctaatcagatatgtagcaaataggatgaattattatggccacagtattttttaatttttgaacgaatctgctcacagatcttttagaagaatttttctctcttatttgacctcacagactatgcctgagaatcctaaatctttgttcaataatattatagaaaagctaacaacattctgttttttgttgaattcctactggaaggtctgactgtttagtgggagagatgatttccccagtatctaatgagatagaaatttatttaaagtatcagaagacataggagtttatagtccaggtctttattattgtgattcctcataaaatatttggtttaatccaagagtttacaaactgtatgattttatgtatgtgtgtatgtatatatctgtgcatgtatgtatacacacataaatatatacttccgatagtctatgtgaacatgaaccttttttattttaataaataaaataatttggcatagaaaaatataagaaatttaaggcagaattatccatttagtgactttgtgctttagaaattagtccccagaaacggaagcatacttacatatgggatctcctgcaacctctggatctgatggttcactgggaggaccaattcctgcagcatttattgccatggctctgaactggtatttaacgccttcaagcaaacgaggaacattaaattccacgcctttcaatcccactttggttattggtgctcggctaacacgtgaccaataaggacttccctcttctcttttctccagccagtagccagtaattggagagccaccattgtccaaaggaggagtccagctcactagcattgatcctttggtgcgtgccaaaacttttggttttcctggaggtccaggaaggcgataaggatcttgaatgactactttatctgatttgcactcatcactgattccatatttattcactgccctgactcggaactcatactgaccattggggataagtttccagatctagaaattagaaaaacagaaatttattgaagagaatatacttatgttggttttcactcatttaaaaattcaacttattttgggagggatgactgtaagaagaaataaatatatagactcaaaacatgggaagacagagaaaaggagaaagctttttttaaaataaaaatatgtagatgtattgtacctgatagtggatctcaattaaaagagtatctgtgtatcaaacgctatgtactaaggagccttatgtgtgtggggctaaacactacaataacaaaataacagcttatcgtgtgtggttttgagtttaattatcaaattccaaggttatattaaaatggcatcaaaccagagtcatgtacttttaatgtgtataagaaaatattcagaagagtttaccccatatcttttctctacagcagtgttggtgacttcctcccattctgctttcttcctacttgcatcacgtttgtcaataacataatgggtgatttcactgccaccattatcaagaggggcatcccatgtcaagtagcaagattcagctttaatgtcagtaacagcaagatttcttggtggggatgggcggtctggaaaggaatcaacagagaatattgagaaggcaattcttaaacagacactggatgcctttttgatgtaagaaagcaagtcacttaccatatacttcaacgtgaacatttcggaacactgagccaaggcgattggaagcagtaactgtgtaagtgcctttgtcctcccggaccgctttgggaatgctaagctcagtttttgcctcacttcgggatacctcttccttggttatctgaagtgcatcagtgggtttttcaattacagtttcatttttggaccattcaatcttaggcattggaaggcctgtcacatctgcagggatgtggacaggctctcctgccttaactttgatagtgtctcctcgaacactcagacgcaacttaatagttggaggcactgcaaagagaagagaaagaaaaacagtaacaaagtcataaggatgtttttttcaacttatgggataaaggcacactgtaaaatgcattaaaattattattatattcagattccgcaccttcatcatcttgtatgactacattaagaggtagggatggttcactttcaccaatttcattgacagctttgacacggaactcatacatttggtgttcatcaagattttcaaccagaaaagatgtggttgggcagagtcgcttgttaactctttcaaagtcaggtttgtcatgacgccgtttttcaatgatatatccttggatgggactgccaccattactgcggggctctttccagtcaagtgtgatagtggactttgtcctttcagtgtatgtgagcctctctggagatgttggaggacctttagccagaggcaagtgaaaatgattagcatgagataaatattcatgtaagaaataatatttcacttcaacttaattatgtaaaaaatagccttctgtttggcataaccttacatccttatttaaaatcattcctaaaacttgtcagttgccaaaattatagacattcatgtagacagaatttttcttagcaaacttttcatcaagattatcagtgaaaaataaatcaagggcacgtatgcttttttaatttaacattttagattgtttacctttgtaactggggatgcttctaattctactgaactaggaaagtaagtctgtgaagctttgctttgaatgaccagctgagagcaaagtgttttttcttttattaacagatagtggatatgtctatgaacatactttgagtcatgttgcctcacatgtgggttcaaaatatggtggaaagaggatgtatgtaatgctgctgaagttttctttcctgaaggaccaaactaagagttaagctttcagtggtaaaactagacccaatccatacttgttgactgttattgcaaccagaaggagtggaagctcagctctgttctggtgcctctggcacagcctgtggtatattggacgttcatagatgagctgcagcagtgatataggatgtatttttttttttcagggggtgatggtgaaggaataagttcttctgtctcttgaggaatgggtcttcctcaaagcctttgctttcttagatgggatgtcagtgtgcattactgtgtgtgcaattttagtgtttcgtattgatttctgggagattccctctggttggttttctattctttggaggctgtttctggttttgggcctctctatccttccagtatggggactttttgaatatagaggaagactaaggcatttattctcaggaattgtctaatcttttagaagaacattgaattctctttaactactacgctagtaagttttaaaaacccgacttccaatgtgttctactggagagatataatatgtctaaactacttctaggttattattaagcccctgtagatccaagtttttcagtacaagaaaccatgcatgattaatatacttacagccacaaattacattgaaattataggaaatatgatatctttaatgttgctaatagttttttgatttacttttcttattactctttagctatagattttgagactgttgggagtttgaagccataaagctcagtaaataatataactagaagcaaaacattactctataaacacaatgaaaccttctcttttacctagtggatcaactgcaagaattggtcctatttcaacaggagggccacagccaaacttgttcttggcaataacacggaacttatattcttgtccctcaagcagacctgtgatgtcacatttagatctctcagtctctattggttgtctccaagtatgcatcttggcatcttttctttcaatgataaagcctgttatttcacttcctccatcatcttctggatcagaccagttaagtagacacatttttctgtttgttacaacaggttttaagtcaagaactggaccagggacatctgaaaacaaaacaaagccaaaaatcaatgtaataagatagtatcacttgggaaaatcctgtgaaaatcagtgcaacattccttaccaaaaacttctaccctggctgctgcaaatttggaaccacagctatttgtagctgtaatcacatatctgccatggtcttttcgcagtgcatccttgataattagttcagatttggttccaacgttgtctattacaacacggtctttatccagctccccttcttctttggtccatacttttgtaggtacagggcgaccagtcaccacagctggaattctaagagtcttcccagccattatttgtattccacccttgacagaaacatccagttccacagctggaggctctgttgaaagagaacagtcatgcattagcccatgaaagattaaaaaatagtcccatatagagaaaatatccataattttattccaataacgttaagtaccttgtggttcagccacagtaacaggttgtgtttctccaggcggtccttcccctgcggcattgacagcactcacccgaagtttgtaatcagcaccctctcggatttctttgacggtgtactgacggaccttgatcatcttctctgtgcagcgtgaccattcatttgtgccaaccaactgcttatcaacaaaatagccaacaatttccccaccaccattgaaagctgggggttcccattctagttcaatagttgtagagcttgtgtcagtgactcttgggataggtggcccaggaggagctagaatgaatgaagatagacaaatcaaactccctgatggttttaaaatgtacaatagcttgttctactccaccttcttcttaaggaactacttacagattggatcatgtgctgttttgggatctgaaggtggactgaactttccaggtccagctgcattttcagcacatactctgaagacataggtgagtccttctaataagccatctacattggctttcaaggcattcagaaggcttttgttgacacgagaccaatgtgtactgttaacttcacgtttttcaagccagtaacccaaaatggggcttccattatcttttggttcattccatttcactagcatactgttgctggtaacatcttccacaatgggcttatctggtgcatcaggtggtcctgataaaaaaataacatttgaagtaaatttcccagtatgacataaaaatgcaattttaaaagctgtagtaattatataccaaagtacatggtaaaaaggcaaactttagatgccaaaggaaacttaccaaatggatctttagccacaagtggctttgaaacacatggtggacctggcccaaatctgttttcagctcttacacggaagaggtactcttttccttcaatcagttttgttactgaatatttgcaatgtctaagtgttgaagtgacaacaatccattctgagtcgggttttgtcttgtctttcttttccaaagtgtagtttatgatttcactgccaccatcatcaaggggtggttcccatttacaaaggactgaggtctttctgatatcttcaaatacaaagttgattggtggtcccggtgtatctaatatttcagaagagaacagtaatcaaaaatttgtgtgggaagggttgctatggaaaatataaatgtgagcatgctcctctgacatgatttgtggttttcccacatctatctttgtattccattagctaataaataacaagatcaggtgatttcttttacatggccagcagataaaatatgattgaggataacttgctgaagctatgtcccatttcttttaactctctcccaaactttttatttttatgttttactaaaacctttttccattggaaagtgtagttttaatgactcacctaacacactgacagtacaaggagcttttgcaataccgtggtcattttcaactttgatcatatacagaccatggtcaggtcggagagaatctcggacgcgtagctgagattctccctttttgctgttgtcaatactcaaacgctgtgtcagaggcaggacaaatggttcttcttcttgaacttcacccttccttctcctaaccaagggtgctgcacgcttcttaatttcctctggtacaataacattttcatcctttatccatgtaatagttgggtaaggtgatccagaaatacttgcatcaagtgctatttcatcacctcgtttcacttctaggcttgttctcagaatgactttgggggcatctatagtgatcataaccaataaatgttttcaattctgatgaaaataactgacaaaacattattttcatttatttcaaaatgggaaagtggcaactccatgaaacaaaacttaccaatgggatctacagctttggttggaggagtagcccgagaaggttcactaatacccgcggcgttctctgctcgcacacggaattggtactctttcccctcttcaagtccttttgctgtataggtcaggattggtaccaggtgttcattgcatctcttccacctttcttcacccttagcaatcttctctatgatgtagcccattatcttgctccctccatcatacaaaggtggcttccatgtaatagtcattgcctccgctgtaggattatgaacctctacatctacaggtggatcagggggttctgaagaacaagaaaaaaatgttagtatcaggaaaaccaccttcttaaaacaaaactatggtttattagttcttagccatagtgcatccatgtccaaacttacgctttggatcttgagcaatgactggatttttcagttcaatatattctcctccaccaaccttgttgactgctttaacacggaagaagtattcaccatttggtatgagatccttcacagtccatgacagtttgttctcaccagacatgactggtatatatgttctcctcccagcttctctgcgctccaggacataatgaagaattggggttccaccatcaaattctggaggttcccaagttaacttacaagaactcttggtaatgtcacttgctttaatatctttgcatggtccaggtaggcctattacaaaaatggataattattctagtaatcctgaaaaatcagcattttaataatgcacttgtctctaagtggggctatctgtattttgggtaggataatctttgatgtgctggagtgtcattcacactgcagagcatttagcatccttggctcccaactactaaatgtcagtggtatctacctcaagtctgtgtgccaagcaaaaatggccccacaaatttccagacattatttgcagggctggggggaatgcagaaaatgttactatccctggttaagaacactatgggaaaatgtgaagctgtgcaattaaaaaattgtggtcatttcaatgctctttgggtatgctaatatctgttatttaaattagtatttcacatgcaattaactaaaactagtataaattagtctaataagcgtttagcgatttcatctctttagaattgttttacttctcctatggaaagacataatcagaagtgacatttagtttacaagtggccagttcatgaagccaattatattattaatagcactgcaaagttaactaatttcctctacatgtgaagaatgtctggtttttcttcaaagaatgattacctatgactttgacattgattgaggctgttgctgagccgagcttattctccagtgtaatggtataaattccggcatctgcacggacactcttgggaacttcaaggtgtgcagagatgtgatcattcttcattgttaatctatcacttgctttaacttctttgccatctttatgccaactaacagttggaactgggacagctctgaagggaacaggaatgcttaacttttcaccttcaataacaataatgtcatgagtctccaggtcaattgttggcttgcctgtaagatatcattcaaaagagcaaaaaacagagtatgtcaaaatgcaatgcatgaataaagggtattttattaactataaaagaccttgtgctcttacagtctgggtctttggcaaccacattttcagagatttcagatggctcgctgacaccaatagcattgactgctctcactctcaggacatattctttgtcaggaacaacaccttcttcaaccttgaatttcaagtcctttattgggcgagaattaactctcatccatttctcagtgcctactggacacatttcaacatggtatcctatgataggacttccaccatttttctctggaggcttccaagcaatggcaatgtgttttctcccagcatcagtcacatgtaggtcaaggggtggtgagggaggacctgagaaaagagtgaaatattcatatccacagtctcatcaagttctagacaatatcttgtgtataatcagcactacttacttgttggatcttcaatggataggatttctgtgggttcacttgggtggccaactccagcttcattttcagcccgaacctgaaactggacctctgttccttcgatgacatcagttactctgaagttacagtcaggtcctgcagtctttccagctttcacccaacgggtacctaacctttctttcttctcaatgacatatctattgaaacaacaaagcatttcattagcattaatgaaaaaacacagttaagaatttgcagccaagtgtaagttattctttatgaattaattcaaattctacctctgtattggtcttccaccatcatttttaggtggctcccactttaggtcaacatgtcgttttgtcacatcaaccactgccagggcgtagggtggtccaggagtggctgaaaataaaataaacaatgattaggaaaaccagaggaaaggtgataatctcctgtcacaaaaattaagtgcgagagcacttattgtcacaaagattaagtgcaagagcatactaaaggtgtctttggccagcacagagtcctcaatttcggtgtagtcgctttgtcctatagcattttctgcagcaactcggaacacatataaagagccctcagtcagtggggtgactgtgcacttggtgtccttgacagtggtatccactgtttgccagccttttcgcctgacgtctctcttttccacaatgtagttggtgatgggggaccctccatctttctcaggaactgtccattttaggtctgctgtattttttgtgatattaataacttcaagccagcgtggtggtgatggaggatctgaaaaagaaggaaggaaaacaaattcatttttttttttattacccaatagtcagtctgaaagtgcaggcagtcattaagaagtaatgtagccaggaggaaataatagtaatgaatttttcatattttctcatatcgtagctcacaggcagatattagaagaatttatatatcccagacatcaagagtgacttacatagcttctcccggcaaagcacagggtcactgggttcactgggttcactttccccagccttattcacagctctaactcggaatgagtattcctgtccttccatgagccctgggagcaagtgctgagtggtgggaaccccttccgccactctgacccactcatctgttccagtcttcagcatttcaatgacataagactcaatctttgcacctccatcatgttctggttttgtccaattcaaccttactgatgttttgcctacatcttttacagttggttttccagggggccatggaggatctgcaagccaatgaaatcattgtttaggtttgtcaaaaaggagttcatatgaacttcgaaataaccacaaaaattatataaataatacctatgggatcctttattaagattggttcagttgatttgcttggttttccaggtccagcaagattttcagccaacacacggaatctgtattttttcttattagtgagacctttcactctgaattaggaacaaagtgcatgtgtatcatcatggtaagaagcagaagaagcctatgtttattttacacagaagagactaatttatttaaattgtgaaaaggtgatttggaaatttaactgaaaagcacttcaatataaattaaaaattgctttttaactgccacacactttagactgggccaaacataccaatctaattataatatctatgacagtggtcattatcataatatactgggggatcaaacactttgaaacttcctgaaggttaatattttagagtaaactaagaaatgtgcccttgaatggaatttatataatttttcaaattatgaggtaatagaaaatatgagtaaaagtagtttaaaatttttttagtaatatataatcatctgtaatcccaaggaatactaaagagtaaacatttgaatatactgctgtcttaacatcttgatggggattctgagcatacctgtatgttgtgtcctttactggcatcttattgcatctaacccatttatctgtatcaggatccagtctttcaacccagtatcctgtgattgggctgccaccatcatcatctggctcacaccatgtgagagtcactgcgtctttagtgatatcagaaggttctaggcgagttggaggaccaggtggatctatagacaggataatggtgtaaaatgttatatgtcctgtatataaatatgacaccaaaatgcaagtttgacataagcatccttttttttttatcagctgattgagaaacttaccaaactgatatttggctgttattggagaggcctgaactggttcaccaacaccatacatgttttctgcagcaactctgaagatgtactctttattggggattaatttggtggccttgaagtttgtatccttgacggtggatgagagcttgtgccacacttcactatcagttgctcgtctctccacaacatagtttgtgatcttagatccaccatcatcgcgtggtgggttccatgttagaagacatgactcattggttacatctgtgatgtcaaaggcagctggtggtccgggtttatctgtgtatggcattacagatgcagaaaaaaaaattgttcaccattttttttatttttttctttcaagaaagtaactgcaaagagtttatccccttttaaaatgagaaccttccttacctaagacgttcacttccaccacagcagtggcccggccacacacattcacagcctcaatgatatatgtgccagtgtcacttctcttactatcaacaatagtcactgtggatttcttagggacattttcaatggtaattcttttgtcctgcttcagaatcatatcagcctttgtccaagttattttaggttcaggttttccggttacggtggcaggaagttcaatcttggtcccagcttttacagtgagaccagcaaggagcttcacatcgaggaagatttctggggcctctgaattggaaaagattatttatgatgttatcaagttcaagcagatttaaggtcagaggcctatttgataagacaaaaatcaaaaatagataccttgtgtgtccacagcctggatttcctctgtgggtctgcttggtttgctagcaccctgcctgtttaaggccttcacgcggtaggcataccatttgccttcctcaagacctgtcacttccattctgtcagaaaacagaataggatgttttactgtgatgtcgataatcgtttcattgtgtagtactcataatctttcaaaaattcaaacccctggtataatactagtctttaaattaaacctggattacttcaacactataactgaatacattttcatttcaatactgtcatgaaaaccctgagcaggcagtacattcagcagcacctttaaaaatcagacagatacaccggcagcataggattctcaatgaaaaaagacaaacatttaaattttccccaacaaagcccattttagtgactaggagtacacatttactctcatgccaaattaaaaacctactttgtttctgcaacaggttctccacaggcaacccatttatcagaaccacgtggacatctttcaactatatatcctttgatgcgtgaaccaccatcatttttaggtggatcccatgttaagaagatgctattggctgttcgatctctccatttaacattctctggtgggtcaggtaccgctacaacatttggaagagagagtcagtcttacacaggccacctatgcagttctcttcacattgccaacccctgccttgccccataacttcaactctaggtctaaaagcaaaaacaggcaacaagattaggtaagaaatcatcaagaatgtactcacttgcaggagttgacatatttacaggttcatcaacatatgcaggttctccagggccacatttgttacgagcacaaactttaaataagtactcttttccttgaacaagatcaggaactgtgaattctagatcagtcacaaagtccataacctgggacaaagaaatacagttaatcagttatttccaaaaaaccctttcgccaacccaaaagatttttaccatgaccagggatacaaactgcagttgttttgaatgctagggattattcttacattaatttcatattagggaaaattgcaaagtaggatacatgataatatttgactcaatataagaaaaactgcttcatagtttgtacacatgaaaaaagatggcaaatgaggtgttgattctaccagtttgcttatcagaaatatgattttaattcagggtaaagaatagtaactaatataaacacaaggaaataatggctgattaggtcaactaaggtattctagtggaataagaagtgtgaccaccagggaaataaatatttactttccacttctagcttaatgggtacatattgggtacttagcaggtaccaagtcagtagggaatttttttttttattacaaatttggtaaggctcacaagacaagacaattacaattatacaatccttggttgagctacctcaggaagcattagcaccgatgcattcttaaaaagtttttgtacattttcagtgaggtaaaggtaagaagttgtagcacataagacttttgtatggcatcccaaccttctgggatttcccctactctcatttttggcattgatgcagtgctgctcaaaactcactttagtccatgttttccggctgacttctcgtttttcaacaacgtatccagttaacggacttcctccatcatcatcaggtggttcccaagtcaaatgtactgagtccttggttatatcaccaaatttcaattctttgggtgcacttgggcgagctgaaaaaaaatgcactcacgagtcactgttaatagtctgaactaatatttgttaatactgccaaatcaccttagatgataaatgttttgttccttaccaattacattgacatcaatttccccagaaattgttttcacacggttttctaatttcagtgtataaatgcccttgtctgaacgttcacttggagaaatgacaagttcggcataggcagacaaggtcttcattttcacccggtcccctgtttctagtactttatctccaaaacaccaggttgcagttggccttggatagcctgtacttggaaccaggatcgtgataggatttgggacaataacttccagaccatctttaaatgcacttaaatccattgttggttcaactacaaagaagaaaagttaatgagtttgcagtgccatatttaagtccctgttgccccaaagtagctatgtgctattccccgatctaaaaataaaatatctatttaccaaatgcatcgtcagcggtgagaggaccaagaatttcagatggatctgaaacaccagctttattttctgcagatactctatataaatatttatttcctttttccaatccggtaacctacgattatgaattaatatttgtaaaaaacacatacagttatgtccatgatccacattgaatattcttttttatatgcaaatgacctaccttgtaagtcagttcagggacaagtttcatattgcaacgaatccaattatcttttccttcttcgcatcgctcaattatatagcctaatattgggcttcctccatctttcagaggaggttcccatttgagctgaactgatgactgagtctgatctgaggaagttaggtttacaggaggacttggtctctctggaataaaagaaggagttggagcataccatttacgttagtgacaatttatgaaaacagtgttgtaatcaattatatcatcctcattaacaggtttatcaaattcactaagtaaagtaggcacagtctgggtttctaaaactttatccaaatttttatgatattctacctttttattaactttcatttaacttgatttattttaattgataggcctaatatctggatttcatgcagtaattatttcccttttttgatgggcttaccaattggatcagcaactttgacgaagggtgtggctgcacttggttttccaactccaattcgattttgggctctcactcggaaactgtactcctgtccttctaccacatcagtaacagttgcagacaggtcttcagctctcacagtcatggcagtatcccacctgatagaagtcttgtctcttaattcaatgacgtagtttgtgatctcagcacctccatcatactctggtggttcccatgtcagtgagacaccaaatcgattcacatcagtgatggttacattcaaaggagggcctggaacatctggatttcaccacagaagaagaaaatatgagtttggggtaacgatgatgaaggcaaagactgcaatttacttaaaagctaacttgaatttacttaaaacttcttaccatatttactccttgcttctacaggattgtcagtttctactggctcaccagtgccaactctgtttcttgcactcacacggaataggtactcaactcctcctttctgtagaccagtgacagtaaactcacaactctctgcacggtctgtggccagaacccaggtctttctcttaatgtcacgtctttcaacaacgtaacctatgattttgcttccaccatcagttaaaggttcttcccaagcaaggctcacttcaccatcaaatgtttctgtcacttctaagttacgtactggcccaggaacatctgaaattcacatatagaggaatttttttagtgtgctgtcttgcttttaaattgtgctttgccaattaagtctgagagacccaagggcttaccaataacttttaaattgatgaatccttctgcttttccatgtttgttctgaagcacaattttatacctccctttgtctcctttcttggcttctaaaattctgaaagaagtttgttcagccgtagtatcaatggtttttgtagataaaggttcattttctttaaaccattcagcttctgctttggggtaggcatcatatggcaccaccattgtcagaggcttgccaacatcaaccacaaggtcttggtcagctgtcttgatttttggtgcagctagtgagaaagataacatgtgaacgctttcgactattaaacgtagccaagctacatcatgttattatgcatttattagaaaatattggttacataaccttggaagtaagctacagtaactttatagcagagaaaactaagtggcttagagttctcatagctttttgttgttgttgtgcgtgcaaattagattggagagtagaggattgagaatggcataaaatcataagacatgcattccttgccaaaaatagtaacataggactcagtgtagtgcaaaacatgttttgttttgttttttgatagagtaggcactgcatacttagttcaataaatcagagaaacttttttcttatgaatgagaggtacactaatggctttttcataaggacagtgtataaggatgtcctgggtcaggatgagaacatacctaaaaggcacacaggggtttgtaaagtaggagagtataagaccgtctttagatttgccaagactctcagggtgatagcttagttgtagcctaagttcataaatagtcatcatgtactagcaactgtccaaggctctggcatgtaaagattattgctattaatttcctcttactcaagacacttactttgtagtgagcaaaattagagttgttaacatgtgggtagggcttgctagaaatgaaagaccctcacaaggattacctcattaaataactgtgaaatctgaaatctaaactctgtgatattggaaggatattttaaaataaagggactgacctgccagttcaagcttagctctggcttctttgtctttggcaataaatctgtattcaccctggtcacggggcttaatatcacaaatctgtagtcgatgtatctttccttcactcatcatctggtgtttatcaccctggacaacaaccatgttatttcttagccattggacttccaccttatctttattgagttctgctaaaaagacaacatcagcaccaggggcttcaagaatatcttgtggaggcctgatgatctcaacaggaatttctggaaagaaaatgtgaaataaatacaaatatgtttacattttgattaacaattttaaaaaattggtaacattagaattgttttttcacttaatatgtaccttccacaaaaagtctagcacgagacttcctgtcttctaccccgcaagcatattcacactcatcatccagcctgcaatcttttataatgagtctgtgtatacttccatctttttcaaatttgtatctaaaggagacattggattatcagttagcttgcaatgatggccactaaattgtcaaaagtgtatatatagctacagaaatagagaataaaaagatcttgcttactttttgccttctttgatttctctcccatttctgtaccattttacattggctttctctctggagagctggcaggagaagacagcgtcatcgaactcagtgactgtctgatcttccaagtgttccacaaattctgtcggggcttctatgatgagaagctcagcaacagatttatcttgtccagcagtgacaatgtattcaccttcatctgggaagccacagtctttaatggttaacatgtgcttgtacttatcaactctgtatgagacacggttgtcaaaaggcacttcttcaccatttttggtccacttcagtgttacattgagacgattcaccttgcaccagaatgtgacagatttcttctccattgtttcaatatctttaagaggctcaacaatcctaaggtcttcctctgttgtaaaggagaaaaatatgttgattttaattatttttataacagaaactgatgaaaaaatctctagtggtatataaattacttaccttctactattagattggctgcacttttaacattttcacctctgtgattggtcaaagacacattatagttggcttggtcatctaagtgtgcatctctaattctgagggtgtagactaggtctttttggagaatgatgtattttgaactatcaaatatagcttcttcatttctgaaccatttggctttggcaccttcagtattgacttcacagttgaagacaacttcctgttgttccttcacccgggtgtccttaagaggaactacgatcctgagtttttctgaaagcaaccgacaagactttatagtatgaataatgatcaaagtggtaaatacaaatacaaaacaaacaaacaaacaaaaaaccctaaaagcaagaacaaacttaccaatgactgtcaagtgagctgctgctctggcggcccctaccatgacaacgtaagtgcccatatcttgtaatgtggcatctttcacaactaggaccctctttttaccatcagcaataacgtcatatttatctccagattcaagtgtcttatcatccctcttccactggactggaaagctttcttttgatatagagcagacaaattcagccttttctccttcaagtatttcaaggttttgaggctttgagataaattcagcagccagttctgggaagaaaaagttacaagatattagaaacatatgtctttgtactttaaatctagcaagtgtgaattgttagaaataaaagattattcactgtagttttcataccatgtactttgactttgccatcggttcgagagcttgggagtcgacagttgtagttgccagcatcctcaaggtgagcgttctgaatgaccaggattctcttccgtccttcagtcagtatttcatatcttcctgtttcaatgatctcctcatcccctttataccaaatcacttctgcgccaggtttggagacttcacaaaccagttttatagtgtctgtttcactaacttcaatgttggcaagatttttggtaaagacagcttcttcttctgcaagcattgaaaaaacaaaaaccacattgagttaagctggaaattattattttttcccaacacatatacttcacaaagaatgactttactcttacccagaactgtcagcatgccagaagttctcgctgtccttacttcacaggaatattcagcttcatcatccagtagacatttgttgatgacaagaatgcgcactgctcccttggatatgatgtcatattttttgccctttttaatttcagcaccatctttaaaccacttaacctatatttaagataaatagattatcagttttcttgttgttccttcacacaggtgtccttaagaaaaactatgatcctgagtttttctgaaagcaaccaacaagacttcatagtgtgaagaagaaccaaggtggcagacacaaatataaacaaaccccaaaagcaagaacaatcttaccaattactgttaagttagctgctgtgatactattatcagttattaaaaacaatgggatcatataagtttagagctatagtgagccttagacattatgcagactaacttcttggatgtgtaaactaaggctcagacttgaagaaacttgccaatggtagttaatagcaacaggaggtacttagttgaaagaaatataattgctgatatttgactttctgatctaagaaaacagcactttcatatggttcaaactaatatctaaatctcctgattgtgagtccagtgtttttcaagtaatagtaaattaataatactaaaaagagagcaattaaagtcaagaatacattttatactacaattatctttaaaagtaaagtggtgaccagagaagttgtgactaacttttttttttccattttggctagaccaaaagtaaatataaagttatttgacagtacaagatgacaggtatacagtcacagaccttagcattttctcgggaaagttcacactcaaatcgagccatttctttttctctaacttgaaggtcggtgagtggtcttaagaattccacatgaggagctgtaagagaatgtcatcagaattcaaaatgaggtttctggaaatttactctgacattaccatagtatacattaagaaaaagtgactcttttttagggattttccatcttaatagactacaactgactttgaaatcacttgaagctgcccatcaggtatgatgctttgctttttagatatctctttagtttacataaaattatgtggcattctatatgttcaactagtgtgcatgtgtgtgtgtacagtatatatactagggagccatctcagttcttttgaataatagctggaggaaaaatcttcatttgcactgcaccagacttgaaagataatgtcaaaggaaacttcagacaccagtggcaaagaaacattgtcttatttaaggcacttagcacaatctttgagaaattagcagaattcaaagatagaacacgtgaagcactatggccagccttgtgtatggctaagaggcatgaggctgtaattgaaacatacatttagctttttaaaaaaatcagctttgaagacgtcacatataagtcaggcataacatctattagtgcaataaagcaatgtgttttgtatgggagggtgattaggattttacatctgttatttcattcatctgtagaattaattcagctggtgtataggattagggagctgcccccttgcccttccttctttcagagctccctgtgagtccttcccaagatgaccattcttgagcaataagattctgagacaaatgctgtctaataggtttgaaaatatgctccttgcagctgagccttcttggagtgaaggtagatgtcaaggtgaagaaggagacccaagaagctactttgacataagcttgagcagagcaaccacaaagtggtaagaaaaacatggtacaagatgcatgaagcacagagtcactaggttgtagctgttgacagatgggaagcaaccaaaccaaacaaacaaatattgcacaaaaaatttgcagaaaaatgtcatcactggacaaaggaatgaatgaaacaaataagctagtatgtggcattttgaaaaaagacattacatttttcaccagaggaagaagtaatgttaaaaaccattagagttctcttcattcaaagagtccaggactcaaaagatccagggcctcactccatcttcttatccattcttattctcagagattgaatcatgtgaatgtgctttgtcatattacagcagatctctagtatgctcctattcagactgaaatttcatgctcattttctagttgttccccacacctgaaaattcattttccttccacatggaaatcacttttactttgtttttaaaattaggactccctacttatctttaaaattcagtttctcctcatccatatcaggatatccatacagtaggctgaccccatgtagacaaagagcacatctactcactactcagtgagagaaaagaagcatagggaaaagtgattgctccatcattaatcagaccagacatagaataagacttttcttttctttttttctttaaacacataaaggatcaggttaggtcagtgtcaatactagaagttgccaagaaatgcagttaggccaagaagggcatgcaaaaagtgttgtgttgttttgttgttgtagttattaaagaattgcaaatgaaaagtcctttgtaagaagaatacttacgcacgacattcaggttacaggaagtcttaaaatccttagcatcacaagtgtatgttttaatatcctctggggtacagtcatgtataacaagttttctgaccctgccatcagcaacaatttcatacttcttgcttttgaggatttctgtcccatttttgaaccatttcaccttagcattttctctggagacttcacactccagcactgcagtggctccctcttcgaccgtctggtcctcaagaggcttagtgaattcaactgggggttctgaaagaatcatactcattagccaaggtactcctttccttctccaagagttttggtaccttctcaactttcccctgccatctccagggctttgttctgtcctaagttttattttcaagttttgattacactcagacattttcctctaaaaatgatattttatcattatttgtacagacaagaggaaaatcatttttaaaaactaggaaacattaaggaaataacagccaactcttggttaataaagtgatggatacctagcttgataataattcttcctccagctggcttttgaaaatctaggatgtgcaataaaaacaatagagatggaaggaggaagtaaaacctatgctagtcaattttggctctttaaaaagatagtctgtgaattattttgttatgctaaaaagtaaaatcagacttttgattatttggttgattttaaacatctatagtactcatcatataaagataattgagagttggcattgttcatgagcctctgccttatacatgtttttaaaataagccttgtaattacctttcacaaagaggttggcgtgagttttgaaatcttttgctgttagttggacttccccagcatcttctaactttacatccctcagagtaagtgtatgaacttttccttctgaacgtgggaccacctagttgtttttaaaaaaagaatacatgaaacagcaatctagtatatgggtgcatttaattcatttagataaaaataaatggaaatagagctttccaagttgttttataatcatctatttagcacgtatgcattcaaaaatcatttcaaccaatagtttgggatcttttttttaaatttatttattattattatactttaagttttagggtacatgtgcacaatgtgcaggttagttacatatgtatacatgtgccatgctggtgccctgcacccactaactcatcatctagcattgggtataaggactataaatcatgctgctgtaaagacacatgcacacgtatgtttattgtggcattattcacaatagcaaagacttggaaccaacccaaatgtccaacaatgatagaccggattaagaaaatgtggcacatatacaccatggaatactatgcagtttgggatctttcaagaaaattttagggtttcatagttacctttatataattactaggtggcctttcacattgaaattgcccaggccagtttctgtttacatttgtggtcttttttgcatatgcgtagatatacagcacatatagtatatacgtatatgtgtatatatatgtgtgcccccattctgcccctgggcttatatacatataaaggaagaacttagaaaagcgaattcatgaaaggatgaaagaaaatatcagctatggcaagctaaaagtaaaccttatgttctgtatgtaaggtgtttgccatgcaacaacaagctataactcttcttcccatttattttagcaattaaacttattttgcaaaccaattaaacctgtgattaaataatttgtacaacctattaattttgttcaaaactgcaaatgaaagttggactcttcttcctttttcatgtgtctaagcatcaggaatgggaaaatcagatgtcaatggtgcgacagataggggtcattctgacagcaaagataagagacttgggggttcttccagttctatgatataaaattcctaagaagctgtgccctgtcatccagactgattttgcactgcttaagagtttacttagcgttaaaaataatgtaaagtttttcaccagtggaactatttgttatgctagtgtaaagaaaagaatcagaaataaggtttcatctaaaagtgttttctttaattaagaactgggcatggttagtcacataattatcttaataattgagagtggccaaaaaacataataaggaaaaataacagctaggagggggtagttaaatatgcccttggaacagagctacttatccgagggcatggtgctgaaatgggaaaaatttgtttttttaataacatttcagtataaattttggcatgcaacttttggctatttgaaaaggtgtctcagtttctaacccacccacagatatattttatctattaatattatgttgctttatcatctgagttcctctgtagctactctaggacactgctcagaatgcagtatgtctcaataaacagcttgtatacaatctacctccactatgttaaaagaaaaaaaaggaaaactggtaggtgccttataaaaataaaccaatgaaatgaatgttgaagattttgcagtagattgtaagaataatgttagagattttaaaaatatttatttatagtggaagcatattaatataatacggtaggcttatgaccatgacaaaactattaaagttttgtatttaaactttaattttatcaaatttaaaatttaactttaaaattatcaaatgccatttggaacttggcagtcctttcttaaactgacagccaaaaacaactacaacaacaaagaaaaaatgcaaacaactcatgtctacaagtttctcttcatatttcctattcctacagcttgtttttgcttgtttggttattgtagttttgaaggcgaaaatttttacataaaatgagtattaaagttcggaattacattgacaagagcaagtttgttctgacagacttaatttaaacaaaatctgccacatgtaacaaaatgattttattacttcaaagtttatatttaagttctttttgaaaagagacatttaagtaatgcaagagcaagttcacaaaaggctaaggtatttcgggtgcctagagtaaaggattaaaattcctatgccaaaagagatgtaaaggggccctatagaattatagtaaactgatcctttctaaccctagaaaaaattttagttacaatgagaattttttaaaaataaaatgtgaataagatttttaggagtctacatttgaattaaaatagtgcagtttttgtattagaactgagactgatcttttaataagaagctcttactatgacaaaaagatatttggtaatgaaaaaataatatcatttgtctttaagcagtgttcctatatataaatcatgaatttgcagatctagaaagaatcttgaaaaagcaaccaattctctgcctttagacatgaagttaattaaatcatgcatgataggcaaaatatattttttcaaacaataagcttgaaggtagaggtgcctccctcagttcaatatttagaagacctcattgtaaggaaggttttgtgatatgtaacttaattcccatgctacaaatggaatgtactgctgctttttctggtcactggaaaaggagaccaagaagatcttattatctgtataacaggcaggcgttacctatcagatgactgctggtgaattaccctgtaatcactttagtggaatactagttttgttgttgttgttgttgtttgtttgtttgtttcaaagcagttacttgaaggcattgctttcaaatacttcagtcaatgctgtggctttttgttaaactgaatcactttttaattatattcctttaagtcttcaaagtttgatttttgttgagatctttatagcacatttaatagtatttctgaaatattgggggaatatgtcacagaacaatgtactgtcctgtgctttatttccaacccaggctggacatattccatatattttattttaagaattcaaaattaatgatggattgtcaagataatttaaagacatatgttgtttctggggacaaaacatatagatcaatttaggcaaattgtattgtgggcctatctgaataatcccttagtttttacttatgggtaaaatcttgggcataaagaatgttagtaaaagctaaaagcaggagctagttatttaccaaagcttaaaaaaaatatttcatccacatatgtggataaccacagagcccttctttcttgtcagtaccatcagttgcactttaaatagtccacttgcattccagatatcgcacagcccagagcacttgaaggttaaaaatagctttggagaaatgcttgaagagcaaatctgcccagaagttatctcaactacttgatcaactgcccgaaatggaatttcagtcttctcctcttaatccccttatatgcagaacactaaataggatggagagcgttagtcttaaaacttaatgtgcaccatggctgcagagcgtgcaatcagaaagcctttttgatccttcctgccttctggttaatcaaactatcattcatagtcaatgagtcttgtcttttcttcaaaaaactaaaacatgatcatactttaaatttatttcaatttcaataaaaaaatcatcaggttaaacctaagaaaaaatgcaaaaaattggctttacagtttcagcagaaatcaggctaaaggcggaaagagaaaggcaaagacagaggaagagacattagaaagagcaaagaataaggaacatacaagtgaaggtggaagaactccagaaaaagaacgggaaagacaaggcatgcctgctttttaccttatcgctgggctctagtttcttccctttgagataccattccactgggatatcttcgtaggagagctcgcagtcgaaggtggctgtttcccctgcagtcacggtgacatcctttaaaggcctcagaagaccaattactcgtgcttttcgagagggaagaaacagctttgcgttactcattttgtaatcccaaaagaataaatagagacttagatatgaatcttcatggttgctttcttcaagaagccacaggactggccactattttaactcccacgtgaacgtggccccacggcgctgagaaggggagagctggtagccagagagcgagtatatgtaggggccctttcgttctgacgtacaaggtcagcgagaaatctgtgctgcatctgtctctctgccaggcgtcaagttcttcttgctacataaggtatgtgacttccaaaataactaagactctgattgggagaggacaaggggccctcaatcagaggctgtccctatccatcaaacactttgcaccttccagaaacgttagcctaatgcttcccaccttctttcttgaatctaaaatgcccacacagcaaagcttgtctttctggtgctctagttgcacagccacttgagggaagtggtctttaagggttctgagttagattctcattgtatgtgtatctactttcaatgagaggactacagagcaggaaaatctgatttgctaaattttcttttgttcaaatggcaaggtcaacaaaatttccaaaactttacgatttgaaccacttctgtattggaatgtcaaagtggcaaatacaagagagccagtttttgtgttttaataatattttctaactaataaaataggtccaattaatttcactcacattcattttctgaaaaagtgtttatttaatttccctgaaaaatatacaatacttacgcttaactcggaggtgggcactagatttaacattggcagcttggaaatccaccccacccgtctggtccaggcgacagttgtgcaaaacaagggagtgtattttgccttcttccttaatttcacaatcctgtaccaacaaaacagaaaaactttcatagaaaataattttctttgaaattttgttctaaggatagattatcttaattaaaggaatgcaacaaataaatggtgatgaaactttatataactttgagctctttttttaggaagtaaagcttacaagtactaagaggaaagccacatttattttagctgtataattctgagccaactagcagcatcacagagtatctacaaccttatactcactctgctggatcaaaagtaatgcaagtgtgccagtctgagcccattcatagaccctgacatctctctttggcttagggtctgatagagaaactgctatcatgttttaaatgtcctgcatccactctgactttcacctgttcttttctaattcacacagctcctttaggtgttgacaagttcagaaatagccttacaggtgtttggagtagggcctctcccttgagtttccagttggcgtggatatcatcttcagagatttcggtttcaaagcgtgctgtctcagtctccatcacctccacactgtgcaggggtcgcaccagtttaatttcccgatctagaaaagtgaagggccagcatgggtcattagcctctggcacaaataaccccaatgcttcaagagtgaaactcatggaaatttccttaccctcaatgtcaagttttcctgaggtcttatctgtcccacagtcacaggtgtactgtccaatatctgatttcaaggctttctttaggattagcatgcgtttcttgccatctgccttaataacagcatttttggatggctttatttccttcccatccttaaaccatttcactggtgcatctgctttgctaatttcacactgtagaataacttcatctttctctacaccagtataatcttgaagttttcctgtaaaatatgggtctccctctgcaagtaaagtataagtgaaaagcttttattaatcaccttagggaaatgacaatctcttggaaagtttaagacacaactcacagagttctgagtatcttttaaaattgtgtcaagtgttcaatcatttaacctgtttatgttcaaaagttctctaaatattaggaagggaatcagtgtgtgggatttatcaagatctaatccattcatattgaattttgaaacattttattaacagtagctaaaaagactgaaatttagcttcaaatacaattttgtgttcctccattatttgggtaaatttctaattcttagcaactctattatgtctagtttacttttaagctttcaggttcacattgttagtttttcttaatcaattaatagtttgcctttaatcatgtctatatatgttagccttcatgtttaatcttgttgatattaggtggccaagaaaaacaatgaggcttattaatgtaaattatgtaatatcttctcttatgggaaacttgaaaaacattcctctgaaataattttgataaaatgaagagatagaaagtatttatatactcctattttaaacatgacagggctcaataattaatgaagaattttaagttggcttttaattggctattttgtgggtgtaagctagaatcttcattaacttatagtaatgaaggtaaagtgttttagaaataagcctgattacatatgtgatagcttcttaaggagttgggctgctttcatgcaatataacacttagaagactattttatagaatagatactccacaaatttctgttgaatttaatgcagtaaaattaaaatttaaaaagcacttaccaagcacagtgagtttagcttctgaactcatccccatagcttctactctaatttgggaggtgtcatcaatagacaggtctttgaatgtgatcgaatgagttttcccttcgtcttgcattgagaccgacctggtggtgtgtaggcgctggtcattcttgaaccatttaactcggatgttatcatgagataactccacagtaaatacagcactttccttctctttggcagttacatctttgagaggggtgaggaatttgagccggattcctatcaagaaaaaaaagaaagaacttattaattgaagcactttaaagaagaaatataaaactaaaggcaaaaaaaatgattttggggtggactatttgataaaactatttaccttcaatgatcagtttgccacttgtgtgcttatcttcagcttcaaacatgtattttgcttcatcttcaaaagcagctgacttgatcaccattgaatgcttagtgccatcctttataagctcaaatctgtcatcacctgtgatttcctgggttccttttagccaacggaatgttttgggctccctggatacttcacactcaaacttagcctcatctttctcgaagactttaacatcactgagaggtgtgatgaagataagaggcaattctgaaagaagtggacagtggatgaagtcagaatacgtttccattgatgacccttgatcaatgcaggggtgtatcaggaagtcttgcagagaaaatacaaaaacgtggctgacaagtagagcatacctttcactttcagattggctgcagatttggcattagcagcctggaaggaaacctctcctgtcatacccagctgacagttatgaaggatcagaatatgcttctttccatcctcaatgatttcacagtcctgtttggagtgagggttagaaggaaagaaagaacatcatttatatagttattcctacaaatcatcaagatattttatgccttttttcaccctacacaaccaagcaacccctctcctatataattagctaatcttgacttacaggggaagctgtcaaaggctgtcctttcagcttccactggccgtgaacatcaggttcagaaagttcaatttcaaagtgggctgtttcaccaacaaacacctctactccgtacagaggcttttccacttttattagtcgagctgaaatgatacagttttgttagcatgactgaactaataaactgcagattcagatagggtaaattttacattgttgagcaactcaccctcaacagtaacatttgccttggtcttgtctgtgccacagtcacacacatattcgcctttatctttaaggtccgcctttttgatttttaagatgcggcgcaggccatctgccttgatagaatatttgggtgaagggacaatctcttcaccatctttgaaccatttcactggtacatctttgctcacttcacacttcaaagtaatctcatccttctccactgcagttttgtcatgtaatttcacagtgaagtagggatcggcctctgtaaaagacatttagcataaaattagaagaatgtgaaaattaaagtttattaaagagtaaaaggttgcaaaatattttattactccccactcccatgattcagaaactggctatctggttatacttggttacatttacctaagaccttcagctgtgctgtggagctcagctccttgacttgagcttttatctgagatatatcatccaatgtcacttctttcatttccaatttgtgagtcttgccctcagaagagatgagtactgttctgcttgtatggagtttggcatcatttttgaaccagactacatgcattttttcatgagaaagttcacaaacaaaagttgctgtttcaccttcttttactgtttgatcttcaagaggtgacatgaatttcagtcttatacctgaaatgcaagcatagataatgcctcagaaacacaattcaccttcagaaagattccattctaatctgcctgagtaaaagggacccatttcacatggcacttatttattcatctttccaaatagagctccactaaaaacaaattaaggggggttgttttggtaacactgtgaaagttaattagtgatgcattatcacagcttttagaacttggcgtcctatctttaaagtcatatatttgcatgcctttatgggatgtcacagatctcattagctcgcttacctgtgacaaacaaccgagctgaggtcttcttgccctccacctcagcagtatagaccccttcatcatcaaattgagaatcattaataacaagaatatgtttctttccatcagcgatgatatcaaatttgtcagatgacttaattatatcaggtcctttggaccatataacatttgcctctcgggtgaggacacattcgaatcgagcctgtcgcctttctggaacagtgacatccttcaggggcacagcaaagtcaagttcgatttctgaaaatcagacattaagaatgaggcttttcagaatgcacagggaagtgaaataaagttgagacccctccccaaattctaaaagccccataccttttactgtcaaaatggcagttgtaattgcattaagggcctggtagaggacttcaccagcttggtccagtttgactttgtgcaaagttaagaagcgttttccaccttctgctttgatttcacaagtctgaaaaacaatagttttagtaaccatttgaaagagataaattccctataggagaagtgtttcagatacaaatttctatagagttttaaaaattactactaataaaagtaagcagagaattccctgtcataacattttacacaaattgttcaagttgtccccaaatgatacgtaaaatttctttccttcttggagactttagaagactccattaactccattattattaaagcaacccgaatctaggatatagatcctgaatattggatgtggttattttatatgactaacaatttaaaatgtgaaattactcacaggtgagggccttagaagttctcctttcagtttccattgtccaggaatgtctgcctctgagatttctgcatcaaagcttgcactttctttctcataaatggtaacgtcctctattggtttaagcagttcaacttcacgctctgtattggtcagggatgaagtaacataatgctttagacaacccaacgatgctttgcttttatgtgttttggtgtgttatttggctttacacatacgcaaaacttataatttgaataaaaggtaagattttatacctccaagtgtcagctttgcagggtatctttttccttcaatttccactgcatactcagcaatatcttctggcatagcattcttaattttgaggtacagatgatttccatctctcagtatttcagtcttatcatttggttccgcagggatttcatcatatcctttgaaccacttaatgtttggagtatcttttgctatatcacaggcaaaaatagctgtccccttgggtttcacatgctggtctcgtataggtttcaccagccaatctctaatgacttctatatgaaaataagatcagaaaaaatgattaaggtctgaacaagtaatatacatagcttccttagtaaatttcaggaataggaaaaatttcacaatactgggcataattaatccactgtaggatatattgttattcccctcttaggtacaagatttctgatattgtaatactgggaaacgaggtcctttcttccattttcttagtgtaacaataagcagaacgaaatctcccaggaaagtactaacctactacttttacgcaagatgaacactccaggttgttggcgttttccacagtaactgtgtatgttccagcatctgtgtcatctgcatcgttgatggtcagagcccgcatcaagccaatgacgcctggcacaattcggccaggtttctccaccacaatcttgccatccttcctccagaccacgtcacgctctttgtttaactcgcagctcaagtacaatggctgtcctttgaccactgtgacttcctcttccagtgtttttacaaaacgcacaggaagttctatggagaatttcagtatatatttcaataaatacaatattttcaatgaaataaaacttggaaataagaggttttgtaaaactacaatgcaagttgctactaaggtttgttacattaaagtttaatatagattatgttcagaagactagaaattaccttctacaacaagtttagccgtggaggtcttttctttgtttcccaaacgtaaaacacaggtgtattcaccagcatcggaaagttgaacatcaatgatgtgcagctttctgtctttaccatctgcaataaacctgtgcttgggactctcacggatattgctaccgtctttcatccaggttgtaattgcagtggaaggggagaccaaacattcaaagattgctgaagagccaacgaactctgattctgtcaagatgatgtctttgatttctttcacaaacttcagtggcacagcctttagctggtaggtgaacggggcttcatcaggaggtttctctccaccacttcctggccttaactttctcctttcggcttctattggtgaaggagtctttttgggtacacctaattcaaagtaaaataaaaagttgatttggcatctccttaggagtcagaaagttcatacttggctgcctgctggataaaaccagccgtaaagcaattagaagacgagaaaactaaagaccaggcaattgaaaggccaattgagtttatactgccttgtttcaggcaggaaaatgagatggtataaggaatccatgaataataaatgtcccttttctcaagttttaatctgaagtataaaatagccagattaatgtctaattattttatctgccatgtataaataccatgcatatgaaaaatgaagctaagaacttatgggattcactatgctaaaatatagttggatatatatatatatatatatatatatatatatatatatatatatctccttgcataatactaaaagtattatttgaaatatcagaaaacatgctagttttagtagaatcaattagaaaaaataaaaattgttatgaattttgaaatttttttccccttgaatatgaactttggaaattcagagtggaaggttacaatgcaagtactagaaaaatgaatttcacctttgataggaccttttggcttggcagcctcttccttaggtgctttggcttctgaaataaaaataaaactcagcatttaaacacttttcggacttatttcatgtttaatagtaaaccatggagggtgagtcatgctccattataaatattaacgcataaagagaaattggtttcatttatatgacttctatggataatcacatttccaggaaggcatattctgagactgaagagctcaagctaaactgccaacatatttaggattaacaacttctttcagcaagtgccttattatcttcccatttttggaaggcttactgttgccttgtgaggaaaagttttgctcctgcctagctgtgcaaaatattttatatgtttatgtaagtcctgattatgtgaaccaaggaaataaggttttgtcaataaatcagtgtagggaaaagggaaatggctgagaggttaccaaaagcctttctttttatgtctaaattgggcagacaaacaaatccagggaagactaaggaaaaagagtccatgtaccacacatgcatgagtttctttgaagatttcctttagacaatgaagtaaggcagaagcaagagagttctgacatttagagtttgattccattattaatacagggacagtataaactgtggaatgagttctctagcttcagcccccaggataactgagaatagctttatttttatacatacttaattagacaagagcagttcatcacctttttctgaataataaaagtactacgttgacattataaaagtttaaaagaatatgcccaaatcataaacatcagcaacaaaatataacacaaatattaaaaattaaactacagtcaaaagaatatagtgtatttttttatgtcattaaacatggtaatgtccaaatattttgagataattttaaataaaaaaatttctaaataatttatataaaaatatataaacaaatataaaatgactaattattgaattaataatctaaaataatataatttttccaaatagttttatttattgatttattaaagatataagccaatttttattattaggttcagaaaattaaattaaaaaatttctctgtcaaactattatggacatttctaaatgttattcccggggcctatgcacatctcactgtggaatgtaacaaatagttctctttttttttttttaaattcaccctgaattttttattttgtgctttatcagtggagatgatcatttttccataggaacaaattgtcaaggcattatattgaatatcttagattcttcacatcttagaaaattatcaatacatgccttctccccaccccaccaccaccgcccccgctttaaatttactttgttttatttttggttttgttgtttcttttttaaaaaaataatttcaacttttattttaaactcatgggatgcatgtgcagttttgttatgtggatatatttcatgatgctgaggtctgggatatgagtgatctcatcacccagatagtgagccaaagggcaaatagtcaggatgtgtatgtttatcaatgactatcaattacacatcaaatcagttttgatcaattatatctcaaattatcacttaaatgatgaactatactaaatagttcatatacaattaataggtgctttaagtttggacttgagatacctatatcattaagttagaacatttaagaaaattattattgatctaattccttatacagattaaaagactgaaatatggagtctcttttttctttttctttcttattgtggtaaaatatacctaacataaaatttaccattttagccatttttaagtattcaattcagttgcatgaaatacattcacaatattgtacaaccatcaacactatccatttccagaacttttacattatcccaatatacacacttttttaaaaaagagaaattgttccaatagggtataagggaaatttgaagcttcatgggattcttatatgtatacccttacagggtctctgcctgtctccttagtttttatcagccccaaacatattcattacttaatctccaaagcatatgaaagaaatggtgcaacccaggaacgtacattccagttaaggcacaatattcacccactgggcaagagacaaggtggataaaggatatcacatgaagaaaaggtagaaacttaccataaacctccgaagttgaaatgatacctatgttgcagcataaacagggcttgaattttaatcaagtgtgaatacttttattaagtcaccaaaacaaactagcaaaaagaaagctacaggataaatacctgctttctttccaaccactggcactgttactggggcagcgatgggggttggttcaggttccacaggaggtggtttgattgttttcacttctgtagagagaagtccattgcattagtgtatcaatttgtcacttcctaaaaacttatttggtagcttatttgcctcttctgatataattttgaaatcttcaaataactagtttttaagagaatagtatattaagcattttgagacgttagaaatcatttgatacatactgactttcacctactatcttttattaagtacatgttatgtgtgtgaatacagaaagaatatgctgttgacattgaggataagcttgctcacctgcttcgggctttggtttcggttcaggtgcagggagaggtattgctggcttgatttcaggcactgaaataatttagagtagagggcagattattacaggatttttgaagtttttcacaaagtcaaaactaaaattaagcccacgtatcttggaagatattagaatttatatacatataattatcaaatcaagtatttgattagttttcattttaaacaaaatatttggaaaatatagtaaggcaatgttcttggttttaatgttgttatttatctcattgcccataaatacaattttttttcaggtaacttatttagcaactgagtaatcattagccaattgcataggagagtgagatggtaaagaaaattaagccatatgtgattaacagattaaggtcatgtgttcaaatcttgatgtcagtgtaatgatattttaaatgatacatatttgcatttttagagacaactaagaatgacagtagatttgtaccttttgttggttcaggaatcttcctttccctttttgtaacagtaggtacttcaacctcttcaacaggttttggaggtggtggttctggtactttaagataagattattttttcagtgttaatatttgaatatttaggaagcacctcatctgaaatatcaatttatttttcaaaaactctatggatggttttttaaaaaaccttatagtttatcaagtaatttctattttattttcttgactctgcttccatttatttttcttccttttattccatccacttatcttccactccccttagctctctccttctaaatcacttctataatagttcccaataattttgccctttgagaataggctaatgataaaaaccaacccatttaaaagcccccagattatgaaacctttgctgacaccctcccatgaatagccacttgattatttcagtcatttctactggaagaacttaagttgcaaagtaatgataagaatgaagtgcagggaaatacatgaatggatttgggaattactataaaaatatttaaacagaaagcagacaatggaaaacagagactacatcacagatgaaatatgaagccatgtttacatctaacttcatttatgtttacaagataaaccttttgttaaatgtccattttgttaaaagataatcttacaaattgtcactgagattcctacctgcaggttttttaactttttctagttttttaggttctactttaggttcttcttcttcaggtctttttcttagaactttaaagacaaaaaggtttatatgtaaaccaagacaaactaatgaagatgttgaataagcttgacaaatgcaaataatgtacaaagcaaggaaaatgaaaaaaagcatgctacctagcactctggaaagtaagcatttacaccgaaagtgttttttgttttgttttttttaaaatcaaaggttgtcaattataatagcactcaaagttactttgtttctatctagatagagggtctattctgagacaagtctgtgggagaaacagctccaacacaaaatgaataatttgaatagcaacgaattataataataattaaatgttaatgatttaatgagtatgtaaataagtagaaagtttacttaagcagagatatctgaagaaatgtagcctaaaaatcagtaattctatgtgaagacaatgttagaacttaattcttcatttgactatcttgtttctcattctttaatattttattagtcagaaagaaatgttcagttttttaaaaatgttatttattagttgtggtgatcctgtgtcacactttaaaactgaatattgaatttaagctaaagtagtttcatgtaaggtatttaataggtttagtgtactttactacataatttggttatgaaaatggcagtcatagttgttgttagtttagaatattatcaacttagttatgtctattaacattttaaatttcaaaatactgtgaatgctcacaaaatttctgtcttttttttttaaaaaaaaagatctggaaatgacatttttcttaattttcaatgaaactacaaacaaattttgataaatagcgaaccaattcaaagaaaaccaaaggacagaaacattttgtaagctttcaagttcatttttaaaatatacttaacgctgacagaatggttgaaaaatactataccgcttttcagaacaacttcttcctttggttcaggtttacgttccggaagtaatttgcgaactttcttttcacctccaggcacttaaaagaatatgatttcaaattttgaagtgaatttatataaaaacggaatttcaacaagaaaaatgtctctcctaaaactagttaactgtagtgcattaagtaacaattttcgctgcatataaataccacagaatttaagtttaaatgatacatttcaagttatctcctctgcaaatatctatacagccttgtgatgaaattcaactccattaactgcaggcaaatgtattcattttaaatgcatgtagaggatgttgctccatactgactttatgaatctttcatcaaattacagggttcttgacagcatctttgtcccaaactgcaattgtagattgtccaaatctacgatgttatctacccaaccactaaatgtatgaaaatgatactggcaagtgttagtgccatcattcagtcttctccactgagggaagaaggtggccaagagttccggtttgtgactttgatgctggggaagggccatatctcactttctgaacagaagaagagtagcctttcttaagatttcctttttgaaataatgctggataaaatatttaaaattatagaattataaaatttcaaagctggtgttggaagctcgtttttcatgaataagaaaatgttcttaaattcattcaaattaaggaacgcaaggaattcaaaatttcctgttgcgtctacagtgaatactgagcatggtggatgatgctattttatagagcagcctcttttgctattatggccctcatagatttgaatggtgaaagaaaggaacacgtggtgattattaaaccattttcctctctactaatgtcaattaaaatctaatttaaaacagtatttatttgtattgtgtaactatttgctattaggaatctgaatttttagatatttctataaaacttcctatttagggctttaaacaagatatttgcaattcattaaatggttttttatgtgataaagataactgcttaactcttatttcaaaaatttaaacctacaataggcaaatatgtatttcgttttgaataatcatttttttaatgtcaaatattttaagtaaaaattttaaagttaaacattacgtattttatccaggataaattgtgttggccttcaatactattttagaggtaccaatcttcttaataactatttttattgctcaaacccagaaggaagcacatgcatctaattaatgtaaagtgaggaggcataatatagattttctttactgatataatgaacatagtgaaaatatatctgtgcattttttatattattatttgattttaaaaatcttattgatgtttgagaacccaacattgtagctattatttttaaagtcattatatgtgattatatgctattttaatgtttatgatcaatatccatgataacattattttgtaattgcctctttatgaaatcaggaaatgtatatttatatgggtgacttttttccccaaaatttcagagtgaccagaaacagtcttaatttctaggtctgaatgtgttgattacttgaacagaacactactacccattagaaaaattatgtttatttttgatagatgttttctagactcttataattcatttagttttctttagggtctaattttagatgagaccttattagggaaaatattgtttacagaaaaatacattttgaaaaattacctacagtaataaggaaatttttctgaaatgtgagttccgtacccctcagagaatgacttagagccagtgagaagagagtgacatgaaagtcctaaggaaatccctacaaataaccttaataatataaaaggaagataggacttatttttagtgcttattacattggctaaaatttttatgtcaggtgaaatgtcaaaacagtttactactagctctcagcattttaatctcatatgtctcttgatatcaattttggctaaccagtaaaatttgttatttttaagtttaggaaaatgcaagaagacatatgtagatgagacaaagatagaccatgtctatacatgtatgaaatggatgggagacaaaggaagcaacactcatgagccaggaccataaaagccacagaaatataagaaatgaatgggactactctctgatcattgaaaaagagagacagaacattcgatggaggcagaaagagcaaggagtcaggtaaaggggtactacataagtatgtatttttcagcctgtgaaatacctttcagaggtgtaagctccactttttctggaacctgaggtttttcaggaactttcttctttggaatagctttaaagaatatgattttacttttgttatttgtatatttaatctgaagcaagtgattaactttctactccaagaatcaaaaccaagctttgcttataaccagaaagcattaataacagccaagaacagccttcaaagaacatacaagcagcattcgaaccatgaaaacagactgcagttttactccaaagttcagtagttaattaaagaccagcagaaaaagaagacaatttttgttattggcaggaggaagaaattttcctttaagcatatattttacattaagggaaatgtatttatgtgtgtgtcttcatggagtgtcaattaacagatgggtggcctttcaagaggtgccagaaggtccccctaatggctatgagggttgtagagggcaagaatcaccagcagcaatgtcttatgctggaagactgtggtttgaagatacataggtctgtatagggaaagtgcatatctaagattatatctagataattttagattggggaatcatatgacgtcacaagacaactttttattaaaataagaataatatgtttctgccagtttatttcagcttttaaagaaactgatatttttaaaattaagtaacattgtgtcaattcatagaaaaatcaaaatataagaagggggaagggaagtttaataataaatgctggataccaaatgtcttcataaccactctttccagctcccctgagaaccacacagaacacttctttaagttgcaagaaaaaaaaagagatgggggaactgtaacaagtcattcatatgctttcctttcatgatatataggcacatatcagctactggaaatcataactatattacttgtaatatatttaaaagcacatgcaattctttaagaacaaagttttggcttttatgtaaatgtgttactgcaatattaaaaatatcttgcaaggatttcttatacattccttaagcataagatcgcaatgatatgtatagcaatcaggctttgaaatcagaaaactctttctccccactccacaaaagaaagttaattggacagtgcctgcattcagatatcccggatgacgctatcaatgtactttctgacttttgcagcagcaggcatggcatgacaagcaacccaggaaccatggggcagcagaagagacagctctatgcaatctcacagtacaatcatgtctgaaagtacacacttctaaaagtcatacatttcttgcaagcatcatttcagatggctggatagaagtttgaagcaggctaataaaactttggaagtggcattttttacctttaagttggaatattttctccttcacatcttccttaggtggagcaggtggaggaggtgggggtcttggtttgagttttggcttctcaataaccttttcaggttcaggttcttgaaagagtatttcagaggtgttagtatatgtatatgttagcatgtggatatgtagtatatttaatagaaattatatatatatatatatatatatatatatatatatatatatatgaagtacaaagtttactttttaaggtacgtaataccagtatccaacataaaacacagaacataaaacataaaaatatcaaccctttacaaagatgatgagaaatacagcaaaggcaccaataacaacaacaaacaaagcatccagacaagccacagttgacatgagagaaacagtacaagttacatggaaacctaagaatgaggctcacatttacaacaaagaatactttacatacaaatgggaacagacatactacatatgtacaacaacataaaccatatacatttcaagagaaagaatatgataaagaagatttaagtccactggattgaataccttttactggtatttcttcaggctgtggttcaggttcgggctcttcaggtttaatatacttttcaatttcacgttctttaaagaatgttgacaaaggagatgaggttgcaatgtaaagttcttcaaaaagactcatacaaatttcacattgatgcaaagattacagtcacaaaataaaaatatacaattcatacaaattcatgtatagaaaaattcacgtataagaaaaagttcttttacttgaactgcctattaattagattattcaatgtatattgatggcaaatgagatgacttttaaaatttgataccgtgttatcatttgaggatccaaggcaattattccattttgcttcagtaaactgtaccttttggaaattgtaattaccaacaacagtaactaaattaaagattctaacttaaaagaagtgtaactatttcaaaaataaagcagtcaaacatgctagactgctcttgtatataatttcaagaaggaatattgtcctgtaaatgcttttgtaattctaacaggaatcttcaggagattaaaaaaatgtatatatatatatatatatataccttcaacagggggagtctcttttctaccaatggttatagatgctttttcttcatatattatttcctcaggagtctcttcaactttaaaaaacatagtattttattttagactatatttagaacagaatactgcaactactattctaacatatcaacctagttacattaagtaacactctataacagattattcagatgaccccccaaatatcaataacttcaatacagacagacaaatacgtaagattcatctacaatcaaagcaagaggatgaagacaattgtcatctttccaagatttatggagaagccgtgtaccttcagcaggtggaacttctggctctgcagggataggcacagacacttccttttctgggatgattttctcaggcactttgggcactttaaagatatgattttgtttactattaagaatttagaagacatgcaagattgtctaaagagcaggcaaagaatgcaggggcaagagcttcatcttagatttcatggggaaaatggcttctgagacatggcaccattttggacatcctaattttatatatgaatcttctcagctttcttcatttgcttctagtcctctgtgtacacttaaatgaaggtggtctaactttgacacttaaaaaaatttgctctacattttctgagtaattgttcctgcacactcaattcttatttacatgtgaatgactttaagatctacatctctaggcctgatctctttcttaagctcctgatacacactcccaacttttatgctttaaaggtgaaaagcacatctaccattttcctctaacgttagttcagagacccaatgaaccattcttttggccatctagctttaaaccttacaatgatcttgggctcctcaatttccctaatggttttgataatggtcagaggccactaagtctccatctctttcaaacccagtccccctttccatttctgccgccacggatcttgtccaactcttaaagaccttaaataattgcaatgggtctttactatttagtagctgaaattgctgccagttatctttctaaagcccaaatcctattaatatgtaagcctgcttcaaaatctttgaagcttcctattgcctacagaaaaaagtacaagccttttactggcatttgaagtactccaaaatatgaccccatctttatatctggtattatctttcaagacattccacagccaatccatactcaaattgagtttacttgacataagtttacttgacaatccttgaacattctagacccttctatctctgtgcctttcaatatgctcttccctttccatgggatatcatgtcctcaatttcttttttttaatttttttgagacagaggctcactctgtcacccaagctggagtgcagtggcattatctcagctcactgcaacctctgcctcctgggttcaagcaattctcctgcctcagcctcccaagtagctgggattacaggcacatatcaccacccccagctaatttttgtatttttagtagagacggggtttcaccatgttggccaggctggtcttgaactcctgacctcaagtgatccacccaccttggcctccccaagtgttgggatgacaggcgtgagccaccacatccggccttatttcctcaatttctacatgtaaaagtccatcaaaatttaaattcagtttaacacagcttcccatgatgcctctgcctgaacttaatcttttcttgccgtgtgtttctgcagcccttttgtattcacttgctatgtgtaatcacttcctgtctgtattagagtcctgttatctttctatcctctcaccagatttaacttatttgaagacagaatcaggccttaatttttctaatatgatgtcttgttaatggtcaacattcaacaaaatatgttgaattgagctgttttacacattgaatgagagaaggttcttttctactagttgtagccatgtgatatatcacagcacaactgaatcccactcattttttcactcctgcttgtctgtttcatttttttcccttcattatttcccttttttctgtgcaatatggttttaacataaattcacattcagtatgtttttctctaagacctattattaacatgcttaaatagcagttagagaaatctattttttcttcatggtaggtacctttttctggaagaacttctggttttttggtaacaggcacaggttctttctttactggaacaagtttcttgggcacctcaggcactttgaagatattagttttgttttaaaaatagtatttaaaaacattttaaaatattaagaataaaaaacctgtatttattggagcagcattaaaattaatgaaagcaaaataaggaaatttttgtccttagttatgcaacaacaatgaggacaacttattggattccactttaagatatcagaatactttcttttttatgatgccaacgatgaagtgaatacctttagctgctggtgtttctggcttcttaacagttgggaccttcttcactggaacaactttctttggcatctcaggttctttaaagatatcagtagcatttaataatacaaagttgtgagatgtaagatatacatacaagtttattcaacactgtaacatataggtaagagttaacaaacatataatacaacacaacacacaataagaagagtgtaaaattgtagacaccacaaaaatgaagtattcattttaacatgagtacctttaggaggcggtgcttctggttttttgatgacaggaactttcttctctgggatgatcttcttgggctcttcaggcacttgaataataggaatttcttttagaattaggtgattacaatgaaaaatttaatgctaatgaatgaattaaaaaccacacatatttcttggtatatgtgggaccaaattctgtgggtccaaagttttatgtgtagaaataacttttgttcttaatgtagtcagatttcaggcaacaagatacaagactgatattttgccttaaggaagatatatagacatgaaaaatgaaatgactgtattttcccatacagtggattctgctttgtacctgctggaggtggaacctctggttcctcctcttctgcaacaggaactggcttttcctcttcaggagcaatttcctcttcaggagcaatttcctcaggttcttcatatactttaaagatattagttaattttatttcaatgtatggaacaatattctaagatggacaaacactaaacacgataaatagtaatcttgatttcttcctttgtttcaattgataccttctcttatttttgtttagataaaatctatctcatttgcactgacttctttgtctattgattcaaatgcttgcaaagcccttttagtgtttaatgtcatttataatcattagttctcctgccttactttctatgtacattggagaagctttgtttaatatagcttactatgacttatgtagatactgtggaccaataacccaaaatagatttgagattggagctaatttagaatgatgaattaagacaaataattaaaggttagaaaatgaccaagaaataatgagttaggaaggaagaagaacaaagcttaaattagaaatagtcgcaagtggcaaggtcattaatcaccggtctcacgtgtaccttctgggggaggagactccgctctttctggaacaggaacagctggtttctcttccaagacaggtttctttggcacttctggcactttaaagatattaattcatttttcttatgagtagttgagaagtatattaaatttataccacatcgacttcacattttgctcaaataacccagggacagatccaagaacaaatttcacaataaggtcagtgatctgtctttggaccctcatatagtggggaggaaaatatggcctattaagaataaaagaaccaagttagtaaacttttccaatgcttgtaataagtaaatatatcactttttaaagtcaatgaaaaaattattaaaaagtattcagaccctaaaaatccagaatgacagttttgtagttgcaaatttaagaggactcgcaaacaaaaggtttgataataggtgacttattagacaagggtgagtgcttttctgcagaatctcattagtgacatgtaccttttgctggtgggacttctggctttttgggaacagctactttcttttctggaacaacttcttttggaacttcaggcacttcaaatatattagtattttaacattagaaacaatcaccagtaaacattcatcacatttacacagaacaaaacccttttagaagctgggggctccatccgcccccatcaaacagtggacagccacatatacctttagcaggtggggcttctggctttttgggaaccaccagaggcaccttcttttcaggaacaacctccttgggcacctcgggcactataaaagatattagtagttgtttaagctcatggtttcaatgaaatgtgaaaatcatgaagcagaacagtagaatatgacacttcaaagaaagttttttgttagggagttagtggcagtgaggaatacctttcactggtggtagttcaggttttttggcaacgacagcaggtgctttcttttctgggacaggtttcttaggtggtacggtcactaaagaattagaaggtatgttttagaaagaacgaagattgagaaacaagacaaaagctcagagcacccagaattatcagggcaggaaggggaaagagtggccgaggtgtcctagcagctttcttgccatgtaccttgtggaggcgccgctggctctggctcttccacaacttcagcaggaggctcttctagggcaacttcctcaggctcctcgaacactttaaagacatgagctcattttaatgccagaattgactaaaactgagatagtttgcaaaaaaatgtttttacaacactaaggaaagatttttttaaaaaacactaatttgaatagtttcattattaccttcagggggaggactttccggtttgggaggaatagcttcaggcaccttcttttctgggacagctacctttggcacctctgggactttaaaagatattattattttcattgttagacaaagtaaagacaaacaaacaatatcaaacacagcaccatgagggtgtctaccttttgtgggtggcacttcaggctttttaggaggaggcactggcactttcttttcaggaacaacttctttgggagcctcaggcacttgaaagataatagtgaaattacatttaggcattatgaagaccactagaaaaatactttccagagcagaagagtttgatcatctgaagcctaaaatcagtgacaaatacctttaacaggtgtgacttcaggctttttaggaggagccgctggcactttcttttcaggaacaacttctttcggagcctctggcacttaaaagatattagtgaaattacatttagaagttatgaagaccattaggaaaaatattttcaagagtagaagagatagatcttctgacgcttaaactcaatgacaaatacctttaacaggtgggacttcaggctttttaggaggagccgagggcactttcttttcaggaacaacctctttgggagcctctggtacttaaaagatattagtgaaattacatttaggggttatgaagaccactagaaaaaatattttcaagaatagaggagtttgatcttctgaagcctaaagccagtgacaaatacctttaacaggagggacttcaggctttttaggaggagccaagggcattttcttttcaggaacaacctctatgggagcctctggcacttaaaagatattagtgaaattacatttagaagtttgaagaccactagaaaagtattttcaagaaatgaagagttcagtcttctgaagcctaaagccagtgacaaatacctttaacaggtgggacttcaggttttttaggaggagtcactggcactttcttttcaggaacaacttctttgggagcctctggcacttaaaagatattaggtaaaattacatttaggggttatgaagaccactggaacaaaatgtcttcaactgcaaaagaattagatcatctgaagcctaaggtcagtgacaaatacctttaacaggtgggacttcaggctttttaggaggagccaagggcactttcttttcaaggacaacttctttgggagcctctggcacttaaaagatattagtaaagttacatgtagagctatggagactactagcaaaatatacagcagaggaattggatcttctgaagcttaaggtcaaatgacaagtacctgtaacaggtggaacttctggctttttaggaagcaccagtgttttcttttctggcacaatttcttgtgggacttcaggcacttgaaagatattagtagtttttcacttaggttaatgagacaaatggagtaaaatatttctaagatcagaagagatatttcttctgcagaaaaaggacaggggtaaaaaatacctgtggcaggtggggcttctggttttgtgggaggagccttaggaactttcttttctgggacaacttcttgagcttcaggcacttgaaagatattagtagttttagacttaagttaatgaagagaaatgggctaaaattgtttacagtaggagaggagatatctcttctgcagaatgaagtcagggctaaagtgtacctgggacaattggagcttctggttttttgggtggagccacgggaatttctttttctgcggcttcttgaggaacttctggcacttgaaagatattagtagttttatacttaggttaatgaagaggaatggactaaaattgttttcaggaatggaagagagatttcttctgcaggataaggttgagctgacatgtacctgtaactgcgggggcttctggttttttgattggtgccttgggaattttcttttctgggacaacttcttgagcagcttcaggcacttgaaagatattagtatttttataatttatgaatggcgaaggtatatattacagtgattgtgaggggtacagacagtaagttattcttagcagaggagagggaataaataccttttgcacgtggggcttccggttttttgggcacagccacagatactttcttttcaagtacaacttctttaggagcttcaggaactttgaagatattagtatcttttagttagaagctataaagggggaatatcgactccacatttacccaagcaaatacaacttgtgagatcggcggacacttctatacagtctttccccagggccccccgactgacaatgtgtaatgatacctacctttaggaggtggagcttctggctttttggcaggaggcaccggtactttcttttctgggaccacttccttcggtggcagcacttcaggcacttcaaagatatttgtaatttgtgtttagaaaaggtgaaaatgatggatgccttttgcatataaacacccaccaagatattttggatagtgattgacatttgttttctttagaattatatcatctttatgtagtaggatttttaacatgtaatttcctagttaaaataacagttatttttctcctatagtttgtatagctttggcattaccttcagggggaggactttccggtttgggaggaatagcttcaggcaccttcttttctgggacagctgcctttggcacctctgggactttaaagatattagtattttcattattagacaaagtaaagacaaacaaacaatatcaaacacagcaacaagagggtgtctaccttttgtgggtggcacttcaggctttttaggaggaggcactggcactttcttttcaggaacaacttctttgggagcctcaggcacttgaaagatattagtgaaattacatttaggcattatgaagaccactagaaaaatattttccagcagcacatcaaaaagcttatccaccatgatcaagtgggcttcatccctgggatggaaggctgattcaacatacaaaaatcaataaacgtaatccatcatataaacagaaccaacgacaaaaaccacgtgattatctcaatagatgcagaaagggcctttgacaaaattcaacagcccttcatgctaaagactctcaataaattaggtattgatgggacatatctcaaaataataagagctatttatgacaaacccacagccagtatcatactgaatgggcaaaaactggaagcattccctttgaaaactggcacaagacagggatgccctctctcaccactcctattcaacatagtgttggaagttctggccagggcaatcaggcaggagaaagaaataaagggtattcaataaggaaaagaggaagtcaaattgtccctgtttgcagatggcatgattgtatatctagaaaaccccatcgtctcagcccaaaatctccttaagctgataagcaacttcagcaaagtctcaggatacaaaatcaatgtgcaaagatcacaagcattcttatgcaccaataacagacaaacagagagccaaatcgtgagtgacctcccattcacagttgcttcaaagagaataaaatacctaggaatccaacttacaagggatgtgaaggacctcttcaaggagaactacaaaccactgctcaacgaaataaaagaggacacaaatggaagaacattccatgctcatggataggaagaactaataccgtgaaaatggccatactgcccaaggtaatttatagattcaatgccatctccgtcaagctatcaatgactctcttcacagaattggaaaaaactactttaaagttcatatggaaccaaaaaagagcccacattgccaagtcaatcctaagccaaaagaacaaagctggaggcgtcacgctactgtattacaaggctacagtaaccaaaacagcatggtactggtaccaaaacagagatatagaccaatggaacagaacagagccctcagaataataccacacatctgcaaccatctgatctttgacaaacctgacaaaaacaagaaatggggaaagggttccctatttagcaaatggtgctgggaaaactggctagccatatgtagaaagctgaaattggatcccttccttacaccttacacaaaaattaattcaagatggagtaaagacttaaatgttagacctaaaaccataaaaaccctagaagaaaacctaggcaataccattcaggacataggcatgggcaaggacttcatgtctaaaataccaaaagcaatggtaacaaaagccaaaattgacagataggatcgaattaaactaaagagcttctgcacagcaaaggtactaccatcagaatgaacaggcaacccacagaatgggagaaaatttttgcaatctactcatctgacgaagggctaatatccagaatctacaatgaactcaaacaaacgtgtaagaaaaaaacaaccccatcaacaagtgggcgaaggatacaaacagacacttctcaaaaaaagacatttatgcagccaaaatacacaagaaaaaatgctcatcatcactggccatcagagaaatgcaaatcaaaaccacaatgagataccatctcacaccagttagaatggtgatcattaaaaagtcaggaaacgacaggcgctggagaggatgtggagcaataggaacacttttacaatgttgctgggactgtaaactagttcaaccattgtggaagtcagtgtggcgattcctcagggatctagaactagaaataccatttgacccagccatcccattactgggtatatacccaaaggattataaatcatgctgctataaagacacgtgcacacgtatgtttattgcggcactattcatattagcaaagacttggaaccaacccaaatgtccatcaatgatagactggattaagaaaatgttccacatatactccatggaatactatgcagccataaaaaatgatgagttcatgtcctttgtagggacatggatgaaactggaaaccatcattcttggcaaactatcacaaggataaaaaaccaaacattgcatgttctcattcataggtgggaattgaacaatgagaacacatggatacaggaagggggacaccacacaccggagtgtgttgtgaggtggggggatgggggagggatagcattaggagacatacctaatgtaaatgacgagttagtgggtgcagcacaccaacatggcacatgtatacatacgtaacaacctgcacgttgtgcacatgtaccctagaacttaaagtataataaaaatatatatatatataaaaagaaaaatattttccagagcacaagagatagatcatctgaagcctaaaatcagtgacaaatacctttaacaggtgggacttcaggctttttaggaggagtcgagggcactttcttttcaaggacaacttctttgggagcctctggcacttaaaagatattagtaaagttacatgtggagctatggagactactagcaaaatatacagcagaggaattggatcttctgaagcttaaggtcaaatgacaagtacctgtaacaggtggaacttctggctttttaggaagcaccagtgttttcttttctggcacaatttcttgtgggacttcaggcacttgaaagatattagtagtttttcacttaggttaatgagacaaatggagtaaaatatttctaagatcagaagagatatttcttctgcagaaaaaggacaggggtaaaaaatacctgtggcaggtggggcttctggttttgtgggaggagccttaggaactttcttttctgggacaacttcttgagcttcaggcacttgaaagatattagtagttttagacttaagttaatgaagagaaatgggctaaaattgtttacagtaggagaggagatatctcttctgcagaatgaagtcagggctaaagtgtacctgggacaatcggagcttctggttttttgggtggagccacgggaatttctttttctgcggcttcttgaggaacttctggcacttgaaagatattagtagttttatacttaggttaatgaagaggaatggactaaaattgttttcaggaatggaagagagatttcttctgcaggataaggttgagctgacatgtacctgtaactgcgggggcttctggttttttgattggtgccttgggaattttcttttctgggacaacttcttgagcagcttcaggcacttgaaagatattagtatttttataatttatgaatggtgaaggtatatattacagtgattgtgaggggtacagacgataagtttttcttagcagaggagagggaataaataccttttgcacgtggggcttccggttttttgggcacagccacagatgctttcttttcaagtacaacttctttaggagcttcaggaactttgaagatattagtatcttttagttagaagctataaagggggaatatcgactccacatttacccaagcaaatacaacttgtgagatcggcggacacttctatacagtctttccccagggccccccgactgacaatgtgtaatgatacctacctttaggaggtggagcttctggctttttggcaggaggcaccggtactttcttttctgggaccacttccttcggtggcagcacttcaggcacttcaaagatatttgtaatttgtgtttagaaaaggtgaaaacgatggatgccttttgcatataaacacccaccaagatattttggatagtgattgacatttgttttctttagaattatatcatctttatgtagtaggatttttaacatgtaatttcctagttaaaataacagttatttttctcctatagtttgtatagctttggcattaccttcagggggaggactttccggtttgggaggaatagcttcaggcaccttcttttctgggacagctgcctttggcacctctgggactttaaagatattagtattttcattattagacaaagtaaagacaaacaaacaatatcaaacacagcaacaagagggtgtctaccttttgtgggtggcacttcaggctttttaggaggaggcactggcactttcttttcaggaacaacttctttgggagcctcaggcacttgaaagatattagtgaaattacatttaggcattatgaagaccactagaaaaatattttccagcagcacatcaaaaagcttatccaccatgatcaagtgggcttcatccctgggatggaaggctgattcaacatacaaaaatcaataaacgtaatccatcatataaacagaaccaacgacaaaaaccacatgattatctcaatagatgcagaaagggcctttgacaaaattcaacagcccttcatgctaaagactctcaataaattaggtattgatgggacgtatctcaaaataataagagctatttatgacaaacccacagccagtatcatactgaatgggcaaaaactggaagcattccctttgaaaactggcacaagacagggatgccctctctcaccactcctattcaacatagtgttggaagttctggccagggcaatcaggcaggagaaagaaataaagggtattcaataaggaaaagaggaagtcaaattgtccctgtttgcagatggcatgattgtatatctagaaaaccccatcgtctcagcccaaaatctccttaagctgataagcaacttcagcaaagtctcaggatacaaaatcaatgtgcaaagatcacaagcattcttatgcaccaataacagacaaacagagagccaaatcgtgagtgacctcccattcacagttgcttcaaagagaataaaatacctaggaatccaacttacaagggatgtgaaggacctcttcaaggagaactacaaaccactgctcaacgaaataaaagaggacacaaatggaagaacattccatgctcatggataggaagaactaataccgtgaaaatggccatactgcccaaggtaatttatagattcaatgccatctccgtcaagctatcaatgactctcttcacagaattggaaaaaactactttaaagttcatatggaaccaaaaaagagcccacattgccaagtcaatcctaagccaaaagaacaaagctggaggcgtcacgctactgtattacaaggctacagtaaccaaaacagcatggtactggtaccaaaacagagatatagaccaatggaacagaacagagccctcagaataataccacacatctgcaaccatctgatctttgacaaacctgacaaaaacaagaaatggggaaagggttccctatttagcaaatggtgctgggaaaactggctagccatatgtagaaagctgaaattggatcccttccttacaccttacacaaaaattaattcaagatggagtaaagacttaaatgttagacctaaaaccataaaaaccctagaagaaaacctaggcaataccattcaggacataggcatgggcaaggacttcatgtctaaaataccaaaagcaatggtaacaaaagccaaaattgacagataggatcgaattaaactaaagagcttctgcacagcaaaggaaactaccatcagaatgaacaggcaacccacagaatgggagaaaatttttgcaatctactcatctgacgaagggctaatatccagaatctacaatgaactcaaacaaacgtgtaagaaaaaaacaaccccatcaacaagtgggcgaaggatacaaacagacacttctcaaaaaaagacatttatgcagccaaaatacacaagaaaaaatgctcatcatcactggccatcagagaaatgcaaatcaaaaccacaatgagataccatctcacaccagttagaatggtgatcattaaaaagtcaggaaacgacaggcgctggagaggatgtggagcaataggaacacttttacaatgttgctgggactgtaaactagttcaaccattgtggaagtcagtgtggcgattcctcagggatctagaactagaaataccatttgacccagccatcccattactgggtatatacccaaaggattataaatcatgctgctataaagacacgtgcacacgtatgtttattgcggcactattcatattagcaaagacttggaaccaacccaaatgtccatcaatgatagactggattaagaaaatgttccacatatactccatggaatactatgcagccataaaaaatgatgagttcatgtcctttgtagggacatggatgaaactggaaaccatcattcttggcaaactatcacaaggataaaaaaccaaacattgcatgttctcattcataggtgggaattgaacaatgagaacacatggatacaggaagggggacaccacacaccggagtgtgttgtgaggtggggggatgggggagggatagcattaggagacatacctaatgtaaatgacgagttagtgggtgcagcacaccaacatggcacatgtatacatacgtaacaacctgcacgttgtgcacatgtaccctagaacttaaagtataataaaaatatatatatatataaaaagaaaaatattttccagagcacaagagatagatcatctgaagcctaaaatcagtgacaaatacctttaacaggtgggacttcaggctttttaggaggagccgagggcactttcttttcaaggacaacttctttgggagcctctggcacttaaaagatattagtaaagttacatgtggagctatggagactactagcaaaatatacagcagaggaattggatcttctgaagcttaaggtcaaatgacaagtacctgtaacaggtggaacttctggctttttaggaagcaccagtgttttcttttctggcacaatttcttgtgggacttcaggcacttgaaagatattagtagtttttcacttaggttaatgagacaaatggagtaaaatatttctaagatcagaagagatatttcttctgcagaaaaaggacaggggtaaaaaatacctgtggcaggtggggcttctggttttgtgggaggagccttaggaactttcttttctgggacaacttcttgagcttcaggcacttgaaagatattagtagttttagacttaagttaatgaagagaaatgggctaaaattgtttacagtaggagaggagatatctcttctgcagaatgaagtcagggctaaagtgtacctgggacaattggagcttctggttttttgggtggagccacgggaatttctttttctgtggcttcttgaggaacttctggcacttgaaagatattagtagttttatacttaggttaatgaagaggaatggactaaaattgttttcaggaatggaagagagatttcttctgcaggataaggttgagctgacatgtacctgtaactgcgggggcttctggttttttgattggtgccttgggaattttcttttctgggacaacttcttgagcagcttcaggcacttgaaagatattagtatttttataatttatgaatggtgaaggtatatattacagtgattgtgaggggtacagacgataagtttttcttagcagaggagagggaataaataccttttgcacgtggggcttccggttttttgggcacagccacagatgctttcttttcaagtacaacttctttaggagcttcaggaactttgaagatattagtatcttttagttagaagctataaagggggaatatcgactccacatttacccaagcaaatacaacttgtgagatcggcggacacttctatgcagtctttccccagggccccccgactgacaatgtgtaatgatacctacctttaggaggtggagcttctggctttttggcaggaggcaccggtactttcttttctgggaccacttccttcggtggcagcacttcaggcacttcaaagatatttgtaatttgtgtttagaaaaggtgaaaatgatggatgccttttgcatataaacacccaccaagatattttggatagcgattgacatttgttttctttagaattatatcatctttatgtagtaggatttttaacatgtaatttcctagttaaaataacagttatttttctcctatagtttgtatagctttggcattaccttcagggggaggactttccggtttgggaggaatagcttcaggcaacttcttttctgggacagctgcctttggcacctctgggactttaaagatattagtattttcattattagacaaagtaaagacaaacaaacaatatcaaacacagcaacaagagggtgtctaccttttgtgggtggcacttcaggctttttaggaggaggcactggcactttcttttcaggaacaacttctttgggagcctcaggcacttgaaagatattagtgaaattacatttaggcattatgaagaccactagaaaaatattttccagagcagaagagatacatcatctgaagcctaaaatcagtgacaaatacctttaacaggtgggacttcaggctctttaggaggagccactggcgctttcttttcaggaactacttctttgggaggctctggtacttaaaagatattagcaaaattacattcagaagttatgaagaccactggaaaaaatatcttcaagagcaaaagaatgagatctgaagcctaaggtcagtggcaactacctttaacaggtgggacttcaggctctttaggaggagccaagggcactttctcttcgcggataacctctttggaagcttctggcacttgaaagatattagtgaaattacatttaggtgttatgaagaccgctagaaaaaaatattgtcaagagcagaagaattaggtcttctgaagcctaaagtcagtgacaaatacctttaacaggtgggacttcaggctttttaggaggcaccaccgacactttcttttcagggataatctctttgggagcttcgtgcacttgaaagatattagtatttttacactcagaaaatacagagattactagatagatacaaagacattttcaagaacaaaagagctatttttttctcctgagctgagatcagtggtaacaagttcccataataggtggtgtttcaggttttagaggaggaacttccggtattttctttttggtagccatttctttgggagcttcaggcagtttgaagatattaatacatttacacttgagttgcaagagtcaacacagacatgattcacatgtacacatcaaaataattttcaaaactagaaaggtggtcctttctatcgccccacccactatcccaccataaaaagacagttaagaatgtacctttgacaggtacaacttcagccctttggggaggatgcactttcttttccgggacaacttctctgagagcctccggcactttgaagatattaataattttacatttagaagttacaagaatcaacacaatcaggaaaaacatttatacaagaaaagacatgttcccacccctctaagcttccagcaagatataccttcatcaggaaggacttcaggctttctgagaggaaccacaagcgttttcttttcagggacaatttcttggagagcttcaggcactttaagaaattagtagttttatgtttagtgttatgcagataactaggaatagcaaaaatattctcaaaactacaagagctagttcttgaccctgagagcatggtgacttgtacctttaactgatgggggttctctttttttggaaggaactgtcttggcaggaataatttcttgaggagcttcgggcgcttgaaagatattagcaattcacatttaagagttaaaatgattaatggaaaacagtaaccacaataagttaggaaatataaccacattttcttctctttcctccatcctccctttgttccaccaataggctaagtcttttaaggggttagtggatccttgagaggaggtgctccccctcctccagaacctcacagagctctcgcgacactctacactctcattataaaggatttgttgaatgaatacttccagcaggagtgttttctgttttggcagaaacagccataaataatttctttttagaggaaacttcctgtggaacctcagacacttaaaagatattagtatgtttatatttagaatttatgaagagtattaggaagaaaccatagttttaagagcagaggacagataatttcttcttccacatttgttcagaggtaacgtacttttcatacgtggagtttctggctcttcaggtacatcctcaaatattttcatttcagggacaacttctttcatagcttctggtgctttgaagatattagtattatggttagaggttaaaaggatcagtggagacattaattaaatgagctgaaccaaagtgatatttatggctaaaaagatgattcctttaaagaatctgaggaggtatacaatcttgaggagaggaaccacatattaattgtctttgtttattattctccagttccctagcaccctgtacatgctaagcactctaataaatgaaggaaggaatggcaggatgaacgatacctttagtgggaggtatttcaatttcaaggggagcagccatgggtgtttcctttacagggacaatttctcgaggtgattcaggcactttaaagatatgaatgcattgtactttggagttatgaagaggagtaaagagttcccatcttaactgcacatacagaacattccagatgggaaccttctcccactccccgcccccagaatcggatcttttgtagcagtgtgagtatttggttataagcggctgttttcttggtcacctcaggcactatcagtattagtaattttatttcttggaatggtagatgcatagaaaactagatcatggaaagtggaaacattgattataattaatgctatacctctagctattatgttgagaaaaacaaattacagccacttcgaaaaatctaggtcggcatttttttgtattcacacctcaggcaccttaaaaaggtgagtgtttttcaagtttaggagagaggagaacaaccaaaagattccagactgagaaaaaatatcaaaatattcagatattcttcaaattacagaataccatgggtgttatgatgaaattattgttctggaggttttaaagctttttcatgttttgacttatctaaagatattcaaaatgaaaaaaaatgatgcttgaaaaataaaagataggctatgagaggagcaaatgaacatggaggggagatttccagctttaactggaattatttttccctaggttggaggatattctgggagggtctcaggtgctctaatcttgtagagatattacagatcagcttcacactgaattaatattttctttaagacatgttttgatcataatatgtgtatatatattttctttggagtcctcataaaaatacactgactcaactatctttcatgtgtataagctaaaggtattttttccctctgttgtctcttgagtgactcactgggacatgaatacatttggttgagcttctacttgggggatccatctctgaaatgatttccactgtagccactttggcttaaaagatattagtatttttacatgtgttaagtacaactgcaaacatgagattaaaaaggtgactttcttccaacttgtacctgttggtgatggtgtttttcttcttttaacaataggagtttctccctctggaatgacttccttgaagacttcaaactctttaaagatattagtattttttttaattgagaaaaggcaaaggcataaagacatgacatactaagaaagttagatatgttaatatcatttcagatatctttatgttagaaatgttatttttgttctaatattttatctttgtatattatatgtgtgggacttgactttcttgggggcaagtcataggtcattctttgttgtgggtatatcagatcctttaaacacagtattttaacattagaggttgtgagaatgtatattaaacattaaatattttgcagactgaagacagtatattttcttctttagattttcctaactagagaattataccttcagttggaggatgttctggaatttcaggaatagcctcaggtggctccacctctggaaaaatgcctctggttgtatcaggttctttaaagatattagtaggtttacatttaaaagttgtaaaaacagtaaattataaaaagcatgcaatgtttgagtcataaagctaaagatactcatctgggtttgatgtatttgaaatatacctttagttgctggtgtttctctctttttaggaatagtcacatatattttgtcttctggaacaactttcttgggtggctcaggcacttaaaagatatgagtatagttatatttataaatggtgaagaaaaatattgagctttttaaaaggggccaaaaaataatttttcttcagagtggatcattggtgttatataccttttgctagtttgggttttgtcttttgaggttgagtcacaagtactttttcttctaggactgcttcttcagatgcttcataaactttaaagatattagtatttaaataattaggatgtttcaaggtggataaagaagtgtattaagaaaaatataatatataataccacattcatcaccaaaattaatagtagcacatagaggcaaattagtggctagaatgcattggctggggatagcctcactcccagtttcatgatgtaagactctaagcatttctctatgatgatgataataaaatggaggaattgttcaggcaaggactatataattcttcattttgccttaagaaagttattggtaaaattgtcctattggtcttatttttaatggatttgtctataaagaacagggaagatgctgaattgcacattgagaattctccgatatttgacctactagaaattcatgtaagtcttttccctttctagaagcctcattatctatattttcaaatcacatctaatatatggtttcacagtttaatatgaatgtaaaagccatttagggtttggaggcagaaaattaaaaaaattaaatacttagaaaataaggcaaataaagacaacaaaaatttctccagcctttagaaagaaaaactgtctgaaaacaataactaaagtcaagaatagaaaggatattcaaaggaggaagtgattatattattttatcccaacttagtataacaggatgaacaacaagaaagttgagtttcaacaggaaattttttagattaaaaaaaatggaagcgggtctggtgtagtggctcatgcctgtaatcccagcactttgggaggctgaggtgggcgggtcacctgaggtcaggagtttgagaccagcctgaccaacatggtaaaaccctgtctctactaaaaatacacaaaattagccgggcctggtggtaggcacctgtaatcccagccactcgggaggctggggcaggagaatagcttgaacccaggagacggaggttgcagtgagccaagatcgtgccactgcactgcagcctgggtgcagcagagtgagattccatctcaaaaaaaaaaaaaaaaggaagaatattttgactactgtcacttttactattcaggttgttgaacagtattctattcacaatattttactatttggattatttcataattcaaattatttaaacctaattttgtatgaaacccccccccaaaaaaaaaggtcgtga

SEQ ID NO: 28 - DNA, 160810 bp, Homo sapiens
cttgccctatagaggcatatagagaaaacttggaacaacgattatgaagtagtgaaagagatctctgaagaaaaattagagagtaaatttgacatgtacaagaaaaccatgaaggaagttgtcccatgaaggagattggttgctctagttgatgagtatcagactgaatgaaagtggaggtgtgttttgataatcttaaggtaagaataaaacatttatagtcacctggaatttgttcgaagtgttaaattttcctcctaaaaggtgatttttgtggggtctggattttctactataattctaacatcacatgaaagcttatgtgaactatacacataaattttctatagtttgtgttttggtgaatatgaactaatctgttgcagggtttatatcctaacttttcttgcatgtcactgccattgaaacttgcatgaaaagcactaacttgccttctttctcttctccctgattggctccaaggctgccagacagatcaaggataggtatggtataaaacacatttttacttaagtataaatattgaagtcagaaatgaaattcagaaatagttttttaattaaaattgtgttagttaagataaaagtacccaatgaccaagtacaaaataaaatgtcctctgtgtattttcttggaataaccattgtatcaataaaattttttaaaagcatagttgtggataattatgtgcttcagaagaatttcatttctggtgtagaaatatagttagttttagttttagaacagttcttaattagttgtactaatgaaaagggaactattttgaataacttaaaaatatatatttctggaatgtgttttttgttgttaaatttaaatgtaagtgggtcttattttctttgaactcactcattttaagtagtcctcaagaactaaagcgctcctatttcactgccctcctgtttaacaccttgtattctcattccatcctgttcctggtgccatctctttctatttctaatgccaccactatctagttaatattctgtgggaagagaaaattaaagaaaattattaaaggttttggtttaaaagttctttcttattggtagagccaggcttaagaaaaggaatttagtacttgtaatgaacatagattgctaaaggagttgctggcaacatttggattgcattaacacagaaggaacagtttggatctgcctgtctagtcactgagtattgtctgtattgagattatagcaagttttttcatctgagggtcatgagattctctgaaaggcacagctcttcaaagtgccactccaaatcctagattaaattattcttcatcagataattcacaaaaattttcattatagattatgtgaaaaacagtgcctctattgttaatcttggctgacagttttacttctgggtttctcttttttttttttttttgaggcagagtcttgctctagcacccaggctggagtgcagtggtgcgatcttgtcacactgcaacctctgcctcatgggctcaagtgatcctccacctcatcctcctgaataggtgggactacaggcatgtgccaccacacccagctaatttttgtattttttgtagaaacagggtcttgctattttgcccaggctggtctggaatgcctaagctcaagctatccgcccaacttggcctcccaaagtgctgggattacaggtgtgagccattgtgcctggtcctgtattaatttttatattttttgtatattttacatcaggcagtagctaaagacatggatcattcttataaatcctggatctagaaagatgattgtgaaagtttgaaggtgaaaaatattagctgtgtgaggaatggatgctagataggtcagttttgtggataaggtagatttgggttgtgtctggaaattgctatgagtcatccatcttcctccctgggtatattatacttactgtttagctacctatcccactgcatcctgctctagttcctaattttctgaattagaagttacttcctaatcatgaccttgcaaaatctgtccttttttcaagattctatatggctctttgcatcacagaatcttgtctgtatccttaaactctttgtctttgcccagatttgtttatcagaatttaatttcatgaccaatttcaatggctgtattcttcactgaagcttgggttttttgcgtcttctaagccagcctcttggcttgatttcataagtatccaggtgatctcaggaattagggttcaggcaaactctgtgtgtgtgtgtgtgtgtgtgtgtgtgtgtgtgtgtggttctttttttttttttttttttttgcttgttcaaaccctatagcatttttgtgatcccctgcagaatttttacttcctgcccgaggaacatttctgattctcaacttaatttttttttttttgagacagagtcttgctcagttgcccaggctggagtgcagtggtgcaatcttggctcactgcagcctctgcctcccgggttcaagcgattctcctgcctcagcctcccaagtagctgggattacaggcacctgccaccacacccagctaatttgtgtgtgtgtgtgttttgtagagatggggtttcaccatgttggccaggctcgtctcgaacccctgacctcaagtgatctgcccacttcggcctcccaaagtgctgggattacaggtgtgagccactgtgcccggcccttcaacttaatttttaaaatttgatgtttagctttataatgttcaggtttctctgatgtagtttttggtactcgccaaaagtgagcttttagaattccattattgtcatttaaaatataaaaataatttaaacgtagtcataataaaataattactgtagctattttcaccaagcaaagaaaggattttttttttttttgggtcagggtcttgctccatcacccaggctggagtgcagtggcacaatcacagcttactgcagcctggacctccctggcttaaggggcccttccacctctgccgcctgagcagctgggactgcaggcacgtgccaccatgccccgttaatttttttgtatcttttgtagagatggggtttcgccatgttgcctaggctggtctcaaactcctgggctcaagctgtcctctcgcgtcagccttccgaagtgctggggttacagatatgagccaccatgtccgccctaggattatctttttataagggcatagatggattttaagggagaatgtgtaacatatctgagcaagaaatcaaatataaaaaatgaaaatgtctgtgaaaactcatcatttatcatttgctatggtagaagttacacagaggaacagcaggattaagagagaaaactcaagatagaaataagataatagcacatctctataactttatagaattactggcatgtacttctggggacttaataatattggaatatgattagttgaggtatattgcaggagttattggttcttgaaagagaggggttatgaaagagtcaagttaattaggtagtttgaggaaatgaaaactatgttttgtagttattttctctttgcaaaaatcaggagcgaaggatccttgaatttaccttgtgctggtagaaatgaactaagaaaatcaaggggaattaaagcatacctagccttctggatcctgtagtgtagagaattatctaatgaattttagatgtttagtttgggctttgaggcacatgtctaaatacatgaagttaaaaattaaagttcagtcttctgaaagattgtagcattgttgcccatctaaattgattcatggaaacttaagttttcattgactaaaaaataagagttgttcttgttttttttaaagctttgataagcctttctaatgcatttatggggcatattctttttctttgatgtcatggtgattgaatcaaatcttacaggtttaaggtttaaaattctctaaaatactttcggattttttttctcaacatttctcagtaaacatttaaatatctagtcaggttttgaataaaccaagtaggttctaacctatgcactgattcagtgagcatttagtaagtacgtatctgactatagctctttcagatgtcctcgaatcaaaagatacttggggctgtaaagaataacatatgtaggacttagtatttgttcctttttattgaaattgtattatttgagagacgggttagtgtagtatgcatgaaatactcagcattatacttggcatatagtaagcagtcagtgtgaattccctttgctgtaaattatatttcagtatagcactttcttcttgataaacacatcaactgttgtttactcattgttactattaaattattactagttttaaaatgaagtaaaataactaaatacagaaatagcttgacatttttcatcctaaaataagtgaatatagcaagtttgacatctttcatttcattgacttcttgggtagatttggcagatccaattgatttggcagatacaattgactaggcctagtattccccttgtcccaccagctctgtttccttccccttccaaattgtgtactaggaggacagtgttcacctgtagtacttctgatcattcttgaaccaaagatagtaaggggcttactttgtgatacttgtggaaatttattggaatatgaaaaattgaaatttgagataaaattaaaaattaatagaataagaggatttcttttaatcttcagttttaatggactacagattctctgtactttggataaagtggcttcattctttttttgtttttccctccacattcatctagtaaatgtttattgaattcctgttacttccatggcatatactttttcacagggctgtttcttacagtaggcttccctatagctgatgttgatagatcagagtgacacctagtgtggtattcattgatagtgatttcacttctctcttttcttatccatggcctatctttagcaactaccaaactatacaatattaggtcaatctacctctactcttatttgagggtacatgggatagctcttattactagggagaatatttgaatcaaggtgtgattcaaatgaatataaatgaatttaagttcattatctggcatatgaaaaggagtaaggctggcatcaggaagtcagtaagattgagtgtacagaggttcagatgaatgttgagtctggtaaggattatttttattggatatttgttgttattcatatatatgcaatttaataaaaattggctgggaggaaagttgctaaccagttgtcttaaatgtctttaaaaagacattttgtagttttttatttagttaattttgaagactaagattaaatttctatttcacttttaacttttattatagtctctgaaattattagtgatataatttgtcttttcattttataaattaaatatgatttgatacttcctatttctttattttaaaaagtatgtttgtgtttaccgtagagtcacaatggcttcagcctttcgcctttctttgaaaccaaaggtcagtgacaacatgactcatttaatggtggatttctcacaggaaagacagatgctgcaaactttgaagtttttgccaggtaaatacatgtattacatgtaaagttttgtataaaacttttttttttctacaagatttttttgcagtgaacattggtttgtaaatattaaggaagtatagtgtgatttttttttcattcagctaaggaataattaaatttgctagtttttttttatttttagagattttattggtagtaaaaattgcattttcagaatcctatcaagggatctcttattgttagcttggcagagggaagcagtatggtgtgatggttagcagtgggtctcaaggccagacttcttaggtttgaatcctattgcttacttgctatgtaatcttgaacaatttacttaacttgcttcatttttaacatctttaaaatgcgatgttattcttctagggtgtttataaggattaaataaattgatacctctaaaatatttataatagtacctgcacatagttaaaattcagtgaatgttaggtgttatcattattattattgtggttgttggctcagatggaactttatcttcagtaatatgttaacattattttattaaagtattaacatgaggatattgcagtagccaaaaccatttgtgattgagtcctaaattattcacatatgtaaaagagccaattaagaaccaatcttagtctgttttgtgttgccataacagaaggcctgagactgggtaatttatataaagaaaagaggttctctaggctgagaagttcaagactgggcagcaatatctggcagcttctggtgatagcctcatgctatgtcaaaacatgatggagcatagaaggggaaccagacacatgcaaaaaaggcaaaacaagagagttaacctcactttgtaagaaccttctttcacaagaactaacccagtcttttgagaaagacattaatccattgtaatgacctaatcacctcttaaaggcaccacttcccaacactgccatattggtgaccaaacttcaacatgagtttgctggggacaagtcaggaatatgacttaacaaccttttggttaggtgtttttttttttttttttttttttgcatcatgttgctgataactaaaactatttagatatggtgatttgagggatcaaggaatttcttgaaagtgacatgttttccttacaagtactttttttttttttgagacggagtcttgctctgtcacccaggctggactgcagtggcacgatctcggctcactgcaagctctgcctcctgggtttgcgccattctcctgcctcagcctcccaagtagctgggactacaggcagccgtcaccaagcctggctaattttctgtatttttagtagagacggggtttcaccatgttagcctggatggtttcgatctcctgacctcgtgatccgcccgcctcggcctcccaaagtgctgggattacaggcgtgagcacaagtacttttttttttggagtctgtttttgaatagagaatgttgattatatggaaccattccttttttccttgaatatatggtcagtgactttaaaatacgattggaaaaacaagttagtagttctcacactgtaatggaacctaggaagggggtagcacaagtgaaatactaatttgtgtgatatagattagaagctctagaggagttcataaaatgaaaagatgagagaaggaactgtagttgtagaggaagaaagtgtacttgtcattggctgtttacctaaacattggcctttcagaatttctatattttcattcacagggctctacttaagagtaaaactgatattaaagcaggaataaatatttttaaaagttttattttgattaccgtataatttaaaatggtttgttcttttcaatctgacatgtagaatttcattggtaagaagctggattttattttagttttgaaaatttgaggtggcacaggttaccagttaactgatgttttacttttaagtagaacactttcatgttcactcttgggagatagggacttaaatttcagactggggaatatatctccaaatgtgaactttcttacttaagaaaggaaaataggaaatatgtttagaagtcacattaaccatatgtctctacttaccaccagtatgaccctaaaacttcagaatttcacccttcttcatatagctatcagatgtagaacattcctaatataatttccatctgagtggagagcaaagaaaaatttcagcaacttagagaggaaagttgtcctttcctgcttatctgtttacatattaaagttactttagtatttttgttggaaaaaaatatatgcatgtggtaaacagttaaagtagtacaaaagagtataaagtagccctctcatctcagacttccaattttcttccctaggagctaccaacattaactagcatgtgcttatctttctagaaacagtctatgcctgtaaaagtgtcatcatatagacagaatcatgtaattggtaatttttggcgatatcatgtgattaaacctaacatataattcacctcctttaaaaagatggaagcatatagtacagcaagaactcaaaaaaaggaagcatacatatacattgttatataattttgctttgccacttaacagtatgtaggagttcattccagatcactgtacatcactttattttttttcatgactagatagtatgaatgtaattagttcttgatgagtatttaggtttatagtcttttcattagaaacaatgctgaaatgatcaaatacttgtatatatttgcagagaggtgccactatctcttgaggacaaattcctggaagtggaagtacatttttattttaaatttgggtagattttaagttgtcaaagagatttcacagtttatatgtactggaaaatatttgaatgcctgtattgttatactgctgcaaacactgctgtcaggttttttttttttcctattctaataggtgacaaatgtgttatgattgttttaattttcatttctttaagtatgaatgagtttgtgcttttgtcatattttcataagccactttaaaaatgagctccctatttatgaattttgtcaaattttcatgggattgttagtctttttattaatgatatgtagggtaggaccttttaatgtattaaggaagtcaacctttgtcctatgtggtgtatatccttgctcaccttgatcatttgcctgttgaatttatggtgattttttttcctagcaaaatttttaattttagtgcagtcaaatacatcacaattttcttttgtgactcttagattttataaaggtcttacttagaaagacttcactattgcaagattgtaaaaatacacatattttcttacatttgtagctttttaaaaataaactgtagttttagagcagttttaagtttacagtaaagttgaatgaaaggtatggagatttctcatataccttcacacatgcatagccttcttcactatcaatgtctcccaccagagtggtatatttattacaattgatgaacctacactgacacatcattatcactgaaaagtctatagtttacattgggggttccctcctggtattgtacattttatgggtttgggcagatgtatactggcatgtatctgccattgtattaccatacggagtattttcactgcccgaaaaatccgctgtgccccatattttcatcgttccttactcccagtcaatggcaaccactgatctatttactctctccatagttttgccttttccagaatcttgtatagttggaatcatatagtaagtagccttttcacattgctttcttttacttagtaatatgcatttaagtttcctccatgtatattgatgacctgatagctcatttctttttagtatggaataatagtccattgtctagatgcgccatggtttattcatttatacactgaaacacatgttgattacttccaactttgggcagttatgaataaggctactataaacatctgtatgcacatttttgtgtagacataagttttcaactcctttggataaatgccgattactgaatagtatggtaaaagtgtgttaaattttatagaagactaccaaactgtcttcctaagtgtctgtatgattttgcattcccacaagcaatgaatagagttctgttgcttcacattttcaccaattggtggtattgtggtattttattgttttttaaaatttcaatttccctaatgacatattatgtgaaggatctttttatatacttactgtctgtatgtcttttttggtgagatgtctgtaaggtctttggcctattttttttacattgggttttttttttttttttggtactacttatgtttttattaaggcatgatataaagttggaaatcaagttcttcataagtactgatactgctaacacaaaccgtgaggtgatggcaaatattatactatgaattactcatcattttattctaaaccttcttacagccagagaaatttacaattccacatgtacaatttttttaagttataattgttatctgtcaattgagaaaagcattaagattaagatgacaatgactatatcagctgactattataaatagactctcagaaactaaggaaaatgtgtttactgacatagatgtagagtattcataatcttaaaactggctgaaatgcaccaggtatacaaatatagccaatcctcccacctattaggtaaaatgcatggtgaagcctacatatgccttttttggggcccactgatctacgataagaaacttttgtaaatattgctttggagttctgagtaaaaatttctaatcactgtttgtgacaaggtctttgtatgtagagttaattactgaaacagcatgcatatctcaaataatacaaattatatttaaagaaatgtttggaagagctaaaaataaacaaaagaaagcaaaataaaatagtctgtaaattcacctcagcctgctgaattctttgcagttttatgtttttttattttattattattatacttctaagttttagggtacatttgtacaatgtgcaggttagttacatatgtatacatgtgccatgctggtgtgctgcacacattaactcgtcatttagcattaggtatatctcctaaagctatccctccccactcccctcaccccacaacagtccccagagtgtgatgttccccttcatgtgtccatgtgttctcattgttcaattcccacctatgagtgagaatatgcggtgttaggttttttgttcttgtgatagtttactgagaatgatgatttccagtttcatccacgtccctacaaaggacatgaactcatcatttttatggctgcgtagtattccatggtgtatatgtgctacgttttcttaatccagtctatcattgttggacatttgggttggttccaagtctttgctattgtgaatagtgctgcaataaacatacgtgtgcatgtgtctttatagcagcatgatttatagtcctttgggtatatacccagtaatgggatggctgggtcaaatggtatttctagttctagatccctgaggaatcaccacactgacttccacaagggatgaactagtttacagtcccaccaacagtgtaaaagcgttcctatttctccacatcctctccagcacctgttgtttcctgactttttaatgattgccattctaactggtgtgagatggtatctcattgtggttttgatttacatttctctgatggccagtgatggtgagcattttttcatgtgtctgttggctgcataaatgtcttcttttgagaagtgtctgttcatgtccttcgcccactttttgatggagttgtttgtttttttcttgtaaatttgtttgagttcattgtagattctggatacctgccctttgtcagatgagtaggttgcgaatattttctcccattttgtaggttgcctgttcactctgatggtagtttcttttgctgtgcagaagctctttagtttaattagatcccagttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccatttcttgtttttctcaggtttgtcaaagatcagatagttgtagatatgcagcgttatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggcgatgtgggctcttttttggttccatatgaactttaaagtagttttttcgaattctgtgaagaaagtcattggtagcttgatggggatggcattaaacctgtaaattaccttgggcagtatggccattttcatgatattgattcttcctacccatgagcatggaatgttcttccatttgtttgtatcctcttttatttcattgagcagtgatttgtagttctccttgaagaggtccttcacatcccttgtaagttggatttctaggtattttattctctttgaagcaattgtgaatgggagttcactcatgatttggctctctgttgttggtgtataagaatgcttgtgatttttgtacattgattttgtatcctgagactttgctgaaggtgcttatcagcttaaggagattttgggctgagacaatggggtttcctagatatacaatcatgtcgtctgcaaacagggacaatttgacttcctcttttcctaactgaataccctttatttccttctcctgcccaattgccctgatcagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctattgagataatcatgtggtttttgtctttggttctgtttgtatgctggattacatttattgatttgcgtatattgaaccagccttgcatcccagggatgaagcccacttgatcatggtggataagctttttgatgtgctgctggattcggtttgccattatcttattgaggatttttgcatcaatgttcatcaaggatattggtctaaaattctcttttttggttgtgtctctgcccggctttggtatcaggatgatgctggcctcgtaaaatgagttagggaggattccttcttttttattgattggaatagtttcagaaggaatggtaccagttcctccttgtacctctggtagaattcggctgtgaatccatctggtcctggactctttttggttggtaagctattgattattgcctcaatttcagagcctgttattggtctattcagagaatcaacttcttcctggtttagtcttgggagggtgtatgtgtcgaggaatttatccatttcttctatattttccagtttatttgcgtagaggtgtttgtagtattctctgatggtagtttgtatttctgtggcatcagtggtgagatcccctttatcattttttattgtgtctatttgattcttctctcttttcttctttattagtcttgctaggagtctatcaattttgttcatcctttcaaaaaaccaggtcctggattcattaattttttgaagggtttttttgtgtctctatttccttcagttctgctttgattttagttatttcttgccttctggtagcttttgaatgtgtttgctcttgcttttctagttcttttaattgtgatgttagggtgtgaattttggatcttttctgctttctcttgtgggcatttagtgttataaatttccctctacacactgctttgaatgtgtcccagagattctggtatgttttgtctttgttctcattggtttcaaagaacatctttatttctgccgtcattttgttatgtacccagtagtcattcaggagcaggttgttcagtttccatgtagttgaatggttttgagtgagtttcttaatcctgaattctagtttgattgcactgtggtctgagagacagtttgttataatttctgatattttacatttgctgaggagagctttacttccaagtatgtggtcaattttggaataggtgtggtgtggtgctgaaaaaaatgtatattctgttgatttggggtggagagttctgtagatgtctattaggtccacttggtgcagagctgagttgaattcctggatatccttgttaactttctgtctcgttgatctgtctaatgttgacagtggggttttaaagtctcccattattattgtgtgggagtctaagtctctttgtaggtcactcaggacttgctttatgaatctgggtgctcctgtattgggtgcatatatatttaggctagttagctcttcttgttgaattgatccctttaccattatgtaatggccttctttgtctcttttgatctttgttggtttaaagtctgttttatcagaaactaggattgcaacccctgccttttttagttttccatttgcttggtacatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaggttaatattgttatgtgtgaatttgatcctgtcattatgatgttagctggtgattttgctcgttagttgatgcagtttcttcctagcctcgatggtctttacaatttggcctgattttgcagtggctggtactggtttttcctttccatgtttactgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggtttgtagagtttctgccgagagatccgctgttagtctgatgggcttccctttgtggataacccgacctttctctctggctgcccttaacattttttccttcatttcaaccttggtgaatctgacaattatgtgtcttggagttgctcttcttgaggagtatctttgtgtcattctctgtatttccttaatctgaatgttggcctgccttgctagattgaggaagttctcctggataatatcctgcagagtgttttccaacttggttccattctccccgtcactttcaggtacaccaatcagacatagatttggtcttttcacatagtcccatatttcttggaggctttgttcatttctttttattcttttttctctaaacttcccttctcgcttcatttcattcatttcatcttccattgctgataccctttcttccagttgattgcatcggctcctgaggcttctgcattcttcacgtagttctcgagccttggctttcagctccatcagctcctttaagcacttctctgtattggttattctagttatacattcgtctaaatttttttcaaagttttcaacttctttgcctttggtttgaatttcctcctgtagcttggagtagtttgatcgtctgaggccttcttctctcaactcgtcaaagtcattctccattcagctttgctccatttctggtgaggagctgcgttcctttggaggaggagaggcgctctggtttttagagtttccagtttttctgttctgttttttccccatctttgtggttttatctacttttggtctttgatgatggtgatgtacagatgggtttttggcgtggatgtcctttctgcttgttagttttccttctaacagacaggacctcagctgcaggtcttttgaagtttgctagaggtgcactccagaccctgtttgcctgggtaccagcagcggtggctgcagaacagtggattttcgtgaaccgcaaatgctgctgtcttatcgttcccctggaagttttgtctcagaggagtacccggccgtgtgaggtgtcagtctgcccctatggagggggtgcctcccagttaggctgctcgggggtcaggggtcacggacccacttgaggaggctgtctgcctgttctcagatctccagctgcatgctgggagagccactgctctcttcaaagctgtcagggacattgaagtctgcagaggttactgctgtctttttgttcgtctgtgccctgcccccagaggtggagcctacagaggcaggcaggcctccttgagctgtggtgggctccacccagtttgagcttcccggctgctttgttgacctaagcaagcctgggcaatggcgggtgcccctcccctagcctcgctgccaccttgcagtttgatctcagactgctgtgctagcaatcagcgagactccgtgggtgtaggaccctcggagccaggtgcgggatataatctcctggtgcgctgtttttaaagcccgtcggaaaagtgcagtattggggtgggaatgacctgattttccaggtgccgtctgtcacccctttctttgactaggatagggaactccctgaccccttgctcttcccgagtgaggcaatgcctcgccctgcttcggctcgtgcagggtgcgctgcacccactgtcctgcgcccactgtctggcactccctagtgagatgaacccggtacctcagatggaaatgcagaaatcacctgtcttctgcgtagctcacgctgggagctgtagaccggagctgttcctattcggccatcttggctccagctcgggttgtttcttttcttattgttgaatattaagagttctttgggccgggcgcggtggctcacgcctgtaaccccagcattttgggagcccgaggcgggcagatcacaaggtcaggagatcgagaccatcctggctaacatggtgaaacctcctctgtactaaaaatacaaaaattagctgggcgtagtgatgggcgcatgtagtcccagctcctcgggaggctgaggcagaatggcatgaacccgggaggcggagcttgcagtgagccgagattgcaccactgcactgcagcctggcagcagagtgagactccatctaaaaaaaaaaaaaaaagaaaaggaattctgtgtagtccttatcagatgtttcttttgcaaatattgtctccctgtctggctttttttccccttgacgatgtcttttacagagcaagatttttaattctaataatgtttagcctatcttactgtttctttcatgaagcttgcctttggttcctttgatctatttgtctcttctttcaccagtaccaggtcttgatgactgtagctttttttttttttttttttgtgtcggaatctcgctgtgtcgcccaggctggagtgcagtggcacaatctctctgctcactgcaagctccgcctcccgtactatgtctgagagttgactagtttcagtcttccaactttgatcttctttttcaatactgtgttgcctttatctggatcctttgcctttccatataaactttagagtcatcttattgatatccacaaaatagcttactgggattatgattgggattgcaatcaatctgtaggtcaaattgggaagaactgacatcttaagaacattgagtatttctatccataaacattggaatgtctctacattgatttagttctttgatttctttcattagagttttgtagttttcctcatataaacatggaacatattttgttagatttgtatcaaaagatttcattttgggggtgctgatgtaaatggtattgtgttttaatttcaaatttcacttgttcatttctggtatacaggaaagtggtaggccttgtatcctgcagccttgctgcaatcacttactagtttcaggagttttttgttgattcttttggattttctacctagatgatcatgttgtttgttaacaaagacagttttatttctttcttcccaacctgaataccttgtattgtcgtactgcattacctaggacttccagtactatgttggaagcagtagaaagagggggatccttgccttgttcctgaacttagtggaaacattttgagtttctctccattaagtatggtgttagctgtaattttttttgtagctatttcttaacaagttgagttgaggaagttcctttctgttcctatttcactgagagtttttattttgaatgagtgttggaatttgtgaaatgcattttttggcatctatttttatgattgtgagatttttctttttaagcctgttgatgtgatgggttacattgatttttcaaatgtcgaaccagcctgcatacttggaataaataccagttggtcaagggtataattctttttgttaattgttggatttgatttgctatattttgttgaggatttttcacatctaatttatgagacatactggtttgtagttttcttttggagtaatatctttgtcagttttggtattagggtaatgctggcctcatagaaagagttaggaagtattctctctatttttctcttctgcaagagattgtagagagttagtgtacttttgtcctgaaaagtatggtagaattcaccagtgaacacttttgtgcctggtgctttctgttttggaaagttattagtatcgattcaatttttaaaatagatagaggcctattcagattgtctgttttccttgtgggttttggcagattgtgtctgtcatagaattggtccttttgggttatcaaatttgtggacatagagttattcacagaattccttgattagctttttaatgtccatgggatctttgttgatgccccctctttcatttttgatactagttatttgatactagttatttattgattccattgatctgtcaaagaaccaggttttgctttcaggatttttttccattgatttccctcttttcagtttcattgatttctgttcttgttttttgtttgtttgtttttagagatagagtcttgctcagttgcccagtctggaatgtagttatataatcatagctcactgcagccttgaactcctgggctcaagggatcttcctgccacagccttctcagtagttaggactacaggcatgtgctaccatgcccagctaatttaaatctttttttgtagagatggggtcttactgtgttgcctagactggtctcaaacccctggcctcaagtgatcttcccacctcagccttctaaagcactgggactacaggtgtgactaccacacccaacctgatttttgttctaattttcattatttcttttctgcttgctttggctttattattattattattattattattattattattgtttttagtttaccaaggcgaaagcttaaattacttgttttagatcttcttttctaatataatcatttgtcagtggtggggatacattctaagaaatgtgatgtttggcaattttgtcattgtgcaaacatcatagagtgtatttacacaaaccaagatggtatagtctcctacacatctaggctatattatatagcagattgttcctaggctacaaacctgtacagcatgttactgtactgaatactgtaagcagttgtaacacaatgataataatttgtgtatctaaacatatctaaacttagaaaaaaatacagtcaaaatatggtattgtaattttatgggaccacttttgtatatgtggtctgtcattgaccaaaatgttgttatatggcttatggctcatgaccatatgtgcattcagtgttataatttccctctaagcactattttcgttgcattcaacaaattttgataagttgtgttttcattttcatttagttcaaaatattttaaaatttctcttgagatttattctttgactatgtgttgtttagaagtgtggtttttatatttttagtagagatggggtttcgccatgttggccaagctggtcttgaactcctcatctcaagtgatccgcccccctcccaaagtgcaaagattacaggcatgagccaccgcgcccatgctagaagtgggttgtttaatctcaaagtattttgggactttgcagctatatatctttttctgttaagtgatttctaatttaatcattgcatgatttctatgcttttgaatttgttaatgtgtgttttacagcccagaatgtagtctttgtcttggcaaatgttctataggagcttgagaaggatgtatattctgccattgttggttgaagtagtctgtagatatcaattacatgcagttgattgatggagttgttgagttcaaccatgtacttagtgattttctgcctctctcccatcacttgtatcattgttgtcatttatttcacttatgcagcagtatgtgtaagcacagatacaccacacacattcaaataaatagttgcccttattgttttgaattaactgttactggttagatcagtcaagaataagaaaaataagtttttattttaccttcacttatccttctccattgctctttgtttctttgtctttaaagaactttttaaaaacatttcttcatagcatgtctattggcaacagatttcctcaatttttatttgtctgagagagtttttatttctccttcactactgaaggataatttcaaggtatacagaattgctcctctataggtaaggtcccctcctccgcccccacctggcttctttcaagtgttttccttgtctttgattttctgtggtctgaatatatgcctagatacagtttttgtttatgtgtgtatggcagggagcatttattttggttgatgttccctgagcatcctagatctgtagtttggtgtctgatattagtttgggattttctcagtcattattgtttcaaatatatcttctgttcctttctgtcttcttcttctgtaatttccattatacatatttactcctttcgtacttccacagtaaattttggatattctgttctgtggggtttcttccaatcttttttgtctttgctgtttcatcttgcaggtttctattgagagatcttcaaactcaaaagattctttccagtcagctattaagtccattaaattattcttaatttatggtacagtgctttttatctttagcctttctttgcggttttttcttagaatttctagcgctccacttgtattgcccatctgttcttttatgctgtctactttctccattttatgctctctgctttctccatgagagccctcagaatattatagctgtttttaattattggtctgataattccagcatttctgccatatctgagtcttgtaattttttcttgatgaccagacatgtattgggttaaagaaactgatgtaaactggcctttattaatgtggtagtaaggtgtgtgggaggggcagcattctgtagcaccataattaggtctcagtcttttggtgagcctgtgcctctggaccgtgaactttgcaagggacttctcagttttccccactccttattcctggatttttcggtggaacaggatggctggagtgggctggggttggtctgggtatttccctttgcccacatggagtagctcattggagttggatatttccctttccccaggtcacttagtctctgttaaaaccccaacagattagactatgattaaatagtttctcttaagggaacagaaactctgatgtatttcaaaatacttccttttctcctccccctgctgtggaagcataaggggatttttctctgttagttattcatggtgagaacctggtaagctcctggaggtaaaactcacaaatgtgtggggacactcctatgactgggtctccttggagctggactctcagacattctgctgtattccttaagtaagtacaatttcaattaaaatttaaataaaaattttgccaagggattataatctcaagcatttgagatagtttatttccctttcatttccaaatggagtagttttatggagaaaactcagcttaataatatcagaaaggcttttctaatagccacaactgactaactatgacaagatcaattttaggaaatagtaactcttcccatcactaaaataattcggtaagaagcttgacaataacttgaagccagtgttgtaaagggaatccattcatcagaagatattgaccagtgcttctcaaactttaaagtgcatgcaaatcaactgcagattctgattcaagagtcttagtgttggacttgaagtaacttaggcttatttttgcacacattcaaggtgagaagcactgccttatttataaaagctcagcaatataacacaataaaattgttttatgcgggatttttttttttgctatcataggatccctccagagtatggtagttatatgatagttatagcagtctatgatagtatatgagtcctcttcttttctatttgaaatttttgaagtttttttcagattgtgtcctcttgctctggctttcatgaattctttaaggtgacactgttgcttatttctaaagttcccatcgtttacagttttttattgtttgagacagggtatttctctatcacccaggctggagtgcagtggcatcatcatagttcactgtagcctctaactcctggctcaagcggtctttctgcatcagcctcctgagttgctaggactacaggtgcatgccaccacacccagctaatttttaatttttttttttttttttgcagagatagagatctcactgtgttgctcaggctggtctcaaactcctggcctcaagccatcctctagccatagtctcccaaagtgctgggattataggtgtgaaccactgcacccagccatcatttccgcgtttacatctgtgttcttcttattggtcatacttaggtccaaaaaagttagtttaccaaacacagactgtactttccaggttattaaattatcaataaggcaaattcagaacttttcagagattctgcctttaggttcctttagttttccaggtcagttaggttcctatcattcatccctttgtgttagttttgtagatcactcatttccacctggccagatagtttaactttcatgtatatttttttctttttatcattattcagatatctttctgcatgttactgctcttcgattttatatatttttatatactaacatatatggccttagcttagagtgcctttctttaagaatagtaaaggctgttgtctctaagtcaaactgcttatgtttaaatcctgtttcttctttaattgtctagctgtgcaatcttgagcaagttactttgacatctttgagcccctaataaagataatgataatataaagtttatggtattgtaatggtaaggattaatatggaaagcactcaataaatgatagctattgttgttactaccattattcgtttttacttttctatttaacttaggaagaaaactttgattgttgcctttgaaattgtatattttactttgtatttatcttaggttcacttttttactcatacttggagaatttacgtgttgatttatagcagttgaggctttaactgttttctatccccttctcagttttctcatgtgaatgactgataccaatgataacatttttcccccataatgttttctgttgtaagtagaacttttctcccctaaaatccagtgtatacatcttcattttctttatctaggtttcccatcacttctgcattctgacagagagtgcacatacacatagatattactactactttgataaaaaaaaatgatttaaaacgccgtcttctcaaccttacttcttcccttcttttgggctttcaacaatggcttaacagaccaagaccatgcttattgtacagtcaaatagattgcatgaacagttaggatttccctttttggtaaaatgaggtatgattaaaaaaaaaaagaaacctttttctggaggagtttcgtccagaaggaaaactgtaataagattttttttttttttttttgagacaaggtcttgctgtgttgcccaggctggagtacagtggcacaaccactgcagcctcaacctcctgggcttaagcaaccctcctgcctcagcctcctgagtagctgggaccacacaggcatgcaccgccatacccaactaaatttttctgatttttttgtcaaagtgagatggggtctcactttgttgcccagggtggtctcaaactcctgggctcaagtgatcctcctgcctcagcttcttaaagtactaggattacaggcatgagccactatgcccagcagaaaaatgtagtaggttttaaaaattcatgaaggatgcatttaaatctctaatttttaatattctgtagcataaaaattttctataagatggaatcaaattaacttataaaatgaagaaatatctattaattccataaatgccactataatgtatcctatagtacattatatgtagtaatattagttatggacatacctgagtcttaacagtggaagtgacgatgatcaatgacaattacaaagtcattatctactcttagccatttcttatgcattgaaattttgactttatatcctttctcctttctggagctaagaaaataagtctggcaatgctgatgccacttaccttttacattcaggtgcagagaaaacatttagcaaattcttcaactaatttctacactattgctagttcatcactgttgctttatggaagtatgtaggtagatgtgtggattgctttccttccaaagacttctgccttgcctaagtaatatttatatgttataagtacactatctttcatcttcccctgaatttgtatgccgtatttgatgaattgttttcttacttctatatagaatctagagtgaacttcccacgttagctccaagtcaacctaaatttgacataccactcttaaattatctaaatatctttgtccctcccacgtgtcaccactttcttattttttttctttttaacctcagtttccattttgtcacttgactttcttttggggaccattattcacaagaaagaagaatctgcctgccagtgcagtcttactagaatggcagctgaattgagatgtagatagcagggtgctaactagtcctactcaccaattaagtgactttttttataccaacctctcaggactttcagttgcagatttatgactcagcaaaattttcacattgctacaggccataggcctttacatttccttacatgtaggcatagcagagcatattaaattcatgaatgcctatagtctctttattctcttggcagtgaatagtctacaattcttatgtttcagtagtagacactaccaaatatgtattataaggacagaaatcctacaagacagatgaaggaaactcatggttatgacaaataataaatgcttttttggttgtcagttgtcttactaataagttatatccaattctaagtatttattgtacaattacacatgtagaatttaactttgggaagactctagttagtggaaatggatcatcctttctaagtcaaatttttccatcttggtgttattttactgggtttattatttgttagctctcatgttgctttgcatcttaactttaatatgtaattcttttgttgttgtggttttgaaaaaaattagcaagagtcatctctcagtatttgtgggggactggttctagcaccttcgttgaattaccaaaatccacagatgctcaagtccctaaaaaatggttatttgcatgtaacctatgcacatcctcccatatactttaagtcatctctagattacttataatacctaatacaatgtaaccactatgtcaatagttgttatactgtagttttaaacttttttattgttgtattgttatttttattttttccgaatattttttgatccaaggctgattgaatccgtggatacagagggccaactttgctttgttttttagaacagggttatatttgtggagaattgagcatgataatacagaaagttaccataaacccactacctcctccatatacaatttcccctgttattactattctgcattagtggggtacatttgatataactgatgaatcaacagtgatacattattagctaaagttcatattttatattagcatttactctttgtgttaaacagttctgtgggttctgataaatgtatagtgtcttatatctaccattatattaccatatagaataatttcactgccctaaagttcctttctgttccgcttattcatctcttatatcctgcaacccttctgtgatcacttgttagttccaggaattttattctttgttgtttttttgttgttgttgttttgttctttttgagacggagtctcgctctgttgcccaggctggagtgtagtggcacgatctcggctcactgcaatctctgcctcctgggttcaagcaattcttctgcctcagcctcatgagtagctgggattactggcgcatgccaccacacctggctaatttttgtgtttttagtagagacggggtttcactatgttggtcaggctggtctcgaactcctgacctcgtgatctgcctgccttggcctcccaaagtgctgggattacaggtgtgagccactgcgcctggcctgttttttgaattttctacataggcagtaatgtcatccacaaagagttttattttttactttataattggtatttttcttgtttcattgatatcattatataatttttctgcaattgatgtgatagaatacattaattgatttcaaatgtttaactagccttgcataccaggaataaatcttttgaattcttttctttagcagtaaaatgtttaaatctggtagctgctggactgcatagtttcacccagttcagacaagtccgtatcactggaggaacatgttctacatttgttatgtcagtggatcatgtgttaatgttaaaaagctatgaaatatgtctttcatggaaaagaaattaatgttcatacattttaaatgtggctcatttacttcagtttattttaatgaactgtagaactcttgggagaaacatttaaaaatccttaagtattttgcagggttgggaaacaagattttaaaatacattcaagagggaaaatacactcttgaattatttcagtcattatattcaaagcaatttattctatttgttaatattgatttaatttatattctacagctatttgaaatatcaattaaaaatataatgtgttcagaagtagcaagttattctcgattccttatccttagtgtgtgtactttgaaaatagttattttacatttatgggctttccttttgcttaatctgatctacttttgaacagtttaaaagcataatgaaaaagcagtttgaatgatataaatgtgatatcaatatttgattagtgttgtaataaatgaggaatgaatgagtcttttttttttttcttctttgcagtccccaaagctccagagatagatccagtagagtgtttggtggcagataactctgtaacagtggcttggagaatgccagaagaagataataagattgaccattttatactggaacataggaagactaattttgatggacttccacgtgtaaaggatgagcgatgctgggagataattgataatattaagggtactgaatatacactatcaggtaacatgactgcattttaggactctcattctcagaagataaatgtattgttgaaaaatattttgagttactttaaagaataaagttttaaagtttctttagtcacactgagtttttagatactcagtatggaagtgattttctcttgaaacatcaaggaaaccctttttttttttttaagacaggatcttgttctattatctcccaggctggagtgcagtggcgggaccttggcccactgcaacctccgcctcctgggttcaagtaattctcccacctcagcttcctgacaagctgggactataggcacacgccaccacacttagctaatttttgtatttgttggtagagacagggtttcactatgttgaccaggctggaaacctttgtctttattacttttggacatttgtaacatagtgaaacagaatatatgtaaaatatatatgaagggatattctgaaaatagtatttcagaataacatttaatttttaccttggttttctgactcttaaaaagctgttggttttttagatgttctcattacccatttcactgataatgtaaatactgtagcttttactgtttcaagattaccttcatgttaataattaacaaagacctgtgacttggtataacaatagaaatttgtgttgaccttttgaaagcctttataagaatgtctcagtatatagtggactttggatatttgaaatggcaaaatattgcctgagttgtccaatgcttattacgcatgaggagtaatattaggagcaccattattgagcagttaccatttatcaggagatgggctcaagtgtattacatatagtacatctcatttaatcagcataatacatctcatttatctttacaacaattatgaagttggctttattatttctgttctacagctagaaaacaggctcggtcaagttgttgacggtcccatagctagtaatttcaaaactgagatttagtaatccagactgtacttcaaaatgtttgttagtaatctctgctttacttcctctttaaattcattttcacataaaaaacgtttcataaatataaaaattatttagggtgttcactttaaattgaatatgttattgtaaattgtaccatctctctctgagtgaaatactacttttaatgaggcctgaaagggtactttttaatcactgggttaaaataacagttgataaactatatgtgtttcttttgaataaaataataattaaatcatgattcctcttattttgagcatatcactcttctttttttttttttttttttgagacagagtttcactcttgttgtccaggctggagtgcaattgcacgatctcggctcacggcaacctctgcctcccaggtccaagtgattctcctgtctcagcctcttgagtagccacgcccggctaattttgtatttttagtagagacggggtttctccatgttggtcaggcaggtctcaaactcctgacctcaggttcgggagttggcctcccaaagtgctgggattacaggcgtgagccactgcgcccgaccacatatcactctttttttttttttttttttttgagacagagtcctgctctgtcgcccagactggtgtgcagtggcgcgatctcagctaactgcaagctccgcctccccggttcactccattctcctgcctcagcctcccgagtagctgggactacaggcgcccgccaccacgcctggctaattttttgtatttttagtagagaccgggtttcaccgtgttagtcagggtggtctgtatctcctgaccttgtgatccgcccacctgggccttccaaagtgctgggattacaggtgtgagccactgcgcctggcccacataccactcttttaacaaattcatactcttcctgaatacagagacacggttcttaatgcctgaaggctcatactcttacttttgggaatagaatcctttactgtacatgtctgaaaaccatgttttcgtttcttcaggcttaaaatttgattcaaagtatatgaatttcagagtgcgagcttgtaacaaggctgtggctggagagtattctgatccagtgactctagagaccaaaggtgagatcagtagctctttatacagcataaaacaaagcttaacatctgaagttattcataactttgtaacaggaagcacttcatgtgatgttgaattacttctctacttctcctagcctagctttctcaacagtaagaattttaagggaaaataggactacagtagtggttttcattgggttttcttatatgattttatttatacagataaaatagactgagatgatggtattgtattctctgggagatgcttaatttataaatttcaatcttgttataaataggtaagtatcactgagatttgcccagagttttcccatagaatggattatgaatcaatattggggaagtatctgtttagttcaggtcctctctgttttcctgtatcttattgcaacagttaacgtttatatagtttattaatggttacaaaacactttcaattctttattagataattaaagtcatcttgagagatcaatatgctagatattattgatacccatattgcagatgaaaaaatagagttttcatatattaaatgactttcccatgatccctagacctagtttggaaaggtgtgaataagaatccacttctgagttttgtgccagcccttactatgagcctggaacctaggttcttctagtctctgaaagcaattggggtttaatgaaaactccctagagtagcagacttgaatacagaggattttttagatatttaccaatttgaaggttataatgctggagactttcctagttgtgagatggttattgactgggtttaattccagaaccagactctacacattcttgtaggcacttgggacttaaggcattccactgacctctagttcatatagcatttgaataggtttacctgccagaaatttgattggatttggaggatgacaaaaaaaatcatataataaaacaaaatataaggcctataagttattgatgagacaaactcagaaaaatgtttgcatcacaaaggtctgaaataaagtctatcttgaagtaatttgtttggattagcagatgtttctatttgagaactataggtaacttagccaaggaatgcagttaactctgtattacatgttatcaaactgagatgttattgtggtttctgtagaggtttttaccattttaaaataatagtcatatgtaggcagataatcttttctatataacttgaactgtttttagcccatcaagtaaaattcattactattattcttcctcaagagcatcatatttttaaaatttcttttgtttcttttcatttactgttcatatttaatgaccaaagttggacctaaatgtggtgaattataatttctatgcaaatttcatagatacaggaaaatgaatcactggcttgtggttttcttccagctgggctggctgctcctattagcagtgattggatgttactggtcaaactcttaatcatggggtttgtagagagaaactaagttgattctaggccttttcagcacttcttcactgttgagtaaaccctctgcggtaggaatagactgaaactcaactctgagacccacaaaacagtgattctgaccttcagggagttccagaataaagttagactcctacatggccatgagtcacagattttctagggttattccatagcattagtggggctactaatgagagtaagagctgcagaggaaaagtccacatttttaccaatgacacactgaacagttgtttaccaatttatttggcttgttgcagcctttttcaaccaaccagtagaaattagggtatggacaaaaaactggagagaaaggaagaaaggtggagattgagtagttgagcctaccaaaatttcatatacttccacttaaggttcttgatatggaaaatagtgaacattgtttacttctgccctccaacatatgaagcactatttcttctggcattgaaattctcagaagtcatgagtaatataagttcttatcaccagaatatttagagtatattattagttattttcttgtgaaggtaaatgatattaaattactaaatcacaaattattctccaactttaattgatagcagctatgatataattttatagtaccaagaaagcagccactcgcacaagttaaacatatgaaacatatctgtactctgatttttggtactttgttttcacagactattaaagatacgggaaccagtatctagttatattataggacttatacaagagataggacctcacttttgaggctagtcttttttttttttttaactatagagtattatctctgttacattagaggagctctataacttaactgaggtccataaggggtagtgtccacaaagaaagagagatacgaaaatgacactccttaggcttgaaatccatgcctttttgtttggatgctgcagtatttaataagtatggtcttaagtggttttcaatggtactatctattttttttttttgccacctttgacaccagtattgctggtggcccttctctccagcataacaaacattaggggacagccttaggatttcttccttttttaaaaaaacagccttaggattttagcaagcagttgagaattggtggcaccttagagttaaatccaatattctttctcaaaaatgtagaagctctcacatgcattacctagtagctcacatatagatgttaactttattaaggcagttcattcttggaaatgcagggtataagttttacttaatcctaaccttttggtaacctgtctattaaggaattctatttctgtttttactaaaaagctgcatgattgctgcattatctcttttttctgtaagttcatttctgtttaaatgcagatgttgaaagctgtgaacttccttgtactgtatgacatttactggaagctctgtggtcagtagatttgtattcagaatgttgtttcataaataaaaaacaatgaacaatagctccaatgcatagttgaaattaaagtgctctttacagaacagtaggggataaaaggattattgattcattaggtaaacagttatgtatcatcaaacaaaataaacctatagagagtcatagttcacagacacactgaagccttagctaaattaagtaatatccataagtgaaatagggttctgtaaagggatactgtatttcttaatatatactagaagtttgaacctttggagggaaatagaactaacaggcagattagttagtaactgtgtaatagctgataccttgcaagatagagattccgagagttatattttaagataaaaggaatggtgtgattagccatgaatcagtacattctaatgatttaccctcagtttccaaggaaagaagcttataccttgcttcactgatttcctaaattcctaaagcagttctgagtaagtcttgtgaaaagtatagttaattcctcaaaatattaaataatctggaagtcatagttttatggtttttttttaaatttatgtggttcttttccctctgtactcttcgtcatgtaaattatctatcagctgggccagtttccttgttctgccatcacggcctcagtttctctatgtttgccttactttgaaactgacagtgtaggtatgaaattattaaatattagagtatcagagaaaatgtgtatgccaggttctataattttttacactatgtaattttatccttctccttaattcttccagttccccttcctatttagtcataacagtcaactgatatcctaataacaggaaatttaggttactgtgtactcattgagattttagtagaatgaacaggagaaatgtcagtgaccatgcaagtacattgtatttggttggtgtataggatatatagagaagaataatgggaaatcagataagaattataaattatagcctgattattgagaactttaagtgctaggattatgaatttgaactttattttctgtattcagtattgaattgattgagtaggaaaataatgtggtgatagctgtgtttcagaaagtggagatatgctatattttaaaaatatatttaaatattatcttgaatagcacttaacttcaatttggataactcctcatcccatttgaacctgaaagttgaagatacatgtgtagagtgggatcctactggaggaaaaggtcaagaaagtaaaattaaaggaaaagagaacaagggcaggtaagctagaccattaaatctgccatatggacaaatgcttgtacactggttcttatttaacaataacttttattgaaattcttagtcaatatacctatgagagttacagtatattagtagcaccaaagtgaagaatataatactatttgtcagtagtttaataggtcattaacattttttattacttttttttagtttcatccctaatcctcttacacattttcatttcagtattccatttctttaaagttatatatacagcaacttgaattgcttagaagaagtttctagtataattcctgaattttagacttatagatcacctatcttacctgcaggtctggtctgcactaaatgacagcgtttaataggtacaaccctagggtcttgcctctgatcagcaacacaatgaacctaagaggcaggttcaaggaccttttgttactgtcataactaacttatttaaataaagtcaaaacatgggatcctctttcttttttaatagaagaaatttttgctcaaactgaagataaatgccattgtgagttacagtaatgaatccccaaaaattcctcagcaggcctttaatctgatttcattataagctgttaaatttaagttgtaaaacagtttcttaacagttgcctgtttttatctgacagtgtccatgttacttcactgaagaaacatacaaggtgatgatctatgtctgtctagttctaggacttagtaaaatctagcttggctgattaaaaaaactttaattttatcttttaaccaataagcagaagccattgcggcagccttcataagctaaaatactgctctgtgtagactgtattggtagcttatgttttgaatttacattgtagtgtgctgcatattatttggattatattgtatatggtaacaaaataagctctgctttaaagtctttcttgaatttttttcccttatctgatttatttttctgcttttactcatacctggcatctttcttgttgtactgaataatattcgttagtctaacattatagcttcgcttttatttgtatttgacacacagcaggtttgaagagttctctgttttataataattaggcagtttcaggagcaacaaggataaaaaataaaggccattgctaaaattatcaagacagttccagaaagatgaatggtttcaatttgcatgagtaataatgtgcttatttgaagatactacatatctttactggaaaccagaatgtgttctcttttcaaaattatcttcctcttattttcagtttatgtacttgttattggtaaaagtgattttatagtgtattataaattggaaaatgctgaatttaatagtctatgagtagactacatatttatgatttaaggttatattatttctcccttcctactttttaagagtattttacgtataggctacttgtcgaatgttatatgcatttatatattctttccataaatatttgtttgctgtaggatgtctgctggatgttataggatttatagggataaacactgtctctgctttcaagaaatttgccctaacttatgtagatgagatgtatgtacaagtagcaataatgcaaggtagacatatgtagaattgtaagtgtgaataaaggtattcagaggaagaaagatgcccagagctgccagatgttgaggtggttaggtaggatagccaaactaaaggtaataatcaagcctttattgatttgctgtgatagtataagcaagaggccacaaaggaaagagtatccactaccccagtgttcaatttttcccaacagaatggcactgggtgaaggtcatgtaaatcaacacagatcacaagtagtggatcttctcactgccagcaagccccaaacaaaaaggttcctgccagtttatgggcctgagagtcaagaaggtggggagtgaggggctaaaatgggaaagatactaaaacagagtggagaaaagtgttttcagaccatcactcctcccctgacctctgccctaaagcagttttacgcagagacacctgaaaagcaactcagcctagggcctccctccagtaaggggacctctgaatagaggtgcctagggtaggattgcagatacggtatatgatcatgatggggagaagagtggaattgcaactctctctcgaaactacagtgcactagctgtgcaccaagtctggtgcgagaagggcagctcaccctaccctgtgcccccaccctgcctcatcaacgcccgcctacgcttgggcctgaaagatcacatacagggcacatgcgcgtcactagatggcacggctgtcttctttccaggagaatttcccaaggactgctggctggaagtttgtggctaatgtggagctgaccgtagtttgccaaattaagaaaacgcgccaggcattcttaggaagaaagatgtgccagatttgatctttaagatggctaaataggaacagctccagtctgcagctcccagcaagatagacgcagaaggcaggtgatttctgcatttccaactggggtacccggttcatctcattgggactggttggacagtgggtgcagcccatggagggcgagctgaagcagggtagagtgttgtctcacccaggaagtgcaaggggtcagggaattttctcccctacccaagggaagccatgagggacagagcctgaggaacggtgcactccggttcagatactgcacttttcccacagtctttacaacctgcagatgaggagatcccttctggtgcctaccccaccagggccctgggtttcaggcacaaaactgggtggccgtttaggcagacaccaaactagctgcagaaggtttttttttttttttccatactccagtggcgcctggaacaccagtgagacagaaccattcacacctttggaaagggatgctgaaaccagggagccaagtggtctggctgggcgggtcccacccccatggaacccagcaaactaaaatccactggcttgaaattcttgctgccagcacagcagcagtctgagactgacctgggacgctatagcttggtcgggggaggggcgtctgccattgctgaggcttgagtaggtggttttcccctcatagtgtaaacaaagctgctgggaagttcgaactaggtagagcccactgcagctcagcaaggccactgtggccagactgccagatttctcctctctgagcaggccatctctgaaaaaaaggcaccagcgtcagtcagggacttatagataaaacccctatctccctgggacagagcccctgggggaaggggcaactgtgggtgcagctttagcgacttaaacgttcctgcctgacagctctgaagaaagcagcggacctccaagcacagagttcaagctctgctaagggtcagactgcctcctcaagtgggtccttgacccccgtgaatcctgactaggagacacctcccagtaggtgccgatagatacctcatacaggaaagctctggctagcatctggcagttgcccctctgggacgaagcttccagaggaaagaacaggcagcagtctttgctgttgtgcagcctccgctggtgatacccaggccaacagggtctggagtggacctccagcaaactccagcagacctgcagcagaggggcctgactgttagaaggaaaactaacaaacagaaaggaatagcacatccactcaaagaccccatccgaaggtcaccaacatcaaatacagaaggtagacacatccacaaagatggggagaaaccagcgcaaaaaggctgaaaattccaaaagccagaatgcctgttgtcctccaaaggatcacagctccttgccagcaagggaacaaacctggatggagaatgagtttgacgaattgacagaagtaggcttcagaaggtgggtaataacaaactcctccaaactaaaggagcatgttctaacctaatgcaaggaagctaagaaccttgaaaaaaggttagatgaattgctaactagaataaccagtttagagaagaatataaatgacccgatggagctgaaaaacacagcacgagaacttcgtgaagcaaacaaaagtatcaatagctgtatcaatcaagtggaagaaaggatatcagacattgaagatcaacttaatgaaataaagcgagaagacaagattagagaaaaaagaataatagggaatgaacaaaggctccaagaaatatgggactatgtgaaaagaccaaatctacatttgattggtgtacctgaaagtgatggggagaatggaaccaagttggaaacactcttcagggtattatcgaggagaacttccccaacctagcaagacaggccaacattcaaattcaagaaatacagagagcaccacaaacatactcctcaagaagagcaaccccaagaaacctaattgtcagatccacctaggttgaaatgaagggcagccagagagaaaggttggattacccacaaagggaagcccatcagactaacagcagatctctctgcagaaaccccacaagccagaagagagtgggggccaatatttaacattcttaaagaaaagaattttcaacccagaatttcatatccagccaaactaagcttcataagtgaaggaaaaataaaatcctttacagacaagcaaatgctgagagattttgtcagcaccaggcctgccttacaagagctcatgaaggaagcactaaacatggaaagaaccattggtaccagccactgcaaaaacataccaaattgtaaagactatcgacactatgacgaaactgcatcaactaataggcaaaataaccagctagcattataatgacaggatcaagttcacacacaacaatattaaccttaaatgtaaacgggctaagtgccccaattaaaagacacagactggcaaactggataaagagtcaagacccatcagtatgctatattcaggagacccatctcacatgcaaagacaaacataggctcaaaataaagggatggaggaatatttacgaagcaaatggaaagcagaaaaaagcaggagttgcaaccctaatctttgataaaacagactttaaaccaacaaagatcaaaagagacaaagaagggcattacataatggtaaagggatcaatgcatcaagaagagctaactatcctaaatatatatgcacccaacacaggagcacccagattcataaagcaagttcttagagaccaacaaagagaattagactcccatacagtaatagtgggagactttaacatcccactgtcaatattagacagatcaatgagacagaaaattaacaaggatattcaggacttgaactcagctctggatcaagcggacgtaatagacatctatagaactctccacccgaaatcaacagaatatacattcttctcagcacctcgtcacacttattctaaaattgaccacataattggaagtaaaacactcctcagcaaatgcaaaagaatggaaatcataacagtcagtctctcagaccacagtgcaatcaaattagaactgaagattaagaaactcacttaaaaccacacaactatgtggaaactgaacaacctgctcctgaatgactactgggtaaataacgaaatgaaggcagaaataaagatgttctttgaaaccaatgagaacaaagacacaatgtactagaatctctgggacacattcaaagcagtgtgtagagggaaatttatagcactaaatgcccacaagagaaagcaggaaagatctaaaattgacatactgacatgaaaatgaaaagaactagagaagcaacagcaaacaaattcaaaagctagcagaagacaagaaataactaagatcagagcagaactgaaggagatagagacactaaaaacctttaaaaaaatcagtgaatccaggagctggttttttgaaaagatcaacaaaatagaccactagcccgactaataaagaaaaaaagagagaagaatcaaatagatgcaataaaaaatgatataggggatatcaccattgatcccacagaaatacaaactaccatcagagaatattataaacacctctatgcaaataaactagaaaatctagaatggatcaattcctggacacatacaccctcccaagtctaaaccaggaagaagtcgaatccctgaatagaccaataacaaattctgaaattgaggcagtaattaatagcctagcaaccaaaaaaagtccaggaccagacagactcacagccaaattctaccagaggtacaaagaggagctggtgtcattccttctgaaactattccaaacaataaaaaaagacaaactcctccctaactcattttatcaggccagcatcatcctgataccaaaacctggcagagacacaacaaaaaaaaatttcaggccaatatccctgatgaacattgatgcgaaaatcctcaataaaatactggcaaaccgaacccagcagcacatcaaaaagctatccaccacaatcaagtcggcttcatccttaggatgcaaggctggttcaacatatagaaatcaataaatataatccatcacataaacagatccaatgacaaaaaccacatgattatctcaatagatgcagaaaaggcctttgacaaaattcaactccccttcatgctaaaaactctcaataaactaggtatcgatggaatgtatctcaaaataataagagctgtttatgcaaacccacagccagtatcatactgaatgggcaaaaactggaagcattcactttgaaaaccagcacagagggagagagttgtgctgctgcctccgagagctccaccttcgtggctctggatccggggccccggcctgtggcggcgagcggcggccgctggagacgagcggcggcggcaggcggccagcccgggtctacctcgctccgtgcagggccgggagagggatccgccatattggagctggggccgaaggtgccttggagccgcggcgcgaggcgggtggaggtggcggccctggcctggatcggggaggagtcggctctgccctggcccgcaaggctggggagctaatgagcctctctggctagtctcctccccgtccactccctccactttctgccgctgggagccggctgtggcagtggcagtggcagtggcagtggcagcggcaggatgttctccaagaagccgcacggggacgtgaagaagtccacccagaaggtgctagacaccaagaaggacgcactgactcgcctcaagcacctgcgcatcgtcatcgagttaatggtggaactggctgaagaagatgcattcatccagatgcctgaatcctagttcagagtttatctcgagctgtcttcctgatgcgtatttgttttggaaagtgatgtttatttagtgaaaaaaagaatgcagaatctattgatcttaaacagtttttcgacaacattttttacatatatactatgtgttctttgaaaattttgtgactatcgaagctagtcttaaacagaaaggtcacaagtctcaaagagaggaactggatgctatactttttatttttgagaaaattttacaacttcttccagaaagaattcatcagccatggcagtttcataatattggattgatttaaagaagctacttcacacaggagactccttaaagattaggcgggaaggtgttcgtcttttcttactatggttgcaagctcttcagaataactgtagcaaagaacagctctggatgttttcatgcttaatccctggattttcagcaccacagtctgaacatggacctcgaactttagataatctcattaatcctccactcaacctttaagaaactcaagtcactatagaagaaatcactcctcttgtccccccacaatcaggagataaagggcaagaagatctcacaagctattttcttgaagcacttctaaaatacatagtcattcaggtaaaaagtttagaatggaagaacaaagaaaaccaagaaaggggattttcatttttgttttcacattttaagaaatattacttgccttatatttttccaaacatctgtaaggaaaacagtttatatcatcctatacttgacatcccgcagatgagaccaaagccacattatgtcatgataaagaaagatgctgaaaccaatgaagcaatctattgtacaaaggagcctttcattaaggctcgtgttattgtcattcgttggctggtttctttctggctggagccaaaaccacatacaggacctcatattcctgggatggaaggtgaagtcttgccaaagaatattcagagagcagctgctagtttagtatccagagaagaaagcaaaaatgataatgctgataaagcagacagaactacagaacccgaacagtctcattccaatacaagcactctcacggagcgagaacctagctcatctagtctctgtagtattgatgaagaacatctcacagacattgaaatagttcgcagagttttttcttctaaaaggagtaatgtaaactttgtgacagagatatttcgtcaggcatttttattaccaatttgtgaagcagcagctatgagaaaagtggtaaaagtatatcaagaatggatccaacaagaggaaaaacctttgttcatgcaagagcctgaagaaattgtgatcacttcttcagacctcccttgcattgaaaatgtcacagaccatgatatttcaatggaagaaggagaaaaaagagaagaggaaaatgggaccaatactgctgatcatgttcgaaattccagttgggcaaaaaacggctcctaccaaggtgctcttcataacacctctgaagaagccacagaacaaaacatacgagctggtacccaggcagttttgcaggtgtttattataaactcatcaaatatatttcttcttgaacctgcaaatgaaataaaaaatcttctggatgaacacacagatatgtgtaaacgcattcttaacatttatcggtacatggttgtacaagtatcaatggacaaaaagacttgggaacacatgctgcttgtgttgctcagagtcacggaatctgtactgaagatgccatcacaagcttttctacagttccaagggaaaaaaaatatgaccttggcaggtcgacttgcaggaccacttttccagacccttatagttgcctggatcaaagcaaacctaaatgtgtacatctcccgagaactttgggatgacttactgtcagtattgtcatcgttgacctattgggaagagttggccactgagtggtcactgactatggagacattaactaaagttttagctaggaatttatatagtttggatctcagtgatttaccattggataagctgagtgaacagaaacaaaaaaagcacaaagggaaaggagttggacatgaatttcagaaagtttcagttgacaagtcattttctagaggatggagtcgtgatcagcctggccaagccccaatgagacagaggagtgcaacaaccactggttctccaggaaccgaaaaggcgaggagtatagtacggcaaaaaactgtcgatattgatgatgctcaaatacttccccgctcaactagagtcagacatttttcacaaagtgaagaaactggaaatgaagtttttggtgctttgaatgaggagcagccattgccttgaagtagcagcacttctgacatcttggaaccattcactgttgaacgagccaaagtcaataaagaggacatgagccaaaaactgcctcctcttaatagtgatattggcagcagcagtgctaatgttcctgatctgatggatgagtttatagcagaatgacttcgaagtggtaatgcctcgactatgacaagaagaggaagtagtccaggcagcctggaaattcccaaagacctccctgatattctaaacaagcagaaccagatgcgccctattgatgacccaggtgtgccctcagaatggacttctcctgccagtgcagggagcagtgatcttatcagctcagatagtcattcggattctttcagcgctttccaatatgatggccaaaaatttgacaattttggctttggagccgacactggggttacgtcctctgctgatgtggattcaggttctggccatcatcagagtgctgaagagcaggaagtggctagtctaactactcttcatatagattctgaaacaagcagtcttaatcagcaagctttctctgctgaagttgcaactattactggttcagaaagtgcttccccagtccactcacctctgtgctccaggtcacagactccttccccttctacattgaatatagatcacatggaacagaaggatctgcagctcgatgagaagctccaccacgctgttcttcagacaccagatgatctagaaattagtgaatttccatcagaatgttgtagtgtgatggcaggaggtactctgactggatggcatgctgatgttgctactgtaatgtggcgaagaatgctaggcattttgggagatgtaaattcaatcatggatcctgaaatacatgctcaagtttttgattacctctgtgaactttggcagaatctagctaagattagagataacctcggcatttcagctgataacctgacctccccttctccaccagttttaattcctccactgagaattcttacaccttggctttttaaggcaaccatgttgactgataaatataaacaaggtaaattacatgcatataaacttattggtaatacaatgaaaagaagacaagatgtttctccaaatagagattttctaacacatttctacaatataatgcattgtggattacttcatattgaccaggatattgtcaatacaatcatcaaacactgctcacctcaatttttttcacttggtttgcctggtgccacaatgcttattatggattttattgtagcagctggtagagtggcttcttcagcttttctcaatgcaccaagagtagaagcacaagttcttctgggatctttggtttgctttcccaacttatattgtgaactgccttctcttcatcccaacattcctgatgttgctgtgtctcagtttacagatgttaaggaacttataatcaaaactgtattaagctcggcaagagatgagccctctggtcctgcacgatgtgtagcactttgtagtttaggtatttggatttgtgaagaactagtccatgagtctcatcatcctcaaattaaggaagctctgaatgtgatttgtgtttccttaaagtttactaataaaacagtagcccacgtagcttgtaacatgcttcacatgctggttcattatgtacctagacttcagatttaccagcctgattctcccttgaaaattattcagatcctaatagctaccatcacccatcttttaccaagtacagaggcttcatcttatgaaatggacaagaggttggtagtatctttacttctctgccttctggactggatcatggccttacctctaaagacactgctccaaccatttcatgctacgggagcagaaagcgataaaacagaaaaatctgttctcaattgcatttataaggttttacatgggtgtgtttatggagctcagtgttttagcaatccaaggtattttcccatgagcctctctgatttggcatctgtagattatgatccttttatgcatttggaaagtctgaaagagcctgagcctctgcgctctcctgactcagaacgatcttctaaactccagccagtaacagaagtgaaaactcaaatgcagcatggattaatctctatagcagcccgcactgttattacacatctggtaaatcacctgggccattatccaatgagcggtggtcctgctatgctaacaagtcaggtgtgtgaaaatcacgacaatcattacagtgaaagtactgaactttctcctgaactctttgagagtccaaatatccagttctttgtgttaataatacaaccttagtgtcctgtatccagatcagatcagaagagaatatgcctggaggaggtttatctgctggccttgcatcagccaattcaaatgtcagaatcatagtacgtgatctctctggaaaatattcatgggattctgctatactgtatggcccacctcctgtaagtggcttgtcagaacctacatctttcatgctttcattgtctcaccaagagaagccagaagagcctccgacatctaatgaatgcttagaagatataaccgtaaaagatggactttccagtttaaaagatttagagaaactgtaccaacttgggatacaataagagatgaagaagatgctcttgatgaactcttgcagtatttgggtgttactagtcctgaatgcttacagagaactggaatctcacttaatattcctgctccacaacctgtgtgcatttctgaaaaacaagaaagtgatgttattaatgctatccttaagcaacatacagaagaaaaagaatttgttgagaagcactttaatgacttaaacatgaaagctgtggaacaagatgaaccaatacctcaaaaacctcagtcagcattttattattgcagattgcttcttagtatattgggaatgaattcctgggacaaacggaggagctttcatctcctgaagaaaaatgaaaagctacttagagaacttaggaacttggattcaaggcagtgccgagagacacacaagattgcagtattttatgttgctgaaggacaagaagacaaacactccattctcaccaatacaggaggaagtcaagcatatgaagattttgtagctggtcttggtttggaggtaaatcttacaaaccattgtggttttatgggaggactacaaaaaaacaaaagcactggattgaccactccatattttgctacctctacagtagaagtaatatttcacatgtcaacaagaatgccttctgattctgatgattctttgaccaaaaaattgagacatttgggaaatgatgaagtgcacattgtttggtcagagcatactagagactacaggagaggaattattcccacagaatttggtgatgtccttattgtaatatatccaatgaaaaatcacatgttcagtattcagataatgagaaaaccagaggttcccttctttggtcccctttttgatggtgctattgtgaatggaaaggttctacccattatggttagagcaacagctataaatgcaagccgtgctctgaaatctctgattccattgtatcaaaacttctatgaggagagagcacgatacctgcaaacaattgtccagcaccacttagaaccaacaacatttgaagattttgcagcacaggttttttctccagctccctaccaccatttaccatctgatgccgatcattaaatatcagttctgtttatctgaaggctcctacccagagattctacccagtgaaactcccacagcagcgcaggtagatggggctgacctggcctctccaatgtctcctcgaactagcaaaagccgcatgtccatgaagctgcgtcgttcctctggctcagccaataaatcctaaggagacaagcagcccagcagtgatcagcagtagccaccttagcatgaacatagggttaaccctttcaggccttcatgtctgccataacatgcatgtttcttcctgtacatttatttgagaaaacactggatttaaataattttaaataatttgtagcttaatattaaagatttaagttatttattgtttcatttttttcccacaatccaagctgccatattttgagggcagggggagttttattctacaccctttaccttcctagataattatgtctaagtagttttatctttaatttcatggttaactgtgagccaaaatacaattggacaattagtctcattatttattgtgctccattgcaactttatggttcaataaatatataattttttacaaatgtaaaattttacatttaagcatttgtaaagttacagcaaaagatgtacctgttaatacacagaatgtgtacagattatttgttatgacaataaaacactcaaaataaatggtctttagcatctcaaattccaactgaaatcattttagtattaactcttcttcccaaagcaatgtctcatttcttggctgtgcaggtgatgccatgttatatccaataactagaaaaatcactgtgctgaacttttatgtttagcttccaagtatttttctaatgttttgcatttcaagtggtatcactgttaaatgccatttgttttcagattgtggccttttattattggctgctagatcctggtgtttctatgttcttttttaagcaccaaaaagaagatggggaagaaaagaaggaaaattttctgatataaatatgttgttcaaattatgagtactatttaaaaaagaaaaaggaacctaacccaggagtctaagttaaatctaatattgttaatactgaacttgcaggtccaggttggtatacattccaccctctagaagtattttcttacagtagataagctgctcacattttgttttgaatgggcatctcctgaggaaatgtagcatgatattggtactaactgcatgtgtaaatacatcatactggcaagccgtaaaatataaattatgtatcattcacgtagtatctataatttgtaacagtggggggaaaagatgacatggtatttaataatacaataaaaatattcttatcaaaaaaaaaaaagaaaagaaaaccagcacaagacaaggatgccctctctcaccactcctactcaacatagtattgaaagttctgaccagggcaatcaggcaagagaaagaaataaagcgtattcaaataggaagagaggaagtcaaattgtctctgtttgcagatgacatgattgtatatttagaaaaccccatcttttcagcccaaaatctccttaagcttataagcaacttcagcaaagtctcaggatacaaaatcaatatgcaaaaatcacaaacattcctataccccaatgacaggcaaacagagagccaaatcatgagtgaactcttattcacaattgctacaaagagaatacgtaggaatacaacttacaagggatgtgaaggacatcttcaaggagaactacaaaccactactcaaggaaataagggaggacacaaacaaatggaaaaacattccatgctcatggataggaataatcaatatcgtgaaaatggccatactgctcaaagtaatttatagattcaacgctattcccatcaagctaccattgactttcttcacagaattggaaaaagctactttaaacttcatatggaaccgcccgcatagagaagacaatcttaagcaaaaagaacaaagctagaggcatcatgctacctgacttcaaactatactacaaggctacagtaaccaaaacagcatggcactggtaccaaaacagatacatagaccaatggaagagaacagagacctaagaaataaaaccacacatctacaaccatctcatctttgacaaacctgacacaaacaagcaatggggaaaagattccctatttaataaatggtgttgggagaactggctagctatgcagaaaactgaaactggaccccttccttacaccttacacaaaaatcaactcaagatggattaaagacttaaagataagacctaaaaccataaaaatcctggaagaaatcctaggcaataccattcaggacataagcatgggcaaagacttcatgtctaaaataccaaaagcaatggcaacaaaagccagaattgacaaatggaatctaattaaactaaagagcttctgcacagcaaaagaaactgtcatcagagtgaacaggcaacctacagaatgggagaaaatttttgcaatctatccatctgacaaagggctaatatccagaatctacaaagaacttaaccaaatttacaagaaaaaaacaaccccatcgaaaagtgggcaaaggatatgaacagacacttatcaaacatatgctaacaaagatattaaaaaaaatgctcatcatcactggtcattagagaaatgcaaatcaaaaccaccatgagataccatctcacgccagttagaatggcgatcatgaaaaagtcaggaaacaacagatgctggagaggatgtggagaaataggaactgttctacactgttggtgggagtgtaaattaattagttcaaccattgttgaagacagtgtggcgattcctcaaggatctagaactagaaatatcatttgacccagcaatcccattactgggtatatacccaaaggatttataaatccttctactataaagtcacatgcacacatatgtttatcgggtcactattcacaacagaaagccttggaaccaattcagatgtccatcaatgatagactggataaagaaaatgtggcacatatacaccatggaatactacacagccataaaaaaggatgagttcatgtcctttgcagggacactgatgaagctggaaaccatcattctcagaaactatgacaagaacagaaaaccaaacgccacgtgttctcactcataagtgggagttgaacaatgagaacgcgtggacacagagaggggaacatcacacatggggcctgtcggggtgggggtctagaggtggaatagcattaggagaaattcctaaggtaggtgaccggttgatgagtgcagcaaaccaccatgacacatgtatacctatgtaacaaaactgcacattctgcacatgtaccccagaactttaagtataataatattaaaaaaaaaagagaaaaaaaatcacacacaggatttgggtctggagcaagagtcctgagacaggttatttaacctgttagaatttgggggactttcattaaagaagtggtatttaggccggttcttgagcaagtgggaaaatgtatggttgttagacttgcagtgaaaggcggaacagccatagcaaaggcactgaagcagatggtgtgagtttaaacaacattttgactggtatatttagctatatagtgctctctaggagttagaaggctagaaaggcagattaggactaaatcaagaaccagaatgtcatgctaagtcgtttgtaagtagtatagaagtaaatgatgatttttaaatagaggaatcagagtaagctttatcttgtaataatgaaaaagatgaattggacagtaaagaaattatttgggaagctggtaaaacagtccagactagaggtagctgaagaggcttacttaaattcagatagttaagtggtcagggtgtcctttagggaagtggggtgagggaggggatgggaggagatcatgcttgacataaaacttattataagttgtttcttgcaaaagtgacttaggattggaagtctggaatgctgcaatggaagagttttccttacttaacttttctctgaaattaaactgccaatgtcaatagttatgtctgtttttcttttctccatgcttccctttatttctttactactggtaagttacaaatttttaaaaattgtttttctgttatcaaaagagctcttaatacattttgaagcagtgctaagtgaaatttttctctttatttgtatgacgttcactttctatttgttgccctgagttacttgggaaatatttttcagaatgcatgtttcctctcagcagacactctgaccaccagttggggaggcaaactatcagtgtattttgaaaaagtttcctgattgtttctgaatctgctgtgccttttcagttgacaatcattgatttattacaaaatgccaaaggcctttgttttttcaatttagtactttggctcaggaagatacaggtgttccttaattgatagtatcacatactctactcagctgagctcattctagtcagatattgtacacctactctgtactgaggatacagagatgagatgtggttcctagcaacagttagttcccttccctcagctactccatagccaagttcctcacttgccgtaaccaataagcgctaagcatgccgtatgatagatttgtaaaacctgtcttttcatcacccttttaatccctactccttgatagaggagttttgctttgttttacctcagtggctcctagcccagatgaacagcaaaatcctgaaattcttaatttaaaaaccagacatgtgtttctcaagcctaccctccagtatctgatttagtagtttatggtaagtcctggtaatttgcatttttaaaaggtccccaagtgattctgatgtgcagctgggttgaagaaccactggtttggttcatttaattcctcctcactcctgattacacatttactttaacctctcctctcctttcatttcattcttacctagttacccaaaacaaaatcttgttgactttctttgctctgtttcttagctgaatagcaaccatagtcatgattgttaatggtaagatagtactagcaatactaaaaagcactggggcttaaagtgaagttagatataatgaagagctagtgttctcaggttattgtatcccatcttccttctctagttacaaaagtaatttttacaaatactgacgtgattaattaaaactgtgttcatttttgtatagttaccaatatttgctgttgaataacttgggtggaggaagattaatgtgcagtcaatttatgaattggtgacttgatgaattgggtaatatttggtgacctctgcactcattttttctgggagaatgtactttcatttcagataatgtcacatgaacttttggagaataactgtcaaccacaggaagttcttttattatataggtgttctggagacctaaaagcttttttgttataatttatataccgtgttgaaacaattttactttcgccctcttccttttcatgtcttcttttaatgttgcatctaaaacattgttttttcacacctctttttaagaaaagcaacagcatggtttctttcatgaaatgtttccagaagcctgatccaaaaagagaaaagtatagctggttaaaggagggaggaagccctaaatctggcttcttcccagagtacctctgtggcatctgtggattcccttgagttcagcacatggtttaaacaccattgatttcaagagtctttgcccctcacaagatcaggaaaatagagctgcatgtactatttttttaaactttgaggcaaatgtaatgttatcttttctcctgagcttaagataaagcttttgaaaacatacagaccttttgtgatcgggcttttaacattctctatcagcttgtataaaatgaatcagaaagaaaattatgatacagttcttttttcctgagttatcagttgacaatgtttgcagttttactttcttactatactagttaatgactcttacaagtattgtataagatcagcttagaatacatgttcatctcaaaccttgaagaagtgaaaacatatatttttggtattcagaataaaaagtataaatgtttaataatttttatttgtttctatccttcattttggagatctcaacaactattctggaattttcccccctcacgttctgttttgctgtccccgtacccaatagcaagaaactactgcctaccttagcacaagtttcacagaaattttaatctacctatccacattcagctttgctcatgctatctgttcaaacagaacttatagtcagtttttagttgtctttttaaagaaacatctttacacaaaggacctttgaaatcccttgggaagaattaaactaagtcatgtgagtgttgtagttctagacttacacttttgctacttaatattatacactaaaaaggagacagttgaagtggtcctgagttctttgaaattgtctaataagtctgatttctgacagcaagacatttaaataatgcagaatgaagtcactgagtcatatgaaatgaatcatatgaaatgactttaagttttatctgtattcttgctttgccatcagggatttctagtctagtattggtagcttatattaaaatctactcagttgatcttttcttaggaagaaaatttctagtgctatgttagaaaaaagtgtttttatttctaactagtggtgagaatatagttatccccatatcccccaaatacttttaggataatcttgaccaaaaaatcttttgttaaatgcagtaattcaatataattaaaatgtttttgaaaacatctttgggactgaatctgttttgagtttttgaatgttagtaaacatcccaatactccagttttccatatatcatataatttgatataagaggaagtcaaggtggatcttgtctatttgagtaggagaaatgcttgataatacttgatattatcctgtgcaaggatttggataattgccatttccatcttttttttttttttttttttttttgagatggcgtctagccctgttgcccaggctggagtgcagtggcgccatctcggctcactacaacctctgcttcctgggttcaggcaattctcctgcctcagcctcccgagtagctgggattacaggcacccacaaccacacccagctaatttttgtatttttagtagaaacggggtttcactgtgttgcccaggctggtctcgaactccagacttcgagatccgcctgtcttggcctctcaaattgctgagattagaagcatgagccaccgcgtgcagcccccccgtccctttttttttaagacagagttttgctcttgttgcctaggctggagtgcaatggtgcaatcatggctcacccgcaacctctgactcctgggttcaagcgattctcctgcctcagcctcccgagtagctgggattacaggcatgtgccaccacgccctactaattttgtatttttagtagagatggggtttctccacgttagtcaggctcgtctcgaactcccgacctcaggtgatcctcctgccttggcgcctcccaaagtgctgggattacaggtgtgagccaccgtgcctggccgccatttctatttttaagaaggtaagattcagagcaaaaatactcactgcttataaaaagagttatttagtcaggattataagaagaaacctatttttgccttcatttaactgcaaaaaaatgtaagctgtaactcattatctttcttgagttcttttttttctttagtaaatcttgtcacattttagcattgtttcttatttcagccgtgtattctttgtataagccttgctcagtctgcatgccattagtgttttcagcctgctttgtattgatagcttcttacatttcagtgtttataattgacagcgctctttaattaactagttcagatcaaattgaatggtgttatttctataacataattagaaatcttttcagaggttccttccatgatttctagttttagtttatgaaacatttacagtataaaatatttgtttttcttttttctttttgtttatatagaagtggtacaccatccccaaaacgaacatctgtaggctccaggccaccagcagtaagaggcagtagagatcgttttactggagaatcatacacagtgctgggtaggacaaaacataattgtttttcattatctcagattaaaggcatcacaatcacactggtggactttccactcaaagtgactgcctgtatattgaataaatctttgcaagaaatttctcccaattgaagcctaattactttggggagttttcagattgtcttattattattgatacttttaaaactctacttcagcttacgtagtgttcccacatctttatatataagccgggaggggggatagtaaggaagaaaacctctgaagcgttttatattcaagaatagtactaaacgtaaaggtaaagttagagcaggtactcagcatttaatgtctgtgtgttaacatgattattcttataggaaaagtacttgaataaaaatttttgtgtctttttttgggacgagtggtaggtaaaactgtgtgactcataaggaagagatgagtcaaatctacctttctgatcttttgtaggagacactgctattgaaagtggacaacattattgggaggtcaaggcccagaaggattgtaaatcctacagtgtgggagtagcatacaaaacgttggggaaatttgaccaattgggaaagacaaacactagttggtgtatccatgtcaacaactggctacaaaacacatttgcagcaaagcataataataaagtcaaagctttggatgttactgttcctgaaaaaataggtgtattttgtgattttgatgggggtaagtttattttctcgtaggttatttcatcatagttgcttgcatttcagtacctttcactggtaatcatctatacaggatttccattagtattgtgggaaggacattttgatcaggtaggcttttgattgcaatcataatctcaattctagaattgactggaatggtatatgtgatgtctgcctggagccctataaaagcactcatttataatatactaagtctgaaagattttgctaattttagtcttcagcactaacatttcttctgtccattttaattccttccttaccatgttttattacctacctctaaagagtgatagtcaaaattttctagttgaagtagatcttagaaattacccaacccaggatgaataccccattttacatgatgtgattattacacattgcatgcctatatgaaagcatctcatatactgcgtaaacatacacacctactatgtacctacaaaaattaaaaaaaaattcaagaagataccagagccatattttctactatcctagtaaacataagctatacagcaaatatttactgtgccaaaccgcatcacacttgaaacgaatggaatgttcttaattttcaagttgctgtctttaaaaatattcttcagaatgactcatgatatctttagaggggccaaaggggtttcccctcaatatcagaatttctttacttacaaaattattaacacagtgtagtctaatccaaaaaagaaaagaaattactccatctgccacacagtatacagttcttagtacactatctctgcaggtagttgccacttatgtgcctgaagaacttttaatgtgaagtttactgtcttagaaagcagcctgtttcattgttggacagctcttggttagaagatttttcttaagttgactcacattgtttcccttaaattttcccatctgaataaacacagaattacgtttcctcactcatgttcacacgataatcctttattaaaaactttcttgccctgtttttccagaccatatattctgttattagctgcccctgttaaaatttaatttttccaagtctttataatctcctatggctgtctagtatgtcagtgtttttcttaaaggttggtcttagagtggaacacatgacctctgaccagcaaaggacagtaatttggctatgctatttctaatagtatgacttagcactgctgatcaatattgagcttgtagctaccctaatccattagatcttttttcacggcattatgtcaaattgtctttttcttttgttaggcagtttatggttttggttttttttgttttgttttgttttgtttttgagacagagtcttactctgttgtccaggctggagtgcagtggctcagtctcagctcactgcaacctctgcctcccatgttcaagcgactctcctgcctcagcctcctgagttagctgggattacaggtgcatgccaccacgcctggctaatttttgtatttttagtagagacggggtttcaccatgctggccaggctggtctcaaactcctgacctcaagtgatccacctggctgggcctcccaaagtgcagggattactgccatgagccaccacacccagccagtttatggtttttaaaaataactcaatgttatatgtaatgcaaatgaagactattacatttacccttttttagtttcatcttaatagatttggcccaaatttcccgtcttaaaattatctaaaaatttacttgatatttatattttgaaaaaattttaaagctcattgaattagttatttcataagcatattctctacagtcatctaatgtataataattttgaagatgacataatattgaactaaagtaattccctagatgttttttctccaagttgacacttaagctaataccaaattttattattttagtaatattgtgcccaaataattccgtgagctgtcagttaatttactcaaaaaaggagaaaaagtaattttggcttgatttatttttagtgatgacatgttagctttgctgtgttttttgttttttaacttattcaccttgaatcagttaaatcattttcctcaggataaatggcaaatttattagcacacatttttttttcaactaccaagacaacatttgcttcttctctctcctttcccatactctgtgagtccataaaggtagtagtgagatacagtttttagtctagaacataacgtatggcaaggggaagttgtactgtggaataggatcagattctgagagccttgaaaaataataatggactggtcttcagtagtggggaggggtggttctgcatgttttagaacactatagtcataagataattgagttttagaaatattagagagtcagtggttaaagatggaagagatcgaaagcatagcaagcataagacttttcgggaagcagtcttcaagtggtgtagagcaggactgagtctcttgttagctattaagcccttattgcctggctagtgcttttcacatagaaagcccttaataagtgttgagtaactggcaacaagcatctgagcagtggagaattaagaatggatttgacagtgtagaagtagaattcataggacttagtaactaaatacagatcagctgaggacagacagttgaagatgactttgaggttccagccagtgtgatcaagaggatgacagtgtcaacaggatagggaacatagagttttggggggaaatgaaatgccagcaggataatcatgtggcatgtttagcaagcattttgaaattcagtgctagaattcagcagttaagtagagctgacattaaatatttgagacagcattacagaattgctatggaagattgtacaggacaatatatttaagcattactattctgctgtttactaactttgtgatcatatgtaccgttatgctgtttaccaacttcgagatcaaagtactgggtactttacatacattacctcaaaatattaaacaatctacataataatgtgcataaatattagtttattttatcttcctctttggtggcagttgatttattaaggaagcattatataaagaaaagagagcatggacaaagtggctacatttagaacaggaagaaaaggaggagatggtgaagttatccccagggttatgatacaaaccaagggaatggtcatcagagaagagtttcaagaagtgataacagctgtaaggaggccatttggttggccagtttaggaggtcagacagacagttttttttagggcatgatcctattgaaggatatactgtgaggtgattttaaaaattaacaaagcaggtcaggcatagtggctcatgcttgtaatcctagcactttgggagactgaggtggaggattgcttgagctcaggagttcaagcccagcttatacaaaatagcaagaccccgcctctgttaaaaaaattaacaaaattgaagcagtgatagatatattgtgattttagagactggagtatcagtatcgcatcaggtagatagaagacaaggtttaatagagtaaaccttaaatggtgattagaatttgggcagagaggctggttataggaaaaataaggaggaagaaatggccttggtttacactgggctaatgaaaccatttgttaaataatgatcaaataaggaaatagtttgtattaaataagtcgaatcgtgctagattatagaggtattatagaggtcttgaaaaccaggggaagaaaattggattgggcttttccttaagcatttgtccttctgattttcaagtgagaataattaatccagtcctcatacaaaaattaatgccaacttatatattattactttttgcatgattatgcgttagaattaattaaatgttacaattttttgtataataaattaggctttttttccttcttttttaggtcaactttcattctatgatgcaaattctaaacagttgctatattcctttaagacaaaatttactcagccagtactacctggtttcatggttagtatgttttatatcttatatatacctaacatattttacttggttggcaactttaaggagaatattctatactgtatatttggagaaggagaatattttgttttttcttcatattctcctccatttccccaattcaccctctcccaaatctgtgattgtttttatatatttttggtatattttattgaagtttatgttaatacatgaagtacacaaatcatgtagtttgatgagtttttataggactgcactcatgtgtaactagcacttagaacattacgagaacctcagaagccccctctagtgcccatttccagtccctaatggcccttctccagtgttagcactgtattgacttttaataccctaaatttacttccttttcagttttatataaacagaatcatacagtatctttttgactcaacattatgcttgtgagattaatccatattctatgtggttatagttcattcattctcatagctgtatagttttccattctgtgactatatcaattgatttataaattttaatttagttggatatgtgggtggtttccatttgggggctatacaaatagaactgctatgaatacttttgttcatatcttttgataaatgtatgtgtatatttccattgagtatatacctatgattggggttgctagatcatatcgtatatgtataatcaactgtaaaattgccggttttctgaaatggttggttatgctaatttacaactagcagtatgtaagaatttgagttccttcaaatccttgtcaacacttagtattatcttttaaaaaattttttgtccttctagtggatgatatattacattttggttttaatttgcatttccttgattactagtgctgttgagcacctttttatatatttgttgactatttgggtatatgcttttgtgaactggctattcagatcttttgcttgtatttctattaggttgtcttcgtgtttcttatgggttaatttgtaggctcttcttcactctggctttcctttttccttattggtattgtttgataaacaaaagttaattttgttcagtttatcaattttttcatttacagttagcactttttgtgttctgtttaagaaatcagtatgcacccccaaggtcatgaaaatattcttctaaaagctttaccttgtacatttagatatagactgcatttacaatgcaagtacaatgtagaattgatgtgtttggtatgaagtaaggatctagatacgttctttaattccccatggatatccagttattccaggaccatttattgacaagatcatagtgcagtgtcatctttgtacaaaatattagatgactgtctttgtgtgctatgctgaatatatgtatgcacaccacatagcaattacatcctgtgtaattgcaggtctactcaatttcaggctgaaaagaaaaatttgtttctctgcacaaaataaaacatggttttgaatttatttaagcaaatgttattgctttttccaactcataaccttctgcatcttttcataggttaggttcccgtggggagttgtgggatccagttaaagttaccattactttggctagagcttttcttaaatttggaggctacctctataagtcaagatggtatatttcaaatggaatattttgcatgtatattcttctgtcatcacccctaactgtaacttctcaactataaggagaaagttttcagagtaagagtgggttgaaaatacagtgcttttaaatctcattatccatagtaattatttattccagatactttaatctcttaagtttaaaacaatgctaataaccaggacacctatttttacattaaaagtaagtgattagtgactaaagttattgctcatggaaacataaagatactggaagggagggttgtttctttttccttttttttttttttttaactttgtacaaacctctgccatattacgcatttttggctatttttccaaactggtccatcaaggatgagttgtttaccatgtggaatgcagaaaaattttttccaagacttaggtgtgcttttataaatagtagatttacttttaatttgaatctatctcatgtatgtatgtactgagtttattgtttttcattccaaataatactctaattatattagtatatgtcataagatactgcaagaaattattttaagcttgttaaaattttttttccttcattgaaggcttgcttttattaagtacgttaatgcctattaaatgttttgtgtacaagattaatttttaagtcagttttattgaatttatagtatggtgcagttctgtggtttttagcaaatgcctgcagttgtataaccaccaccataatcaagatatagaacatttccatcaccctagaaaattcctttgtgttcttttatagtggaccgttccacacaaccagccctagctatcagtaaccagttcgtaggccctatagttgtaccttttccagaacatcgtataaatagaattgtatggtatgtagcctttcgattccgtaccatgctgcatttgaaattcatccatgttgttgtggtgtcagtattctcctttttttcattgctgagtagtgtttcatatatgtatgtatcacagtttattcattcattcaccagttgaaagacacttgggtttttcccagtttggggcagttatgaataaaatcactataagcatttacatatgggattttcccttgggtaaatacctaagagcagtaatagagtagctgtatcacattgaaagtgtatgtttaacttcatggggaactaccaaaatgttttccaaagtggctgtaccattttttgccttcctatcagtgatatgagagttggtcatatccttgccattatttgatattaccagattttttgttgttgttaagccattttaataggtgtgtagtggtatgtcattgtgtttttatttgtagtttcctaatgacaaatgatgtttcatgtccttatttgccattcatataatttatttcaagtatctgttaaaattatttgcttactttttaggacttaattgttttcttatttttttattttactttatttttaagacagggtctcgctctgtcacccaggctagagtacagtggtgcgatcacagctcactgcagtcacaactgcctgggctcaagtgatcctcccaccttagcctcccgagtagctgggattacaggtgcccaccaccatacccggctatttaaaaaatgtttcttgtacagatggagttttgctatattgcccaggctggtctcaaagtcctgggctcaaatgatccaccagccttggccccccaaaatcctgggattacaggcatgagccactgcctggttttcctgtttttaagagttctttataagtttggatgtgaatcctttgtcagatatatgctttgcaaatattttctcctggttatggtttgcattttcattttctgaacatttcagagagaagtttttcattttgttatgaagtccaatttggtaatttttttccctattatgggtaatgctttgcttaactcaaggtcacaaaggttttatgttttcttcttgatttccctttgcatcttcatgttagatattttgagtaaatatttttctaaatcatttaaataatttccaaaaaataatatagtagttttataatcagaaagttgcttttgtattttgggagttatcattactgagcctgttagttttgaaaatttataatgttaattatataattacaaatttcacagttcagtagattctttggtataataatctagttacttagtagatattgaacacttaagggtataattgaaggtgatgatacttaaacaacttctagaatttcccttgctttaagcttgtgtctactattaatatatacggtagttgatgatagtgtcaatgatctgtattttcatattttaattcttttgactgtgtcccaaatcttatgtctcactttattgaattatagctgctctgttcacaagcagttttaattttattttattttttgtttttatttttattatactttaagttctagggtacatgtgcacaacgtgcaggtttgttatatatgtatacatgtgccatgttggtgtgctgcacccattaactcgtcatttaccttaggtatatctcctaatgctatccctctcccctcccccaaccccacaacaggccccggtgtgtgatgttccccttcctgtgtccatgtgttttcattgttcagttcccacctatgagtgagaacatgtggtgtttggtttttgtccctgcgatagtttgctgagaatgatggtttccagcttcatccatgtccctacaaaggacatgaactcatccttttttatggctgcatagtattccctggtgtatatgtgccacattttcttaatccagtctatcattgatggacatttgggttggttccaagtctttgctattgtgaatagtgccgcaataaacatacatgtgcatgtgtctttatagcagcatgacttataatcctttgggtatacacccagtaatgggatggctgggtcaaatggtatttctagttctagatccctgaggaatcgccacactgtcttccacaatggttgaaccagtttactctcccaccaacagtgtaaaagtgttcctgtttctccacatcctctccagcacctgttgtttcctgactttttaatgatcgccattctaactggtgtgagatggtatctcattgtagttttgatttacatttctctgatggccagtgatgatgagcattttttcatgtgtctgttggctgcataaatgtcttttgagaagtgtctgtccatatcctttgcccactttttgatggggttgtttttttcttgtaaatttgtttgagttctttgtagattctggatattagccctttgtcagatgagtagattgcaaaatttttctcccattctgtaggttgcctgttcactctgatggtagtttcttttgctatgcagaagctcttcagtttaattagctcccatttgtcaattttgtcttttgttgccattgcttttggtgtttcagacatgaagtccttgcccatgcctatgtcctgaatggtattgccttggttttcttctagggtttttatggttttaggtctaacatttaagtctttaatccatcttgaattaatttttgtataaggtgtaaggaagggatccagtttcagctttctacatatggctagccagttttcccagcaccatttgttaaatagggaatcctttccccatttcttgtttttgtcaggtttgtcaaagatcagatggttgttgatgtgtggtattatttctgagggctctgttctgttccattggtctatatctctgttttggtaccagtaccatgctgttttggttcctgtagccttgtagtatagtttgaagtcaggtagcgtgatgcctccagctttgttctttttccttaggattgtcttggcaatgtgggctcttttttggttccatattaactttaaagtagttttttcccattctgtgaagaaagtcagtggtagcttgatggggatggcattaaatctataaattaccttgggcagtatgaccattttcacgatattgattcttcctatccatgagcatggaatgttcttccatttgtttgtgtcctcttttatttcattgagcagtggtttgtagttctccttgaagaggtctttcacatcccgtgtaagttggattcctaggtattttattctctttgaagcaattgtgaatgggagttcactcatgatttggctctctgtttgttattggtgtataggaatgcttgtgatttttgcacattgattttgtatcctgagactttgctgaagttgcttatcagcttaaggagattttgggctgagacaatggggttttctagatatacaatcatgtcatctgcaaacagggacaatttgacttcctcttttcctaactgaataccctttatttctttctcctgcctgattgctctggccagaacttccaacactatgttgaataggagtggtgagagagggcatccctgtcttgtgccagttttcaaagtgaatgcttccagtttttgcccattcagtatgatattggctgtgggtttgtcataaatagctcttattattttgagatatgtaccgtcaatacctaatttattgagagtttttagcatgaagggctgtcgaattttggtaaaggccttttctgcatctattgagataatcatgtggtttttgtctttggttctgtttatatgctggattacgtttattggtttgcgtatgttgaaccagcctaagcaaagcagttttatctttcacaaagtcattcacatttatgataagtaatagaacatgggaagtacatctggatattgggatttgcatttttgtcaggagtccttcttaaataattatataagagttcttatagttaacacggtaaggaagaaaacagtggattttactgttaactgaggggtgttagatttttatagtctcaggccatatctcattatcaaaaccaaaagcataagtgggaagtaagttggtgctttgtatgcttcccttggttgtgaaaattagcatcagtaatgataggtaataccttttgcctagattaagccaatgaagtttctcaatttctgcacccctgagttccttctcttgggtgcagcttcagttggttctgctaccaccaagacctcctctggcctctgtggttctaaaataattctgatttagtctttccatttcccctcagctgaaatatgacagttaatgtgtttgagaatgattgatgttcatatgtgtggcattttgcctttgaaatggaaatttaaaaatcactgaaattctagtttgatttgcaatctgacaggtttttttgtcttttcttaggtatggtgtggtggactttctttgagtactgggatgcaggttccaagtgctgtgagaacacttcagaaaagtgaaaatggaatgactggttcagctagcagcctgaacaatgttgttactcaatagtgtctactcagaatacgtttaccctccgtcttgattaggtggccttttctgtgcagttactaatcacaggaatttggtagtagtgaaaatcaggtttgctgtgttctgctttgaggcctggaatcttttatcattaaacacctagtacgaagcatttgcaggaacctactgtgcagtatcatagaagcaagcagataccaagcaaaaaactgatgattgaagagtaaatgggggaaaaggcagtgtttaattaacataaaaactcatttttgtatttcttggattactttgactattctaatgtttaattacatatggtaaccctaaggcctggggagaaaagcttttaaatcttgccttctttcttctgtactttgtctttttaaaatctcattactatctattatttagttctaacacagaagctttaaaaatacatagtcatccaaggttttctaaaaattgaaatcatatgttgggaatggtaaaaaggttttcaaatggtttatttttcctcttttataaataagttttacaaaattttcctcttttgtttattgactagattgtatataattttcttttttccaaaatattgtgataagaaatttctagacacaacagcttaaaatcacccaaatttcagttctttacctactgcactaacaatggcaaggggggtattctttatatgttgccttgtttaactacagttcttttcattccatcactttaggtgatgggtaagatttttgaaagccttatattttttgattttgttgtctagtttaatcctacctttaatagttgtgtttggtaaaattcccacttgaatgtgacactgataataattatgctgatttttagcatctcttataggaatcaaagtttattaaagttacatagaggattgaaaaatgtatatcactcaatttttatctaagaaggataggttataaagggaggtacctaaatactcaaataatgtatatattctttttcataacatatggaatgctttaagcaattgttttgaaaaaaatctgcgtatctttgacttaattggcacatgactttttcaagcagccattcattcagaggtttgttttctctcagtccttttgctacattcactttcttttcaaagaaatgttaattattacaaaaattgacatagatatctttcccaaacttggggtaaaacccatggttatgtggaacataactgttcttaaaaagtcaattataatttgtaactcacatcctttgagctaaactaaattaaaattacagtatttaataattctttgggcatttttaagaggtctgaatttgtatttttcttcatttttgaaactttacatttgttgactttttttcattctcatttaaaatatattgtgctatgataaccaaccttcttccaaggagtgaccattactgcctacatttgcgttgctttctacatagagacttgtataatagtattaatagtagctcattctctctaaaaatttactgcccactgataggatgttttgtttccttgataaaacaaatgtaaatgaggaattttatttgaattggaatattgtttttctagaggacattcatatctgcactattatctgatgacatgttggtaattttaaagactgcaaggcagtttagagaatgaagtaaaccaatagatactcttttgattctccaaagaaatataattttggtttttgttcctcagagagagtttgaaagaaattttcagatgttctgttccctatagagggcctattccaggatctaaatgaatgggaatttataattcctttcatagactcaaacctgaaagcagaaatttttagtagttgagttgctttaagtgaattttaacaaatatgacacagaaaaggtcagatgctgttgtataaaattttttactagtgtgtcttatataattctttcttctcattaattcagtgcctttttcctctaagcatactcttggtccatgccccatgcagtgtcaactgatgtttaagctacagagcattgttgtagtggtgagggccctctgttgcaggggcatggggaaatgcatatattaatcaggggctggaggagtatacatgattcttgtgttcatgttgtcatttgaaactcttcacataaaattttctaatattcatttggaaaacctctccactggagaggtttcatctctgagaggttttgtaataatagtgtaagttcagtaaatccagtccaaattctcatcacatgtattatttgatactaaattttcaattattacttcaaaataagagtctgaggatttcttcttactggcgttcttaaaggtctctaaaattaaagaacaagatgtggttttttgtttaagacgtttttagtttatttgttgttaagttaaactggagaaagtttgtcatcctcattttcaaactgaaaactaatcaaatatagtgcctatttagtctcaaaataaggtaactattaacttgattatactatataatattctcaattacatttgaatttaaaaatattgagctcttgattacaatttaatacattgtaaaaagtattaaatcctttgaaacatcttttgttgcttatttagtttttgtttctacaggtcaaacatgattgctttctataaaagaaatgcttgagaggttgactataatggatatgtcacaggtataaaacagttgttttctaaaaacatgcatttagtatggcattctcttttagcaactgaattcccaacgagttttattaagctggatatcgaaatgaaggagctgccttaagcactttagaaaaagaatttttttacaattcattttgactctcatggctgaccatgtcattatgtctttaaattttggtaaatatgtagataccaagcattaataactaatgcacacagaaatttaatatacagcaattctttgaatgttccaggtgtacgtaaactaactgaaagtattaaggacatgcctgtctatacatgggtttcattgatggtatctgtatcatcttgacaaatcgtgaactgctgctgtatggctagactttgcctatttactctgttatgcaaacagtaatttttccctatgttatgaagagagacatattggcttgctttaatttacttatttatgaaattaaagcatgaataatatgtataatttgaattttttgtgactgatccttggcagtataaatgataaaagtaaatgtaatggaatcttttaattaggctaagatatgctatttcataacttatgtagaatgatttttatctatatactttgtccataaaattataattgtttatgtaattttattgtttcttatggaaacaattggaaaagtatatggaaaatgattatttcaaagaatatttatttaaagagggaagtgtagacttcttactgtaaaatatgtgattccaggcttaagaaattgattatattttaaaataattatttttttaaaaacgtaatttgtttttaaaagatgagtctccattcattggctaatccatacagcaaatatttgagtgtttgtgatatggcagtaaaaatgtgattactttgtatgtacattaaccaaaaccagtgaagtttgatggactgtgcatagagttttgcagcttttgagtagtgtgacagagtttgcctcttaaaattgttttgctaataagtcagaagtttaaaatgtgttatagtttgctaaaaaaaaatcaaattaactgcatataaaatggttcacttttatatagtcacatgtaatgggcctgaaaaagtttcttctttgattatgtagttactctagatacattcttttagggaagtgtatggtcaacatatatttactcagtatacagataaccacaaagttgttatttttaaccaaaatatacatttcataatgttggcactggagtattataagagatcatgaatgtttccttaattatcatggcaagattacctcacgttcagtatagtttagttttgtgtgtatcttacagtatgcatgttctgaaattatttgtgatcctgatatgtcacatataatagctttgttacctggagtatttgattaacctaaacagtttaagcattttgaattagttggagtttaaatggattacatttggtgtatattgtcttcattgaaaagatattgttggatatgccacatcagagttagcattgacttataaataaataccagaatttaccagagtacacttttctcttcagatgactcaattattaaataaaagaatatttcttatttctgggtcaatataaggtactgacttctgatgcataatcacttaagctatgtgagtttaaactggtatcttttcttagtggtacccattcaatgtaagctggtccatgggaatggacatgaagaggatttcacagtatgtagagcagaaggcacgtgaatgtgtttgctttggcttggagcttattaagttttgactacggttaaaataagtcaaatagtaagtggtaaaacacatttttgttagtattggaactttctggagaacataagggctatgagaatgcatatatatattttttaacatttcctatatatctaaggtaccaaagcactgagtctaatttacctattaagggagactctttaaaatcaactttataactaattcatactataagacagataatagctaaagttttggaataatttatattaaaagccgcaagtcttaaaaatccctggatatgacataaaaaggattttggcttcttttttgaagtatttaaaattaatcaccttagctctaccatatactagatctgtgaccgctacacaaattgtttatcatctttgggtctctattgccttctttataaaataagtgtaagttgttcagcctgcctcacagggctgttgtgaggaaataaaatgaaatggagtatgtgaaattgcttcagcaacagcaaagtgctacgtaaatgtaaagtgttgtttttagctaataatggatttaagtgtttggataattgtagatgcatttactttgataaagcgtgtgcttaaagtggtatcaccagtgatttctaacatgattttaaaaaaataaaaccccaattaaaatgttctttaatattcatttaatttgtgcatgacttgtggcctttttgtattttctcaagcctattactctagagctgtaaaagctcttgcacagcattgttgtgtcagtgtagaatagtggcataaataaatgaattaagctacatttccatgcaggcatttgcactttgaagttagggctgcccagtgccacatgcaaagagtgtatttggtctaaacagttctttccaaacaaccaaatggctgggcagcttgttgtcacggataaatgatataaaatgtaaccactgaacatttgacaactttgttgcattatcatttttaaaaaaagatgaagcatttcaaaatcttgttaacctggttatctcttggtatctctcctgacatatttgttttgctttaaattggattaaatggtttacaggttatctgaatctacagatttagtatgtctattatctggacatgattttgctatgcagttgtgataataaaaattctaattcctcaggtttggccttttaagttatggctgaagacctttaatgatacttatgatgcactcagtgccatacaatagtgttttaagaagcacatggcctcattttccttagaaacaagacaaagcctttttaaaatgtttttttttcactttaaaatagggtattcaaagtggagtaacgtgtattttgaaatgattttgtgttctatatagaatgtcccagttaagattttacagaagcacctggaatatctcattaaaaatttaaaaactcttttcctgctctcttttgcttcattgtttgattttattaacttttatttaagtataaatacaatatgctgttggggatgagaatataaaaaaagtcatagttcctttgcctaaaaagcttaacattttagagcactactgttcaacagaattttatgcaattatgaaaagttatttgtgcagtccaatacagtagtgactggccataggcagctactgagcactttatatgtggctacatagagttgcatattgctaatagccactgttttgaacagtgtacctacagatggaaaatgaaacatgctatgttagtaactataatattacttatgaatttggtttctttggatcttgctacatgttgggttacattttggtagatggtaactaagagtcagaatcagaacctaaacatttttaaaattcttgctctaacttgaaaacagtttaaaagaaaaaaaatcagtgagactggagcgcctgtaactaagaagttatgtaagaagaatgaaaggagactggatagtcttgagtcacaggaagaagaatggacaaagattgataaaccactatagaagatggagagtgaatgggtgcagcatttctggagaacaattttagcaatattaagatttttaaatgcacatgctccttaatttcctttataagtatttctcttacatatatactcacaaaaaagccaatgttccttgcagcattaccatagctaatagtagcaacctaattattaattgaagacctacaaatttggatggacttggaggtaaattccttttccttttttggtagcaaggcacagaactggttcaaaaggcccaagttgcctcaacaaaagaatgtgataacagaattttgaaggctccccttttctaacttgctgcaccagcaaactaccatataagtagtggtctagatattatatattctgcacattcccctccccaataaatgttatatagaccattatgacaattggcttaattagagccttttccttggtataccagttcatttgtgcctggctgggagttctgtggcataagagctcaggatattatgtgcactctacttttctactaaaccccattttacacttacactgcatggtgtatttgtatttatttatttttgcacaaggtcagcacaagagcagatggttagattttggtatttccatgtgatcctacacagctgttaaaggatatgctgttaatggaagtgtattcatgatattaaacaaaaaagtcatccagcaatatatacagtacgatacaacgggtgtgtgcatgcatgtatacttgggtaagaggggaccctgacctgatcaccacacagtcttgctgtgcttctcttcatgggatgaaaaattgaggagccaagggattatgcctacttggaatgcatgtttcattacccacttatatactatattattgaaacagtctttcgttgtctgagataacacctggagttcttgtccacttatatactacattattgaaacagtctttcgttgtctgagataacacctggagttcttgtcccacctccaagacgattatggagcacggacacaaaggtgaggttagagtgaaagtttaataaggtgaaagaagaaagctctctgccagcagagagggggtcccgaacgggagtgcccatcatgaggctggggtccaggtttttatggacggaaggggaaggaatgtgcttagtctgggggctgtcttggcgaatgcgtgactcggcttggcccgggaccagtcaggaggtgaaatgattcatagatgctgcttagcttggcccaggacctatcagaagctgaagtgaagtgtggccgaggaccaatcgggctgaggtgatgatacacagcagctggacttacagtcctaacaaaggaaagtagagcgcccataggaacttaccagagcccactgtgcccatgcctacaaaaggggaataaacttttcctgggaacctgctgacaatacaaaggaccaaggcatttctatgccaggccttgttcccttatctgagtgagctggaggtttgtgcaagtttttatccaaatgggccgtaggtttttccatctgtgcagtcatgggcatgtctccaggcacaacaccctgtgctagttcccttattggtgcctgcagcttttttcccaggctgctttttatattatctggggataaggcactgactcatgagccaggggctctccaggacccttctcttgttacctacctaaggtaagctaactaaccggatccccacactcttgctgtgcctctcttcatgggatgaaaaattgaggagccaagggactatgcctacttggaatccatgttcctttacccacagaattctatactatgttatcagccagaaccccaggattccttgcctcatcagcctgaagcttgcttccaggatatgtgcaggccttttgtccaaatccatcctgaaaaaagactactacagatgtatatacccctatggctggcagtttgtgggaagtacagatgaagcttggatgtgcagactgagttgtccacatgcatgcatgataggcccctgtggcaggcttaagctagaagtaaaaagagacccaggggatcagggaagggcaggccaacctagtatcactttctagtacacttctgaagaatctgcgaatcgcatatttgaacctagatttctgttccttgagaatacatgttaaagtagaagagtataacattttatttgttggttaacgctcagctatttagacactgaaaatatgtcagggttggctttcatttgtattcttggcccagaccctacaaatgttaggagtcggccaggatccttacatgtgtgcacagctgagtggtttatagaacatgaatatttacttgtaagagaggctgtttttatgcatccttgtacccactctttcagctgtatttgctatccagattaaagcatactgacttgacgtttgccatgagctgagggctcacatttgacctttcagtatgcttgataagtaacactgccaccagtttagttgtatatttaccttcagttatgtttgttcccaaacctgcttatgtaggtggtagtcactgttgtagtcatgtaagtatgtaaaccaattatataaatatataaaccaaaataaatatgaaatgagtatgaaaaggtacttataagaaaagtacgagaaccattagagatgaagagtttaaaaagttgcaaagttagttgtggccaaagtaattgtgagtgataggggaagatttttaaaaataaattccaggactccaaatttatattccttcacttgtatctttaagttcctggtccattttacagaaacagaaactacaaatgatggatgatgcattatgtctatggttttgtaagaaaaacagtgagatactctaatcagctggtccatgcttaaaatgaacttagttcaaaacagaagattggccattgtaaccctctactgaaactgcctttttgagaaggtttattcagaactagatttgttatacacttggaaagtatttatttctaagaacctgataatttttcccttttcctgttacttttaattataatttccaaatatacagaaaagtagaaagccagtgctttgtgctcatcacctaatcaattgttaacattttgccatgtttgtgctatctattttgttttaaaatgtcacctgtaagtatgctatatgcatccatgatggcttttaaaaacagccacattctgttaacattcttagcaaaattaacagtaattctgtactattatctaatggatcagtccatactaaaatttcagttgtctcagaagtatctttttacagttatcttgttcaaatcaagatctagacagggtccacacattgtactccgttacatctcttaaatatttgattttacaatagttccctctgcttttaaatgccatttatgaaaaaaactgaggaatttgtctggtagaatgtcccgttttctgaatttagttgcttctctatatcctgtattagatctagagtttgagtaaatgcaggttcaatttttaggcaagaatccttcacaggtgtggctgtgtactttctatcacatcaggaagtacataatatatgcttgtcccaaatttagtgagattaagatcagtgggtttaggtgatgccagtctattataaagttccccatcaacctttcaccttaattttatcatctattgatgttgccctttcgattattttattaggagttacaaaatcgtgattgttttatcatcctccatttattagctggaactcttataagtactttggttacactaaaattcaattcatacaagaaaggcaggataaatgcttgatgttttcccttatcaagttttagaatatttaatcttcaacttggcaatcttcaatcacgactgaattttattttttaaggagtcattataaactcaagaatttttatatttgatgtgtttcaatcaatagcaagtatgtgatgctcaagttttcccatgtcccatcacgttagcacctgtgttaatgatgccattaagctttgataacttacttcctcttggtgtaaccttccacttttttttattaacctactgagtacctacccgttctgagtgcattggatgagaggacttcaacagtaagcttgtatgtgcataggaaatttctggaaggaaaaacaaaaagttggtaaatgtcataacctgtaggaagtgaggaagattttttcttccttttctttctgtactgatagaattaaaaacaaagcttagaaaacaaatatatgatgggagtattttccgttttgtagaaataaattataattacagtaactggtttagtgaattatggttttcaaaaatttataagaagattaatatctgagccttaacaaccaccttttggattacaccgttaaaagaaccaaagtgagaggatcgcttgaggccaagagttcgagaccagcctgggcaagatggtgaggacgccctcccccccacccccgccacaccccgccctgctagcccccaacgtctctacaaaaaaagaaaagaaaaaagttaatcaggtacaaaattgtatccagccttaaactggagggcaacaggtcgctaaatcttgaatgtcataaaggcacctcaacttcatgaggaatagtgaacgcagctgctattttccactctatcccctagctctactaattgtatccaaaccaaacttcagggagttatgctgaatccctctagcaaagcacacgcactaaaaaaaccactcgtttatcagaagttcacatttaacgggcttggaaaacggctcagctgctgcctccagttcatcttccgctgtcgaaagcgtttcagaacttaaactctcagattgcctcagtgcgctgctgtagttgtcaattaggcaagagataaaaaagggctttggctaagtggctagattataaaagcgaggaatcgccagggctcagtgaacttctggcggtgaggatgcgacaagagtcacaggaaagccgaggctggggctggaccgtgggaacgtcccagcaggaaccaagccagcctccgccgctcagcacttgacggcggcttttgcggcggttgctgtgagtgccgtaaagcggagcggctgcagcctgctgttgagtgaggtaaggtacgggaggctcaggtcggtacccggggatgggtgggcgccttcagacaggtaccgctggcgactcgggtgcccttaccgggcatcctccagcattctgggcacctgcctaccccttggtgaggaggccggccacaggctgagcgcgctccgggctgggtactcctcagtcagtccacgagcatcgcgtggtagacttccacttggccagtccttcccgcacttctgggcgtgtcatcaggtgaaatcttaatcctgggacagatgaaaggttggaggacgatcgagactcttgtagtagccgggttagggtagtgacccctgacctcaggttatccgcccgcgttggcctctcaaagtgctgagattacagccgtgagccaccgcgcccggcctgaaatttacaatttctcatttaacatgaggtaagccacatttctcttggcttcagttttgtcagatgtggaaaaaaaaaaaaaaggacctagatgatatatcagattctttatgcttttgaagatagcacgtttccagtcggtaaaaatcaagctgtgaacaaatgacaaagtgaatgatagagcagtatattagaaattgggcagatggaagcccagtagaaaaggctgtgtttgagctagactctgaggataaatagggtttgaacgattggaaaccatctctgttgggccatggacaaagatatcaaatgcaggaataagcatttatattttagcgattctatttgtggacataagtttagtgagggtagaggatttgggaaggctggcattgaacggtgaaagaactcttagtggaaaggaagtgcagggtgttctgacaaggaagaagaaaggaaccggggaaatgccgaaagaacaatacgcaggacttgatttcttggatctgggtgatgatatttttaacctgcgtttctaaaaagtaagtttaagtgctgttggcaaaaatgggaattctgttgaattccagcatgcaatagtgtactgggaataaagtgatttagatcgtagagtgctgaggttgccaataactagcctcttggctgtcatttaattcttctagagcctattctccataaggtgatgttgggccagctgatctctcttctctaaagcctgtaaaactagagactgtgaggatggagagctagttactttcttctggactgggagaggacgatagttgacagagaataaaattgttaattttggggctggacgcggtggctcacgcctgtaatcccagcactttgggaggctgaggcgggtggatcacctgaggccaaggagttcgaaaccagcctggccaacatggtgaaaccctatctctactaaaaatacaacaaattagccgggtgtggtggcgggcgcctgtaatcccagctactcctgaggctgaggcaggagaatcgcttgaacttgggaggcagaggttgcagtgagccaagatcaggccactgcactccggcctgggcaacaagagcgaaactctgtctcaaaaaaaaaaaaaagttaattttgaacatgttaaatttgaggtgaggtgcaggaaatagagttgaaaatataggcagatagagtgcatggactgtaatttaaatagtgttttctctcacaggtggtagttaaaatcttgagaatggatttggtttcagggagagattgtagagagagtaactataggccatacccacagagaggaggttggagaaattattgaaggaggcatgtggatctcagagctaagagcaaggaaggagttctttttaaaaaagttacatatagttgtagattctcaggggcccagtgttgttattaagctaatttaacagcatttacagcaaataataagcacctacttctgggaattctggcagaaaataaataattcaaatagatataatctccactgcctaattgtctacccagaagtggtatcatttacatatttatttattcaacaaatatttatatgtttcaagcactgctggttctagggatataacgacgagcaaggtagacattgttcttatcctccctgcatgtaaagcccttagcatctacatcagtgcttttcaaattttaatgtacatatgaatcatctgaggattttattaaaatgtagattatgaatcagtaggtgggggctgaaaattctgtattactaacaagctccaatgtgatactgatgttcttaggaccatacttttaagtgacaagaatctagatcctgtttagcaaatatggccgttattaagccactaccactacccatcatctgtttctcctaggataaaataattttacttcttatgaaaataatatatgcttatacaaatattggaacaatatagaaaagtgtaaagaaccatgtaaaaatcactcctaattctccctacccagagataaccattattaatatttttgggaacattcatccagattttacatatgtacatacattcacaatttaagtgttgcactaagtacatgtcacactctaagccctgtgtttgattctatttgctgtatgattttattaagataaatacccaagtgtccagaaccaagcaattaagtacttgcattcttgagggagccacttaaaaataatttgggggccaggcacggtggctcacgtctgtaatctcagcactttgggaggccaaggtggatggatcacgaggtcaagagatcaagaccatcctggccagcctgatgaaaccctgtctctactgaaaatacaaaaattagctaggcttggtggcacatgcctgtagtcccagctactcgggaggctgaggtaggagaatcacttgaacctgggagcggaggttgcagtgagctgagattgtgccactgcactccagcctggcaacagagcaagaatccgtctcaaaaaacaaaaaaaaaaacaaaacaaaaaacaaactttgggagccggacagtgtctcatgcctataatcattccaggtgcccaagaggctgaggtgggaggattgcttgtgcctagcagtttgaggcagcagtgagctatgattgtgacactgcactccagcctgggtgacagagcaagactccatttcttaaaaaaataaaaacttgtgttacttcaaaaatggggagacattaacataattacatgtgggctctagtaaatgaatatttgtcatttcatttaggatgagaggagaatttttaaagttttaaaaaaaacttagtttttttcttactacaaaatcaattgatgttcacgtaagataaataaggaaaaaaaataaaagcacctacactcctcccaacccaaagacaatccttgctgtcttcaccttccttcctgctaacctgtcttatctatatctttcatttcagccactatctttccaaaaccctcttacaccatagtcattcagaaaggagtaactatgtatttatgatttttctggagcatctactggagaaactaaatttcattagctttttatcttcaagtaacagcatgtgtaggtagaagttatattgcaaaggattaagtgcatgaatggtaagcaggtaaagaaacttcttaaccctttgcagtctaatgtttacttccaagctgctgacagttgtgaaaagttagcagtcaaaggaaaagaaatggacaataagaaagaccaacagtatttagggaagatttgatagtagctgttgctactgggatatttttggcttttgagaacagctgaaaaatgtcgatttttttttttttttggtctgacctctgaattcattttcagacgcattttctctttatgcctgccaatctgctacatcatctctctaactataccttttcctaattacactactctctttcctctgtagttcagcctcctgttttattttgttcagagcatatttgaatgtcagttctgttttaatgaattgcctgaaggattcttcctgtgcgctgcacaaacgaaaccagttcactgagactgtgctactgcagtaaagaaacagcttacttaacaatgatgctggctgtgcaaaggagttattactcaaatcagtctcgccaaagacttggtggttagtttttcaaggatagtttttagtttggtggcaggggactagggaatgagggctgctggttggctggggatgtgatgataagggtgtgaaaaatggtccttgtgtgctgagtccacctctgggtggggagccacgtgactggttgggtcatgagtcactagttcacctctaggtagtgtcagttggtccagaatgcaaaggtctgaaaaatatctcaaaagaccaatcttaggttctgtagccagggaaaatataaatcctgtgtcctctggaaaaaagactggttatcatttaactacatgttaccagaattcaggtccctctcataatcctaatcttgtagtctttcattacctttataaaggcagtttagttttggaaaaggttactatcatccttgctttaggttaaactgtaaactaaattcctttcaaagttagcttggcctgcacccagaaatgaccaaggacagattggaggtcagaaacaagatggaatcaactatgagatttctcttagctgtcataattttgcaaaggcagtttcactctctgattcatactatctatgcctcactcttactccccaatatccccaaataagtcggggatcccacagcataaggatatggctaggctctcacatatcatcttatgaacctaagttaggtgtcagggaaggtttttgattccacttccccccactcctgccttctggatcatctctcttgatatatcattcattcattcattcattcaaacagacccctacctaggtgattctcaaaagagtggggtctggggctggaggaggtgtcagggtaaaccagttaccaaaagtctttcatactaataccttcaaaggacaaatgcaaatgtaaaaaggaagctgaaagaatatgcagtggggttccaagatggccgaataggaacagctccagtctacagctcccagcgtgagcgacgcagaagacgggtgatttctgcatttctaactgagatactgagttcatctcactggggattatcggacagtgggtgcaggacagtgggtgcagcgcaccgagcgtgagccgaagcagggcaaggcatcacctcacccgggaagtgcaaggggtcagggaattccctttcctagccaagggaaggggggacaaatggcacctggaaaatcgggtcactcccaccctaatactgtgcttttccgacagtcttagcaaacagcacaccaggagattatatcccacgcctggctcggagggtcctatgcccacggagcctcactcatttgtagcacagcagtctgagattgaactgcaacgtggcagcgaggctgggggggggggcacccgccattgctgaggcttgagtagataaacagaggggccgggaagctcgaactgggtggagcccaccacagctcaaggaggcctgcctgcctctgtagacttcacctctgggggcagggcatagccaaacaaaaggcagcagaaacctctgcagacttaaatgttcctgtctgacagcttggaagagagtagtggttctcccagcatggagcttgagatctgagaacggacagactgcctcctcaagtgggtccctgaccctcaagtagcctaactgggaggcaccccacagtaggggcagactgacacctcacacagccgggtacccctctgagacgaaacttccagaggaacgatcaggcagcaacatttgctgttcagcaatattcgctgttctgcagcctctgctgatacccaggcaaacaggatctggagtggacctccagcaaactccaacagacctgcatctgagggtcctgactgttagaaggaaaactaacaaacagaaaggacatccacatcaaaacccatttgtacatcaacatcatcaaagaccaaaagtagataaaaccacaaagatggggaaaaaacagagcagaaaaactgaaaattctaaaaatcagagcacctctcctcctccaaaggaacgcagctcctcaccagcaatggaacaaagctggatggagaatgacttcgacaagttgagagaagaaggcttcagacgatcaaacttctccgagctaaaggaggaagttcaaacccaacacaaagaagttaaaaaccttgaaaaaagattagacgaatggctaactagaataaccaatgcagagaagtccttaaaggacctgatggagctgaaaaccatagcacgagaactacatgaagaatgcacaagcttcagtagccgatttgatcaactggaagaaagggtatcagtgatggaagatcaaatgaatgaaatgaagccagaagagaagtttagagaaaaaagaataaaccgaaatgaacaaagcctccaagaaatatgggactatgtgaaaagaccaaatctgcgtccgattggtgtacctgaaagtgacagggagaatggaaccaagttggaaagtactttgcaggatattatccaggagaacttccccaacctagcaaggcaggccaacattcaaattcaggaagtacagagaatgccacaaagatactcctcgagaagagcaactccaaaacacgtaattgtcagattcaccaaagttgaaatgaaggaaaaaatgttaagggcagccagagagaaaggtcgggttacccacaaagggaagcccatcagactaacagctgatctctcggcaggaactctacaagccagaagagagtgtgggccaatattcaacattcttaaagaaaagaatcttcaacccagaatttcatatccagccaaactaagcttcataagtgaaggagaaataaaatcctttacagacaagcaaatgctgagagattttgtcaccaccaggcctgccctaaaagagctcctgaagggagcactaaacatggaaaggaacagccgataccagcctctgcaaaaacatgccagattctaaagaccatggatgctaggcagaaactgcatcaactaacgaggaaaatcagcagctaacatcataatgacaggatcaaattcacacataacaatgttaaccttaaatgtaaatgggctaaatgccccaagtaaaagacacagactggcaaattggataaagagtcaagacccaccagtgtgctgtattcaggaaacccatctcacatgcaaagacacacataggctcaaaataaagggatggaggaagatctaccaagcaaatggaaaacaaaaaaaggtaggggttgcaatcctagtctctgataaaacagactttaaaccaacaaagatcaaaagagacaaagaaggccattacataatggtaaagggatcaattcaacaagaagagctaactgtcttaaatatatatgcacccaatacaggagcacccagattcataaagcaagtcctgtgtgacctacaaagagacttagactcccatacaataataatgggagactttaacaccctactgtcaacattagacagatcaacgagacagaaagttaacaaggatatccaggaattgaactcaactctgcagcaagtggacctaatagacatctatagaactctccaccccaaatcaacagaatatacattcttctcagcaccacaccacacttactccaaagttgaccacatatatggaagtaaagcactcctcagcaaatgcaaaagaacagaaattataacaaactgtctctcagaccacagtgcaatcaaactagaactcaggattaagaaactcactcaaaaccgctcaaatacatggaaactgaacaacctgctcctgaatgactactgggtacataacaaaatgaaggcagaaataaagatgtgctttgaaaccaaggagaacaaagacacaacataccagaatctctgggacatgtttaaagcaatgtgtagagggaaatttatagcactaaatgcccacaagagaaagcaggaaagatctaaaattgacaccctaacatcacaattaaaagaactagagaagcaagagcaaacacattcaaaagctaacagaaggcaagaaataactaagatcagagcggaactgcaggagatacagacacaaaaaacccttcaaaaaatcaatgaattcaggagctggttttttgaaaaggtcaacaaaattgatagaccactagcaagactaataaagaagaaaagagagaagaatgaaatagacgcaataaaaaacgataaaggggatatcaccaccgatcccaccgaaatacaaactaccatcagagaataaacacctctacacaaataaactagaaaatctagaagaaatggataaattccttgacacacacactctcccaagactaaaccaggaagaagttgaatctctgaatagaccaataacaggctctgaaattgaggcaataattaatagcttaccaaccaaaaaaagtccaggaccagatggattcacagccgaattctaccagaggtacaaggaggagctggtaccattccttctgaaattattccaatcaacagaaaaagagggaatcctccctaactcattttatgaggccagcatcatcctgataccaaagcctggcagagacataacaaaaaaagagaattttagatcaatatccctgatgaacatcgatgcaaaaatcctcaataaaatactggcaaaccgagtccagaagcacatcaaaaagcttatccaccatgatcaagtgggcttcatccccaggatgcaaggctggttcaacatacataaatcagtaaatgtaatccaacatataaacagaaccaacaacaaaagccacataagattatctcaatagatgcagaaaaggcctttgacaaaattcaacaactcttcatgctaaaaagtctcaataaattaggtattgatgggacgtatctcaaaataataagagccgtttatgacaaacccacagccaatatcatactgaatgggcaaaaactggaagcattccctttgaaaactggcacaagacagggatgccctctctcaccactcctattcagcatggtgttggaggttctggccagggcaatcaggcaggagaaagaaataaaagatatttagttaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtgcaaaaatcacaagcattcttatacaccaaataacagagagccaaatcatgagtgaactcccattcacaattgcttcaaagagaataaaatacctaggaatccaacttacaagggatgtgaaggacctctttaaggagaagtacaaaccactgctcaacgaaataaaagaggacacaaacaaatggaagaacattctatgctcatggataggaagaatcgatatcttgaaaatggccatactgcccaaggtaatttatagattcagtgccatccccatcaagctaccaatgactttcttcacagaattggaaaaaactactttagagttcatatggaagcaaaaaagagcccgccttgccaagtcaatcctaagctaaaagaacaaagctggaggcatcacgctacctgacttcaaactatactacaaggctacagtaaccaaaacagcatggtactggtaccaaaacagagatatagaacaatggaacagaacggagccctcagaagtaataccacacatctacaactatctgatctttgacaaaactgataaaaacaagaaatggggaaaggattccctatttaacaaatggtgctgggaaaactggctagccatatgtagaaagctgaaactggatcccttccttacaccttatacaaaaattaattcaagatggattaaagacttaaatgttagacctaaaaccataaaaaccctagaagaaaaccaaggcaataccattcaggacataggcatgggcaaggacttcatgtctgaaacaccaaaagcaatggcaacaaaagacaaaattgacaaaagggagctaattaaactgaagagcttctgcatagcaaaagaaactaccatcagagtgaacaggcaacctacagaatgggagaaaatttttgcaatctactcatctgacaaagggctaatacccagaatctacaaagaactcaaacaaatttacaagaaaaaaacaaccccatcaacaagtgggcaaaggatatgaacagacacttctcaaaagaagacatttatgcagccaacagacacatgaaaaaatgctcatcatcactggccatcagagaaatgcaaatcaaaaccatgataagataccatctcacaccagttagaatggcgatcattaaaaagtcaggaaacaacaggtgctggagaggatgtggagaaataggaacacttttacactgttggtgggacagtaaactggttcaaccattgtggaagacagtgtggcgattcctctgggatctagaactagaaataccatttgacccagtgatcccattactgggtatatacccaaaggattataagtcatgctgctataaagacacatgcacatgtatgtttattgtggcactattcacaatagcaaagacctggaaccaacccagatgtccatcagtgatagaccggattaagaaaatgtggcacatatacaccatgaaatattatgcagccataaaaaaggatgagttcatgtcctttgtagggacatggatgaagctggaaaccatcattctcagcaaactatctcaaggacagaaaaccaaacatcgcatgttctcactcataggtgggaactgaacaatgagaacacttggtcacaggaagggggacatcacacaccggggcctgttgtgggatgggagcaagggggaggcgtagcattggtagatatacctaatgtaaatgatgagttaatgggtacagcacaccaacatggcacatgtatacatatgtaacaaacctgcatgttgtgcacatgtaccctagagcttaaaatataataataaaaaaaataagtaaataaaaaagaatatgcagtgctgctcttcactgtagaaagagcctgagaattatcttgaactccaaatcctgtaccttttttcatcacagttgtgtatgggttttatctactactagtttttttccaagccttttcacatcttgacacatagtaaatttgaccaagaaaagatgaaaggaaacataaaagaatgtgttcttggctggagatgacctactcttggggtctagctgccccaaagactgagaggattgttaactctgacacctataacccattcatgatttagttggtaagcagatctgcccatttctttcttcttcattgccagatctcagttcatgcactagttatgccctgcttccacttcatctaagaataattctgtgtcgcaatataccataattatatattaatcttctcatatttgcattagaactttaagattattgggctacttaaacttcgtaactcccctcgttacatcttttttttccctgaaaacatttgtcatttctctcccaaccactgcctcattttaatttactatctctgcaatactttttcttttcttttccattagagatgatatgctgtcttctttaggaaactttacctaagtgtaagtaaggaaatgaatgctatcctccctagtgtttttattatgatagctaaaatgtaacatataaaaagaagtgtatatagaaacaatatttttgttttagttctatgccatatctctctataggttattttttatatttttaaacgtttattttttgaaggttggaaccagatatgtgagtttaaggggctttaaactcttttaaaaatcttttttttttatatttcaaattctgttttattgtaaaagttcctgcagaacagaaaagttttatttaaatagttttctgttttcttgagcattgtgcagtgtatttttagtatacttagcatacttactattacttgatgttaattcagccaattttaggctggtggggaagatgattcatgtacactaacagttataatgcaaaatagaaactagtaaaagcctcaaggttagttgcctctccttgtgcttccatagtaacccgtgcttattccttcattgcaactatactgtattgttattgcctctatatttatctctgatagagtccatcataaactagaacagtggttcttaattgatgtgggggtggtaaggaatggggcttgcgcattttggaaaacatcttctcatattctttttcaggtacatcactctctccaccactatcactactgcccttcttcttttgaaaactcctgtactcacctttaagcccttcaaaattagggaagtgtatcttatttgtcattttatctctagtgcttagcatttttttttggcatctgtgcccattaaggtagacagtaactgtttatttgttgcaggaaggtaaaactaggttggaggtggagggagcacttctaacctggaagaatattgaagacttccttgaagaagtgtcatttgagaggagctatgaaaagaaagtaaactggttttatggaagtaaatgagaacattgcagacaagaggtaatgggcaaaaacacagaggcaggaaagtgtaggatgtattccaggaatactcatgcaaaaaccatagactatgtgaagtgtgagaaagcttatagtaaatttgcctgtattcagtcagattgtgaatacccctttataccattatatgtaatttgaactatttgtaggtggtagggaactattgaaaagttttgattgtggtgtaacttgatttatctgtcagcaacttgatacatctgtcagtgtataggtaagattgtggatacagagaaagtggagacagggacatcagttaaaattaggacattaggtacaattagagtttagaatgacagtgaagaaggaaggaattgatgcaagaggtattttaaaggtaaaatcaacatactatggcttctttttttcagtgtcacattattcatttttaagtggttactgaatattcctaatgaagcggtagtgctagtgaaaaggaacattttgataggcgaatctttctcttttgtgactgaattgccttggcatttatagaaaataaataatgaagttaattggatatcatcttgataataaaaatgtaattaagtttttgatattatggtttggaggtttattttataagaattagttgtaaactagagaagaaagaacaagatattaatttagattttatgcctgtagtagcttatataggcaggcctattatgtgttctttcccatttattaatttgggcttagaagaagctgagttatggcctactctgagtgccactttagatttcactaggaatcagcatagaatacattaatgcactgtttaatacaagtacaagaacttgagttgaaatcttgaaaatgaagggcagtctccttgttaatcttgtgagctgccctcatcagagtataggttgagcatcccaaatctgaaaattcaaaatctgaaatgctccaaaatctgcaacttttgcgtgctaatatgatgctgaaaggaatgttcattggagcatttcagaattttggattagggatgttcaactggtaagtgtaatccaaatattctggaatcctaagaagtccaaaatacttttggtcccaagcattttggataagggatactaaacctctatttgataattgtatttccatgggttttaactgaatacaaaaactaataccatcatcaatgttgattgatattgttttcacagttttgggagatacaaaataattatgatttattaggttatctttgcttaatatacattactgatcaggtgaattgttcacatcactattggtattatttctcttaagtagtttcttgagactgtatatatatatatatatatattttagtgtttgctttatatagtcatcagctctggcagctcatttggattgttttaaaaccccaaaccaagacttgattttaagatggtaaagacatttgtgccctattctatctgaaattaccatgaaacaacaaggaaactgagagaaagagatgtaattacatctttgctgagactagaagacctgtaactccaaactgaaatatttgagaaatggcagccacatgtaagcaggaagaggttaaaagagaatgctggtagaaagagatctcagatagagctggcagagcaaagagtcctcttctgtttgcagtgggatcaggatgcatagaaaggcaatgggaatttccttggattgtttggcaacatgaactagcaagaaaggaagagtgaatgaggaagtgcacagataccccatctttgcaggaagcactctcttgctgaggcaaagtagaggagagatagtgagtggccctttgctgcctgtctctgacatctggaagaagtaatgtttaaatgcttttcccacttgttctcatacacattctctgcctttctcacatatacacatgtacaaaatactctgtcagaaagagttttcttgtataccagagactaccctctagtctagaatacacccttatttctttcttccatagttaaggcgtaaattatattcccgtttagaaaagtagatgaggactgggtgccgtggctcatgcctgtaatcccagcactttgggaggctgaggcaggtgggttgcttgaggtgaggagttcgtgaccagcctgaccaccacagaaaaaccccgtctaaactaaatatacaaaaattagccgagtgtggtggcaggcacctgtaatcccagttactcgggaggctgagataggagaattgcttgaacccaggaggtgaaggttgcagtgaactgagatcgtgccactgcactccatccagcctgagtgacagagggagactctgtctcaaaaaaaaaaatgcttaattgtagttctgaaaatagagaattcaatgttataacagaaaaaatatttaagaaaaccttctgcaaagaaaagacatctttaggtcaggctcagtagtagctcacacctgtaattccagcactttgggaggctaaggcaggaggttctcttgaggctgggagtttaagaccagcttgggcaacatagcaagaccctgtctttacaaataaatttttaaaaaattagctgggcatggtggcacatacttttactcatggctactcaggaggctgagataggaagatcacttaagtgtgggagtttcgggttacaatgagctatgattgcaccattatacttcagcctggacgacaaagtgagaccctgtctcaaaaaaaaaaaaatctttattctacagattgaaaggaaacacactgaatgaggaaaaactaacatacggtcatcaacatccttgtataacctagtttttaaaaaaattggatttcaaaggtaaggaatgcattctttgctcatcccaataaaaagattaaattacctatcaggagttggtttgggaaatcagatattgtcaagggaatatttagcactacaggacaatggtacaaagtgtgtaagtcattggggaaagacagtgtaacctcaaagccaaattgacaactatttttgaacaaggcaaaagctcaaggtaagtggtacccctaagttctttttgataaactgcaagaagatgaatatcagtcatacagtagatgaacagagatgatatagcaaatggattggcagggaacattgtaggaataagaccaaaataactatgagatttgtagttatagaatacaatagaactgtaacatgtagaaataattaataaaagtcaagattgaaagaggagagaagacagaatgtagtataaatttgttggtttcttcttattttatagctggagaacaaaagacatataaaccttagatatcaagcataagagaggtgtcagtatatttgaaggattgaaggaataaatgtaagcatttgaagaactaaatgtgtttaaccaaaatcaaacagtggagacaaggtaggaagaagtagaactgtattaaatttcttatcctaaaggaataatcagagatgagacctaagatgaaagaacaaaatgtttattgtggcattctttacagttgaaaaaactgaaaacatacatggagtataaataaaaactgaccacatcctagatcacacacaaacttgaaaagcaacaaagagctgtcttacaggccatgttccttgactaaaaacggtctcagtttctcctttggaagtggttctcagcattgtcagcagcaccagcatcatttgggaacttgtcagaaatgaaaattctgaggtctcataccggatttactgaatcagaaactggaggagaaaagcacctctcaaccttgttggtcagtttttataaatatcctatttatgttttcagttatttacagttataaaaaaaagtgataataaacatttttgttttttcatcattggtctcatatttgattatttctttagcatagacaatgaccagatcaaagaatgcctgtggaaatttaattttttctttgttctattgttggttattacaggtacaaaattaaagaggtttttgtttctttaaaaatatcttttttgttcacagaaaacaaaattatcttcctttccaaatccaaaaagatgaaaacgactgagatactttcaaaagacaaccaagtgagcagcacagactaatgagtagaatcaataagaacgtggttttggcccttttaacgctgacaagttctgcatttctgctgtttcagttgtactactacaagcactatttatcaacaaaggtaattttattccttctttcttatcattcctcctttcttatcattgtatattttctgatcacacttctctttgcaatacataatattaatcatgggtattcaaattcttgcatctttgcgaggtgtggcaaacaattaaaaattcagttaaatatacttgtaatagcacactaaagacaggtgctaagtttcaaggatgtttaatctattggaatttcctgagctagttatttaaaaattattattttgttaaacagattatccttcatttaaatgaactcaatgataaataattttgataaaatgtcaaaattagtttattttagtacagcatatattttaatttagtacctactggggaagtataatggtatgacttacctttatctgtatgtataggaataaagtagagacaatgatgtggaaatcaatagcttctgaagattccgtagaatataccagataaggaattccaaagttgagatggtgttgttacattgtgaaaagttgccaaacactccctctggggtgtattataataattactaccatcactgataattgtactagatgctttccatgctcagtttagtcctaaaaacaatcatggggaagaaaaaaaattttttttgtttttatgtttttatcctcatgtcttaattagaactattcatcagaattaatcactttgcgcccctcctcaactagaatggagtatacttccctgccttttttatgttgggcttgaccagtagaatgttaacagacatgtgcagaagctttgaataggctgttgtgatttgacttagtttttatgctcccctgacctataggagaagagaaaaatgtatggagcagaccaaagcatagctgcccagctgactcacagatttgtgagggaggaaatagatgcttataagccataagactgggggaagtttattatgcagcattgttacatggagttattagacctaattttgacagataagaaaactgaaacttttcttttttttttttttttaattaatttattttttttattatactttaagttttagggtacatttgcacattgtgcaggttagttacatatgtatacatttgccgtgctggtgtgctgcacccactaactcgtcatctagcattaggtatatctcccaatgctatccctccccactcccaccaccccacaacagtccccagagtgtgatattccccttcctgtgtccatgtgatctcattgttcatttcccacctatgagtgagaatatgcggtgtttggttttttgttcttacgatagtttactgagaatgatgatttccaatttcatccatgtccctacaaaggacgtgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctgtttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatgtccttcgcccactttttgatggggtggtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttattttaattagatcccatttgtcaattttgtcttttgttgctattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccatttcttgtttttctcaggtttgtcaaagatcagatagttgtaggtatgcggcattatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggcgatgcgggctcttttttggttccctatgaactttaaagtagttttttcgaattctgtgaagaaagtcattggtagcttgatggggatggcattgaatctgtaaattaccttgggcagtatggccattttcacaatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattatgaataggagttcacttatgatttggctctctgtttgtgtgttgttggtgtataagaatgcttgtgatttttgcacattgattttgtatcttgagactttgctgaagttgcttatcagcttaaggagattttaggctgagacaatggggttttctagatatacaatcatgtcgtctgcaaacagggacagtttgacttcctcttttcctaattgaataccctttatttccttctcctgcctaattgccctggccagaacttccaacactatgttgaataggagtggtgagagaggacatccctgtcttgtgccagttttcaaagggaatgcttccagtttttgcccattcagtatgatattggctgtgggtttgtcatagatagctcttatcattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaagaatattggtctaaaattctctttttttgttgagtctctgcccggctttggtatcagaatgatgctggcctcataaaatgagttagggaggattccctctttttctattgattggaatagtttcagaaggaatggtaccagctcctccttgtacctctggtagaattcggctgtgaatccatctggtcctggactttttttggttggtaagctattaattattgcctcaatttcagagcctgttattggtctattcagagattcaacttcttcctggtttagtcttgggagagtgtatgtgtcaaggaatttatccatttcttctagattttctagtttatttgtgtagaggtgtttattctctgatggtagtttgtatttcagtgggatcggtggtgatatcccctttatcgttttttattgcgtctatttcattcttctctcttttcttctttattagtcttgctagtggtctatcaattttgttgaccttttcaaaaaaccagctcctggattcattgattttttgaatggttttttgtgtctgtatctcctgcagttctgctctgatcttagttatttcttgccttctgttagcttttgaatgtgtttgctcttgcttctctagttctcttaattgtgatgttagggtgtcaattttagatctttcctgctttctcttgtgggcatttagtgctataaatttccctctacacattgctttaaacatgtcccagagattctggtatgtcgtgtctttgttctcgttggtttcaaagaacatctttatttctgccttcatttcgttatgtacccagtagtcattcaggagcaggttgttcagtttccatgtagttgagcggctttgagtgagtttcttaatcctgagttctagtttgattgcactgtggtctgagagatagtttgttataatttgtgttcttttacatttgctgaggagagctttacttccaagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcacacaggacttgctttatgaatctgggtgctcctgtattgggtgcatatatatttaggctagttagctcttcttgttgaattgatccctttaccattatgtaatggccttctttgtctcttttgatctttgttggtttaaagtctgttttatcagaaactaggattgcaacccctgcctttttttgttttccatttgcttggtagatcttcctccatccttttattttgagcctatgtgtgtctctgcacgtgagatgggtttcctgaatacagcatactggtgggtcttgactctttatccaatttgccagtctgtgtcttttaattggagaatttagtccatttacatttaaagttaatattgttatgtgtgaatttgatcctgtcattatgatgttagctgctgattttcctcgttagttgacgcagtttcttcctagtctcgacggtctttacattttggcatgattttgcagcagctggtaccggttgttcctttccatgtttagtgcttccttcaggagctcttttagggcaggcctggtggtgacaaaatctctcagcatttgcttgtctgtaaagtatttaatttctccttcacttatgaagcttagtttggctggatatgaaattctgggttgaaaattcttttctttaagaatgttgaatattggcccccactctcttctggcttgtagggtttctgccaagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagtacttctctgtattggttattctagttatacattcttctcaatttttttcaaagtttttaacttctttgcctttggtttgaatgtcctcccgtagctcagagtaatttgatcgtctgaagccttcttctctcagctcgtcaaagtcattctccatccagctttgttccgttgctggtgaggaactgcgttcctttgtaggaggagaggcgctctgcgttttagagtttccagtttttctgttctgttttttccccatctttgtggttttatctacttttggtctttgatgatggtgatgtacagatgggttttcggtgtggatgtcctttctgtttgttagttttccttctaacagacaggaccctcagctgcaggtctgttggagtaccctgccttgtgaggtgtcagtgtgcccctgctgcggggtgcctcccagttaggctgctcgggggtcaggggtcagggacccacttgaggaggcagtctgccggttctcagatctccagctgcgtgctgggagaaccactgctctcttcaaagctgtcagacagggacattgaagtctgcagaggttactgctgtctttttgtttgtctgtgccctgcccccagaggtggagcctacagaggcaggcaggcctccttgaactgtggtgggctccatgcagttcgagcttcccggctgctttgtttacctaagcaagcctgggcaatggcgggcgcccctcccccagcctcgctgccgccttgcagtttgatctcagactgctgggctagcaatcagcgagattccgtgggcgtaggaccctccgagccaggtgtgggatatagtctcgtggtgcactgttttttaagccggtctgaaaagcgcaatattcgggtgggagtgacccgattttccaggtgtgtccgtcacccctttctttgactcagaaagggaactccctgacaccttgcgcttcccaggtgaggcaatgcctcgccctgcttcggctcgcgcacggtgcgcgcacccactagcctgcgcccactgtctggcactccctagtgagatgaacccggtacctcagatggaaatgcagaaatcacccgtcttctgcgtcgctcatgctgggagctgtagaccggagctgttcctattcggccatcttggctcctacccgaaacttttctttttttaagagaggatctcgcttcgtcacccaggctgaagtacagtggcataatcatagctcactgtaaccttgaatctggggctcaagcagtactcctgcctcaatctcctgagttgttaggaggactacaggcacatgccatcacgcctgactaattaaaaaaaattttttgtagagacggggtctcgctgtgttgcccaggctggtcttgaactcctggcctcaggcagttctgtcacctcaggctcccaaagtgctgggattacaagtatgggctactgcaactggcctggaaaaccaaaattgttaacagagatgtgaaataatttacccatacaaaccacccaatatctaatgtgtatagctgacctctaatgtccctagctccattttttccaggctatataattttaaaaataacagactatactgattctacttttgatcttggctgtttatccaatgaatgtctttctgtgacatcttcaaccctttcctcattattttcttaggataaagtcctagagtagaaattctagatctaatatgcacattttagatttttgttatatattacaaagttatccttcataaggataagcagtatacctgatttctcatatcttttcataaataggaataacaataataatggcatctgtttcagttagagatggctggctaatagtagcttaaacaaatagaggaattatctgtccatatctataagtctagagcctctaaaattctcttggtatttcctgtgttacagtcaaggctagaaggaataatagtgtgatctagcaggcttctagttttgtgacagtggccagcagattcccaaatataagagaatctggggaagtaaggttttactattgttatttagcttttctagcctctataatagagattgcaaaagagaaggggtttgggaatgggtgtcaggtcagcttacctatagtgcctgccatagcagctaacattttttgatgtgcttgattgagcaggccctatgcgaagcactttaccaacatttaattcttaaaacaagttgagtagatcttgttcttcctgtttttccagcaaaaacattgaggttttgagagacttactaattttcccaatatcacatagttattaagtgggggagatgaacctgaggagtctaccccaaaacctcattcattaatttttagtgttcgtaatattcagaaactgaaagctattcaactccattagaggtcgtttctttgattactagtggggttaaacatctttccatatgtatattggttctttttagttgtattcttacttcttcttatttgtgtctttcatatatgttcctgatgatgttgtctttttctgtagctgttctttatagtttgaagaatattaaaccttcatcatatatatttcaaatatttttcctgacttgtaatttgccttttaactttatattcatgatgtactccctcaataaattagtacttaatgtataaatagacagatgtcaaaatctgttttccttagggcatctgttttttatgttataagtagcccaagattatgggaatatttaactgtatttttgtctatttaatgtttaaattttttcactaaaatgaatttattttagtatgaggtatgaattagacatctaacttacatttttccacaatgattaaccaattgtcccaatatcccttattgaattacccattactttaaaaatcccatcttaattatatattaaattctaataaagaactgctgtctcaacccttttcccttggtggcagtgtaacatagttgttgagagcatgaacatcagtttgagattaaacctcatctatactgcttattagctgtgggatcttgagttaattacttgacttctaaatgcctttgtttccttatctacaaaatgggaggcaataacagtaccacctcatagacttgtgaagcttaaatgaattgatatacataaactatttggaacaatgcatgttatacagaaagaaaccagtaaaaattggctattattattattttttaattttataatgaaaaatagtatttgttgtattgtgtccataccatacaaactgccttagtaataatgccttattcattaaagaaaatataatctttgaacagaagtggtatgtaattaaagttcaggtaacctttatataccattaattttgtaaagttcattattcatactagattcttgttttttatgtttacttttgataataggtagacattataacatctaagttctaaaatatcacagattatttttattttattgaaatatatggagtgggtgcagtggctcacacctgtagtcccagaatttggggacactgaggtgtgcagattgcttgagcccaagagtttgaaaccagccatggcaccatggcaaaaccccatttctacaaaaaatacaaatattagcccagcatggtggcgtgtgcctgtagtcccagctattcaagaggctgaggtgagaggatcacttgagcttgggagattcaaggctgcagtgagctgtcattgcgccactgcactccagcctgggtgacggggagatcgtgtcttaaaattttttttttttaacatatggaaattatattaaaccgtttgtagcccagtaattgtatcctttaaaatggaatttttaaatttactcatgagttcagaaactgttatttaaaagtcacaatttgtagagtattttgccaaggcaatagaaacaatgaggtggtttcttcctgcccaatatttataatttaatttgggacagatgctgatgagagtatagatgcttcctgtatgttatagtgtgaaaacaggatactgtctgtaaggaatacaagcagtttctctatgccagtaggaaaaaaaaatgctttatttaaaaatagtaaggagaccaggtgcctgcctgtaatcccagcactttgggaggcttaggcgagaggatcgcttgagcccaggaattcaagaccagcctgggcaacatagtaagatctcatctctgctaaaaataagaaaattagctggttgtggtggtgcacgcctgtagtcctagctacttgggacactgaggtgagagaatccctctgagcccaggagtttgagtttacagtgagctaagatctgcactccaggatggacaagagagggagaccctgtctcaaaaaataaataaataaatatgtacatatgtaaaataaaaatagtaaggatagttagactaattagatgctaaagataccaacttttaaatttatttcagtgtcattgtggaaaattttgaagcttttgggtttttgttaaacttataaatctcacttacacgcagcgtttttgaactcaaagtttagtgaagtatagatgcatcctcagttttctaatggttttcttctgacataggaagagaacctgaactattgttaactttgtttaccgattacatctgaattgcattcctctgttgttcaatgagcagtgttttgtgggatatgcttagataaataaattcatgtaaaaattacttatagttcaattaaatgtttgatttggtagccaaagagtatggaatcatagtcttgatcagtgtgaaattataggttagcgtcatcaacataaaaaccaagattctaagtcatccttgaacttcaaggtaattttcagagacccttgagattatgtgttagagatagggatgaaaaattgattttatcttttattccaacccaaatttagtagcagtaaatgcctgcagcaccatggtaagaaggactgcaaagctttcaggcttttcaggaaagaacactctagtactggctaccttggagtttaaggagacttacttttgaccattttgagggccttagcacagaactactcttggtcctagctggttagacaagcctagcttttctatgatcctccaaatgggatctgaataatccagttatcatgttagcattgaagataaagaactagtatattatatttattgggtctactaaaatttcatagacgggtagaattgactcttcagattccagaacaacccttcaggtcttggatatacaaactcctttagtgtagtgtccttgtgagcattgtctgtgggcgccaactttcaagtagttggcttgcagctcacaccagaatggaaaggacatgtttctaggaccctgaagagaattttcattgttcactgtttttatgcaaccaacaggatagtatgataattgtgtgtgttcatttaatccgtatttattgatcactcgtcttacacagtgtacttaggaatacagagataaatagaacacaggccctactcatgaaactcataatttgatagacatggcagcatcaataatttttgagtttgggcactacatagtcctcatgcaattgtttggctttcagcaagtcactttgagcaccagtttctttaaatgggtctaatggcaacattgctggttgagataatgtatgtgatatgtctcacttagtgtctgatacatggtagatgataactatcagtagcttacattttctagtacttttaaggtttacattgcagtttgacaagtaaaattgtattaaattcttatagtgtccctataagcttatattttttactttttcataaaccaagttaactggggtccagatatgttaagtttcttaagttcaagattgccaatcaggtcctaaaacttgtatttattcatacagctattccaacatgtaaatataaatttgttcaaaagaaatgagtgataagatatgaaatgagatggctttaaggaatgccgtagcacaacagaaaatcgtcaaatattgatgcctatgtggagggaagacaaagccaatgaactatgtttgtattaggcactgagtgatccaagcctttttattgttcttgacttagtccaatgagcagcaccagtgcctgcagtaatcagctgtttgtattatctaggagcccacttatagaattgggtgctgagatatcttattttgcattctatttagtagcctatgtatgtttggttagaaggagggaggagggagttgaaaggggagtttggatttcaagtttggcagtagtcattcacagtgagcaattttatatgccattattagaaatggaaatcagtcttgtagccatttagatcatgtgcaacaaaggcttttgaatatttttagttggttagttacttgctaaaattatgcaagaaatatgattttccctttatcttttttcacttttgggcttcttccattttgccttcaaggataacatataggtcatttctggaggaagaatattatatttgatagcttgatccaatgtggtaaactttaataaatactactgccccacttcttctatcaccctctcactcctgctattatccaggagaaatgtgatataatttctttcattagaattgaagggtgtttttatagtctttccattttttcatttattctcaaacattaggctgtgtaggtttgtaggttttctggccagttttgattattaagaatcacagcttttctaccatttaaggtcacatttatgagtgattcactaataaatctaagaactgcagtggcttgggagtaaatataagagaaatgtttctactggaaagagaaacactgagaggcagaagtggaaggctatctggagggttgtggaattggcaatggtcagtgtttctgatccttaggtttgcaagcttataagcaattgaaaaagacagttattgaagacttaattttttctgaaagtactactgtttgattctatatgagcataattaatgatcatgctgaattaggaatttggtttgagggtttctataagaaacactgttggatactgcatttcaaaaatgatagaattttttcttaaatcttcacctcctactttctggatgctttttctttgataatatatctttatttgacccagttatcactagagttcagttgctaccagacttttcctaccagttgttgttggcatctgattccatctgtttactcatttattcatttcccgtaaatttttactccaaatatcccataggcagtgtgtcagaatatttttttttaaccagttgactttacatggcatttctttcagaacattctgccattcatttgtcaagtatttgttgaaagcttactgtgtgccaagcacagtaataggctatgaaacaaatgatcagtgaagttcaatccttatgtctaggaactcacaaattgggaaatttgggggatgaaggggagagaggttaagaaacataaagagacatataagcaaacaataacaatacatgttacctcttttttcaaagcacacttcataacttttctgttctctagtatctagcctttgtaatctttcttctgtactgttgtcagagatatttttcttagatgcagatctgatccaagttattctctgcatagtatacctatggaataagaaccaaacttcttagcatagcatgctggatatactgtttgctctccaaattctctctttaccatactctgttcttggggaggcagacctttatggattatattagctgagctcccttgccctttggtttcctgttgggtttagccaatgggatacggctggagattgcaaactggaaagaaagagaggtcagattatttattctcttggttctctacttgtagggtcattggttgacagtgactgcatcttcctgtatagctacagttgcagccactgtagctgccactgagtgccaataactcttgctctccagagacggattaaacgttaagataatgaaatttaaacttcagggcccctcacttgcaggggacttgcagaggccttaggaatctgtttacaaagctatttatttttgtaacatttgcaaaagttatttttacattctttctgaagaagggccgacggctgggcacagtggcttatgcttgtaatcccagcatttttggaggccgaggtgggtggatcacctgaggtcaggagttcgagaccagcctggctaacatggtgaaaccctgtctctaccccaaataccaaaattagctgggtgttgtggcatatgcctgcctgtaatcccagctattcaggaagctgaggcacgagaatcgcttgaacccaggaggcggaggttgcagtgagccaaaatcacgccagtgcactccagcctgggtgacagaatgagactccatctcaaaaaaaaactggggggggcgggtactaacaaaatggtataatcttcaggccctataaaactggaccctccaatgtccttaaccttgacccttcaagcttaggtaagtataaggtttacagggaagagagactactgaataacatacttgggaaggctattaatgaatatttcatggatgaaataataatttgagttggtgttgtaggatgaggagttcttcaggtgaagaaggatagaaaggtcattacaaatagaagacacagcctgttcaaagggaatgagtattttgatgtctacagtgaagcatactaggtagaaaacaaagaaaatacaaaagtcctgcggcaggaatatgtctgtcagttttgagaacagcatagagatcaatgtggctgtagacaaatgagtgatggggagaatagtaggtaaggttagagtttcctgttacttagggtcttgtaagccgttgtaaggactttgaccttttatcctgagtgagactgggaaacaggaaggttttgagctatgtggacatgatctgactattgttttaaaacaagtagcctggccactttgatgagaatagattggctgtgttgccacccaaatctcatctttaattgtagctcccataattcccatgtgctggggggggacctggtgggagataattgaatcatgggggtggcttcccccatactgttcttgtggtagcaaataagtctcatgagagctgatgattttataaggggagatctgatgatttctccttttgcttgattctgattttctcttgtctgctgccatgtaagatatacctttcaccttctgccatgattgtgaggcctccccagctacttggaactgtgagttcattaaacttcttttgtaagttgcccagtctcaggtatgtctttatcagcaacgtgaaaatggactaatacacagagagaccagttagaaggctattctagtaatttacacaagagatgataatgatttggacaagagagttgatggtagagttggtgagaaatggaaagtacagtattcaggatttgttgatggattcgatgtagggtattagagtgacagaagcgagtcaaggataactctagtatttttgtcctaagtaattgcaatggcaaattgctgtttactgagatggatgagactgggaagagcaagtttgaggaatggtgaaaatcaggagtttttttgtacgtgttaagtttaaggtgctatgttaatctgttctttcattgctgtaaagaaatatctgaggcagggtaatttataaagaaaagaggtttaattggctcatggttctgcaggctgtagaggaagcatgatgctagcatctgctcaacttctggggaggcctcaggaaacttacaatcgtggcagcaggtgaagggggagcccgcacctcacatggccagagcaggaggaaaagagagagtggggagatgctacacacttttaaacaaccagatcttaggggaactcactcactccctatcacaagaatagcaccaagaggatggtgctaaaccattcatgacaaactgtccccacaatccaattacctcccaccaggccccatttccaacactggggattacaatttgacatgagatttggtggggacacagatctaaaccatattattctgcccctggcccctcacacctcatgatcctttcacattgcaaaatacaatcatgccttcccaacagtccttcaaagtcttaacttattccaacattaactcaatagttcaaagtctcatctgagacaaggcaagccccttccacctatgagcctgtaaaataaaaaattagttagttactcccaagattcgatgggggtatagtcattgggtaaatactcctgttccaaaagggagaaattggccaaaagaaaggggctacaggccccatgcaagccccaaacccagcaggttactcattaagtcttaaaaccccaaaatttgactccatgtctcatgtccagggcacacgggggtgggctcccaaggccttgggcagctcagaccctgtggctttgcagggttcagcccccacaactgctctcatgggctgacattgagtgcctgcagcttttcctggtgtaccatgcaggttactggtggatctaccactttggggtctggaggactgtggccctcttctcacagctccagtaggcagtgccccagtgggggctctctgtgggagcttcaaccctgcatttcccttccacactattctagtagagttctccatgagggctccattagcagcaagcttctgcctggacatccaggcttttccatacatcctctgaaatctaggcagaggctcttaagcctcaactcttgcactgtgtgcacctgcttacagcttgcaccctctgaagcagcctcagctatacctgtgcccccttgagccatggctggaactagagcagctggaatgcagggagcagtgtcttgaggctactcagggtggcaggcactgggcgtagcccaccaaactattcttccctcctacgtctccaggcctgtgatgggaggggctacctccaaggtctttgaaatgccttcaaagccttgtccccattttcttggcgaatgcaaatttctgcagcctgcttgaattcctcccctgaaaatagacttttcttttctatcacatggccaggctgcaaattttccaaacatgtatgccctgcttccctattaaatatgttccaattttatgtcatttctttgctcacacatatgagcataggttgttagaagcagccaggccagatcttgaactctttgctgcttagaaatttcttctgggttgggcatggtggctcatgcctataatctcagcactttggtaggccgagttgggtggatcacaaggtcaggagttcgagatcagcctggccaatatggtgaaaccctgtctctactaaaaatacaaaaattagctgggtgtggtgatgggtgcctgtaatcctagctactcagaaggctgaggcaggaaaattgcttgaaactggatagcagaggttgcagtgagccacgatcataccactgcaatccagcttgggcaacaagagtgaactctgtctcaaaaaaaagaaaaaaagaaatttcttcttccaggtaccctaaactatcactctcgagttcagagtttcacagatctctagggccagggcacaatgcagccaggttgtttgctaaggcataacaaaagtgactttttgcttcacctcccaatacattcctgatttccatctgagacttccttagcctgggcttcattgtccatatcactataagcatcttgatcacaaccattcaacaagtctctaggaagtttcaaattttccctcatcttcctgtcttcttctgagccctccaaactttccctttgcctattacccagttccaaagttacttccacattttcagacaccttacagcaacactgctttcctggtaccaattttctgtagttagtctgttctcgaattgctataaagaaacacctaagactgggtaatttataaaggaaagtttaattgtctcattgttctagaggctgtacaggaagcatgatactggcatctgcttggcttctgtggaggcctcaggaaacttagaatcatggcagaaggtgaaggcggaaccagcacttcatatggctggagcaggaagaagagagagagggaggaggtgctacagtcttttaaacagttagatctcaggataactcactcactcattatcacaagaacagcaccaaagggatggtgctaaatccgtcacgagaaactgtttacatgatacagtcacctcccaccaggtactgcctccaacactggggattacaattcagtatgagatttggtggggcacagatccaaagcacatcaggtgcctatttgacattcaaatgaagaaggtgaatagacaattggctatataagtctgggtagagtgggttgggagtacaaatggagtgttgtaagcatatagatggtgtctaaagccatatgactagatgagatactaaggaagtgaatatagatttttaaagggggagaaagaaagtgccaacatctgaggtttgggaccctccaacacatcagggaagtaggaagaactgacaagttaaagaagcagccagagagaaacagagaaaaaacagaaatatggtgatacagagagctaagtgaatgaagtgtttcagtgaggcagaggttgtcaacaattcttggtatatcaaataagataagtattgataattgaccgttggatttagcaatgttcaggtcattggtgatcttgatgatgctcagcagagtgaatttaaaatgaagtgagttcatgggaggagaggaattggaggcaatgagaagagacaacccattaggagttttgctgtaatgggggacagaaagttgttctttgggaaaagaggagttgagaagtttttgtgttttgttttaattattagtgttttaagatggaataaataatagtcatgtttgtatactgatgggaatgatccatcagagaaagaaaaattgctggagcaatgtctttgtccagtcaaggggggatgggatttagtgcataagtggagaggctggccttagataggaacatagacaattcatctgttatgacagaagggaaggtgtattatatggatataattcttgtacagtaggtgggaagatgtggtgggggtttttgaaaattattttcaaatttcttttttctcagtgaaatagaaagcaatgccataagttgaaagataggatagggaggtgttagaaaaaagggggaaaagtcatctaggagaatgagacagttaatacacaaggggaatgtagtatgatttctgggcagaattaaagccccacttgggattagtagtcatgaatttaaattgacatcagccagatatggtgtctcacacctggaatcccagcactttgggaggcggaagcaagtggatcacttgagatcagcctaggcaatatggtgacaacctgtctttatgaaaaatacaaaaattagccaggtgtggtagtgcatgcctctatagtttcagctgctaggaagactgaggtaggagtatcacttgagtctgggaggttgaggctgcagtgagccgtgatcacgccactgcactccagcctgggcaacagagacccctgtctcattaataatagtaataataataaagtgatatcagtcagcagccacattagctgcacagttgcaggtgcagaataagtagaaagttggcctttgctgagcaaataaaatgaagtcagatggaggaaagttgtcagtgtatacaagagaatgattgtgaaacatgaatatttccgattgcatttttcataatagccaaaagctggaaataacctaaatgttcatcaactaatgaatgaatatacaatggaatattagccataaaaggaaatgaagtactgatacatgccacagcatgaatgaactttgaaaacatcatgcttagtgaaaaaccagatgtaaaaggccacatatatgattccatttttatgtagtgtccataatgggcaaatccacagagaagataattagtgttatgattggggctgagtggaggaggaaaggggagtggctgttaataggaacatagtttctttttggagtgattaaaatattctggaattagatagtggtaatagttgcacaactctaaacatactaaaaatcactttagaaaggcagattttatggtatgtgaattatatctcaataaagctatataaaaataacatgctagctcactagaaatttgcttatcccaaactcaacaaattgaacagctcagaaatatagctgagctgtatttgtaatcaactaatgtaggactaaggtgaacaagtagctgtattacaatgtttgcagtctcttttcaggtttcaagattacagttgtttttttctcagacatcccttagtattaaaatgttattggctaagttgcagagcttgtgaggagagaccaattctggctcagtcttaattacttagtatcttcatctctccatcccttcctctccccttccaattaacaaacctttactaagctataaaaatcatcaagcactatcctaggtgctactggttatacaaagatggattggactttgtccctccccttgaatgtgaggtttaatggggaaatgaggtttaggaacttggagcacatttcatttttagggtgagactactctaatcgttcttcagcatcctcccatctatagcttatagataacgtatgcactcaaggcataagaaacttatttggatcttcattacgcttgaaacattcttccttttgtctctagaacatcagacattctttctcctcttactctaaagtattttggggctaccagatgaaaactcataataattttcttctgatgctctagacctgaaatatcttttataaaaacttcaacattcaaaattacgatgtatgttaggcaaagcgtgcatactggtgctatctgcaaaacaaataataatgtttaccttgcaggattgttgtgagggatcaatgagtatacataattgatatatggaagtgtcaaacacacgagctcttcaataaacattagtatactttatcactttgccaaagtctacaaacactaattttatatatggcaatatgttgagattgcagatatagacatagaccttaacagacaaaccctaattccaaagagtttgccattcattgatggaaattaattggttcagagatgttgaccatgtctaccttattatttaataacttaattaacttactacaaatctatcgatgttttccatcttggatttttatatcataaaaatgtagaattcttagctcatgactatatgaaaaatagatatttgataatgctttttaatgattataagctaattatattttgaatctcatgcctaactgaaatgtaatgttgcatgctggactttgaatttactaaaaagttcttttgttgtcttcctagaatggagctggtttgtcaaaatccaaaggaagccgaattggatttgatagcacacagtgggtatgtagaataaacaagaaatttctcaattataatgttcatttagttcattcatttactccgtaagtatttgttgaatgatggcaataataatagctaccttgtgtggtgggtggccggttggtagtggcaggtaagggacaggccctttaccaagtgctttatgcaatgtcttatttagtccctatagaaagtttaagaagtgagtaaatattgttactctcaattcacttagagagattaaacttagttggctgataatttggtaagaccagattctgtctgcctctaaaacccacattcactgagctatggtgtttccctaaatgaatgaatatatgaatcagatttatttgaataagggaaaagtaatgatcaggaataaaaatctattcaacctattcctttataagatgaggggaaaccagcaatatatacaatatatccttgttttgttttagaaatttcagaacctacacattgataaaatatattttcctatgttttaaaactaaatttagaaagaaaaacattgctgggttactaataaaacacaacatttattctgttagcatacattatgggaatgaccagatatttcttgatacacttcaatctttggcttctctataactagagatgtggaacactttaaattagaagtggattttcagatcaccaagcagtggtcattttagatcattgctaacaccaagtagattttgaactactgtttaaaagtaaagtctgggatatcctattatcaggctccccagctctctagtctataagtgtcaatgtaaacttttaatttattaaaaatagcaattgttttgctctgtgaatttagggtattctgaggataaaggtaagcatgatatacttggaagttatactacccagtcacagttataaagattttagattaaattaaaaagaggtattttgtatgcttctctgtaacacttctctacctccatcccacccttaggaaacacatacacctaatacttggacctgatttatcatcttgtggttgaagtaatttgctgagatttaaaattcagtattttaacagccaaaggcaacaggggtgatctttcatacattttaacattataagatgtgatgatacttagagaaacatatatttttcagatttgccatttattaggagtcttcatctgtacactgtaaagcaatttcagcaaaaaatttaaagccgtagtagcttcagttggataaaaggttttcctttatcggtattaaccaacaacattctgacaacattcccaaaccttttagtaaatagagagagcagtcagagaaagtacaggttcactgatacattttaaaatggaatttgtgaaaaatttaaagcttaaaataatagaaaaaagtagcgtgactctatccttttcattcaagaaatgatccttgaggtgggagaaaataatggatttttttcaaagtctttacttccacggtacgcaagcaaaaagttgaagagcagcttaccacattcagtgagttctctttatactcttttacattgaggggactaaaaaaaattgtaaatgtggtcactgaatgactatatttgcaaaatcacaggaaaggagaagtactaacatacttctaaacttttagaaggaataaaaggtgaaatctcatcaatagtgtgatattgagccctggtaaaattctagggctcaatgtttatggagttattaaacagatgacttgggagcacttagaaaagaaaatgatcataattaggaactaggcttttactaagaacaagtcctgccaagactttttaggttttaataaaattttaatacacaggcagatgaatgggctattatggtctcagcataatctcttttcaacaagatgtttttcagtcttataaacaaaatgagttactgaaggtcagatgataatagtgatttagaattaattggatttagaatcaactggacacgtttccaaggagcgttaatgattgtattgataacaacttggaggatgtgtttagaaggtgagttatagaatctctgcttgaccctgacctaatctgtatttatattaataatggtaatgaagctataagtgtgttcatcatatttgtatttaacaccaacctgagatccattcaacaaacattaaagtaccttttatgtagtagttctgttatctcatctttcttccaaaaccatttctttcttgtttttttcctagtataaagcacagaaagtaataaccctaaaagacacacacacacacacacacaaaatagctaaattggactattaaaattttaaacttctagtcatcaaaaaacactattaagaaaatgaataagcatgccacagagtagcaaatatttgtaaaacatgtatctcacaaaggaatggtatcaaagatatatgaagaactcccacacgactcagtaatagattttttgttcatgcctttcatcaagttgaggatgtattttattcctggtttgctgaaagttttaaatcatgaatagatactgaattttgtcaaatgcttttttctatattgaaattatcatagtttttcacttttttctgttgatttgtcaaattttattgattgattttcaaatgctaaagtaagctttcattcctaggataaatactacttggtcatgatatttactttccttttttatctttttttagttactggaattgattttctaatattttattaagtatttttgcatctgtgttcatgagggatggtggactatacttttttttgtaaggtctttgtcaggttttgcttttttttttttttttttgagatgaagtctctctgtcgcccaggctggagtgcagccatgtgatctcggctcactgcaacctccaccttgtgatctcggctcactgcaacctccacctcccgggttcaagtgattctcctgcctcagcctcctgagttgctgggactacaggcacacaccaccacgcccggctaatttttgtatttttagtagagacagggtttcaccatgttggccaggctggtcctgaactcctgacctcaggtgatccacctgccttgacctcccacagtgctgggattacaggcgtgagaagttttgctgttgagtatggcactggcctcttaaaatcagataggaagtattttctcctgctccattttctcagaaagtttttgtagaattggtattcttccttaaaaatgatagaattcaccagtgaactgtctaagtctgaagtttttccttgttgttttgagggcagtttttttttttcctaacaaattcagtttctttaataggtatagggcaattcagattttgtttcatcttgtggcagttttgttaaattgtatttttaaagaaatttgtgtcatctaagttgaattttttggtgtaacattgtttatcctaactttttacttagctgtttctcacactgaggtaataaacccctataaggcagagattattgtattcttggcatttgcataatactctacactaaaaacaaataatgagactgattcttagctttatctcatcctttatccttacaattgatattttgtctatttatttatcttgtatatatttttatgagttccttcagattttctgaataagaatttattcttaatttcatgaagcacctttttgataggcaaacattcctataagtcttgctttcattgaagtaggcttttaagcaatagtgtatgccagatattctgtttatccttgctgttcttagatattacttattcctaagtgtgatttagtccattttcattctactgttgaatttttgtttttttcagtaggggaccctacttactacccagcagagttatattttgaaatattgcagtattagaaaagcacattatatatggcagtcatcaagcaggcagtgtattttggtctgagtcttttgcttagaaagattattaagcagcattacagatatgaagaaaaatggtacaaacaactgaattttgtttttgaaagattaacaagactgatttttaaaagctgacggatagttctctcaattttgcttgaaaagatttagctaatactaagagaataattttttaagcaccacattttcatgtcagataccacttcctctgtgaaatttcttatccttttgatgtatggtaaatttgtagcttactggtctgtacttttataatatgttgtatatgtttttcttgtagcatatttcaccttatattgaaaatgttcatctttcttagaagactgcttattgagagcagagaccatatgtgctatttaatcatttgtattttttagcacaatgataagcatggtatctattgggtaactactctgcattcttatacaattaatgaattaaaatgttataaaatagactgttgtgttggcttactggaattacgagaattctttttctctcaaacagcgtgcagttaaaaaatttattatgttaacatccaaccaaaatgtaccagtgtttcttattgatcctttgatactggaattgattaataagaactttgaacaagtcaaaaatacttctcatggctctacttcacaatgcaagtttttctgtgttccaagagactttactgcatttgcactgcagtatcacctatggaagaatgaggtaagtgacttgctttcagataatggaatgtgtctctttttacaaaatagtataggtttaggctagtttaaaatgtaaaacattaaaaatttttcctgaaacactttataaattgtatcaggaatattttcagctataaataacaatacaactaatcactaaggcaaataggggatttctttttcttatataatgagaggttaaaaggttagtggctattgatattagtttagctagccactgatgtcaggacttgtgtctctgaaattctttattcatttacctcattatcacaggatagctgtcgtagctccacatatcacatccatgttcacaacaggaagatgagaggaaagattctgcttttttgctgggggaaacttctcaatatcggtatttttaggtcatttctgttgaactgtttgatatctcatagaaaaagcctacaaggcttatttttacaaagaatattttataatgtccctttatattccccaaatgaagttcatagaaattataaccctcctatatacataattccccaaatcaatataatgtattaactataatataacctagaaataaaaggaaatgatatgtattgctgtgtgcagatgctccagaatgactacactggaagacataataaagtaattcagatgcttgtatttagaagtaggatcacagaatgtggtagctacaaatataaacccatactatgaatgatattgttgttggcaatatgattttccaaaatagtgagcaagtttccaacaacaaaaaaagtaaaattgtctcttcattgacatgactattgtattcctgagaaataaaagctcagacaattataaacaagtttttcactatgtgattatgtgacaggacatttgaaattacatagtacacaggatagattttcatattttggattgtaggatatctaatgttcttggcctaggactctaaatgccagtttgtcattatgataaaccaaaaatatccccccaaatttctgaagtatctgttgggtacagtcccacttgccttgagaaccactattttagaagaaggggagtatgccaccattggcaaaactgatactaccatagtcaagaggaagaagcaaaagctcagccatacccagaatcagcacatgggttcaagtttattcttcgtttgtttttgtttgtttgtgttgggttttttgtttttgtttttgttttttgagacggagtctcgctgtgtcacccaggctggagtgcagtggtgcaatctctgttcactgcaatctccgcctcccaggctcaagggattctcctgcctcagcctcctgagtagctgggattacaggcgtgtgccaccacgtgtgactgatttttgtatttttttttagtagggacggggtttcaccatattggccaggctggtcttgaactcctgacctcaaatgatccacctgcctcagcctcccaaaagtttctccttttgtacatatgacatcctactattcaagagattcaagagcccttggatagtcccccctaaaacatcccccaatgtggagctaatcagattgttagatctaataatgaaagactccatttgcatgtgatttttctttattaatgccattaccataaagtgagcaaacctctgccaaggctactgggagtggacttttctagcaaaaccttgacctaggcctttacaccaattgatcagagcaactattttgttctttacttctcttgttgatggttataagaaagcaaaccatatcataattctgcctattttgtctgtcagtctttcctcctataacccaaggtcacgttcttctcaagttctggccggccttttaaatatttcctgaatttgtcagctgataatgcctttcttttattctattcagtagtgtctttctctgaattggctaccctccccctcagtcagtgctttctacttctaaggtgtaccaagaaagaaaagggaagaagggaatgttacagttgataatgaaacaaatgatgttggaaaatgaaccttgtcttacagtatgtttgttaatttctaatgatttgcattatgatggtgttctattatggtagtattttaagatgttgggatgtaaactatgagatgaaagaactacttttttgaagtacttttgaagataaaggttattaaaagttaaattaagaattacaagtttaattttaagtgctgtccttaaatcaacatttactttatagaaactaactggaaaacactaacatgagcattctcattccaaggaagggatttgtattaattttcatagagttttttttgttttttttttttgagacagggtctcactttgtcacccaggcttgagtgcagtggcacaatcttggctcactgcagccttgatctctcaggttcaagtgatcctcctggctcagacccccaagtagctgggactacaggtacatgccaccacaccttggcaaatttttgtttgtattttttgtagagacaggttgcccaggctggtctcaaactcctgagctcaagtgatccacctgcctcagcctcccaaagcgctgggattacaggggtgagctatggtgcccaacctataaagagagtctttggctatatctttcctgctacatactttgtatttttgctgctttcctttattctcccaccactaccttctgcccatcaccctcattaaaaaatgttcttacagagcagattagcacaaaaatatggctcaagttcaatataagaatcactttagttttgctactagtatttggctttaaatattcaatgtttaagtgttgtttcttgatgtttgatgcttctttggttctaggaaggctggtttcggatagctgagaatatgggatttcagtgcctaaagattgagagtaaagatccccggctagacgggatagactcactctctggaactgaaatccccctgcactatatctgcaaactggccactcatgcgatccacttggtagtctttcatgagaggagtggcaactacctctggcacggccacttgagacttaaagaacacattgacaggaaatttgttcccttccgaaagttacagtttggtcgttatccaggagcttttgacaggtaagttcagagtcaaaacgtgaaatgtgaaatgagtgttgttcagtcataattcttgcagtgtttttacatttgagtattgaaatctaatatataatttatataagtatttacagtaacattattcttaatgactccaaattagaagccacccaaatgtccttcaacaataaaaggattggctgggcactgtggctcatgcatgtaatcccagcactttgggaggccgaggtgggcagatcacctgaggtcaggagttcgagaccagcctggccaacatggtgaaacctcgtctctacaaaaaaatacaaaaattatccatgcattgtggtgggtgcctgtaatcccagctactggggaggctgaggaaggagaattgcttgagccctggaggtggaggttgtagtgagccgagattgtgataccacactctaggctgggcaacagagcaggactttgtctcaaaaaaaaaaaaaaaactgtaaaggaataaataatttttgatatatgtgttcatacaatgaagtattacacagcagggaaaaataaactaggggtctgtgcacattgtggatgaatcctacaatgctgaatgacacaaggcacaaaagaatctaaattctattattattattatttttttccattcaaaagtttcttttattcattaataaacaatgatatatatgtatacacagcttcataatcataccaaaaaagtttaagtgaactatcctttaaaggctgagaccataactttttgaacagaaataatatggattataagacagtatattgatttttgctgtctttattttaatataaagaacaaattgtgtggtaagactaatttattttcccactttgaaattaaacctctctagaaacatttagataaattatgaactaatctttaaaataccgtattacttcagcatttcaaaatcagtaagtttggaaactgtatttaagttaatattaggaataatataaccactgttgataactaacaatatagccaaaagaaaatgtggtacatacacacaatggagtactattcagccataaaaaagaatgagatcctgtcatttgcaacaacatggatagaactggagatcattatattaagtgaaataagccaggcacagaaagacaaactttccatgttctcacttatttgtgggagtgaaaaatgaaaataactgaactcatggagatagagagtagaatgatggttatcagaggctaggaagcatagtgggagaaagaggggaagagggggatggttaatgggtacaaaaaaatagttagaaataatgaataagactgagtatttgctaggacaacaaggtgactatagtaaaaaataattgtacattttaaaataactaaaagtatacttggattgtttaatacaaaggataaatgcttgaggtgatagataccccatttactctgatgtgattattatgcattgcatgcttgtatcaaaatattgcatgtaacccataagtatacacacctactatgtacctacaaaaattgaaaatacaaaagtgaaagtaaattctattattacttttataaaaagttcaaacacatgctaaattatgttcatggatgtatacccttatagtaaaagtattaagaaggctaagcaagacgtaccaaaaaagactagatagaggacacagagaactacagggaaactggaagaattttatttctgtggtggagactttggtgtttactttataattcattattttgtgcctttatgttatgcactttcctatatattttttaaaaccatgtgcaaaaatttatctttggctatctcaataataaaaatatttcttgtgagaaacagttatttgaaggaactcatgtaaaatttgattagctatagtttataatattaacaattacaggattaaaaacattcttgaagttatacttggagtatgaagtttctaacctagaattgttccttttattctccttttgaaatcagcgataatgatgttacagtctactttgaatagcagaatctgatgtaaaggtagcagtaaatatttgtaaggattttcacattaaaaactccttcttagtaacttccagtgagataattcttatctgttacacttgagaagtgtaagagtatgtttattcttgccttcttttaaaaatatatatatatattatatatatatgttttctctctatctggaatcatgtgagattgccttcttattagtacttaaagtcacatatttgagaatgactgaaaaaggtattcgaaactgaagtcttctatattttttgtgtatgaaaagtcggaacttttctgaaccaagccatattttcaaaatgaccaaaaaaaatgagtagagatggagaacaatactttgtttttattattggcttctcttattttaatcaaaaatcttaatactcactgttctcttaccacttttttgcctgtttttttcttattctgtatttcaaatgaccttctttagggagacattatcttttagttttttaaagctttgtgaatttatttcaaaatttaataacttagtaaagttcaaaattgtgagttacttattaaacataaacatgtgacaatagataaaagctatctctacattgtaaaattttatatgagtaggaatggaaaactctcaaataatatttttagagtatgggatccaaaatacataagatagatttgcagattagcattttacccattaatgagattctcaggccattgtaattaacttgtgtgtcttaagtgttaaaaacatttacttctctaaaagtaaactgataattaaaaattatgtcacaaaatttttgtttctgcttaaaatgccaagtgtgtatgaacaagtacaaatatattaatatataaatacattaaccaaaataattaaaactcaactgtttgatgtcagatttttcaaggtcttattaaaattgctaattgatatctgacataattgatgaaactatgcttgatgtttaggtattttgctaatgtttgatatttgtaagaggctgccagtattctgggttaaatccttttaataaatcttttattattattattattatttttaaattttactttaagtagtgggacacatgtactgaacgtgcaggtttgttacataggtatacatgtgccatggtagtttgctgcacctatcaacctgttatctaggttttaagctctgcacgcattaggtatttgtcctaatgttctccctccctgtttcccccacccctcattaataaatcttaacttttgttttcaggccagagttacagcaagttactgttgatggactggaagttctcattccaaaggatccaatgcactttgtagaagaagtaccacactctaggtttattgagtgtaggtataaagaagctcgagcattctttcaggttagagacaaccaaatgtgtacttttaaattaaagaaaatgttgggattatttttaatatttgagggtggtaagatgaaggggcttatggaaaatagaaaagtaaacatccttttttgatatgtctcttttcttctagattgttttctttcagttttttttagaagtagattaaaaattaaccttaagaaactattttctaagtcaataggttgatatttatttattgttttatttgaataactttaatagatttagcactggcttctgccttaagatagcccattaactttgtgaaaggtggtgtattctcagtccaagtaggataaagccactatagaagatggaccatgtagatttagaaaagacttcatgaaaatacagtttgtttcagagttggcattgaatataattttttttgcatttatgaaggtttttgaagataaatgctacacaaagaccaggtgcttttaaaactttattctcttgctgcagctttcaattcaatacacatttattgtgttccgcaggcttctggccctggggatataaagatgattttgaaaggcatgaaagttcagctctaagagatgacatgaaacacagagatacagtgaaaacaggcaaatttacagtggggttttggtacctgaattctttcacttgccctttattttctggggttccctgccaagaaagctgtgtccacgagggatacgaaaatgaagtatataactgtcaagtgcccaagacccacaaatctgaggtttctctaatacagtgtactggcacctaaagctgaggcctgacagcccaagtgggccttcgtagccctatttccttaagtcattgtggagctgtgaaatttatgcagccagcctcatgaataaaaagctgaaaaaccacatgtgtggatgggcctactctagtagaaaagtgctgcctgacatatgcctaccacataataacaggaagtagaagagatggagttttgtgcttaaacttgaccgctcttcctgtcctaagggagtttgctgtggttgtcatctctattatagcaattatcacagtgaattatgaatatctgtcttgtcctcttatcaaattttatgaacttcttgataacaggagtgttcttttatttacctgtgttggcccagtatctactgtacctggcataaagaaaagatccagtagggtcagttttcaaattaaagtgaacatacatgtatttgaacacttgatggcgccaaacagtcttaaatgtaatgcttggtgtaaagcaataaattaatctaatagacctcatcaagcagccgcctttctttttttaaaataatttttaaaaagcaattttaaatacataaaagctgcaagtacagtaccgataacttttttttttctgaaccacttgggagtaagatgttgaccacaacttcaaaaaatttagtatttttttaaaaataggaacattctctacatgtcctaatatgaaagttaggaaattagcacatacatttttaccatttaatccctattcaatttttgtcagttgtcccaataataacctttgtaataaaaagattcgattcagaatcacatgttgtcttaattttcctgtctctttagtcttcttcagtctgggacagtttctcagttcttttattactttcatgactaatactttggaagattacaagccagatgttttgtgcagtgtccctcatttggggtttgtccgggggttcctcatgttagatttaggttatacttctttagaaggtatagaagtggtgctgtgttctcattacatctcactgggcactgcataattttgatttatcccattactgttgatattcacattgttcacctgattaaagtgctgtctgaaacttcgtatctttaccactatgaagtttctgtttttccctttataataataagcatctggcaagaagttactttaaaactatgtaaatattgttttcctcattacattttcaatttatttgttcatatcaatataaataaattcatggtttcctattttaccctatgggttatagtcaattattttcattatttattttgatcttcagattgttccatatttggccagtagaaactccttcataatgctttctgtgtccttttgacttgtctccgttgttttttgaacactttagtactttttggcactataaaatattctgggttcatcttacaattttcatacctccaccctgggatcagccatttctttaagtcctgtttccttttagaagccaagacctggatgccaggtgtacccattgctatttgggttttgctgcagagagtttctctcagtgaacaggggtagggtgtatatgtctgtgtgtatttatttctgtatctatctattgaaacctctgaattcacattgacatctccagtccggttaaaagttccaattaaacaacagagttcatttccatatttgcgactcccttttcaaatcgtgagaaatctgactcccattgaccttaatgtttacttagttgttcagtctccctgtatgtaacctatcttccaacacatgtcctcccctccctaccccctgttcttctcaccctacctgggcactgctatcctctgctgggctgcacacacgtagaggcattcttcttaccctgttcaggctctgacttcccacacctggctgctgttctgcagagaggctttcctcaccctgcttgggctctgactccccacactggacactctcctactctcttcatgtggatgtcctcattacctgcctaggctctgataccccgtatcaggcaatccctttgcacaaaaacctttcttgctctgccccatctaatggttttagtatcgaatagttcaggaagggcgggagactttatttacttttaattattttctcaatctaccatgaagttcaaaaactagaataatataccttttcctgaatttgattttgttttagcaaaaaccatcacaagataattaatgagctccaggctgttgaatatcagtgaaaaaccaaaaggaaagttggaaatacctgtacacctggcctaggaatatctagataacaatatttttattttatttctactaatttgctctaagattttgggcaaatttctgagccttggtttcctcatctacaataagagttggtaccttctgtcatcttattctttgatataaggtttgtgcttttggattccacgattcttcttgggctttgtgtccccgttcattggctgaacaggaaaaattaaataaacatgatatttaaagtaggatattaattttgtctttttttagaggtatagtaatcctgagatttgtacttgggatttatttttatttgtttacttatttattttatttttaacttgtaagttcaggggtacaagtgcaagtttgttacataggtaaacttgtgttgtgggggtttgttgtacagattatttcaccacccaagtattaagcctagtacctattagttatttttcctggtcctctttctcctcccaccctccaaaagaacccattgtgtgttgttcccctctatgcgtccatgtgttctcatcatttagctcccacttataaaaacatgaagtattaggttttctgttcctgtgttagtttgctaaagataatggccttcagctccatccatgtccctgcaaagaacatgatcttgttcttttttatggctgcatagtattccatggtgtatatatactacattttatttatccagtctatcattgatgagcatttagattgattccatgcctttgctattgtgaatagtgctgcagggaacacacacatgtatgtgtctttataagagaatgaatgatttatattcctttcagtatatacctgataatggaattgctgggtcaaacagtatttctgtctttaggtcattgaggaatcaccacactgtcttccacaatggttgaactaatttacactcccaccaaccgtgtataagtgttcctttttctccacaacctcaccaatatctggggtttattttattttattttattttattttattagtttttttttacttgttatagtagccactctgactggtattagatagtatcgtattgttttttattgcattttctaatgatcagtgatgttgaacttttttcatatgattgttggccacatgtatgtcttttgaaaagtgtctgttcgtgtccttcacccactttttaatggggttgtttggttttttccttgaaaatttgtttaagttcctgatagatgctggatattagacctaatagttaaggtttgcaaaccatagtttgcaaaaatgctctcccattccataggttatatgtttactctgttgatagtttcttttgctgtgcagaagctctttattttaattagatcctatttgtcagtttttgcttttgttgcaatttcttttggcatcttcatgaaatttttgcctgtgcctgtgtcctaaatggtattgcctgggttatcttccagggttttatagttttgggttttacatttaagtctttaatctatcttgtacaggatatttttaaatgaaaaaagtatgtatactataatttttaaaatttatagcagatgtttaaggtatatagctctatgcatgtatgcactttaacacatacaaggatcagttctgagaaatggaatttctggctgggcgccatggctcacgcctgtaatcctagcactttgggaggccaaggcgggtggattgcctgagctcaggagtttgagaccagcctgggcaacatggcgaaaccccggctctacaaaacacacaaaaattagctggacatggtggtgtgcacttgtaatcccagctacttggaaggctgaggtagaagaatcacttgaacccaggaggtggaggttgcagtgagccaagatcatgcccctaaattccagcctgggcaacagagagaggagactttgtctccaaaaaaaaaaagaaatggaatttctgagagtgtcatgttaagaaaagtagattggggtgggaatatgtccatatgggagcagtaccagcagcaggtaactatcagacctgatgtttttgtagagcacaaatttttcatatttgctgtttagtcctttcagtcactctgtgtaataaggcaaggattcttttaacaggtaagaaaattgatgtttcaagatgtcagttacatggtcatcattggttgagcatggactaaatcctaggtctccacctcttaactccaggcttttcctactacaacaagcattataacatgtatctctcattccagtcatttattgtaagagcacttatggctttgaggaaagggatgtattcaaattgaagggatcctgtgtaatttgtatattctgtagacagtgacttatctgcaagaaattcttcttactgaaggtagggtactttttgcttaagattcatatagtccatccaggatctatattctttcctactatattgtaaaagaattacaggatattttaggatgttgcaggcctgggaggggcttagtcaatcatttattcatttgcccattcatcagtatgtgtttttcagatattatgtgccaggcaccattctaaacctgtagatacagtgatgaagagatgtagtacttgccctcagggaactatctttacagtctagtggagggaatataaaattgatgattaggaataaatatgatatgaattatagtaaaagtatttacaagtggtaactattataagcttgttaaggaaaaagataattcatttgtctttgtatatctagaaccaaacataattctttgctctataaatgttgaatagaaacacttcctgaataggaacattggaagaataaatacatatgtcttcctgggaaaactggggaatgttttgcagaggttggagctgagacttgaaagattttattgatcagggccatatcagacaaaggaaacaagtgcggaggcttgaaaagttgtggtgtatttgaggagttacaagttattgtggtatatttgggggtttacaagttataagatgaagtgtgaggagatgcagatgaggctggaccccagtagtcaggaaccagaacacagtgtttatgtccaccaggacaagaagtttagattttgtcccacaggtagcgaagcaacactatagaatttatagtgctttcctcagctccagaacactctaaaaacgaagagaatcagaaaaccaagatgactaaatgatatatatgacctgacaatttgcaagacatttttctccttcaatcttcacagcagtcctgtgaagtataataattatctttaaactacaaatgagaaaagtagatacaagagagatttgtttattacattctttcattcattcagcaaatactcaggcactactctacccactggagatataatgataaaatgaatgcactttcctcatagaaagtgaggatgatatgtacatggtcaaagctaaaaagaagtgcactagatttgataatctgattcaaaatctcaggctttttctactatactacacagtctctaaagaccaatagaatcactgaatggtgaaaacattattaaattctttttgtttcagctatgtttgtagctctcataattagctttattttatcctgattgtccagctactaaattgtgatgtaaaggagggagctgataaaaggatgtctcatcctttgggaatcctggttctattctttcccttttaatttatctctccaagaatctgctcttaagtgttcattttaatgtgggacaaacaagtaactgtaaaatgtggtttttataatataaaaagattatatggggttagttttcttttttttctcctttctttcttttttttttttcttttttgagacagtctcattctgtcgcccaggctggagtatagtggtgtgatctttgcttactgcaacctccacctcccgggttcaagtgattctcttgcctcaacctctcgagtagctggaactataggcgcgggccaccactctcagctaatttttatgtttttagtagagatggggttttgccatgtgggccaggccagttttgaactcctgaccccaagtgatccacctgccttggcttcccaaagttctggggttacaggcgtgagccactgtgcccagcctggggttaattttcaaatttaattcagatgccacagaaaggttcctagcaatttagaaatggctgtaatagctgactatttattatatctgtagcagtaccttgatgataacactgtggaagctgtggcctttcggaagagtgcaaaggaattactgcaactagcagcgaaaacattaaacaaattgggagtaccattctggctgagcagtggaacttgtctaggtaaaattcttacgactttccatttgtctttctgtcattttgtcctctggctttagggattactgcttgagatgacaaaatatcagtgacatttgaagtgtcatgtgtatagacagaataaacatgagtgcatgcagcaaggatctattgatttccttaaagaaattaatttgagaattataaaaaagaatgttagaaaggccatggttgtgtttactcataattataaataatatgtataaaatgtatatcagaacatgtagactatacaatagtccccccttatccatggacaatacattccaagaccaccagtggatgcctgaaatctccgatagtactgaaccctatatacgctgctctttccctatacatacatatgatgtttaatttataaattaggcacagtaagagatgaacaacaataaataataaaatggaacaattttaacaatactataataaaagttgtgtgtgatctctgtctctcagagtatcttattttactgtactcactgttattcttcttacgatggtgtgagatgataaaatgcctacatgatgagatgaagggagatgaaggatgtaggcattgtgatgtagtgttagtctactattgaaaatttcctgggaaaatcaaggaatgtgtcacagaggctaaatctgagccctgaaagatttgatttaacacttctgaattgtttatttctggaatttaccatttaatatcttcagatcgtggttgtccacaggtaactgaaactgctaaaagcaaaaccacggatatggcaggactactatagttgattctcagataatccttaaattagcattttattatttctatcccaaagattgttattgcctttttttataattataaaaaaccctctatttctttacttatataccattcaaacagcttgcattgcaccaaatgtttctactgagaggaacattaaagacagtgtcataaggtcttccatcagcctttcctaggtcattggtagtatcactaactagacatcactgttcatctgacatggacatacagacttttctacagtccttaagcaggttgctattagaatctgtgagtgatttctgggtctctgtccactgtccattaaatcaaacttctttggaatttagaattatttagaatcttaaattttgttttgtgtttatttgttgtctcttgattatcatgatagttaattatagctgtatttgctttttctttatagtaaccatatctgtacaaaagttaattcaactcctgcctttatagggatagggttgccatccaatttattgttcaattcaagagacttgagagtgaaaggaagcaccattaataattatgttggtacaacaggcataaactgggatatacggttatcctatctattagcctttgttgaaaatttacatggttcttcctgccaaggagcttactactagaataagccaaaaaaaaaaaaaaagtacatctcacacatttatgtgatatttgctttaaggtttaattttttagaaacaagattgttttataatgtgtgtcatcaaagacacttcatagtcatttgacatgatttgttttgagttttcagtcccatggttttctgtctgatttaagggcacttatgagggagttgtattagatgatatttaagaaaacttttatttttaattgtttataattctttaatagaattattttagaattccaaacaatattatccaacagcaatgcctataaggataatcgcagtcatttatttacttttgaaataattggaatgaaatgattagaaagatcataggggagacccaggagtccttaataatattaaggtacatgttttatttcttcagaacagtgctatagcaatgaattagagcacatacgtggtaaacacttagaaatatcatttggcagtgtgttgaacattgaagctgctactgcttttctttttcatacggcccatcaggtggtcactgttgagagctgttaggttctacaaattattgctcaagaaaaatatattggttaagcaaaagaattaaatattttttgcatatcttaacagccccctctatcactagagattaatgattaaacattcttatcagcaacttagtgttattaaagctaatggtttattcagaaactaaaatatatcatgaaagtttttgaggaagctgagagtgctcagacagtaaaaatagatacatagatagatagaaggttcaggtgactgctcaaacaaagtcatttagtttgaggtttaatttttaaaaataattttggtgaagcatcttaagtctaatcctgtgaaataaaatccattctatagccccagccactcaagaggccaaggcaggaggatcacttgagccaggagtttgcgtacagcctgggcaatatagtgagactctgtctctttaaaaaaaaagaaaaaaaatccttgttacaaatataatttgttataataactaattttttccaaacctaaattttgttaaaaaaatttaatcttctttttaggatggtatcgacaatgcaacattattccttatagcaaagatgttgacctaggaatttttatacaagattacaaatctgatattattttagcatttcaggatgcaggacttccgctcaaacacaaatttgggaaggtcagtaacaaaagtcggcttcatttcataagtaacatatctcacttgtaaagtttacattaagcaactcagatatggttaagaatgctacatacataattttatcactcagtattgactaggatgagttcagcagaagcctgttaccacttgtaatttctgcactgtctaggcaaaagcaagaaaatctggctttctactgggttggtgcaaaagtaattgtggtttttgccattacttttgcaccaataatgataagaaaagaaggatcttgaactcttataggtgaatgtattgctattatattaggcaacaatgtaatataaaatcaatataatgtataatatacaattaataagtaagaatcccacccgccgtacctgattgtttctcatgagtcatttaatttacagatgtcattatcaacataaaatattccattgattgctaagggatagaaatatagaatcatttcaaataagtacttcaatttcttgtttatcttatatgtcctaggctatagcagtttgctcagacatcaactagggataggtcattggggcctagatgaaatctccctctagacaatttgattcctatgccctaagcccatgatctcttgcaatcatcttgttcttaatttgcttgtcccctcggaggtgttaccctacaagcaagtaaaaatatgtttagtcggctgggcgcggtggctcacgcctgtaatcccagcactatgggaggccgaggcgggtggatcatgaggtcaggagatcgagaccacagtgaaaccccatctctactaaaaatacaaaaaaaattagccgggcgcggtggcgggcgcctgtagtcccagctactggggaggctgaggcaggagaatggcgtgaacctgggaggcggagcttgcagtgagctgagatcgcgccactgcactccagcctgggcgacagagcaagactccgtcttaaaaaaaaaaaaaaaaagtttagtcaccagaaaattattttttccatcataaatagttattttatgttactaaaaaatataaataaaatattttactgaggtcaaagtcaaataacagagctctagttattcagcaaacatttaccaaacattcactataagtatggcactgtcctctgcacctgggagacaaagatgaataaatgatagttcttacccttgagaagctcactgtctaattgggagggggaaaggctgcataaataattctgtgatgagtgctgtggcggacagatgtaccaagtccaatgggaacgtaattatttgtatgataagttttctttagggaaatgttctcagaattatttatttttttaccttaacttttatttttttcttttttccatgtgtgtagtataatgagctagactatttatgtatgtggctatgaggaatgccactttacttaagtacttattgattgttatgagagacttatttcctgatagttttatttggattattaaaggaaataatatttctttggttcttttccttttttagtcagaaagctgctctggaataggatatttctattttttttctgcagtgataattaccataagtcatttactctgagttatcatcaattgtaagaaacattattttagatgcagttaagaaattaaatgatatgttactgatgcatcccaatttcagaggtgccttaacttgaaaaaatgtgcatcttagaatgaatactctatgtatgtaaaacttaagaatctgtttctttatttttattttttaaaaaaaggtttttaaaaatgtatttcctttgtttcagtgtgtgaaggttttcatcttccccataggtagaagacagcttggaactatccttccagggaaaagatgatgtaaaacttgatgtttttttcttctatgaagaaactgatcacatgtggaatggaggcactcaggccaaaacaggaaaaaaattcaagtatgaatcaaataagtacttatttataaaggtactacagaaataatttcaggaggtagaaataaagaagtaactgaaaagaaaaccaaaaatctctttcaagactccattattagctaacactttcttagcttacccatagagtccagttatgcctgtgaagtaagaatacctgtaaggacggtttgtgaggaggaagtgtccctgggtttgtcagtccaagttgatgatacagctggtctattctcagttctgagagagagaatgagaatgagaacctgaagagcatgggttttagagtcaggctgacctgggaaaccttagctccaccctaatttgtggcctttagattttctgaacgtaatcattttatccattacattgagtaatactactgtgtgtcaggcactattctgaacgttttacatatattaacccatctagtcctcaaaataaccttcagaggtagatattctgaagccagtgtgattgctgttgaatctcagctctttattttaccagctatattaccttgagcaagttatttaacctctctgcctaagtttcctcagctgtaaaatggaaattatagtagaaattgccacatagagtggttttaaggattaaaagaattaatacacaaaaagagctttgaggtgtgtcaggaggtcctgggtgctaagtaattattacctgctgttactaatactactatagtagtagtagtagtagtagtagtagtagtagtagtagtagtagtaaagaaaactatttctcttcttattctcatgagaaatttacagattagagacatgtataattatctcaatattaaactgttacatctattcttagagaacttctgtaagagtgtcaccttttttctaagaaagataatttctagagccagtattagagtcctgttattcttaaattactttctaaggcttgaattttttctctcactgacatgatccgaaacctgcaaacctcaaaagaactgttcatttccaactactacatttctggagagaaaaagcttctttcattctgctttaacagctctttatagtagcagtgtttgggaagtgtgaagtgttctgattatttaacaagagaaatgagcagtgatagaactgtctggacagatggtgtgagtcccagattttctatcatgttactgtgaccttaaaaggcagagaaaagaacaggagatggctgagtagagtagtttctttggaagattcccccagccatatgccatttttattcttttcggcactatttactttaagaaaatgtagtatttttaacactactattccttggggatgaagaaaaacaaaatgtttaaagctagttcaagggtctttttaatgtattttaaatttttgaatagattatacattacatagttaaaatattcaaagaatataaaggatgtgtatgaaaagttaacctttctccatcctctgcccctcattttcccgtttctagttgccctttacagagataaccatgattactcatttcttatgtatcctttccgagacaaacatatgctcgtatacatatagtatttacgttcatctctccccctttacacaaatagtattatggcatattacacactgtctgtatgttcttttcctcacatagctatgtatcttggaaaatgttccaaatgagtatgtatagaaatagctgcattttattccattgtatggcaataccataatttattcaaccaattccctattgatgaatatttaggctgtttccagtagtttactgtgaccctcagttctgcagtcactatctctgtccatatgtctttatgcacacgtgtgaaaccctgtgcaggataaagtattagactcaaattttggggctaaagggaatataagcatatttcaattttgatagatattgccaaattgccctccaaagatgtttccccaatttatattctcaaccacatggtttgagaatatgggtttattttttaaaagtgcactatctgtaaagagaggtaaacttgctcaatatttgccactaatcagtaacttatcaattacttgtaatcagtaactaaatctaccatacaccaaatataattgggagcacattagaattactgttcaaactagtcagtataatgtatcatctcaccttctccaaaggtctttttgtctttataataacctattttttattttatatatagttcattctgagaaaagcttaataatatagaatgcttactattttttaaaaggcagaagaggaactcaagaaggaagaaaaaagattttctttctaaactactctgcaggactatagaatgatatctttggtcctaagatttaacagtatattaagagtaataaaaaagataaagcttccaggatatctgctacctatcaggcactgtgataggtagttcatatatatatttatatatataatctggttaatcctcatactatccctgtgggttcggtattctcacctccagttagacattaggaaactaaagctcagagtgaagtaacttactcgaggcttttgactgttaatggcaagatcaagatttaatgccagacctgtttgacccctaagcctaaatgctttcttcttagagttaataggttaagtgagttagtacatctaatgcatttagaacagtacctggcacattgtaagtattgtgtaagtagtagctactgtcagtactgtattattattattactgttactgttattataattaccatgctgcactggcataaggtatggtactttcagcacagtggtaaattggattagtaattttctaggcaggcatattttcttcctccgtctcatgatactcattccgtctttagttctcagtctttcacttctttataggaagcccttcttttacctgaaatccaaattccatttaaaaatattgactggattctttattctgtttttctccagcatccaaatctgccagtaataaaagtgatgaatataataactatgcctccagaatgtgaagttcttaattcaacttcacatttcctaaagatgctgcctagatttatttggtttgcttctttccttcccattttgaatcaactggtatgggtagaagccagaagtttgaaaggtaataataatagttaactttattgaatacttactataagccaatcaatatgccaagcttttatatgtgttatcttatttaatcctcacaataagtttataaaggagattttatcatcatcacctttattttatggatgagcaaattaaggcagacctgagtcagacctaggtgtgtatcacttcagagcccatgttcttactaagttagtgtcaccatgatctctatcatgttgttaataccccttccatgaaaacattatcagggtaatacaactactgctacatcctctaataggaaatctactccttgggctagtagtgggttccttataccttctgacagttgcagcttctgattattggatagatcttcagaaaattcagattcatcctctgtggaccacactcccatccaggtgtggatcctgtgtaatttatcacttcatttctgtaaaatgtatttaccaactgctatgtgctaaggatactgatgtgactgtaacttagtttctgctcttaaggatctcatgatctagaccatgagacatgttaaagtactctgatagcagtactgtaatcaaatatgtataatctatagttgaagtaccaaatcagccatatctagaaacaatggcaaagaagtgtggcttacaagtagagaaatttgttaggtagacttaggagaaatgtgggaaaagtcctaaaaatagatttatttaatgatttttaaattagtttatttctattttttaatttaaaaaattctgtgggcatctgtatacgtaaagtaaaaactttaaggggttgtttccttcaatagatacccaaaggtagaattattaagtcaaaagatatgagccttttaaagagttttgatacatattgccaggttgcattcctaaaaagttatgcaaaattttatacagtcaccaacataaatgagcatgcttagtttgctatatcatactgagtgttgcattgtactcacagtcattcatgactcccctgatagtttctttgagtaacttttcttttcactttcttcttattatcccaaggtatcttctatcataaaaccaggtcagtcattagtagcaagttaccaacaattattacctttctggccaggcacagtggctcatgcctttaatcccagcacttcgggaggccaaggtgagagaactgcttgagcacgggagtttgagaccagcttgggcaacagaataaaccctggctttatataaaaattttttaaaaattacccaggcatggtggcatgtgtctgtggtcccaactacatgggaggctgagacggtaggatcacctgagcccaggaaatctaggctgcagtgagccacatttgcaccactgtactccagcctaggtgacagagcaaaaccaaaaaaaaaaaaaaaaaagaaaaagaatcattacttttctcttaactattcctaacatcaactggcttttagtatacatctaaccccctccctgtcgtcccagtctccctttcaaaatccagctttaaaatattacagtgcattttgaatgtcttgttataggtgtttgttagacacttattatatagagacttttatatttaagctttatacaagtgtgattttagctgagtgagcccaggaattagaagacctgaattcaaatctgagttctatttttttgtgtcatataaccttctgagcttcagatttctcctcttaaaatgggaataacactgcgtacttcacagggtataatgcttcgattaaatactgtgtagttacctgattcagtgcttggcacgtaatagattcacaactgtttgctaattctaaattaggcaggcagagcatagaagtctgattaggaagattcattgctaggtagcaattagaaaaaaaatcacatggtagtgaattaaagcctaccaaatgttacagagatgaatataaacttgtattacatataactgcagagagatatagtttataggaaaaaaacgtgtaaagagtactgattctttggaagttttctctgaaagtgagggttgagtcagcacaatttgaatgaatattgttgaatggggaattgctattaagttagatttggttgcctctaggaaaagagacttagggccatgtaaagatgatatttggcaatgctggtaaactggttaattgccagaaagtcttgttgtttggtggggtttttgactggatgtaataaagaatctctctcataaggcttttggtggagaatgtagtaagacacaagtcctgttgaggaatattgttcttgctagtgtgtgtaggcatggaaagctggtatagtgaggaagacttgggtggttgaggacctatgctaaacaggaggtgaccggaagaaatggtaaaagaacttagcaccatgcctggctgtgaacaaggggagtccaagaaaactaagtgtccaaaataacatataagtttataatcttagagctagagaaaaattaggaaatagtggattattatgtttttaattgaagtgtaacatacatacagaaaactatacaaagcaaatgtatggctccaagaattatcaaatgaacaaatgtgtaaccagcaccccagtaaaaaaaaaaaagtatttgtcagcaccccagaaacccatatcattttccctcacgatcatagctcctgtttcccacaaggtaacagcgatgctaacttctggtattacagtttagttttacctgtttttttattttatataaactagatggtatgttgctggcttcttttcattcaacattgtatttgtgagaaccatccatatttttacatgttgtggctcttcattttctttgctgtgtagtagttaattgtatgaatatatcacaaatatttattaagtccactaacccaaatagtagttggatatttgggttgttttcaatttggggctattataggtgatgctgtagtgaacatttctgtacgtgtcttttagtgccctggtacatgcttatcttagtttgctcaggctgctataacaaaataccataaactgggtggctcataaacagaaatttatttctcaggtttctggatgatgggaagtccaagataaaggtaccagcatggtcaggttctggtgaaggccctcctcctggttgtagactgctgatttctcctcacatggtgaaaggagcaatcaagctcccttaggccttttttataaagtttccattcctgagtgtttcaccctcatgacctaatcacctcccaaaggtcttacctcttaataccgtcaccttggaggttaggatttcagcatatgaattttgaggagacataaacattcaaaccacagcaatgtttttctattgggtttacacataaagtttgggattgcttggtcgtagggtattcttgtgttcaatttcagcatattgtttacaaatagttttccaaagttattccaagttatattccagtatgttatagaactttccattgccccacatttttaccaacgcttggcattgtcagacttcttaatttgtaaccattttggtaggtgtgtagtgttaccaaattgtagtttagatttctttttccttgacttaatgaaggcaagttcatgtttactgaccatttggatatcctcttttgtgagttactggctgagtatcttgtcagggtttttttctgagttgtctgtctttttcttacttgaaaatatcttctcccaatttgtgcctttcttctttattcttttttttttttttttgagacagagttgtcacccaggctggagtgcagtggtgtgatcttggctcactgcaacctccacctcccaggttcaagcagttctcatgcctcagcctcctaagtagctggaattacaggcacattccatcatacccagctatttttgtatttttagtagagatggggtttcaccatgttgcccaggctagtctcaaacccctgacctcaagtaatctgccctcctcggcctcctaaagtgattggaatacaggcatgagctgccatgccagcccttctttactctcttaatagtgatttttggtgaataaaaagttattttaatgtagttcagtttatctattatgggtagtattatcgtgtcctgtttaagaaatctttccctatcccaagataatgaagctattcctcttgtactaccttctagaaactttattgttctatatgtaatatgaagtaaagatcaaatttagactctatactttatttggattcactagcttttctaccaatgtgctttttctgttctaagatctaatccaggataccacattgcatttagacactctaccttttgaaactttattttggtccaagattttaagcttgtcactagtaatactagattatcatacatcactgcatgtcccacttctgctcattcaagggccttacgttgctgtctgtttgaactagcttcttggtaccttgatctggaaataatcttctcttcctctgcatttctatagattttctttttctttccctctctcatgctttattggagtacttttgctgatttgtctgtcctttctatgtgatagataaaatcaggcctggtacatgtttggctaagtgagacctgagccctacatgaaactaagtcagatcctcttaagtgtagtctacactgttttgttaagatgataaggtgacactgggttgatgacttgatccaacctaacgtggttggagaattaaaactatagaattaagttagcctagttgttttcaatcattctgcttcacaagaagttaaaagactagaggtatttgttgaatcctcactcattgtctctctcagcttcacagattgatactgtgctcctacagttgtaactccaagaaacacatttgtctttttagtacttacagctgtgaagctaaaggcaaatttgaataatttctttaaatgagtgtatttaaaacattgacttttctatgaatgatctcgtattttctgctctgtttatgcgtttatattttacaacatacagattatgtcttaggtctccttaattatacctccaaaccgctagtaagtagcaggtgcaaaattgaggaattgagggaagaactttgaatgcatgttatatgggaattgtatacttatacaatatgtagaagtagcagttatttatatagcaagctttgtttatttttttaagagaagattgcctccagatgaataagcagtaaatctttcatttatgtgaagtaagttatgttttttaaaactgtcgaatagtttgttgtttgaacataattctataagatattatataggatagtattctaagagaaataaaagcatattttcagtaaaagacttgtacacagatgtttatagcagtcttactcatactagcaagaaatggaagcaacccaaatgcccatcttctggtgactagttataaaattatgatatattcaaacaatggactaccactgaacaatgaatagcaatgaactactgataaatgcaataacatggatgaatttctaaaacatgatgctaagtgaaagaagtcagataggaagagtatatactgtgtacttgctgttatttgaaattgcacaggaaaaaccaaccaacagtgtaataagattagtggttgcctaggaccagggtgggttgattgcttgactgacaaggggcacagggaactttggacgaggggttggtagaaatgttctatatcttgattattgtggttacacaggtatatacatttatcaaaactcatcacttaagatagatgcatttcattatacttaacttatacctcaaaagaagttaccttaaaagtttaagactgggcacagtaacccatcagcatttggggaagacccggtgagaggatcacttgagcccaggagttcaagataagcctgggcaacatagggagaccccatgtctacaaaaaaataaaaactaaacttaaaaaaggttaaaaagataaaaaacagtttgtgacttagaaaactgatgctaagagaaaaagggtctgagatcacaggttgaaacagagggatatatgggaccaaaagcaatgaatttggtcagggcagacctaattgcaatgataaactttgagactttcacatatgattaaacaaattgtgtaatctgatagtaaagccttttgtattgagtatgaaaattgaaactataatttaattcttttaaaaattatccattatatacaaggagaaatcctgtaaaagtctgaaggaaagcaagcacaactggagtctaactggttgttgaagtgctattagatctagttctgggaagttatgtggttatgtagagctatagagtttttggaagttatgtagttatgtcccaaggctttgtcctctggcattgaggaaaactttagtacttgttttaaattgatagtttttaatgtagtcattatgtgtatgtatatatacatgctgctctaaagacacatgcacacatatgtttattgtggcactattcacaatagcaaagacttggaaccaacccaaatgtccatcaatgatagaatggattaagaaaatgtggcacatatacaccatggaatactatgcagccataaaaaaggacaagttcatgtcctttgtagggacatggatgaagctggaaaccatcattctcagcaaactatcgcaaggacagaaaaccaaacactgcatgttctcacttataggtgggaattgaacaatgagaacacttggacacagggtggggaacatcacacaatcacacactggggcctgtcgtggggtagggggagaggggagggatagcattaggagatatacctaatgtaaaggacgagttaatgggtgcagcacaccaacatggcacatgtatacatatgtaacaaactggcacgttgtgcacatgtaccctagaacttcaagtataattaaaaaaaagaaaaaagaaaaatctgggatggctggctttagtttatactcagctgtgttacattaactctctcaaaacaaaatgcggtagataactaggtcaataaatgtgatcattagttaaaatgtgaaaatgataaaattttctagaaaaataaataccaaaatcaactcaaaaagatctagataacctatattcattcgagacagtgaattagtaatccgaaatcctcctttctccctcttttccctaccagagtatactaaaacctagaaagtttgctgcaaagtttcactgtgccttcacagaacagattatccctgtattgtacagcttatttcaggcaatagaaaaagagaaaactaaataactattttatgagagtgatagcaaaagtggacatgaacaataccaaaaaaaattttttaagggaaattactgtctcagtgaatacagtgaaaaaatactaaatgaatagaattttgtagtgtgtacatattaatgtaattctctgtattaaaggattaaaagattaaaggaacaaaaacactatgattgttttaatagatgacattaacattttttgataaattttataattaaccaaaaggagagagacctcttagcaaatttggattaaaaggaatctaggctgggcatggtggctcacatctgtaatctcaacatttagggaggccgaggcaggtggatcacttgaggcaggaggtcaagaccagactggccaacatggtgataccccaactctactaaaaatagaaaaattagccaggtgtggtggtgtgcgcctgtaatcccagccactccagaggctgaggcaggagaattgcttgaacccgagaggtggaggttgcagtgagctgaggtcgcaccactgtactccagcctgggtgacaaagcgagactgtctcaaacaaacaaacaaaaaaatctgaaatttcttttacctaataaagagaatataacaaaaacctagagtgagcaatcatgtttaatgataaaactttagaagcccttccattaaaatcagaaaaacgttaggaatgtgtgctagccctgcttctattaaacaatatgctagagggcttaggcactggaataacatgagaagaaattaaaagttaaaagaagagaaaaaattggtagtgagaataaaccatttatgttttgtaggaaattcttgtcaagaatggctctactgctccaattctagagttaatgtaaaacttaagtttaaaaaagccaggttcgggaacaggcaacctacaaaatgggagaaaatttttgcaacctactcatctgacaaagggctaatatccacaatctacaatgaactcaaacaaatttacaagaaaaaaacaaacaaccccatcaaaaagtgggtgaaggacatgaacagacacttctcaaaaaaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgactcctcagggatctagaactggaaataccatttgacccagccatcccattactgggtatatacccaaaggactataaatcatgctgctataaagacacatgcacccgtatgtttattgcggcattattcacaatagcaaagacttggaaccaacccaaatgtccaacaatgatagactggattaagaaaatgtggcacatatacaccatggaatactatgcagccataaaaaaggatgagttcatgtcctttgtagggacatggatgaaactggaaatcatcattctcagtaaactatcgcaagaacaaaaaaccaaacaccgcatattctcactcataggtgggaactgaacaatgagatcacatggacacaggaaggggaatatcacactctggggactgttgtggggtggtgggaggcgggagggatagcatcgggagatatacctaatgctagatgacgagttagtgggtgcagtgcaccagcatggcacatgtatacatatgtaactaacctgcacaatgtgcacatgtaccctaaaacttaaaagtataataaaaaaaaatatatatatatataaaaataaaaaataaaataaataaaaaagccaggttcagttatagttgatgttgtctctatctctctgagcctagtaataataaaacactgttggttctgggatagtggaagaacttccttttcatttagcagttgtattcataggttgtgcttaaactgattgtaattaaactgatgaaattatccaactaccaccaagtagttgtatagattttaaggatatctgtgagggaaaaaaatggtctattccaattattgaactactgttttatgtaaaaataatatgaaataaaagtggtatgaaatagaaaatggatggaaggatttttttgtggtaataatatctcttaaacttatattctgatttagggttgccttagtctgcatttaaacctgttcacatgctggatccaatcccagggccttaaagtacaaactgcttagccgaacttagtcttagctttaaaagccaaggtaacattgcagacccatggtgtattttagtcttagtcattatttactggtagcctggacagagtgcatggcatgtgctgttctgtgtcattcactctccttcacttcctccctacaatcctattttataatcagtttttacattttattgtttgtttatctttcctcttaggaagctgggattttctttttgctgaatggattgaaaaataattggggaaaaggaaaccacaaagagtttagagaggtttctgttaagtacaaaaattaacatttgagttaaattgtcttcgaattattttcacattatttatatatttaaaatgttttggctttgctcataaattcttcattgttcaaaacattgcttttgtaaaatttgtagtattccctttcaccttatctatcctgtatctattattatttttccctctttcagctttttgatgagaccacaaaggataatacttagaggagtttcctggcctgtattacaagatagaccatgagttctgcctcaattcaacttcattgtgtcaacttgataggataagacaggtggacattctgctaaccagcatctgattagagagggtggaggctggtgatggattgttaggtgtgatgacaaaataagcaattccgttaacatgagtgtgcagagtaaaattgggaccagcagatggtggggctaagctgtatcttatttctcagctatgagattttccgtggccaccttttcacagtagccagctgggattgtccattaactgggtttgagtaaaagggagttgttgctttctttagaatttgttcagcctctccttttcatgtatggctttatgttcatttggtagtaaaacacgatattcaaaggcagaatatatgagaactgaccttttcttggagaacatcccagttagatcccatttccacaatatgattacactttgaaatctggcttttccctgttctttctttaatcctctgatattttaaattcctgtaatctctgctattgccactttaaacctcattactgaaagttcttcccacactgaaacacttctcagaaaaaaaatgcagaatatagagcagagctataatataaacttaaacagacctgctagttttagctttcttttctagtatacataatttagtttacttgatccaaaggatctttaagaaacatgttttggtttaatttctgtttgttttgtttttttttttgagacagggtctcactgtgtcacccgggctggagtgcagtggcgtgatcttggctcactgcaacctccacctccagggttcaagtgattctcctgcctcagcctcctgagtagctgggacgacaggagtgtgccaccacacccagctaatttctttgtatttttagtagagatggggtttcgtcatgttggccgggctggtctcgaacttctggcctcaagtgatctacctgcctcagcctcccaaagagctgggattacaggcgggagccaccacgaccggcctggtttaatttctaaaacttacctactaatcgacttagttctgcaataaatatagttacaatcattataactagtattccttgggctggtttaaagatgttctttagcatttgagatgaaaggcagaaaccacaggtaggatcatgtaagctatggaaccaaaggaaaagcctggaaatgcaacttggagtcctgcttactctgtatccttggaaaatccagattgtgaaagaaaagaaaaagatcattttcatccatcttttgacagctttctactttgacacttctttcctctacagttccaacagaaagcccaaggctgactttgatttgcctgacttgggtatgttcccatccctgcctcaatcattaacttactggcctgagtcttagtgatggggtcagcctctcctcaatcctatgagcttggaacaggaaaggaaaattggagaagaggaaagggattctggacagtcaaaaataattaaatatccactctcttcccaaagctgtgtaatgggagagcactgtccttcagccaataatgcactagcagctagattccttagctagaccttcttccactgttgaagcctaatccctctgttttgctgcagatacctgtttccgaagtttacactgtgctggactgagtttgtagacatgaaggtccatgtaccctgtgaaaccctcgaatacattgaagccaactatggtaagacctggaagattcctgtaaagacgtgggactggaagcgctctcctcccaatgtgcaacccaatggaatctggcctatttctgagtgggatgaggttatccagttatattgagatagtaggttgaaatgggagaatttctcttttggaaaaaaaggtagataactgtttaaaaaatacatgtctatttgtcaaacataagtgggaaccaaagaaaaaatgtgacaagtttgaagacacagaaagagtcatctgatgtaattctctcacttagtactgaggaattttcatgtgccacatacaatgctaggttacagtggagaagcctagatgaatgagacaaatacctacttcttttattcctccttttggtaaacaactcaattttcctttgagggaaccctcccccaccctttgaagagttcaagttctgtacaggtttttaaaacgtgaagtaatgtttgaactggaagatgagctcaccaggcaaagctaaggaaggatatactagttgaaaagaataacccactcctcttctgggcatttaagctggtatgttagtgctacttttaagattgtggagtctgagttaatattcaagtgatcagactttgagtgacatcaagaaaagatgatatcaggttcatttttcaactaatcttatgtggaattgaattagagaacaaggcattattcttttagggaaggtgagagcttatttgtatcagagcttattacttgtcaggataagtaaatttctgtacatgtactgttttcatatgtgaagtgagaagaaactttatgcttgtttaatgcttaaatttccatccattgtgagaatattttcactgacctctgatggcacttgttgacaaatcattcaagtgagaccatgttactagacatgatcttgaaagaggccatgatttcacaaaactcatttttattttattctcagacagtctgttaggtaaaaatatgagaaattcatgtacattttatattttctgaatttataatctgtgcactcccaattttaatgacactaaaatattaatagaattttttaaatatactctaatttttaaaacatactctttattatcttcatttatcaattacagcttcgtatctctaatttatggtctatataccaatttaaatggcatgtaaacctgcctgtttcttctcctcttctaatatatcagatctccaaaatggaagctaaatggtggacttgacaactattcaccctacctcagatcatagagtttgtaaagtttgtgtccctccccagtttttcagtctgttgaatgtcgatggggcaagaactcagacttctactttaccaagtaccacacactctggaatgctttagtttccttttcccctcaagatgtctgagtcagctaggatgctgtttaccccatctctctcttatatcacttgaatgatatattgtaagtgagaggtaaaggaaaatgtaggcacaataagcactgctatttttctctttgtctaggaaaggaagctgaatcttatatcttatctatgctatttaggactactttctggagcttggcagattttcctctgacaccagagaacaatagtagtctcaagaatggaaacctgaatgtctgagggaatgggctggtagactttttcgaaaacaaattagagaaagtaacttacaaccacccattccggatttgtaaagcaacatgaaaacctttgataaatgataaccaacagtcttctgtcctaatttgcattctcaatgcagaattattgggtctttcataaataacatgagtggtttctggagacatttaagattgtcagcaaacttgtcccaaaatggcacatcatcataatccattttctctttgctagaaaatcagcccatagagtgcattcccaaattctaaatagctgaccctaaattcatttttcatgcttaaaaataatagaacaaataataatactatttttgggcaaaatccaccctacttgatgaggaccatttgcttgtgctcagtatttagaaatgcatacactccacatttctccccatttccaattgggactcccattctttgccaggagatcttacccatcccttttcagattaatcttttatcctttcctgaagtacaaagtcttaagagtgtctgaaatccaagacatcttggcccaattgacacaggttctatattcttccctacatagaccactggctgctgaaatacttttcttgtcttctggtttcacaggcttcagctcatgggttccaccctaacttggggaaacaaaagccttctctagaatctgaaggccaggcttacctctgattctgattcatccatacttcatcttatgtattttaacagttgggttctgtggagtgtccagagaccttgggttaggtatatccatcttcagtacctcattggatcacttttctttcatcacttgagtattctagcagtcattctcctaatctgaccactttcaggtttagtttacctggcttacctggggaagttgacaacttgttggtagttaggcacccatgaatgtctccagagacatcctgagaggcaagattcctcttaattgataaccaggacaaccaggtagtcacccagtcctctctaagcagggagcacttgtccttctctcctctgctgcagctactgatatctggcccctggaataaaaccatagttcctaaaattgagcatccctaagagtagctgcttggtgggacagctgatttctttgattccctagctgcaaaacctgaaattgaccactaggtgacagaatgtttgccagtatccccacaaaacaagttaaaacttaagtgaaaatcattctgcttttgaatcttaaaagctagaaaaaccataatgtaatattctttttaaaccctcttattttataactaaataaataatcacagaaaagaatgatctgaacaagaacagctgaggctaaaacccaagactgccgtgactcctagtccaatgtctgtttcgcatcacaacacagtatctttaacagtgcttgagatgcttaacagagaaggcatccagtgcttcattgaggctaagtctcagggtgtttctgccgcttagtatctttttgttcagattgagaacctaaggcgacagagaggtcaaggggaagtattttctagttcagaattcagaattcttaggcaaccttcatacctttatctggaaaatgccttctctccagacaataagacagttcacatctggagacatcagcctttggtacctaattctctaagctcaagatgcatcccattgccactttaccattctatttcccaagggaaccatcagcaccaacctgctaaatgcctgtatttgaagtctctccccttcctgaagtgaccttttatgaggctctttccttcctaagggacctttccctggtagtagtggtctcattcacaaaaaagaataatagatgtaactggagtcactttgcagttttcaagattttttttttatctgcttggctggaaaggagactagagtatctagtttttagtatttaaactacttttaattatttatattgatactctctgataaatgcaggtagttaagaatagattgtactcattcctttttgagtttgtgacctcaaaccattgtttttattcttacacgactacagtacttcaaatggcacatagataggcaggatattacataggtaagcaggaatttatacattgggtaccagagctaaatctggaaaacacatttggaatgagcttccacacttcagtctaaaatctcacccaaacttatggctacatatttttctaagtttcccccctagtttcactttctggaaagtgaacagttttttaaatcctaaatgttataaatccttaggagaaatattccctcaaaacctagtcaagaaagtgccacattcccaccttctaacaggtaattattagttgtaatagctttaatgcatggaaaaacttcagttactgaccagtcaagagaatttctcaagaaaaatcccagcaacgttccctctttcctccttgtcttccactatcattaagacctgggctagatcacctctaacatctcactcagggaaggcaatgtgttgccataaaaagaccacaagcttttgagttaggcctgaatttgaatttcagcttaatcatgtgggatttatggtgggggccctttcagtctcaatttccacattagtgaactggggaaatgatacatacttctaagggtttttagggggattaaatgaagtatacagttcttagcctcaggcctaggattaagtaagtactcaagaaatgtgcaattttctagttccatgtttcttttctaatcttcaaatggaattatagaaaccatgggtcagaacatattcctttactcaaaagattgcatgactgaatttgcttaagaaaaaaaaaattgtatcaagtcattaatacaattatac

SEQ ID NO: 29 - DNA, 179687 bp, Homo sapiens
gcttgacaataacttgaagccagtgttgtaaagggaatccattcatcagaagatattgaccagtgcttctcaaactttaaagtgcatgcaaatcaactgcagattctgattcaagagtcttagtgttggacttgaagtaacttaggcttatttttgcacacattcaaggtgagaagcactgccttatttataaaagctcagcaatataacacaataaaattgttttatgcgggatttttttttttgctatcataggatccctccagagtatggtagttatatgatagttatagcagtctatgatagtatatgagtcctcttcttttctatttgaaatttttgaagtttttttcagattgtgtcctcttgctctggctttcatgaattctttaaggtgacactgttgcttatttctaaagttcccatcgtttacagttttttattgtttgagacagggtatttctctatcacccaggctggagtgcagtggcatcatcatagttcactgtagcctctaactcctggctcaagcggtctttctgcatcagcctcctgagttgctaggactacaggtgcatgccaccacacccagctaatttttaatttttttttttttttttgcagagatagagatctcactgtgttgctcaggctggtctcaaactcctggcctcaagccatcctctagccatagtctcccaaagtgctgggattataggtgtgaaccactgcacccagccatcatttccgcgtttacatctgtgttcttcttattggtcatacttaggtccaaaaaagttagtttaccaaacacagactgtactttccaggttattaaattatcaataaggcaaattcagaacttttcagagattctgcctttaggttcctttagttttccaggtcagttaggttcctatcattcatccctttgtgttagttttgtagatcactcatttccacctggccagatagtttaactttcatgtatatttttttctttttatcattattcagatatctttctgcatgttactgctcttcgattttatatatttttatatactaacatatatggccttagcttagagtgcctttctttaagaatagtaaaggctgttgtctctaagtcaaactgcttatgtttaaatcctgtttcttctttaattgtctagctgtgcaatcttgagcaagttactttgacatctttgagcccctaataaagataatgataatataaagtttatggtattgtaatggtaaggattaatatggaaagcactcaataaatgatagctattgttgttactaccattattcgtttttacttttctatttaacttaggaagaaaactttgattgttgcctttgaaattgtatattttactttgtatttatcttaggttcacttttttactcatacttggagaatttacgtgttgatttatagcagttgaggctttaactgttttctatccccttctcagttttctcatgtgaatgactgataccaatgataacatttttcccccataatgttttctgttgtaagtagaacttttctcccctaaaatccagtgtatacatcttcattttctttatctaggtttcccatcacttctgcattctgacagagagtgcacatacacatagatattactactactttgataaaaaaaaatgatttaaaacgccgtcttctcaaccttacttcttcccttcttttgggctttcaacaatggcttaacagaccaagaccatgcttattgtacagtcaaatagattgcatgaacagttaggatttccctttttggtaaaatgaggtatgattaaaaaaaaaaagaaacctttttctggaggagtttcgtccagaaggaaaactgtaataagattttttttttttttttttgagacaaggtcttgctgtgttgcccaggctggagtacagtggcacaaccactgcagcctcaacctcctgggcttaagcaaccctcctgcctcagcctcctgagtagctgggaccacacaggcatgcaccgccatacccaactaaatttttctgatttttttgtcaaagtgagatggggtctcactttgttgcccagggtggtctcaaactcctgggctcaagtgatcctcctgcctcagcttcttaaagtactaggattacaggcatgagccactatgcccagcagaaaaatgtagtaggttttaaaaattcatgaaggatgcatttaaatctctaatttttaatattctgtagcataaaaattttctataagatggaatcaaattaacttataaaatgaagaaatatctattaattccataaatgccactataatgtatcctatagtacattatatgtagtaatattagttatggacatacctgagtcttaacagtggaagtgacgatgatcaatgacaattacaaagtcattatctactcttagccatttcttatgcattgaaattttgactttatatcctttctcctttctggagctaagaaaataagtctggcaatgctgatgccacttaccttttacattcaggtgcagagaaaacatttagcaaattcttcaactaatttctacactattgctagttcatcactgttgctttatggaagtatgtaggtagatgtgtggattgctttccttccaaagacttctgccttgcctaagtaatatttatatgttataagtacactatctttcatcttcccctgaatttgtatgccgtatttgatgaattgttttcttacttctatatagaatctagagtgaacttcccacgttagctccaagtcaacctaaatttgacataccactcttaaattatctaaatatctttgtccctcccacgtgtcaccactttcttattttttttctttttaacctcagtttccattttgtcacttgactttcttttggggaccattattcacaagaaagaagaatctgcctgccagtgcagtcttactagaatggcagctgaattgagatgtagatagcagggtgctaactagtcctactcaccaattaagtgactttttttataccaacctctcaggactttcagttgcagatttatgactcagcaaaattttcacattgctacaggccataggcctttacatttccttacatgtaggcatagcagagcatattaaattcatgaatgcctatagtctctttattctcttggcagtgaatagtctacaattcttatgtttcagtagtagacactaccaaatatgtattataaggacagaaatcctacaagacagatgaaggaaactcatggttatgacaaataataaatgcttttttggttgtcagttgtcttactaataagttatatccaattctaagtatttattgtacaattacacatgtagaatttaactttgggaagactctagttagtggaaatggatcatcctttctaagtcaaatttttccatcttggtgttattttactgggtttattatttgttagctctcatgttgctttgcatcttaactttaatatgtaattcttttgttgttgtggttttgaaaaaaattagcaagagtcatctctcagtatttgtgggggactggttctagcaccttcgttgaattaccaaaatccacagatgctcaagtccctaaaaaatggttatttgcatgtaacctatgcacatcctcccatatactttaagtcatctctagattacttataatacctaatacaatgtaaccactatgtcaatagttgttatactgtagttttaaacttttttattgttgtattgttatttttattttttccgaatattttttgatccaaggctgattgaatccgtggatacagagggccaactttgctttgttttttagaacagggttatatttgtggagaattgagcatgataatacagaaagttaccataaacccactacctcctccatatacaatttcccctgttattactattctgcattagtggggtacatttgatataactgatgaatcaacagtgatacattattagctaaagttcatattttatattagcatttactctttgtgttaaacagttctgtgggttctgataaatgtatagtgtcttatatctaccattatattaccatatagaataatttcactgccctaaagttcctttctgttccgcttattcatctcttatatcctgcaacccttctgtgatcacttgttagttccaggaattttattctttgttgtttttttgttgttgttgttttgttctttttgagacggagtctcgctctgttgcccaggctggagtgtagtggcacgatctcggctcactgcaatctctgcctcctgggttcaagcaattcttctgcctcagcctcatgagtagctgggattactggcgcatgccaccacacctggctaatttttgtgtttttagtagagacggggtttcactatgttggtcaggctggtctcgaactcctgacctcgtgatctgcctgccttggcctcccaaagtgctgggattacaggtgtgagccactgcgcctggcctgttttttgaattttctacataggcagtaatgtcatccacaaagagttttattttttactttataattggtatttttcttgtttcattgatatcattatataatttttctgcaattgatgtgatagaatacattaattgatttcaaatgtttaactagccttgcataccaggaataaatcttttgaattcttttctttagcagtaaaatgtttaaatctggtagctgctggactgcatagtttcacccagttcagacaagtccgtatcactggaggaacatgttctacatttgttatgtcagtggatcatgtgttaatgttaaaaagctatgaaatatgtctttcatggaaaagaaattaatgttcatacattttaaatgtggctcatttacttcagtttattttaatgaactgtagaactcttgggagaaacatttaaaaatccttaagtattttgcagggttgggaaacaagattttaaaatacattcaagagggaaaatacactcttgaattatttcagtcattatattcaaagcaatttattctatttgttaatattgatttaatttatattctacagctatttgaaatatcaattaaaaatataatgtgttcagaagtagcaagttattctcgattccttatccttagtgtgtgtactttgaaaatagttattttacatttatgggctttccttttgcttaatctgatctacttttgaacagtttaaaagcataatgaaaaagcagtttgaatgatataaatgtgatatcaatatttgattagtgttgtaataaatgaggaatgaatgagtcttttttttttttcttctttgcagtccccaaagctccagagatagatccagtagagtgtttggtggcagataactctgtaacagtggcttggagaatgccagaagaagataataagattgaccattttatactggaacataggaagactaattttgatggacttccacgtgtaaaggatgagcgatgctgggagataattgataatattaagggtactgaatatacactatcaggtaacatgactgcattttaggactctcattctcagaagataaatgtattgttgaaaaatattttgagttactttaaagaataaagttttaaagtttctttagtcacactgagtttttagatactcagtatggaagtgattttctcttgaaacatcaaggaaaccctttttttttttttaagacaggatcttgttctattatctcccaggctggagtgcagtggcgggaccttggcccactgcaacctccgcctcctgggttcaagtaattctcccacctcagcttcctgacaagctgggactataggcacacgccaccacacttagctaatttttgtatttgttggtagagacagggtttcactatgttgaccaggctggaaacctttgtctttattacttttggacatttgtaacatagtgaaacagaatatatgtaaaatatatatgaagggatattctgaaaatagtatttcagaataacatttaatttttaccttggttttctgactcttaaaaagctgttggttttttagatgttctcattacccatttcactgataatgtaaatactgtagcttttactgtttcaagattaccttcatgttaataattaacaaagacctgtgacttggtataacaatagaaatttgtgttgaccttttgaaagcctttataagaatgtctcagtatatagtggactttggatatttgaaatggcaaaatattgcctgagttgtccaatgcttattacgcatgaggagtaatattaggagcaccattattgagcagttaccatttatcaggagatgggctcaagtgtattacatatagtacatctcatttaatcagcataatacatctcatttatctttacaacaattatgaagttggctttattatttctgttctacagctagaaaacaggctcggtcaagttgttgacggtcccatagctagtaatttcaaaactgagatttagtaatccagactgtacttcaaaatgtttgttagtaatctctgctttacttcctctttaaattcattttcacataaaaaacgtttcataaatataaaaattatttagggtgttcactttaaattgaatatgttattgtaaattgtaccatctctctctgagtgaaatactacttttaatgaggcctgaaagggtactttttaatcactgggttaaaataacagttgataaactatatgtgtttcttttgaataaaataataattaaatcatgattcctcttattttgagcatatcactcttctttttttttttttttttttgagacagagtttcactcttgttgtccaggctggagtgcaattgcacgatctcggctcacggcaacctctgcctcccaggtccaagtgattctcctgtctcagcctcttgagtagccacgcccggctaattttgtatttttagtagagacggggtttctccatgttggtcaggcaggtctcaaactcctgacctcaggttcgggagttggcctcccaaagtgctgggattacaggcgtgagccactgcgcccgaccacatatcactctttttttttttttttttttttgagacagagtcctgctctgtcgcccagactggtgtgcagtggcgcgatctcagctaactgcaagctccgcctccccggttcactccattctcctgcctcagcctcccgagtagctgggactacaggcgcccgccaccacgcctggctaattttttgtatttttagtagagaccgggtttcaccgtgttagtcagggtggtctgtatctcctgaccttgtgatccgcccacctgggccttccaaagtgctgggattacaggtgtgagccactgcgcctggcccacataccactcttttaacaaattcatactcttcctgaatacagagacacggttcttaatgcctgaaggctcatactcttacttttgggaatagaatcctttactgtacatgtctgaaaaccatgttttcgtttcttcaggcttaaaatttgattcaaagtatatgaatttcagagtgcgagcttgtaacaaggctgtggctggagagtattctgatccagtgactctagagaccaaaggtgagatcagtagctctttatacagcataaaacaaagcttaacatctgaagttattcataactttgtaacaggaagcacttcatgtgatgttgaattacttctctacttctcctagcctagctttctcaacagtaagaattttaagggaaaataggactacagtagtggttttcattgggttttcttatatgattttatttatacagataaaatagactgagatgatggtattgtattctctgggagatgcttaatttataaatttcaatcttgttataaataggtaagtatcactgagatttgcccagagttttcccatagaatggattatgaatcaatattggggaagtatctgtttagttcaggtcctctctgttttcctgtatcttattgcaacagttaacgtttatatagtttattaatggttacaaaacactttcaattctttattagataattaaagtcatcttgagagatcaatatgctagatattattgatacccatattgcagatgaaaaaatagagttttcatatattaaatgactttcccatgatccctagacctagtttggaaaggtgtgaataagaatccacttctgagttttgtgccagcccttactatgagcctggaacctaggttcttctagtctctgaaagcaattggggtttaatgaaaactccctagagtagcagacttgaatacagaggattttttagatatttaccaatttgaaggttataatgctggagactttcctagttgtgagatggttattgactgggtttaattccagaaccagactctacacattcttgtaggcacttgggacttaaggcattccactgacctctagttcatatagcatttgaataggtttacctgccagaaatttgattggatttggaggatgacaaaaaaaatcatataataaaacaaaatataaggcctataagttattgatgagacaaactcagaaaaatgtttgcatcacaaaggtctgaaataaagtctatcttgaagtaatttgtttggattagcagatgtttctatttgagaactataggtaacttagccaaggaatgcagttaactctgtattacatgttatcaaactgagatgttattgtggtttctgtagaggtttttaccattttaaaataatagtcatatgtaggcagataatcttttctatataacttgaactgtttttagcccatcaagtaaaattcattactattattcttcctcaagagcatcatatttttaaaatttcttttgtttcttttcatttactgttcatatttaatgaccaaagttggacctaaatgtggtgaattataatttctatgcaaatttcatagatacaggaaaatgaatcactggcttgtggttttcttccagctgggctggctgctcctattagcagtgattggatgttactggtcaaactcttaatcatggggtttgtagagagaaactaagttgattctaggccttttcagcacttcttcactgttgagtaaaccctctgcggtaggaatagactgaaactcaactctgagacccacaaaacagtgattctgaccttcagggagttccagaataaagttagactcctacatggccatgagtcacagattttctagggttattccatagcattagtggggctactaatgagagtaagagctgcagaggaaaagtccacatttttaccaatgacacactgaacagttgtttaccaatttatttggcttgttgcagcctttttcaaccaaccagtagaaattagggtatggacaaaaaactggagagaaaggaagaaaggtggagattgagtagttgagcctaccaaaatttcatatacttccacttaaggttcttgatatggaaaatagtgaacattgtttacttctgccctccaacatatgaagcactatttcttctggcattgaaattctcagaagtcatgagtaatataagttcttatcaccagaatatttagagtatattattagttattttcttgtgaaggtaaatgatattaaattactaaatcacaaattattctccaactttaattgatagcagctatgatataattttatagtaccaagaaagcagccactcgcacaagttaaacatatgaaacatatctgtactctgatttttggtactttgttttcacagactattaaagatacgggaaccagtatctagttatattataggacttatacaagagataggacctcacttttgaggctagtcttttttttttttttaactatagagtattatctctgttacattagaggagctctataacttaactgaggtccataaggggtagtgtccacaaagaaagagagatacgaaaatgacactccttaggcttgaaatccatgcctttttgtttggatgctgcagtatttaataagtatggtcttaagtggttttcaatggtactatctattttttttttttgccacctttgacaccagtattgctggtggcccttctctccagcataacaaacattaggggacagccttaggatttcttccttttttaaaaaaacagccttaggattttagcaagcagttgagaattggtggcaccttagagttaaatccaatattctttctcaaaaatgtagaagctctcacatgcattacctagtagctcacatatagatgttaactttattaaggcagttcattcttggaaatgcagggtataagttttacttaatcctaaccttttggtaacctgtctattaaggaattctatttctgtttttactaaaaagctgcatgattgctgcattatctcttttttctgtaagttcatttctgtttaaatgcagatgttgaaagctgtgaacttccttgtactgtatgacatttactggaagctctgtggtcagtagatttgtattcagaatgttgtttcataaataaaaaacaatgaacaatagctccaatgcatagttgaaattaaagtgctctttacagaacagtaggggataaaaggattattgattcattaggtaaacagttatgtatcatcaaacaaaataaacctatagagagtcatagttcacagacacactgaagccttagctaaattaagtaatatccataagtgaaatagggttctgtaaagggatactgtatttcttaatatatactagaagtttgaacctttggagggaaatagaactaacaggcagattagttagtaactgtgtaatagctgataccttgcaagatagagattccgagagttatattttaagataaaaggaatggtgtgattagccatgaatcagtacattctaatgatttaccctcagtttccaaggaaagaagcttataccttgcttcactgatttcctaaattcctaaagcagttctgagtaagtcttgtgaaaagtatagttaattcctcaaaatattaaataatctggaagtcatagttttatggtttttttttaaatttatgtggttcttttccctctgtactcttcgtcatgtaaattatctatcagctgggccagtttccttgttctgccatcacggcctcagtttctctatgtttgccttactttgaaactgacagtgtaggtatgaaattattaaatattagagtatcagagaaaatgtgtatgccaggttctataattttttacactatgtaattttatccttctccttaattcttccagttccccttcctatttagtcataacagtcaactgatatcctaataacaggaaatttaggttactgtgtactcattgagattttagtagaatgaacaggagaaatgtcagtgaccatgcaagtacattgtatttggttggtgtataggatatatagagaagaataatgggaaatcagataagaattataaattatagcctgattattgagaactttaagtgctaggattatgaatttgaactttattttctgtattcagtattgaattgattgagtaggaaaataatgtggtgatagctgtgtttcagaaagtggagatatgctatattttaaaaatatatttaaatattatcttgaatagcacttaacttcaatttggataactcctcatcccatttgaacctgaaagttgaagatacatgtgtagagtgggatcctactggaggaaaaggtcaagaaagtaaaattaaaggaaaagagaacaagggcaggtaagctagaccattaaatctgccatatggacaaatgcttgtacactggttcttatttaacaataacttttattgaaattcttagtcaatatacctatgagagttacagtatattagtagcaccaaagtgaagaatataatactatttgtcagtagtttaataggtcattaacattttttattacttttttttagtttcatccctaatcctcttacacattttcatttcagtattccatttctttaaagttatatatacagcaacttgaattgcttagaagaagtttctagtataattcctgaattttagacttatagatcacctatcttacctgcaggtctggtctgcactaaatgacagcgtttaataggtacaaccctagggtcttgcctctgatcagcaacacaatgaacctaagaggcaggttcaaggaccttttgttactgtcataactaacttatttaaataaagtcaaaacatgggatcctctttcttttttaatagaagaaatttttgctcaaactgaagataaatgccattgtgagttacagtaatgaatccccaaaaattcctcagcaggcctttaatctgatttcattataagctgttaaatttaagttgtaaaacagtttcttaacagttgcctgtttttatctgacagtgtccatgttacttcactgaagaaacatacaaggtgatgatctatgtctgtctagttctaggacttagtaaaatctagcttggctgattaaaaaaactttaattttatcttttaaccaataagcagaagccattgcggcagccttcataagctaaaatactgctctgtgtagactgtattggtagcttatgttttgaatttacattgtagtgtgctgcatattatttggattatattgtatatggtaacaaaataagctctgctttaaagtctttcttgaatttttttcccttatctgatttatttttctgcttttactcatacctggcatctttcttgttgtactgaataatattcgttagtctaacattatagcttcgcttttatttgtatttgacacacagcaggtttgaagagttctctgttttataataattaggcagtttcaggagcaacaaggataaaaaataaaggccattgctaaaattatcaagacagttccagaaagatgaatggtttcaatttgcatgagtaataatgtgcttatttgaagatactacatatctttactggaaaccagaatgtgttctcttttcaaaattatcttcctcttattttcagtttatgtacttgttattggtaaaagtgattttatagtgtattataaattggaaaatgctgaatttaatagtctatgagtagactacatatttatgatttaaggttatattatttctcccttcctactttttaagagtattttacgtataggctacttgtcgaatgttatatgcatttatatattctttccataaatatttgtttgctgtaggatgtctgctggatgttataggatttatagggataaacactgtctctgctttcaagaaatttgccctaacttatgtagatgagatgtatgtacaagtagcaataatgcaaggtagacatatgtagaattgtaagtgtgaataaaggtattcagaggaagaaagatgcccagagctgccagatgttgaggtggttaggtaggatagccaaactaaaggtaataatcaagcctttattgatttgctgtgatagtataagcaagaggccacaaaggaaagagtatccactaccccagtgttcaatttttcccaacagaatggcactgggtgaaggtcatgtaaatcaacacagatcacaagtagtggatcttctcactgccagcaagccccaaacaaaaaggttcctgccagtttatgggcctgagagtcaagaaggtggggagtgaggggctaaaatgggaaagatactaaaacagagtggagaaaagtgttttcagaccatcactcctcccctgacctctgccctaaagcagttttacgcagagacacctgaaaagcaactcagcctagggcctccctccagtaaggggacctctgaatagaggtgcctagggtaggattgcagatacggtatatgatcatgatggggagaagagtggaattgcaactctctctcgaaactacagtgcactagctgtgcaccaagtctggtgcgagaagggcagctcaccctaccctgtgcccccaccctgcctcatcaacgcccgcctacgcttgggcctgaaagatcacatacagggcacatgcgcgtcactagatggcacggctgtcttctttccaggagaatttcccaaggactgctggctggaagtttgtggctaatgtggagctgaccgtagtttgccaaattaagaaaacgcgccaggcattcttaggaagaaagatgtgccagatttgatctttaagatggctaaataggaacagctccagtctgcagctcccagcaagatagacgcagaaggcaggtgatttctgcatttccaactggggtacccggttcatctcattgggactggttggacagtgggtgcagcccatggagggcgagctgaagcagggtagagtgttgtctcacccaggaagtgcaaggggtcagggaattttctcccctacccaagggaagccatgagggacagagcctgaggaacggtgcactccggttcagatactgcacttttcccacagtctttacaacctgcagatgaggagatcccttctggtgcctaccccaccagggccctgggtttcaggcacaaaactgggtggccgtttaggcagacaccaaactagctgcagaaggtttttttttttttttccatactccagtggcgcctggaacaccagtgagacagaaccattcacacctttggaaagggatgctgaaaccagggagccaagtggtctggctgggcgggtcccacccccatggaacccagcaaactaaaatccactggcttgaaattcttgctgccagcacagcagcagtctgagactgacctgggacgctatagcttggtcgggggaggggcgtctgccattgctgaggcttgagtaggtggttttcccctcatagtgtaaacaaagctgctgggaagttcgaactaggtagagcccactgcagctcagcaaggccactgtggccagactgccagatttctcctctctgagcaggccatctctgaaaaaaaggcaccagcgtcagtcagggacttatagataaaacccctatctccctgggacagagcccctgggggaaggggcaactgtgggtgcagctttagcgacttaaacgttcctgcctgacagctctgaagaaagcagcggacctccaagcacagagttcaagctctgctaagggtcagactgcctcctcaagtgggtccttgacccccgtgaatcctgactaggagacacctcccagtaggtgccgatagatacctcatacaggaaagctctggctagcatctggcagttgcccctctgggacgaagcttccagaggaaagaacaggcagcagtctttgctgttgtgcagcctccgctggtgatacccaggccaacagggtctggagtggacctccagcaaactccagcagacctgcagcagaggggcctgactgttagaaggaaaactaacaaacagaaaggaatagcacatccactcaaagaccccatccgaaggtcaccaacatcaaatacagaaggtagacacatccacaaagatggggagaaaccagcgcaaaaaggctgaaaattccaaaagccagaatgcctgttgtcctccaaaggatcacagctccttgccagcaagggaacaaacctggatggagaatgagtttgacgaattgacagaagtaggcttcagaaggtgggtaataacaaactcctccaaactaaaggagcatgttctaacctaatgcaaggaagctaagaaccttgaaaaaaggttagatgaattgctaactagaataaccagtttagagaagaatataaatgacccgatggagctgaaaaacacagcacgagaacttcgtgaagcaaacaaaagtatcaatagctgtatcaatcaagtggaagaaaggatatcagacattgaagatcaacttaatgaaataaagcgagaagacaagattagagaaaaaagaataatagggaatgaacaaaggctccaagaaatatgggactatgtgaaaagaccaaatctacatttgattggtgtacctgaaagtgatggggagaatggaaccaagttggaaacactcttcagggtattatcgaggagaacttccccaacctagcaagacaggccaacattcaaattcaagaaatacagagagcaccacaaacatactcctcaagaagagcaaccccaagaaacctaattgtcagatccacctaggttgaaatgaagggcagccagagagaaaggttggattacccacaaagggaagcccatcagactaacagcagatctctctgcagaaaccccacaagccagaagagagtgggggccaatatttaacattcttaaagaaaagaattttcaacccagaatttcatatccagccaaactaagcttcataagtgaaggaaaaataaaatcctttacagacaagcaaatgctgagagattttgtcagcaccaggcctgccttacaagagctcatgaaggaagcactaaacatggaaagaaccattggtaccagccactgcaaaaacataccaaattgtaaagactatcgacactatgacgaaactgcatcaactaataggcaaaataaccagctagcattataatgacaggatcaagttcacacacaacaatattaaccttaaatgtaaacgggctaagtgccccaattaaaagacacagactggcaaactggataaagagtcaagacccatcagtatgctatattcaggagacccatctcacatgcaaagacaaacataggctcaaaataaagggatggaggaatatttacgaagcaaatggaaagcagaaaaaagcaggagttgcaaccctaatctttgataaaacagactttaaaccaacaaagatcaaaagagacaaagaagggcattacataatggtaaagggatcaatgcatcaagaagagctaactatcctaaatatatatgcacccaacacaggagcacccagattcataaagcaagttcttagagaccaacaaagagaattagactcccatacagtaatagtgggagactttaacatcccactgtcaatattagacagatcaatgagacagaaaattaacaaggatattcaggacttgaactcagctctggatcaagcggacgtaatagacatctatagaactctccacccgaaatcaacagaatatacattcttctcagcacctcgtcacacttattctaaaattgaccacataattggaagtaaaacactcctcagcaaatgcaaaagaatggaaatcataacagtcagtctctcagaccacagtgcaatcaaattagaactgaagattaagaaactcacttaaaaccacacaactatgtggaaactgaacaacctgctcctgaatgactactgggtaaataacgaaatgaaggcagaaataaagatgttctttgaaaccaatgagaacaaagacacaatgtactagaatctctgggacacattcaaagcagtgtgtagagggaaatttatagcactaaatgcccacaagagaaagcaggaaagatctaaaattgacatactgacatgaaaatgaaaagaactagagaagcaacagcaaacaaattcaaaagctagcagaagacaagaaataactaagatcagagcagaactgaaggagatagagacactaaaaacctttaaaaaaatcagtgaatccaggagctggttttttgaaaagatcaacaaaatagaccactagcccgactaataaagaaaaaaagagagaagaatcaaatagatgcaataaaaaatgatataggggatatcaccattgatcccacagaaatacaaactaccatcagagaatattataaacacctctatgcaaataaactagaaaatctagaatggatcaattcctggacacatacaccctcccaagtctaaaccaggaagaagtcgaatccctgaatagaccaataacaaattctgaaattgaggcagtaattaatagcctagcaaccaaaaaaagtccaggaccagacagactcacagccaaattctaccagaggtacaaagaggagctggtgtcattccttctgaaactattccaaacaataaaaaaagacaaactcctccctaactcattttatcaggccagcatcatcctgataccaaaacctggcagagacacaacaaaaaaaaatttcaggccaatatccctgatgaacattgatgcgaaaatcctcaataaaatactggcaaaccgaacccagcagcacatcaaaaagctatccaccacaatcaagtcggcttcatccttaggatgcaaggctggttcaacatatagaaatcaataaatataatccatcacataaacagatccaatgacaaaaaccacatgattatctcaatagatgcagaaaaggcctttgacaaaattcaactccccttcatgctaaaaactctcaataaactaggtatcgatggaatgtatctcaaaataataagagctgtttatgcaaacccacagccagtatcatactgaatgggcaaaaactggaagcattcactttgaaaaccagcacagagggagagagttgtgctgctgcctccgagagctccaccttcgtggctctggatccggggccccggcctgtggcggcgagcggcggccgctggagacgagcggcggcggcaggcggccagcccgggtctacctcgctccgtgcagggccgggagagggatccgccatattggagctggggccgaaggtgccttggagccgcggcgcgaggcgggtggaggtggcggccctggcctggatcggggaggagtcggctctgccctggcccgcaaggctggggagctaatgagcctctctggctagtctcctccccgtccactccctccactttctgccgctgggagccggctgtggcagtggcagtggcagtggcagtggcagcggcaggatgttctccaagaagccgcacggggacgtgaagaagtccacccagaaggtgctagacaccaagaaggacgcactgactcgcctcaagcacctgcgcatcgtcatcgagttaatggtggaactggctgaagaagatgcattcatccagatgcctgaatcctagttcagagtttatctcgagctgtcttcctgatgcgtatttgttttggaaagtgatgtttatttagtgaaaaaaagaatgcagaatctattgatcttaaacagtttttcgacaacattttttacatatatactatgtgttctttgaaaattttgtgactatcgaagctagtcttaaacagaaaggtcacaagtctcaaagagaggaactggatgctatactttttatttttgagaaaattttacaacttcttccagaaagaattcatcagccatggcagtttcataatattggattgatttaaagaagctacttcacacaggagactccttaaagattaggcgggaaggtgttcgtcttttcttactatggttgcaagctcttcagaataactgtagcaaagaacagctctggatgttttcatgcttaatccctggattttcagcaccacagtctgaacatggacctcgaactttagataatctcattaatcctccactcaacctttaagaaactcaagtcactatagaagaaatcactcctcttgtccccccacaatcaggagataaagggcaagaagatctcacaagctattttcttgaagcacttctaaaatacatagtcattcaggtaaaaagtttagaatggaagaacaaagaaaaccaagaaaggggattttcatttttgttttcacattttaagaaatattacttgccttatatttttccaaacatctgtaaggaaaacagtttatatcatcctatacttgacatcccgcagatgagaccaaagccacattatgtcatgataaagaaagatgctgaaaccaatgaagcaatctattgtacaaaggagcctttcattaaggctcgtgttattgtcattcgttggctggtttctttctggctggagccaaaaccacatacaggacctcatattcctgggatggaaggtgaagtcttgccaaagaatattcagagagcagctgctagtttagtatccagagaagaaagcaaaaatgataatgctgataaagcagacagaactacagaacccgaacagtctcattccaatacaagcactctcacggagcgagaacctagctcatctagtctctgtagtattgatgaagaacatctcacagacattgaaatagttcgcagagttttttcttctaaaaggagtaatgtaaactttgtgacagagatatttcgtcaggcatttttattaccaatttgtgaagcagcagctatgagaaaagtggtaaaagtatatcaagaatggatccaacaagaggaaaaacctttgttcatgcaagagcctgaagaaattgtgatcacttcttcagacctcccttgcattgaaaatgtcacagaccatgatatttcaatggaagaaggagaaaaaagagaagaggaaaatgggaccaatactgctgatcatgttcgaaattccagttgggcaaaaaacggctcctaccaaggtgctcttcataacacctctgaagaagccacagaacaaaacatacgagctggtacccaggcagttttgcaggtgtttattataaactcatcaaatatatttcttcttgaacctgcaaatgaaataaaaaatcttctggatgaacacacagatatgtgtaaacgcattcttaacatttatcggtacatggttgtacaagtatcaatggacaaaaagacttgggaacacatgctgcttgtgttgctcagagtcacggaatctgtactgaagatgccatcacaagcttttctacagttccaagggaaaaaaaatatgaccttggcaggtcgacttgcaggaccacttttccagacccttatagttgcctggatcaaagcaaacctaaatgtgtacatctcccgagaactttgggatgacttactgtcagtattgtcatcgttgacctattgggaagagttggccactgagtggtcactgactatggagacattaactaaagttttagctaggaatttatatagtttggatctcagtgatttaccattggataagctgagtgaacagaaacaaaaaaagcacaaagggaaaggagttggacatgaatttcagaaagtttcagttgacaagtcattttctagaggatggagtcgtgatcagcctggccaagccccaatgagacagaggagtgcaacaaccactggttctccaggaaccgaaaaggcgaggagtatagtacggcaaaaaactgtcgatattgatgatgctcaaatacttccccgctcaactagagtcagacatttttcacaaagtgaagaaactggaaatgaagtttttggtgctttgaatgaggagcagccattgccttgaagtagcagcacttctgacatcttggaaccattcactgttgaacgagccaaagtcaataaagaggacatgagccaaaaactgcctcctcttaatagtgatattggcagcagcagtgctaatgttcctgatctgatggatgagtttatagcagaatgacttcgaagtggtaatgcctcgactatgacaagaagaggaagtagtccaggcagcctggaaattcccaaagacctccctgatattctaaacaagcagaaccagatgcgccctattgatgacccaggtgtgccctcagaatggacttctcctgccagtgcagggagcagtgatcttatcagctcagatagtcattcggattctttcagcgctttccaatatgatggccaaaaatttgacaattttggctttggagccgacactggggttacgtcctctgctgatgtggattcaggttctggccatcatcagagtgctgaagagcaggaagtggctagtctaactactcttcatatagattctgaaacaagcagtcttaatcagcaagctttctctgctgaagttgcaactattactggttcagaaagtgcttccccagtccactcacctctgtgctccaggtcacagactccttccccttctacattgaatatagatcacatggaacagaaggatctgcagctcgatgagaagctccaccacgctgttcttcagacaccagatgatctagaaattagtgaatttccatcagaatgttgtagtgtgatggcaggaggtactctgactggatggcatgctgatgttgctactgtaatgtggcgaagaatgctaggcattttgggagatgtaaattcaatcatggatcctgaaatacatgctcaagtttttgattacctctgtgaactttggcagaatctagctaagattagagataacctcggcatttcagctgataacctgacctccccttctccaccagttttaattcctccactgagaattcttacaccttggctttttaaggcaaccatgttgactgataaatataaacaaggtaaattacatgcatataaacttattggtaatacaatgaaaagaagacaagatgtttctccaaatagagattttctaacacatttctacaatataatgcattgtggattacttcatattgaccaggatattgtcaatacaatcatcaaacactgctcacctcaatttttttcacttggtttgcctggtgccacaatgcttattatggattttattgtagcagctggtagagtggcttcttcagcttttctcaatgcaccaagagtagaagcacaagttcttctgggatctttggtttgctttcccaacttatattgtgaactgccttctcttcatcccaacattcctgatgttgctgtgtctcagtttacagatgttaaggaacttataatcaaaactgtattaagctcggcaagagatgagccctctggtcctgcacgatgtgtagcactttgtagtttaggtatttggatttgtgaagaactagtccatgagtctcatcatcctcaaattaaggaagctctgaatgtgatttgtgtttccttaaagtttactaataaaacagtagcccacgtagcttgtaacatgcttcacatgctggttcattatgtacctagacttcagatttaccagcctgattctcccttgaaaattattcagatcctaatagctaccatcacccatcttttaccaagtacagaggcttcatcttatgaaatggacaagaggttggtagtatctttacttctctgccttctggactggatcatggccttacctctaaagacactgctccaaccatttcatgctacgggagcagaaagcgataaaacagaaaaatctgttctcaattgcatttataaggttttacatgggtgtgtttatggagctcagtgttttagcaatccaaggtattttcccatgagcctctctgatttggcatctgtagattatgatccttttatgcatttggaaagtctgaaagagcctgagcctctgcgctctcctgactcagaacgatcttctaaactccagccagtaacagaagtgaaaactcaaatgcagcatggattaatctctatagcagcccgcactgttattacacatctggtaaatcacctgggccattatccaatgagcggtggtcctgctatgctaacaagtcaggtgtgtgaaaatcacgacaatcattacagtgaaagtactgaactttctcctgaactctttgagagtccaaatatccagttctttgtgttaataatacaaccttagtgtcctgtatccagatcagatcagaagagaatatgcctggaggaggtttatctgctggccttgcatcagccaattcaaatgtcagaatcatagtacgtgatctctctggaaaatattcatgggattctgctatactgtatggcccacctcctgtaagtggcttgtcagaacctacatctttcatgctttcattgtctcaccaagagaagccagaagagcctccgacatctaatgaatgcttagaagatataaccgtaaaagatggactttccagtttaaaagatttagagaaactgtaccaacttgggatacaataagagatgaagaagatgctcttgatgaactcttgcagtatttgggtgttactagtcctgaatgcttacagagaactggaatctcacttaatattcctgctccacaacctgtgtgcatttctgaaaaacaagaaagtgatgttattaatgctatccttaagcaacatacagaagaaaaagaatttgttgagaagcactttaatgacttaaacatgaaagctgtggaacaagatgaaccaatacctcaaaaacctcagtcagcattttattattgcagattgcttcttagtatattgggaatgaattcctgggacaaacggaggagctttcatctcctgaagaaaaatgaaaagctacttagagaacttaggaacttggattcaaggcagtgccgagagacacacaagattgcagtattttatgttgctgaaggacaagaagacaaacactccattctcaccaatacaggaggaagtcaagcatatgaagattttgtagctggtcttggtttggaggtaaatcttacaaaccattgtggttttatgggaggactacaaaaaaacaaaagcactggattgaccactccatattttgctacctctacagtagaagtaatatttcacatgtcaacaagaatgccttctgattctgatgattctttgaccaaaaaattgagacatttgggaaatgatgaagtgcacattgtttggtcagagcatactagagactacaggagaggaattattcccacagaatttggtgatgtccttattgtaatatatccaatgaaaaatcacatgttcagtattcagataatgagaaaaccagaggttcccttctttggtcccctttttgatggtgctattgtgaatggaaaggttctacccattatggttagagcaacagctataaatgcaagccgtgctctgaaatctctgattccattgtatcaaaacttctatgaggagagagcacgatacctgcaaacaattgtccagcaccacttagaaccaacaacatttgaagattttgcagcacaggttttttctccagctccctaccaccatttaccatctgatgccgatcattaaatatcagttctgtttatctgaaggctcctacccagagattctacccagtgaaactcccacagcagcgcaggtagatggggctgacctggcctctccaatgtctcctcgaactagcaaaagccgcatgtccatgaagctgcgtcgttcctctggctcagccaataaatcctaaggagacaagcagcccagcagtgatcagcagtagccaccttagcatgaacatagggttaaccctttcaggccttcatgtctgccataacatgcatgtttcttcctgtacatttatttgagaaaacactggatttaaataattttaaataatttgtagcttaatattaaagatttaagttatttattgtttcatttttttcccacaatccaagctgccatattttgagggcagggggagttttattctacaccctttaccttcctagataattatgtctaagtagttttatctttaatttcatggttaactgtgagccaaaatacaattggacaattagtctcattatttattgtgctccattgcaactttatggttcaataaatatataattttttacaaatgtaaaattttacatttaagcatttgtaaagttacagcaaaagatgtacctgttaatacacagaatgtgtacagattatttgttatgacaataaaacactcaaaataaatggtctttagcatctcaaattccaactgaaatcattttagtattaactcttcttcccaaagcaatgtctcatttcttggctgtgcaggtgatgccatgttatatccaataactagaaaaatcactgtgctgaacttttatgtttagcttccaagtatttttctaatgttttgcatttcaagtggtatcactgttaaatgccatttgttttcagattgtggccttttattattggctgctagatcctggtgtttctatgttcttttttaagcaccaaaaagaagatggggaagaaaagaaggaaaattttctgatataaatatgttgttcaaattatgagtactatttaaaaaagaaaaaggaacctaacccaggagtctaagttaaatctaatattgttaatactgaacttgcaggtccaggttggtatacattccaccctctagaagtattttcttacagtagataagctgctcacattttgttttgaatgggcatctcctgaggaaatgtagcatgatattggtactaactgcatgtgtaaatacatcatactggcaagccgtaaaatataaattatgtatcattcacgtagtatctataatttgtaacagtggggggaaaagatgacatggtatttaataatacaataaaaatattcttatcaaaaaaaaaaaagaaaagaaaaccagcacaagacaaggatgccctctctcaccactcctactcaacatagtattgaaagttctgaccagggcaatcaggcaagagaaagaaataaagcgtattcaaataggaagagaggaagtcaaattgtctctgtttgcagatgacatgattgtatatttagaaaaccccatcttttcagcccaaaatctccttaagcttataagcaacttcagcaaagtctcaggatacaaaatcaatatgcaaaaatcacaaacattcctataccccaatgacaggcaaacagagagccaaatcatgagtgaactcttattcacaattgctacaaagagaatacgtaggaatacaacttacaagggatgtgaaggacatcttcaaggagaactacaaaccactactcaaggaaataagggaggacacaaacaaatggaaaaacattccatgctcatggataggaataatcaatatcgtgaaaatggccatactgctcaaagtaatttatagattcaacgctattcccatcaagctaccattgactttcttcacagaattggaaaaagctactttaaacttcatatggaaccgcccgcatagagaagacaatcttaagcaaaaagaacaaagctagaggcatcatgctacctgacttcaaactatactacaaggctacagtaaccaaaacagcatggcactggtaccaaaacagatacatagaccaatggaagagaacagagacctaagaaataaaaccacacatctacaaccatctcatctttgacaaacctgacacaaacaagcaatggggaaaagattccctatttaataaatggtgttgggagaactggctagctatgcagaaaactgaaactggaccccttccttacaccttacacaaaaatcaactcaagatggattaaagacttaaagataagacctaaaaccataaaaatcctggaagaaatcctaggcaataccattcaggacataagcatgggcaaagacttcatgtctaaaataccaaaagcaatggcaacaaaagccagaattgacaaatggaatctaattaaactaaagagcttctgcacagcaaaagaaactgtcatcagagtgaacaggcaacctacagaatgggagaaaatttttgcaatctatccatctgacaaagggctaatatccagaatctacaaagaacttaaccaaatttacaagaaaaaaacaaccccatcgaaaagtgggcaaaggatatgaacagacacttatcaaacatatgctaacaaagatattaaaaaaaatgctcatcatcactggtcattagagaaatgcaaatcaaaaccaccatgagataccatctcacgccagttagaatggcgatcatgaaaaagtcaggaaacaacagatgctggagaggatgtggagaaataggaactgttctacactgttggtgggagtgtaaattaattagttcaaccattgttgaagacagtgtggcgattcctcaaggatctagaactagaaatatcatttgacccagcaatcccattactgggtatatacccaaaggatttataaatccttctactataaagtcacatgcacacatatgtttatcgggtcactattcacaacagaaagccttggaaccaattcagatgtccatcaatgatagactggataaagaaaatgtggcacatatacaccatggaatactacacagccataaaaaaggatgagttcatgtcctttgcagggacactgatgaagctggaaaccatcattctcagaaactatgacaagaacagaaaaccaaacgccacgtgttctcactcataagtgggagttgaacaatgagaacgcgtggacacagagaggggaacatcacacatggggcctgtcggggtgggggtctagaggtggaatagcattaggagaaattcctaaggtaggtgaccggttgatgagtgcagcaaaccaccatgacacatgtatacctatgtaacaaaactgcacattctgcacatgtaccccagaactttaagtataataatattaaaaaaaaaagagaaaaaaaatcacacacaggatttgggtctggagcaagagtcctgagacaggttatttaacctgttagaatttgggggactttcattaaagaagtggtatttaggccggttcttgagcaagtgggaaaatgtatggttgttagacttgcagtgaaaggcggaacagccatagcaaaggcactgaagcagatggtgtgagtttaaacaacattttgactggtatatttagctatatagtgctctctaggagttagaaggctagaaaggcagattaggactaaatcaagaaccagaatgtcatgctaagtcgtttgtaagtagtatagaagtaaatgatgatttttaaatagaggaatcagagtaagctttatcttgtaataatgaaaaagatgaattggacagtaaagaaattatttgggaagctggtaaaacagtccagactagaggtagctgaagaggcttacttaaattcagatagttaagtggtcagggtgtcctttagggaagtggggtgagggaggggatgggaggagatcatgcttgacataaaacttattataagttgtttcttgcaaaagtgacttaggattggaagtctggaatgctgcaatggaagagttttccttacttaacttttctctgaaattaaactgccaatgtcaatagttatgtctgtttttcttttctccatgcttccctttatttctttactactggtaagttacaaatttttaaaaattgtttttctgttatcaaaagagctcttaatacattttgaagcagtgctaagtgaaatttttctctttatttgtatgacgttcactttctatttgttgccctgagttacttgggaaatatttttcagaatgcatgtttcctctcagcagacactctgaccaccagttggggaggcaaactatcagtgtattttgaaaaagtttcctgattgtttctgaatctgctgtgccttttcagttgacaatcattgatttattacaaaatgccaaaggcctttgttttttcaatttagtactttggctcaggaagatacaggtgttccttaattgatagtatcacatactctactcagctgagctcattctagtcagatattgtacacctactctgtactgaggatacagagatgagatgtggttcctagcaacagttagttcccttccctcagctactccatagccaagttcctcacttgccgtaaccaataagcgctaagcatgccgtatgatagatttgtaaaacctgtcttttcatcacccttttaatccctactccttgatagaggagttttgctttgttttacctcagtggctcctagcccagatgaacagcaaaatcctgaaattcttaatttaaaaaccagacatgtgtttctcaagcctaccctccagtatctgatttagtagtttatggtaagtcctggtaatttgcatttttaaaaggtccccaagtgattctgatgtgcagctgggttgaagaaccactggtttggttcatttaattcctcctcactcctgattacacatttactttaacctctcctctcctttcatttcattcttacctagttacccaaaacaaaatcttgttgactttctttgctctgtttcttagctgaatagcaaccatagtcatgattgttaatggtaagatagtactagcaatactaaaaagcactggggcttaaagtgaagttagatataatgaagagctagtgttctcaggttattgtatcccatcttccttctctagttacaaaagtaatttttacaaatactgacgtgattaattaaaactgtgttcatttttgtatagttaccaatatttgctgttgaataacttgggtggaggaagattaatgtgcagtcaatttatgaattggtgacttgatgaattgggtaatatttggtgacctctgcactcattttttctgggagaatgtactttcatttcagataatgtcacatgaacttttggagaataactgtcaaccacaggaagttcttttattatataggtgttctggagacctaaaagcttttttgttataatttatataccgtgttgaaacaattttactttcgccctcttccttttcatgtcttcttttaatgttgcatctaaaacattgttttttcacacctctttttaagaaaagcaacagcatggtttctttcatgaaatgtttccagaagcctgatccaaaaagagaaaagtatagctggttaaaggagggaggaagccctaaatctggcttcttcccagagtacctctgtggcatctgtggattcccttgagttcagcacatggtttaaacaccattgatttcaagagtctttgcccctcacaagatcaggaaaatagagctgcatgtactatttttttaaactttgaggcaaatgtaatgttatcttttctcctgagcttaagataaagcttttgaaaacatacagaccttttgtgatcgggcttttaacattctctatcagcttgtataaaatgaatcagaaagaaaattatgatacagttcttttttcctgagttatcagttgacaatgtttgcagttttactttcttactatactagttaatgactcttacaagtattgtataagatcagcttagaatacatgttcatctcaaaccttgaagaagtgaaaacatatatttttggtattcagaataaaaagtataaatgtttaataatttttatttgtttctatccttcattttggagatctcaacaactattctggaattttcccccctcacgttctgttttgctgtccccgtacccaatagcaagaaactactgcctaccttagcacaagtttcacagaaattttaatctacctatccacattcagctttgctcatgctatctgttcaaacagaacttatagtcagtttttagttgtctttttaaagaaacatctttacacaaaggacctttgaaatcccttgggaagaattaaactaagtcatgtgagtgttgtagttctagacttacacttttgctacttaatattatacactaaaaaggagacagttgaagtggtcctgagttctttgaaattgtctaataagtctgatttctgacagcaagacatttaaataatgcagaatgaagtcactgagtcatatgaaatgaatcatatgaaatgactttaagttttatctgtattcttgctttgccatcagggatttctagtctagtattggtagcttatattaaaatctactcagttgatcttttcttaggaagaaaatttctagtgctatgttagaaaaaagtgtttttatttctaactagtggtgagaatatagttatccccatatcccccaaatacttttaggataatcttgaccaaaaaatcttttgttaaatgcagtaattcaatataattaaaatgtttttgaaaacatctttgggactgaatctgttttgagtttttgaatgttagtaaacatcccaatactccagttttccatatatcatataatttgatataagaggaagtcaaggtggatcttgtctatttgagtaggagaaatgcttgataatacttgatattatcctgtgcaaggatttggataattgccatttccatcttttttttttttttttttttttttgagatggcgtctagccctgttgcccaggctggagtgcagtggcgccatctcggctcactacaacctctgcttcctgggttcaggcaattctcctgcctcagcctcccgagtagctgggattacaggcacccacaaccacacccagctaatttttgtatttttagtagaaacggggtttcactgtgttgcccaggctggtctcgaactccagacttcgagatccgcctgtcttggcctctcaaattgctgagattagaagcatgagccaccgcgtgcagcccccccgtccctttttttttaagacagagttttgctcttgttgcctaggctggagtgcaatggtgcaatcatggctcacccgcaacctctgactcctgggttcaagcgattctcctgcctcagcctcccgagtagctgggattacaggcatgtgccaccacgccctactaattttgtatttttagtagagatggggtttctccacgttagtcaggctcgtctcgaactcccgacctcaggtgatcctcctgccttggcgcctcccaaagtgctgggattacaggtgtgagccaccgtgcctggccgccatttctatttttaagaaggtaagattcagagcaaaaatactcactgcttataaaaagagttatttagtcaggattataagaagaaacctatttttgccttcatttaactgcaaaaaaatgtaagctgtaactcattatctttcttgagttcttttttttctttagtaaatcttgtcacattttagcattgtttcttatttcagccgtgtattctttgtataagccttgctcagtctgcatgccattagtgttttcagcctgctttgtattgatagcttcttacatttcagtgtttataattgacagcgctctttaattaactagttcagatcaaattgaatggtgttatttctataacataattagaaatcttttcagaggttccttccatgatttctagttttagtttatgaaacatttacagtataaaatatttgtttttcttttttctttttgtttatatagaagtggtacaccatccccaaaacgaacatctgtaggctccaggccaccagcagtaagaggcagtagagatcgttttactggagaatcatacacagtgctgggtaggacaaaacataattgtttttcattatctcagattaaaggcatcacaatcacactggtggactttccactcaaagtgactgcctgtatattgaataaatctttgcaagaaatttctcccaattgaagcctaattactttggggagttttcagattgtcttattattattgatacttttaaaactctacttcagcttacgtagtgttcccacatctttatatataagccgggaggggggatagtaaggaagaaaacctctgaagcgttttatattcaagaatagtactaaacgtaaaggtaaagttagagcaggtactcagcatttaatgtctgtgtgttaacatgattattcttataggaaaagtacttgaataaaaatttttgtgtctttttttgggacgagtggtaggtaaaactgtgtgactcataaggaagagatgagtcaaatctacctttctgatcttttgtaggagacactgctattgaaagtggacaacattattgggaggtcaaggcccagaaggattgtaaatcctacagtgtgggagtagcatacaaaacgttggggaaatttgaccaattgggaaagacaaacactagttggtgtatccatgtcaacaactggctacaaaacacatttgcagcaaagcataataataaagtcaaagctttggatgttactgttcctgaaaaaataggtgtattttgtgattttgatgggggtaagtttattttctcgtaggttatttcatcatagttgcttgcatttcagtacctttcactggtaatcatctatacaggatttccattagtattgtgggaaggacattttgatcaggtaggcttttgattgcaatcataatctcaattctagaattgactggaatggtatatgtgatgtctgcctggagccctataaaagcactcatttataatatactaagtctgaaagattttgctaattttagtcttcagcactaacatttcttctgtccattttaattccttccttaccatgttttattacctacctctaaagagtgatagtcaaaattttctagttgaagtagatcttagaaattacccaacccaggatgaataccccattttacatgatgtgattattacacattgcatgcctatatgaaagcatctcatatactgcgtaaacatacacacctactatgtacctacaaaaattaaaaaaaaattcaagaagataccagagccatattttctactatcctagtaaacataagctatacagcaaatatttactgtgccaaaccgcatcacacttgaaacgaatggaatgttcttaattttcaagttgctgtctttaaaaatattcttcagaatgactcatgatatctttagaggggccaaaggggtttcccctcaatatcagaatttctttacttacaaaattattaacacagtgtagtctaatccaaaaaagaaaagaaattactccatctgccacacagtatacagttcttagtacactatctctgcaggtagttgccacttatgtgcctgaagaacttttaatgtgaagtttactgtcttagaaagcagcctgtttcattgttggacagctcttggttagaagatttttcttaagttgactcacattgtttcccttaaattttcccatctgaataaacacagaattacgtttcctcactcatgttcacacgataatcctttattaaaaactttcttgccctgtttttccagaccatatattctgttattagctgcccctgttaaaatttaatttttccaagtctttataatctcctatggctgtctagtatgtcagtgtttttcttaaaggttggtcttagagtggaacacatgacctctgaccagcaaaggacagtaatttggctatgctatttctaatagtatgacttagcactgctgatcaatattgagcttgtagctaccctaatccattagatcttttttcacggcattatgtcaaattgtctttttcttttgttaggcagtttatggttttggttttttttgttttgttttgttttgtttttgagacagagtcttactctgttgtccaggctggagtgcagtggctcagtctcagctcactgcaacctctgcctcccatgttcaagcgactctcctgcctcagcctcctgagttagctgggattacaggtgcatgccaccacgcctggctaatttttgtatttttagtagagacggggtttcaccatgctggccaggctggtctcaaactcctgacctcaagtgatccacctggctgggcctcccaaagtgcagggattactgccatgagccaccacacccagccagtttatggtttttaaaaataactcaatgttatatgtaatgcaaatgaagactattacatttacccttttttagtttcatcttaatagatttggcccaaatttcccgtcttaaaattatctaaaaatttacttgatatttatattttgaaaaaattttaaagctcattgaattagttatttcataagcatattctctacagtcatctaatgtataataattttgaagatgacataatattgaactaaagtaattccctagatgttttttctccaagttgacacttaagctaataccaaattttattattttagtaatattgtgcccaaataattccgtgagctgtcagttaatttactcaaaaaaggagaaaaagtaattttggcttgatttatttttagtgatgacatgttagctttgctgtgttttttgttttttaacttattcaccttgaatcagttaaatcattttcctcaggataaatggcaaatttattagcacacatttttttttcaactaccaagacaacatttgcttcttctctctcctttcccatactctgtgagtccataaaggtagtagtgagatacagtttttagtctagaacataacgtatggcaaggggaagttgtactgtggaataggatcagattctgagagccttgaaaaataataatggactggtcttcagtagtggggaggggtggttctgcatgttttagaacactatagtcataagataattgagttttagaaatattagagagtcagtggttaaagatggaagagatcgaaagcatagcaagcataagacttttcgggaagcagtcttcaagtggtgtagagcaggactgagtctcttgttagctattaagcccttattgcctggctagtgcttttcacatagaaagcccttaataagtgttgagtaactggcaacaagcatctgagcagtggagaattaagaatggatttgacagtgtagaagtagaattcataggacttagtaactaaatacagatcagctgaggacagacagttgaagatgactttgaggttccagccagtgtgatcaagaggatgacagtgtcaacaggatagggaacatagagttttggggggaaatgaaatgccagcaggataatcatgtggcatgtttagcaagcattttgaaattcagtgctagaattcagcagttaagtagagctgacattaaatatttgagacagcattacagaattgctatggaagattgtacaggacaatatatttaagcattactattctgctgtttactaactttgtgatcatatgtaccgttatgctgtttaccaacttcgagatcaaagtactgggtactttacatacattacctcaaaatattaaacaatctacataataatgtgcataaatattagtttattttatcttcctctttggtggcagttgatttattaaggaagcattatataaagaaaagagagcatggacaaagtggctacatttagaacaggaagaaaaggaggagatggtgaagttatccccagggttatgatacaaaccaagggaatggtcatcagagaagagtttcaagaagtgataacagctgtaaggaggccatttggttggccagtttaggaggtcagacagacagttttttttagggcatgatcctattgaaggatatactgtgaggtgattttaaaaattaacaaagcaggtcaggcatagtggctcatgcttgtaatcctagcactttgggagactgaggtggaggattgcttgagctcaggagttcaagcccagcttatacaaaatagcaagaccccgcctctgttaaaaaaattaacaaaattgaagcagtgatagatatattgtgattttagagactggagtatcagtatcgcatcaggtagatagaagacaaggtttaatagagtaaaccttaaatggtgattagaatttgggcagagaggctggttataggaaaaataaggaggaagaaatggccttggtttacactgggctaatgaaaccatttgttaaataatgatcaaataaggaaatagtttgtattaaataagtcgaatcgtgctagattatagaggtattatagaggtcttgaaaaccaggggaagaaaattggattgggcttttccttaagcatttgtccttctgattttcaagtgagaataattaatccagtcctcatacaaaaattaatgccaacttatatattattactttttgcatgattatgcgttagaattaattaaatgttacaattttttgtataataaattaggctttttttccttcttttttaggtcaactttcattctatgatgcaaattctaaacagttgctatattcctttaagacaaaatttactcagccagtactacctggtttcatggttagtatgttttatatcttatatatacctaacatattttacttggttggcaactttaaggagaatattctatactgtatatttggagaaggagaatattttgttttttcttcatattctcctccatttccccaattcaccctctcccaaatctgtgattgtttttatatatttttggtatattttattgaagtttatgttaatacatgaagtacacaaatcatgtagtttgatgagtttttataggactgcactcatgtgtaactagcacttagaacattacgagaacctcagaagccccctctagtgcccatttccagtccctaatggcccttctccagtgttagcactgtattgacttttaataccctaaatttacttccttttcagttttatataaacagaatcatacagtatctttttgactcaacattatgcttgtgagattaatccatattctatgtggttatagttcattcattctcatagctgtatagttttccattctgtgactatatcaattgatttataaattttaatttagttggatatgtgggtggtttccatttgggggctatacaaatagaactgctatgaatacttttgttcatatcttttgataaatgtatgtgtatatttccattgagtatatacctatgattggggttgctagatcatatcgtatatgtataatcaactgtaaaattgccggttttctgaaatggttggttatgctaatttacaactagcagtatgtaagaatttgagttccttcaaatccttgtcaacacttagtattatcttttaaaaaattttttgtccttctagtggatgatatattacattttggttttaatttgcatttccttgattactagtgctgttgagcacctttttatatatttgttgactatttgggtatatgcttttgtgaactggctattcagatcttttgcttgtatttctattaggttgtcttcgtgtttcttatgggttaatttgtaggctcttcttcactctggctttcctttttccttattggtattgtttgataaacaaaagttaattttgttcagtttatcaattttttcatttacagttagcactttttgtgttctgtttaagaaatcagtatgcacccccaaggtcatgaaaatattcttctaaaagctttaccttgtacatttagatatagactgcatttacaatgcaagtacaatgtagaattgatgtgtttggtatgaagtaaggatctagatacgttctttaattccccatggatatccagttattccaggaccatttattgacaagatcatagtgcagtgtcatctttgtacaaaatattagatgactgtctttgtgtgctatgctgaatatatgtatgcacaccacatagcaattacatcctgtgtaattgcaggtctactcaatttcaggctgaaaagaaaaatttgtttctctgcacaaaataaaacatggttttgaatttatttaagcaaatgttattgctttttccaactcataaccttctgcatcttttcataggttaggttcccgtggggagttgtgggatccagttaaagttaccattactttggctagagcttttcttaaatttggaggctacctctataagtcaagatggtatatttcaaatggaatattttgcatgtatattcttctgtcatcacccctaactgtaacttctcaactataaggagaaagttttcagagtaagagtgggttgaaaatacagtgcttttaaatctcattatccatagtaattatttattccagatactttaatctcttaagtttaaaacaatgctaataaccaggacacctatttttacattaaaagtaagtgattagtgactaaagttattgctcatggaaacataaagatactggaagggagggttgtttctttttccttttttttttttttttaactttgtacaaacctctgccatattacgcatttttggctatttttccaaactggtccatcaaggatgagttgtttaccatgtggaatgcagaaaaattttttccaagacttaggtgtgcttttataaatagtagatttacttttaatttgaatctatctcatgtatgtatgtactgagtttattgtttttcattccaaataatactctaattatattagtatatgtcataagatactgcaagaaattattttaagcttgttaaaattttttttccttcattgaaggcttgcttttattaagtacgttaatgcctattaaatgttttgtgtacaagattaatttttaagtcagttttattgaatttatagtatggtgcagttctgtggtttttagcaaatgcctgcagttgtataaccaccaccataatcaagatatagaacatttccatcaccctagaaaattcctttgtgttcttttatagtggaccgttccacacaaccagccctagctatcagtaaccagttcgtaggccctatagttgtaccttttccagaacatcgtataaatagaattgtatggtatgtagcctttcgattccgtaccatgctgcatttgaaattcatccatgttgttgtggtgtcagtattctcctttttttcattgctgagtagtgtttcatatatgtatgtatcacagtttattcattcattcaccagttgaaagacacttgggtttttcccagtttggggcagttatgaataaaatcactataagcatttacatatgggattttcccttgggtaaatacctaagagcagtaatagagtagctgtatcacattgaaagtgtatgtttaacttcatggggaactaccaaaatgttttccaaagtggctgtaccattttttgccttcctatcagtgatatgagagttggtcatatccttgccattatttgatattaccagattttttgttgttgttaagccattttaataggtgtgtagtggtatgtcattgtgtttttatttgtagtttcctaatgacaaatgatgtttcatgtccttatttgccattcatataatttatttcaagtatctgttaaaattatttgcttactttttaggacttaattgttttcttatttttttattttactttatttttaagacagggtctcgctctgtcacccaggctagagtacagtggtgcgatcacagctcactgcagtcacaactgcctgggctcaagtgatcctcccaccttagcctcccgagtagctgggattacaggtgcccaccaccatacccggctatttaaaaaatgtttcttgtacagatggagttttgctatattgcccaggctggtctcaaagtcctgggctcaaatgatccaccagccttggccccccaaaatcctgggattacaggcatgagccactgcctggttttcctgtttttaagagttctttataagtttggatgtgaatcctttgtcagatatatgctttgcaaatattttctcctggttatggtttgcattttcattttctgaacatttcagagagaagtttttcattttgttatgaagtccaatttggtaatttttttccctattatgggtaatgctttgcttaactcaaggtcacaaaggttttatgttttcttcttgatttccctttgcatcttcatgttagatattttgagtaaatatttttctaaatcatttaaataatttccaaaaaataatatagtagttttataatcagaaagttgcttttgtattttgggagttatcattactgagcctgttagttttgaaaatttataatgttaattatataattacaaatttcacagttcagtagattctttggtataataatctagttacttagtagatattgaacacttaagggtataattgaaggtgatgatacttaaacaacttctagaatttcccttgctttaagcttgtgtctactattaatatatacggtagttgatgatagtgtcaatgatctgtattttcatattttaattcttttgactgtgtcccaaatcttatgtctcactttattgaattatagctgctctgttcacaagcagttttaattttattttattttttgtttttatttttattatactttaagttctagggtacatgtgcacaacgtgcaggtttgttatatatgtatacatgtgccatgttggtgtgctgcacccattaactcgtcatttaccttaggtatatctcctaatgctatccctctcccctcccccaaccccacaacaggccccggtgtgtgatgttccccttcctgtgtccatgtgttttcattgttcagttcccacctatgagtgagaacatgtggtgtttggtttttgtccctgcgatagtttgctgagaatgatggtttccagcttcatccatgtccctacaaaggacatgaactcatccttttttatggctgcatagtattccctggtgtatatgtgccacattttcttaatccagtctatcattgatggacatttgggttggttccaagtctttgctattgtgaatagtgccgcaataaacatacatgtgcatgtgtctttatagcagcatgacttataatcctttgggtatacacccagtaatgggatggctgggtcaaatggtatttctagttctagatccctgaggaatcgccacactgtcttccacaatggttgaaccagtttactctcccaccaacagtgtaaaagtgttcctgtttctccacatcctctccagcacctgttgtttcctgactttttaatgatcgccattctaactggtgtgagatggtatctcattgtagttttgatttacatttctctgatggccagtgatgatgagcattttttcatgtgtctgttggctgcataaatgtcttttgagaagtgtctgtccatatcctttgcccactttttgatggggttgtttttttcttgtaaatttgtttgagttctttgtagattctggatattagccctttgtcagatgagtagattgcaaaatttttctcccattctgtaggttgcctgttcactctgatggtagtttcttttgctatgcagaagctcttcagtttaattagctcccatttgtcaattttgtcttttgttgccattgcttttggtgtttcagacatgaagtccttgcccatgcctatgtcctgaatggtattgccttggttttcttctagggtttttatggttttaggtctaacatttaagtctttaatccatcttgaattaatttttgtataaggtgtaaggaagggatccagtttcagctttctacatatggctagccagttttcccagcaccatttgttaaatagggaatcctttccccatttcttgtttttgtcaggtttgtcaaagatcagatggttgttgatgtgtggtattatttctgagggctctgttctgttccattggtctatatctctgttttggtaccagtaccatgctgttttggttcctgtagccttgtagtatagtttgaagtcaggtagcgtgatgcctccagctttgttctttttccttaggattgtcttggcaatgtgggctcttttttggttccatattaactttaaagtagttttttcccattctgtgaagaaagtcagtggtagcttgatggggatggcattaaatctataaattaccttgggcagtatgaccattttcacgatattgattcttcctatccatgagcatggaatgttcttccatttgtttgtgtcctcttttatttcattgagcagtggtttgtagttctccttgaagaggtctttcacatcccgtgtaagttggattcctaggtattttattctctttgaagcaattgtgaatgggagttcactcatgatttggctctctgtttgttattggtgtataggaatgcttgtgatttttgcacattgattttgtatcctgagactttgctgaagttgcttatcagcttaaggagattttgggctgagacaatggggttttctagatatacaatcatgtcatctgcaaacagggacaatttgacttcctcttttcctaactgaataccctttatttctttctcctgcctgattgctctggccagaacttccaacactatgttgaataggagtggtgagagagggcatccctgtcttgtgccagttttcaaagtgaatgcttccagtttttgcccattcagtatgatattggctgtgggtttgtcataaatagctcttattattttgagatatgtaccgtcaatacctaatttattgagagtttttagcatgaagggctgtcgaattttggtaaaggccttttctgcatctattgagataatcatgtggtttttgtctttggttctgtttatatgctggattacgtttattggtttgcgtatgttgaaccagcctaagcaaagcagttttatctttcacaaagtcattcacatttatgataagtaatagaacatgggaagtacatctggatattgggatttgcatttttgtcaggagtccttcttaaataattatataagagttcttatagttaacacggtaaggaagaaaacagtggattttactgttaactgaggggtgttagatttttatagtctcaggccatatctcattatcaaaaccaaaagcataagtgggaagtaagttggtgctttgtatgcttcccttggttgtgaaaattagcatcagtaatgataggtaataccttttgcctagattaagccaatgaagtttctcaatttctgcacccctgagttccttctcttgggtgcagcttcagttggttctgctaccaccaagacctcctctggcctctgtggttctaaaataattctgatttagtctttccatttcccctcagctgaaatatgacagttaatgtgtttgagaatgattgatgttcatatgtgtggcattttgcctttgaaatggaaatttaaaaatcactgaaattctagtttgatttgcaatctgacaggtttttttgtcttttcttaggtatggtgtggtggactttctttgagtactgggatgcaggttccaagtgctgtgagaacacttcagaaaagtgaaaatggaatgactggttcagctagcagcctgaacaatgttgttactcaatagtgtctactcagaatacgtttaccctccgtcttgattaggtggccttttctgtgcagttactaatcacaggaatttggtagtagtgaaaatcaggtttgctgtgttctgctttgaggcctggaatcttttatcattaaacacctagtacgaagcatttgcaggaacctactgtgcagtatcatagaagcaagcagataccaagcaaaaaactgatgattgaagagtaaatgggggaaaaggcagtgtttaattaacataaaaactcatttttgtatttcttggattactttgactattctaatgtttaattacatatggtaaccctaaggcctggggagaaaagcttttaaatcttgccttctttcttctgtactttgtctttttaaaatctcattactatctattatttagttctaacacagaagctttaaaaatacatagtcatccaaggttttctaaaaattgaaatcatatgttgggaatggtaaaaaggttttcaaatggtttatttttcctcttttataaataagttttacaaaattttcctcttttgtttattgactagattgtatataattttcttttttccaaaatattgtgataagaaatttctagacacaacagcttaaaatcacccaaatttcagttctttacctactgcactaacaatggcaaggggggtattctttatatgttgccttgtttaactacagttcttttcattccatcactttaggtgatgggtaagatttttgaaagccttatattttttgattttgttgtctagtttaatcctacctttaatagttgtgtttggtaaaattcccacttgaatgtgacactgataataattatgctgatttttagcatctcttataggaatcaaagtttattaaagttacatagaggattgaaaaatgtatatcactcaatttttatctaagaaggataggttataaagggaggtacctaaatactcaaataatgtatatattctttttcataacatatggaatgctttaagcaattgttttgaaaaaaatctgcgtatctttgacttaattggcacatgactttttcaagcagccattcattcagaggtttgttttctctcagtccttttgctacattcactttcttttcaaagaaatgttaattattacaaaaattgacatagatatctttcccaaacttggggtaaaacccatggttatgtggaacataactgttcttaaaaagtcaattataatttgtaactcacatcctttgagctaaactaaattaaaattacagtatttaataattctttgggcatttttaagaggtctgaatttgtatttttcttcatttttgaaactttacatttgttgactttttttcattctcatttaaaatatattgtgctatgataaccaaccttcttccaaggagtgaccattactgcctacatttgcgttgctttctacatagagacttgtataatagtattaatagtagctcattctctctaaaaatttactgcccactgataggatgttttgtttccttgataaaacaaatgtaaatgaggaattttatttgaattggaatattgtttttctagaggacattcatatctgcactattatctgatgacatgttggtaattttaaagactgcaaggcagtttagagaatgaagtaaaccaatagatactcttttgattctccaaagaaatataattttggtttttgttcctcagagagagtttgaaagaaattttcagatgttctgttccctatagagggcctattccaggatctaaatgaatgggaatttataattcctttcatagactcaaacctgaaagcagaaatttttagtagttgagttgctttaagtgaattttaacaaatatgacacagaaaaggtcagatgctgttgtataaaattttttactagtgtgtcttatataattctttcttctcattaattcagtgcctttttcctctaagcatactcttggtccatgccccatgcagtgtcaactgatgtttaagctacagagcattgttgtagtggtgagggccctctgttgcaggggcatggggaaatgcatatattaatcaggggctggaggagtatacatgattcttgtgttcatgttgtcatttgaaactcttcacataaaattttctaatattcatttggaaaacctctccactggagaggtttcatctctgagaggttttgtaataatagtgtaagttcagtaaatccagtccaaattctcatcacatgtattatttgatactaaattttcaattattacttcaaaataagagtctgaggatttcttcttactggcgttcttaaaggtctctaaaattaaagaacaagatgtggttttttgtttaagacgtttttagtttatttgttgttaagttaaactggagaaagtttgtcatcctcattttcaaactgaaaactaatcaaatatagtgcctatttagtctcaaaataaggtaactattaacttgattatactatataatattctcaattacatttgaatttaaaaatattgagctcttgattacaatttaatacattgtaaaaagtattaaatcctttgaaacatcttttgttgcttatttagtttttgtttctacaggtcaaacatgattgctttctataaaagaaatgcttgagaggttgactataatggatatgtcacaggtataaaacagttgttttctaaaaacatgcatttagtatggcattctcttttagcaactgaattcccaacgagttttattaagctggatatcgaaatgaaggagctgccttaagcactttagaaaaagaatttttttacaattcattttgactctcatggctgaccatgtcattatgtctttaaattttggtaaatatgtagataccaagcattaataactaatgcacacagaaatttaatatacagcaattctttgaatgttccaggtgtacgtaaactaactgaaagtattaaggacatgcctgtctatacatgggtttcattgatggtatctgtatcatcttgacaaatcgtgaactgctgctgtatggctagactttgcctatttactctgttatgcaaacagtaatttttccctatgttatgaagagagacatattggcttgctttaatttacttatttatgaaattaaagcatgaataatatgtataatttgaattttttgtgactgatccttggcagtataaatgataaaagtaaatgtaatggaatcttttaattaggctaagatatgctatttcataacttatgtagaatgatttttatctatatactttgtccataaaattataattgtttatgtaattttattgtttcttatggaaacaattggaaaagtatatggaaaatgattatttcaaagaatatttatttaaagagggaagtgtagacttcttactgtaaaatatgtgattccaggcttaagaaattgattatattttaaaataattatttttttaaaaacgtaatttgtttttaaaagatgagtctccattcattggctaatccatacagcaaatatttgagtgtttgtgatatggcagtaaaaatgtgattactttgtatgtacattaaccaaaaccagtgaagtttgatggactgtgcatagagttttgcagcttttgagtagtgtgacagagtttgcctcttaaaattgttttgctaataagtcagaagtttaaaatgtgttatagtttgctaaaaaaaaatcaaattaactgcatataaaatggttcacttttatatagtcacatgtaatgggcctgaaaaagtttcttctttgattatgtagttactctagatacattcttttagggaagtgtatggtcaacatatatttactcagtatacagataaccacaaagttgttatttttaaccaaaatatacatttcataatgttggcactggagtattataagagatcatgaatgtttccttaattatcatggcaagattacctcacgttcagtatagtttagttttgtgtgtatcttacagtatgcatgttctgaaattatttgtgatcctgatatgtcacatataatagctttgttacctggagtatttgattaacctaaacagtttaagcattttgaattagttggagtttaaatggattacatttggtgtatattgtcttcattgaaaagatattgttggatatgccacatcagagttagcattgacttataaataaataccagaatttaccagagtacacttttctcttcagatgactcaattattaaataaaagaatatttcttatttctgggtcaatataaggtactgacttctgatgcataatcacttaagctatgtgagtttaaactggtatcttttcttagtggtacccattcaatgtaagctggtccatgggaatggacatgaagaggatttcacagtatgtagagcagaaggcacgtgaatgtgtttgctttggcttggagcttattaagttttgactacggttaaaataagtcaaatagtaagtggtaaaacacatttttgttagtattggaactttctggagaacataagggctatgagaatgcatatatatattttttaacatttcctatatatctaaggtaccaaagcactgagtctaatttacctattaagggagactctttaaaatcaactttataactaattcatactataagacagataatagctaaagttttggaataatttatattaaaagccgcaagtcttaaaaatccctggatatgacataaaaaggattttggcttcttttttgaagtatttaaaattaatcaccttagctctaccatatactagatctgtgaccgctacacaaattgtttatcatctttgggtctctattgccttctttataaaataagtgtaagttgttcagcctgcctcacagggctgttgtgaggaaataaaatgaaatggagtatgtgaaattgcttcagcaacagcaaagtgctacgtaaatgtaaagtgttgtttttagctaataatggatttaagtgtttggataattgtagatgcatttactttgataaagcgtgtgcttaaagtggtatcaccagtgatttctaacatgattttaaaaaaataaaaccccaattaaaatgttctttaatattcatttaatttgtgcatgacttgtggcctttttgtattttctcaagcctattactctagagctgtaaaagctcttgcacagcattgttgtgtcagtgtagaatagtggcataaataaatgaattaagctacatttccatgcaggcatttgcactttgaagttagggctgcccagtgccacatgcaaagagtgtatttggtctaaacagttctttccaaacaaccaaatggctgggcagcttgttgtcacggataaatgatataaaatgtaaccactgaacatttgacaactttgttgcattatcatttttaaaaaaagatgaagcatttcaaaatcttgttaacctggttatctcttggtatctctcctgacatatttgttttgctttaaattggattaaatggtttacaggttatctgaatctacagatttagtatgtctattatctggacatgattttgctatgcagttgtgataataaaaattctaattcctcaggtttggccttttaagttatggctgaagacctttaatgatacttatgatgcactcagtgccatacaatagtgttttaagaagcacatggcctcattttccttagaaacaagacaaagcctttttaaaatgtttttttttcactttaaaatagggtattcaaagtggagtaacgtgtattttgaaatgattttgtgttctatatagaatgtcccagttaagattttacagaagcacctggaatatctcattaaaaatttaaaaactcttttcctgctctcttttgcttcattgtttgattttattaacttttatttaagtataaatacaatatgctgttggggatgagaatataaaaaaagtcatagttcctttgcctaaaaagcttaacattttagagcactactgttcaacagaattttatgcaattatgaaaagttatttgtgcagtccaatacagtagtgactggccataggcagctactgagcactttatatgtggctacatagagttgcatattgctaatagccactgttttgaacagtgtacctacagatggaaaatgaaacatgctatgttagtaactataatattacttatgaatttggtttctttggatcttgctacatgttgggttacattttggtagatggtaactaagagtcagaatcagaacctaaacatttttaaaattcttgctctaacttgaaaacagtttaaaagaaaaaaaatcagtgagactggagcgcctgtaactaagaagttatgtaagaagaatgaaaggagactggatagtcttgagtcacaggaagaagaatggacaaagattgataaaccactatagaagatggagagtgaatgggtgcagcatttctggagaacaattttagcaatattaagatttttaaatgcacatgctccttaatttcctttataagtatttctcttacatatatactcacaaaaaagccaatgttccttgcagcattaccatagctaatagtagcaacctaattattaattgaagacctacaaatttggatggacttggaggtaaattccttttccttttttggtagcaaggcacagaactggttcaaaaggcccaagttgcctcaacaaaagaatgtgataacagaattttgaaggctccccttttctaacttgctgcaccagcaaactaccatataagtagtggtctagatattatatattctgcacattcccctccccaataaatgttatatagaccattatgacaattggcttaattagagccttttccttggtataccagttcatttgtgcctggctgggagttctgtggcataagagctcaggatattatgtgcactctacttttctactaaaccccattttacacttacactgcatggtgtatttgtatttatttatttttgcacaaggtcagcacaagagcagatggttagattttggtatttccatgtgatcctacacagctgttaaaggatatgctgttaatggaagtgtattcatgatattaaacaaaaaagtcatccagcaatatatacagtacgatacaacgggtgtgtgcatgcatgtatacttgggtaagaggggaccctgacctgatcaccacacagtcttgctgtgcttctcttcatgggatgaaaaattgaggagccaagggattatgcctacttggaatgcatgtttcattacccacttatatactatattattgaaacagtctttcgttgtctgagataacacctggagttcttgtccacttatatactacattattgaaacagtctttcgttgtctgagataacacctggagttcttgtcccacctccaagacgattatggagcacggacacaaaggtgaggttagagtgaaagtttaataaggtgaaagaagaaagctctctgccagcagagagggggtcccgaacgggagtgcccatcatgaggctggggtccaggtttttatggacggaaggggaaggaatgtgcttagtctgggggctgtcttggcgaatgcgtgactcggcttggcccgggaccagtcaggaggtgaaatgattcatagatgctgcttagcttggcccaggacctatcagaagctgaagtgaagtgtggccgaggaccaatcgggctgaggtgatgatacacagcagctggacttacagtcctaacaaaggaaagtagagcgcccataggaacttaccagagcccactgtgcccatgcctacaaaaggggaataaacttttcctgggaacctgctgacaatacaaaggaccaaggcatttctatgccaggccttgttcccttatctgagtgagctggaggtttgtgcaagtttttatccaaatgggccgtaggtttttccatctgtgcagtcatgggcatgtctccaggcacaacaccctgtgctagttcccttattggtgcctgcagcttttttcccaggctgctttttatattatctggggataaggcactgactcatgagccaggggctctccaggacccttctcttgttacctacctaaggtaagctaactaaccggatccccacactcttgctgtgcctctcttcatgggatgaaaaattgaggagccaagggactatgcctacttggaatccatgttcctttacccacagaattctatactatgttatcagccagaaccccaggattccttgcctcatcagcctgaagcttgcttccaggatatgtgcaggccttttgtccaaatccatcctgaaaaaagactactacagatgtatatacccctatggctggcagtttgtgggaagtacagatgaagcttggatgtgcagactgagttgtccacatgcatgcatgataggcccctgtggcaggcttaagctagaagtaaaaagagacccaggggatcagggaagggcaggccaacctagtatcactttctagtacacttctgaagaatctgcgaatcgcatatttgaacctagatttctgttccttgagaatacatgttaaagtagaagagtataacattttatttgttggttaacgctcagctatttagacactgaaaatatgtcagggttggctttcatttgtattcttggcccagaccctacaaatgttaggagtcggccaggatccttacatgtgtgcacagctgagtggtttatagaacatgaatatttacttgtaagagaggctgtttttatgcatccttgtacccactctttcagctgtatttgctatccagattaaagcatactgacttgacgtttgccatgagctgagggctcacatttgacctttcagtatgcttgataagtaacactgccaccagtttagttgtatatttaccttcagttatgtttgttcccaaacctgcttatgtaggtggtagtcactgttgtagtcatgtaagtatgtaaaccaattatataaatatataaaccaaaataaatatgaaatgagtatgaaaaggtacttataagaaaagtacgagaaccattagagatgaagagtttaaaaagttgcaaagttagttgtggccaaagtaattgtgagtgataggggaagatttttaaaaataaattccaggactccaaatttatattccttcacttgtatctttaagttcctggtccattttacagaaacagaaactacaaatgatggatgatgcattatgtctatggttttgtaagaaaaacagtgagatactctaatcagctggtccatgcttaaaatgaacttagttcaaaacagaagattggccattgtaaccctctactgaaactgcctttttgagaaggtttattcagaactagatttgttatacacttggaaagtatttatttctaagaacctgataatttttcccttttcctgttacttttaattataatttccaaatatacagaaaagtagaaagccagtgctttgtgctcatcacctaatcaattgttaacattttgccatgtttgtgctatctattttgttttaaaatgtcacctgtaagtatgctatatgcatccatgatggcttttaaaaacagccacattctgttaacattcttagcaaaattaacagtaattctgtactattatctaatggatcagtccatactaaaatttcagttgtctcagaagtatctttttacagttatcttgttcaaatcaagatctagacagggtccacacattgtactccgttacatctcttaaatatttgattttacaatagttccctctgcttttaaatgccatttatgaaaaaaactgaggaatttgtctggtagaatgtcccgttttctgaatttagttgcttctctatatcctgtattagatctagagtttgagtaaatgcaggttcaatttttaggcaagaatccttcacaggtgtggctgtgtactttctatcacatcaggaagtacataatatatgcttgtcccaaatttagtgagattaagatcagtgggtttaggtgatgccagtctattataaagttccccatcaacctttcaccttaattttatcatctattgatgttgccctttcgattattttattaggagttacaaaatcgtgattgttttatcatcctccatttattagctggaactcttataagtactttggttacactaaaattcaattcatacaagaaaggcaggataaatgcttgatgttttcccttatcaagttttagaatatttaatcttcaacttggcaatcttcaatcacgactgaattttattttttaaggagtcattataaactcaagaatttttatatttgatgtgtttcaatcaatagcaagtatgtgatgctcaagttttcccatgtcccatcacgttagcacctgtgttaatgatgccattaagctttgataacttacttcctcttggtgtaaccttccacttttttttattaacctactgagtacctacccgttctgagtgcattggatgagaggacttcaacagtaagcttgtatgtgcataggaaatttctggaaggaaaaacaaaaagttggtaaatgtcataacctgtaggaagtgaggaagattttttcttccttttctttctgtactgatagaattaaaaacaaagcttagaaaacaaatatatgatgggagtattttccgttttgtagaaataaattataattacagtaactggtttagtgaattatggttttcaaaaatttataagaagattaatatctgagccttaacaaccaccttttggattacaccgttaaaagaaccaaagtgagaggatcgcttgaggccaagagttcgagaccagcctgggcaagatggtgaggacgccctcccccccacccccgccacaccccgccctgctagcccccaacgtctctacaaaaaaagaaaagaaaaaagttaatcaggtacaaaattgtatccagccttaaactggagggcaacaggtcgctaaatcttgaatgtcataaaggcacctcaacttcatgaggaatagtgaacgcagctgctattttccactctatcccctagctctactaattgtatccaaaccaaacttcagggagttatgctgaatccctctagcaaagcacacgcactaaaaaaaccactcgtttatcagaagttcacatttaacgggcttggaaaacggctcagctgctgcctccagttcatcttccgctgtcgaaagcgtttcagaacttaaactctcagattgcctcagtgcgctgctgtagttgtcaattaggcaagagataaaaaagggctttggctaagtggctagattataaaagcgaggaatcgccagggctcagtgaacttctggcggtgaggatgcgacaagagtcacaggaaagccgaggctggggctggaccgtgggaacgtcccagcaggaaccaagccagcctccgccgctcagcacttgacggcggcttttgcggcggttgctgtgagtgccgtaaagcggagcggctgcagcctgctgttgagtgaggtaaggtacgggaggctcaggtcggtacccggggatgggtgggcgccttcagacaggtaccgctggcgactcgggtgcccttaccgggcatcctccagcattctgggcacctgcctaccccttggtgaggaggccggccacaggctgagcgcgctccgggctgggtactcctcagtcagtccacgagcatcgcgtggtagacttccacttggccagtccttcccgcacttctgggcgtgtcatcaggtgaaatcttaatcctgggacagatgaaaggttggaggacgatcgagactcttgtagtagccgggttagggtagtgacccctgacctcaggttatccgcccgcgttggcctctcaaagtgctgagattacagccgtgagccaccgcgcccggcctgaaatttacaatttctcatttaacatgaggtaagccacatttctcttggcttcagttttgtcagatgtggaaaaaaaaaaaaaaggacctagatgatatatcagattctttatgcttttgaagatagcacgtttccagtcggtaaaaatcaagctgtgaacaaatgacaaagtgaatgatagagcagtatattagaaattgggcagatggaagcccagtagaaaaggctgtgtttgagctagactctgaggataaatagggtttgaacgattggaaaccatctctgttgggccatggacaaagatatcaaatgcaggaataagcatttatattttagcgattctatttgtggacataagtttagtgagggtagaggatttgggaaggctggcattgaacggtgaaagaactcttagtggaaaggaagtgcagggtgttctgacaaggaagaagaaaggaaccggggaaatgccgaaagaacaatacgcaggacttgatttcttggatctgggtgatgatatttttaacctgcgtttctaaaaagtaagtttaagtgctgttggcaaaaatgggaattctgttgaattccagcatgcaatagtgtactgggaataaagtgatttagatcgtagagtgctgaggttgccaataactagcctcttggctgtcatttaattcttctagagcctattctccataaggtgatgttgggccagctgatctctcttctctaaagcctgtaaaactagagactgtgaggatggagagctagttactttcttctggactgggagaggacgatagttgacagagaataaaattgttaattttggggctggacgcggtggctcacgcctgtaatcccagcactttgggaggctgaggcgggtggatcacctgaggccaaggagttcgaaaccagcctggccaacatggtgaaaccctatctctactaaaaatacaacaaattagccgggtgtggtggcgggcgcctgtaatcccagctactcctgaggctgaggcaggagaatcgcttgaacttgggaggcagaggttgcagtgagccaagatcaggccactgcactccggcctgggcaacaagagcgaaactctgtctcaaaaaaaaaaaaaagttaattttgaacatgttaaatttgaggtgaggtgcaggaaatagagttgaaaatataggcagatagagtgcatggactgtaatttaaatagtgttttctctcacaggtggtagttaaaatcttgagaatggatttggtttcagggagagattgtagagagagtaactataggccatacccacagagaggaggttggagaaattattgaaggaggcatgtggatctcagagctaagagcaaggaaggagttctttttaaaaaagttacatatagttgtagattctcaggggcccagtgttgttattaagctaatttaacagcatttacagcaaataataagcacctacttctgggaattctggcagaaaataaataattcaaatagatataatctccactgcctaattgtctacccagaagtggtatcatttacatatttatttattcaacaaatatttatatgtttcaagcactgctggttctagggatataacgacgagcaaggtagacattgttcttatcctccctgcatgtaaagcccttagcatctacatcagtgcttttcaaattttaatgtacatatgaatcatctgaggattttattaaaatgtagattatgaatcagtaggtgggggctgaaaattctgtattactaacaagctccaatgtgatactgatgttcttaggaccatacttttaagtgacaagaatctagatcctgtttagcaaatatggccgttattaagccactaccactacccatcatctgtttctcctaggataaaataattttacttcttatgaaaataatatatgcttatacaaatattggaacaatatagaaaagtgtaaagaaccatgtaaaaatcactcctaattctccctacccagagataaccattattaatatttttgggaacattcatccagattttacatatgtacatacattcacaatttaagtgttgcactaagtacatgtcacactctaagccctgtgtttgattctatttgctgtatgattttattaagataaatacccaagtgtccagaaccaagcaattaagtacttgcattcttgagggagccacttaaaaataatttgggggccaggcacggtggctcacgtctgtaatctcagcactttgggaggccaaggtggatggatcacgaggtcaagagatcaagaccatcctggccagcctgatgaaaccctgtctctactgaaaatacaaaaattagctaggcttggtggcacatgcctgtagtcccagctactcgggaggctgaggtaggagaatcacttgaacctgggagcggaggttgcagtgagctgagattgtgccactgcactccagcctggcaacagagcaagaatccgtctcaaaaaacaaaaaaaaaaacaaaacaaaaaacaaactttgggagccggacagtgtctcatgcctataatcattccaggtgcccaagaggctgaggtgggaggattgcttgtgcctagcagtttgaggcagcagtgagctatgattgtgacactgcactccagcctgggtgacagagcaagactccatttcttaaaaaaataaaaacttgtgttacttcaaaaatggggagacattaacataattacatgtgggctctagtaaatgaatatttgtcatttcatttaggatgagaggagaatttttaaagttttaaaaaaaacttagtttttttcttactacaaaatcaattgatgttcacgtaagataaataaggaaaaaaaataaaagcacctacactcctcccaacccaaagacaatccttgctgtcttcaccttccttcctgctaacctgtcttatctatatctttcatttcagccactatctttccaaaaccctcttacaccatagtcattcagaaaggagtaactatgtatttatgatttttctggagcatctactggagaaactaaatttcattagctttttatcttcaagtaacagcatgtgtaggtagaagttatattgcaaaggattaagtgcatgaatggtaagcaggtaaagaaacttcttaaccctttgcagtctaatgtttacttccaagctgctgacagttgtgaaaagttagcagtcaaaggaaaagaaatggacaataagaaagaccaacagtatttagggaagatttgatagtagctgttgctactgggatatttttggcttttgagaacagctgaaaaatgtcgatttttttttttttttggtctgacctctgaattcattttcagacgcattttctctttatgcctgccaatctgctacatcatctctctaactataccttttcctaattacactactctctttcctctgtagttcagcctcctgttttattttgttcagagcatatttgaatgtcagttctgttttaatgaattgcctgaaggattcttcctgtgcgctgcacaaacgaaaccagttcactgagactgtgctactgcagtaaagaaacagcttacttaacaatgatgctggctgtgcaaaggagttattactcaaatcagtctcgccaaagacttggtggttagtttttcaaggatagtttttagtttggtggcaggggactagggaatgagggctgctggttggctggggatgtgatgataagggtgtgaaaaatggtccttgtgtgctgagtccacctctgggtggggagccacgtgactggttgggtcatgagtcactagttcacctctaggtagtgtcagttggtccagaatgcaaaggtctgaaaaatatctcaaaagaccaatcttaggttctgtagccagggaaaatataaatcctgtgtcctctggaaaaaagactggttatcatttaactacatgttaccagaattcaggtccctctcataatcctaatcttgtagtctttcattacctttataaaggcagtttagttttggaaaaggttactatcatccttgctttaggttaaactgtaaactaaattcctttcaaagttagcttggcctgcacccagaaatgaccaaggacagattggaggtcagaaacaagatggaatcaactatgagatttctcttagctgtcataattttgcaaaggcagtttcactctctgattcatactatctatgcctcactcttactccccaatatccccaaataagtcggggatcccacagcataaggatatggctaggctctcacatatcatcttatgaacctaagttaggtgtcagggaaggtttttgattccacttccccccactcctgccttctggatcatctctcttgatatatcattcattcattcattcattcaaacagacccctacctaggtgattctcaaaagagtggggtctggggctggaggaggtgtcagggtaaaccagttaccaaaagtctttcatactaataccttcaaaggacaaatgcaaatgtaaaaaggaagctgaaagaatatgcagtggggttccaagatggccgaataggaacagctccagtctacagctcccagcgtgagcgacgcagaagacgggtgatttctgcatttctaactgagatactgagttcatctcactggggattatcggacagtgggtgcaggacagtgggtgcagcgcaccgagcgtgagccgaagcagggcaaggcatcacctcacccgggaagtgcaaggggtcagggaattccctttcctagccaagggaaggggggacaaatggcacctggaaaatcgggtcactcccaccctaatactgtgcttttccgacagtcttagcaaacagcacaccaggagattatatcccacgcctggctcggagggtcctatgcccacggagcctcactcatttgtagcacagcagtctgagattgaactgcaacgtggcagcgaggctgggggggggggcacccgccattgctgaggcttgagtagataaacagaggggccgggaagctcgaactgggtggagcccaccacagctcaaggaggcctgcctgcctctgtagacttcacctctgggggcagggcatagccaaacaaaaggcagcagaaacctctgcagacttaaatgttcctgtctgacagcttggaagagagtagtggttctcccagcatggagcttgagatctgagaacggacagactgcctcctcaagtgggtccctgaccctcaagtagcctaactgggaggcaccccacagtaggggcagactgacacctcacacagccgggtacccctctgagacgaaacttccagaggaacgatcaggcagcaacatttgctgttcagcaatattcgctgttctgcagcctctgctgatacccaggcaaacaggatctggagtggacctccagcaaactccaacagacctgcatctgagggtcctgactgttagaaggaaaactaacaaacagaaaggacatccacatcaaaacccatttgtacatcaacatcatcaaagaccaaaagtagataaaaccacaaagatggggaaaaaacagagcagaaaaactgaaaattctaaaaatcagagcacctctcctcctccaaaggaacgcagctcctcaccagcaatggaacaaagctggatggagaatgacttcgacaagttgagagaagaaggcttcagacgatcaaacttctccgagctaaaggaggaagttcaaacccaacacaaagaagttaaaaaccttgaaaaaagattagacgaatggctaactagaataaccaatgcagagaagtccttaaaggacctgatggagctgaaaaccatagcacgagaactacatgaagaatgcacaagcttcagtagccgatttgatcaactggaagaaagggtatcagtgatggaagatcaaatgaatgaaatgaagccagaagagaagtttagagaaaaaagaataaaccgaaatgaacaaagcctccaagaaatatgggactatgtgaaaagaccaaatctgcgtccgattggtgtacctgaaagtgacagggagaatggaaccaagttggaaagtactttgcaggatattatccaggagaacttccccaacctagcaaggcaggccaacattcaaattcaggaagtacagagaatgccacaaagatactcctcgagaagagcaactccaaaacacgtaattgtcagattcaccaaagttgaaatgaaggaaaaaatgttaagggcagccagagagaaaggtcgggttacccacaaagggaagcccatcagactaacagctgatctctcggcaggaactctacaagccagaagagagtgtgggccaatattcaacattcttaaagaaaagaatcttcaacccagaatttcatatccagccaaactaagcttcataagtgaaggagaaataaaatcctttacagacaagcaaatgctgagagattttgtcaccaccaggcctgccctaaaagagctcctgaagggagcactaaacatggaaaggaacagccgataccagcctctgcaaaaacatgccagattctaaagaccatggatgctaggcagaaactgcatcaactaacgaggaaaatcagcagctaacatcataatgacaggatcaaattcacacataacaatgttaaccttaaatgtaaatgggctaaatgccccaagtaaaagacacagactggcaaattggataaagagtcaagacccaccagtgtgctgtattcaggaaacccatctcacatgcaaagacacacataggctcaaaataaagggatggaggaagatctaccaagcaaatggaaaacaaaaaaaggtaggggttgcaatcctagtctctgataaaacagactttaaaccaacaaagatcaaaagagacaaagaaggccattacataatggtaaagggatcaattcaacaagaagagctaactgtcttaaatatatatgcacccaatacaggagcacccagattcataaagcaagtcctgtgtgacctacaaagagacttagactcccatacaataataatgggagactttaacaccctactgtcaacattagacagatcaacgagacagaaagttaacaaggatatccaggaattgaactcaactctgcagcaagtggacctaatagacatctatagaactctccaccccaaatcaacagaatatacattcttctcagcaccacaccacacttactccaaagttgaccacatatatggaagtaaagcactcctcagcaaatgcaaaagaacagaaattataacaaactgtctctcagaccacagtgcaatcaaactagaactcaggattaagaaactcactcaaaaccgctcaaatacatggaaactgaacaacctgctcctgaatgactactgggtacataacaaaatgaaggcagaaataaagatgtgctttgaaaccaaggagaacaaagacacaacataccagaatctctgggacatgtttaaagcaatgtgtagagggaaatttatagcactaaatgcccacaagagaaagcaggaaagatctaaaattgacaccctaacatcacaattaaaagaactagagaagcaagagcaaacacattcaaaagctaacagaaggcaagaaataactaagatcagagcggaactgcaggagatacagacacaaaaaacccttcaaaaaatcaatgaattcaggagctggttttttgaaaaggtcaacaaaattgatagaccactagcaagactaataaagaagaaaagagagaagaatgaaatagacgcaataaaaaacgataaaggggatatcaccaccgatcccaccgaaatacaaactaccatcagagaataaacacctctacacaaataaactagaaaatctagaagaaatggataaattccttgacacacacactctcccaagactaaaccaggaagaagttgaatctctgaatagaccaataacaggctctgaaattgaggcaataattaatagcttaccaaccaaaaaaagtccaggaccagatggattcacagccgaattctaccagaggtacaaggaggagctggtaccattccttctgaaattattccaatcaacagaaaaagagggaatcctccctaactcattttatgaggccagcatcatcctgataccaaagcctggcagagacataacaaaaaaagagaattttagatcaatatccctgatgaacatcgatgcaaaaatcctcaataaaatactggcaaaccgagtccagaagcacatcaaaaagcttatccaccatgatcaagtgggcttcatccccaggatgcaaggctggttcaacatacataaatcagtaaatgtaatccaacatataaacagaaccaacaacaaaagccacataagattatctcaatagatgcagaaaaggcctttgacaaaattcaacaactcttcatgctaaaaagtctcaataaattaggtattgatgggacgtatctcaaaataataagagccgtttatgacaaacccacagccaatatcatactgaatgggcaaaaactggaagcattccctttgaaaactggcacaagacagggatgccctctctcaccactcctattcagcatggtgttggaggttctggccagggcaatcaggcaggagaaagaaataaaagatatttagttaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtgcaaaaatcacaagcattcttatacaccaaataacagagagccaaatcatgagtgaactcccattcacaattgcttcaaagagaataaaatacctaggaatccaacttacaagggatgtgaaggacctctttaaggagaagtacaaaccactgctcaacgaaataaaagaggacacaaacaaatggaagaacattctatgctcatggataggaagaatcgatatcttgaaaatggccatactgcccaaggtaatttatagattcagtgccatccccatcaagctaccaatgactttcttcacagaattggaaaaaactactttagagttcatatggaagcaaaaaagagcccgccttgccaagtcaatcctaagctaaaagaacaaagctggaggcatcacgctacctgacttcaaactatactacaaggctacagtaaccaaaacagcatggtactggtaccaaaacagagatatagaacaatggaacagaacggagccctcagaagtaataccacacatctacaactatctgatctttgacaaaactgataaaaacaagaaatggggaaaggattccctatttaacaaatggtgctgggaaaactggctagccatatgtagaaagctgaaactggatcccttccttacaccttatacaaaaattaattcaagatggattaaagacttaaatgttagacctaaaaccataaaaaccctagaagaaaaccaaggcaataccattcaggacataggcatgggcaaggacttcatgtctgaaacaccaaaagcaatggcaacaaaagacaaaattgacaaaagggagctaattaaactgaagagcttctgcatagcaaaagaaactaccatcagagtgaacaggcaacctacagaatgggagaaaatttttgcaatctactcatctgacaaagggctaatacccagaatctacaaagaactcaaacaaatttacaagaaaaaaacaaccccatcaacaagtgggcaaaggatatgaacagacacttctcaaaagaagacatttatgcagccaacagacacatgaaaaaatgctcatcatcactggccatcagagaaatgcaaatcaaaaccatgataagataccatctcacaccagttagaatggcgatcattaaaaagtcaggaaacaacaggtgctggagaggatgtggagaaataggaacacttttacactgttggtgggacagtaaactggttcaaccattgtggaagacagtgtggcgattcctctgggatctagaactagaaataccatttgacccagtgatcccattactgggtatatacccaaaggattataagtcatgctgctataaagacacatgcacatgtatgtttattgtggcactattcacaatagcaaagacctggaaccaacccagatgtccatcagtgatagaccggattaagaaaatgtggcacatatacaccatgaaatattatgcagccataaaaaaggatgagttcatgtcctttgtagggacatggatgaagctggaaaccatcattctcagcaaactatctcaaggacagaaaaccaaacatcgcatgttctcactcataggtgggaactgaacaatgagaacacttggtcacaggaagggggacatcacacaccggggcctgttgtgggatgggagcaagggggaggcgtagcattggtagatatacctaatgtaaatgatgagttaatgggtacagcacaccaacatggcacatgtatacatatgtaacaaacctgcatgttgtgcacatgtaccctagagcttaaaatataataataaaaaaaataagtaaataaaaaagaatatgcagtgctgctcttcactgtagaaagagcctgagaattatcttgaactccaaatcctgtaccttttttcatcacagttgtgtatgggttttatctactactagtttttttccaagccttttcacatcttgacacatagtaaatttgaccaagaaaagatgaaaggaaacataaaagaatgtgttcttggctggagatgacctactcttggggtctagctgccccaaagactgagaggattgttaactctgacacctataacccattcatgatttagttggtaagcagatctgcccatttctttcttcttcattgccagatctcagttcatgcactagttatgccctgcttccacttcatctaagaataattctgtgtcgcaatataccataattatatattaatcttctcatatttgcattagaactttaagattattgggctacttaaacttcgtaactcccctcgttacatcttttttttccctgaaaacatttgtcatttctctcccaaccactgcctcattttaatttactatctctgcaatactttttcttttcttttccattagagatgatatgctgtcttctttaggaaactttacctaagtgtaagtaaggaaatgaatgctatcctccctagtgtttttattatgatagctaaaatgtaacatataaaaagaagtgtatatagaaacaatatttttgttttagttctatgccatatctctctataggttattttttatatttttaaacgtttattttttgaaggttggaaccagatatgtgagtttaaggggctttaaactcttttaaaaatcttttttttttatatttcaaattctgttttattgtaaaagttcctgcagaacagaaaagttttatttaaatagttttctgttttcttgagcattgtgcagtgtatttttagtatacttagcatacttactattacttgatgttaattcagccaattttaggctggtggggaagatgattcatgtacactaacagttataatgcaaaatagaaactagtaaaagcctcaaggttagttgcctctccttgtgcttccatagtaacccgtgcttattccttcattgcaactatactgtattgttattgcctctatatttatctctgatagagtccatcataaactagaacagtggttcttaattgatgtgggggtggtaaggaatggggcttgcgcattttggaaaacatcttctcatattctttttcaggtacatcactctctccaccactatcactactgcccttcttcttttgaaaactcctgtactcacctttaagcccttcaaaattagggaagtgtatcttatttgtcattttatctctagtgcttagcatttttttttggcatctgtgcccattaaggtagacagtaactgtttatttgttgcaggaaggtaaaactaggttggaggtggagggagcacttctaacctggaagaatattgaagacttccttgaagaagtgtcatttgagaggagctatgaaaagaaagtaaactggttttatggaagtaaatgagaacattgcagacaagaggtaatgggcaaaaacacagaggcaggaaagtgtaggatgtattccaggaatactcatgcaaaaaccatagactatgtgaagtgtgagaaagcttatagtaaatttgcctgtattcagtcagattgtgaatacccctttataccattatatgtaatttgaactatttgtaggtggtagggaactattgaaaagttttgattgtggtgtaacttgatttatctgtcagcaacttgatacatctgtcagtgtataggtaagattgtggatacagagaaagtggagacagggacatcagttaaaattaggacattaggtacaattagagtttagaatgacagtgaagaaggaaggaattgatgcaagaggtattttaaaggtaaaatcaacatactatggcttctttttttcagtgtcacattattcatttttaagtggttactgaatattcctaatgaagcggtagtgctagtgaaaaggaacattttgataggcgaatctttctcttttgtgactgaattgccttggcatttatagaaaataaataatgaagttaattggatatcatcttgataataaaaatgtaattaagtttttgatattatggtttggaggtttattttataagaattagttgtaaactagagaagaaagaacaagatattaatttagattttatgcctgtagtagcttatataggcaggcctattatgtgttctttcccatttattaatttgggcttagaagaagctgagttatggcctactctgagtgccactttagatttcactaggaatcagcatagaatacattaatgcactgtttaatacaagtacaagaacttgagttgaaatcttgaaaatgaagggcagtctccttgttaatcttgtgagctgccctcatcagagtataggttgagcatcccaaatctgaaaattcaaaatctgaaatgctccaaaatctgcaacttttgcgtgctaatatgatgctgaaaggaatgttcattggagcatttcagaattttggattagggatgttcaactggtaagtgtaatccaaatattctggaatcctaagaagtccaaaatacttttggtcccaagcattttggataagggatactaaacctctatttgataattgtatttccatgggttttaactgaatacaaaaactaataccatcatcaatgttgattgatattgttttcacagttttgggagatacaaaataattatgatttattaggttatctttgcttaatatacattactgatcaggtgaattgttcacatcactattggtattatttctcttaagtagtttcttgagactgtatatatatatatatatatattttagtgtttgctttatatagtcatcagctctggcagctcatttggattgttttaaaaccccaaaccaagacttgattttaagatggtaaagacatttgtgccctattctatctgaaattaccatgaaacaacaaggaaactgagagaaagagatgtaattacatctttgctgagactagaagacctgtaactccaaactgaaatatttgagaaatggcagccacatgtaagcaggaagaggttaaaagagaatgctggtagaaagagatctcagatagagctggcagagcaaagagtcctcttctgtttgcagtgggatcaggatgcatagaaaggcaatgggaatttccttggattgtttggcaacatgaactagcaagaaaggaagagtgaatgaggaagtgcacagataccccatctttgcaggaagcactctcttgctgaggcaaagtagaggagagatagtgagtggccctttgctgcctgtctctgacatctggaagaagtaatgtttaaatgcttttcccacttgttctcatacacattctctgcctttctcacatatacacatgtacaaaatactctgtcagaaagagttttcttgtataccagagactaccctctagtctagaatacacccttatttctttcttccatagttaaggcgtaaattatattcccgtttagaaaagtagatgaggactgggtgccgtggctcatgcctgtaatcccagcactttgggaggctgaggcaggtgggttgcttgaggtgaggagttcgtgaccagcctgaccaccacagaaaaaccccgtctaaactaaatatacaaaaattagccgagtgtggtggcaggcacctgtaatcccagttactcgggaggctgagataggagaattgcttgaacccaggaggtgaaggttgcagtgaactgagatcgtgccactgcactccatccagcctgagtgacagagggagactctgtctcaaaaaaaaaaatgcttaattgtagttctgaaaatagagaattcaatgttataacagaaaaaatatttaagaaaaccttctgcaaagaaaagacatctttaggtcaggctcagtagtagctcacacctgtaattccagcactttgggaggctaaggcaggaggttctcttgaggctgggagtttaagaccagcttgggcaacatagcaagaccctgtctttacaaataaatttttaaaaaattagctgggcatggtggcacatacttttactcatggctactcaggaggctgagataggaagatcacttaagtgtgggagtttcgggttacaatgagctatgattgcaccattatacttcagcctggacgacaaagtgagaccctgtctcaaaaaaaaaaaaatctttattctacagattgaaaggaaacacactgaatgaggaaaaactaacatacggtcatcaacatccttgtataacctagtttttaaaaaaattggatttcaaaggtaaggaatgcattctttgctcatcccaataaaaagattaaattacctatcaggagttggtttgggaaatcagatattgtcaagggaatatttagcactacaggacaatggtacaaagtgtgtaagtcattggggaaagacagtgtaacctcaaagccaaattgacaactatttttgaacaaggcaaaagctcaaggtaagtggtacccctaagttctttttgataaactgcaagaagatgaatatcagtcatacagtagatgaacagagatgatatagcaaatggattggcagggaacattgtaggaataagaccaaaataactatgagatttgtagttatagaatacaatagaactgtaacatgtagaaataattaataaaagtcaagattgaaagaggagagaagacagaatgtagtataaatttgttggtttcttcttattttatagctggagaacaaaagacatataaaccttagatatcaagcataagagaggtgtcagtatatttgaaggattgaaggaataaatgtaagcatttgaagaactaaatgtgtttaaccaaaatcaaacagtggagacaaggtaggaagaagtagaactgtattaaatttcttatcctaaaggaataatcagagatgagacctaagatgaaagaacaaaatgtttattgtggcattctttacagttgaaaaaactgaaaacatacatggagtataaataaaaactgaccacatcctagatcacacacaaacttgaaaagcaacaaagagctgtcttacaggccatgttccttgactaaaaacggtctcagtttctcctttggaagtggttctcagcattgtcagcagcaccagcatcatttgggaacttgtcagaaatgaaaattctgaggtctcataccggatttactgaatcagaaactggaggagaaaagcacctctcaaccttgttggtcagtttttataaatatcctatttatgttttcagttatttacagttataaaaaaaagtgataataaacatttttgttttttcatcattggtctcatatttgattatttctttagcatagacaatgaccagatcaaagaatgcctgtggaaatttaattttttctttgttctattgttggttattacaggtacaaaattaaagaggtttttgtttctttaaaaatatcttttttgttcacagaaaacaaaattatcttcctttccaaatccaaaaagatgaaaacgactgagatactttcaaaagacaaccaagtgagcagcacagactaatgagtagaatcaataagaacgtggttttggcccttttaacgctgacaagttctgcatttctgctgtttcagttgtactactacaagcactatttatcaacaaaggtaattttattccttctttcttatcattcctcctttcttatcattgtatattttctgatcacacttctctttgcaatacataatattaatcatgggtattcaaattcttgcatctttgcgaggtgtggcaaacaattaaaaattcagttaaatatacttgtaatagcacactaaagacaggtgctaagtttcaaggatgtttaatctattggaatttcctgagctagttatttaaaaattattattttgttaaacagattatccttcatttaaatgaactcaatgataaataattttgataaaatgtcaaaattagtttattttagtacagcatatattttaatttagtacctactggggaagtataatggtatgacttacctttatctgtatgtataggaataaagtagagacaatgatgtggaaatcaatagcttctgaagattccgtagaatataccagataaggaattccaaagttgagatggtgttgttacattgtgaaaagttgccaaacactccctctggggtgtattataataattactaccatcactgataattgtactagatgctttccatgctcagtttagtcctaaaaacaatcatggggaagaaaaaaaattttttttgtttttatgtttttatcctcatgtcttaattagaactattcatcagaattaatcactttgcgcccctcctcaactagaatggagtatacttccctgccttttttatgttgggcttgaccagtagaatgttaacagacatgtgcagaagctttgaataggctgttgtgatttgacttagtttttatgctcccctgacctataggagaagagaaaaatgtatggagcagaccaaagcatagctgcccagctgactcacagatttgtgagggaggaaatagatgcttataagccataagactgggggaagtttattatgcagcattgttacatggagttattagacctaattttgacagataagaaaactgaaacttttcttttttttttttttttaattaatttattttttttattatactttaagttttagggtacatttgcacattgtgcaggttagttacatatgtatacatttgccgtgctggtgtgctgcacccactaactcgtcatctagcattaggtatatctcccaatgctatccctccccactcccaccaccccacaacagtccccagagtgtgatattccccttcctgtgtccatgtgatctcattgttcatttcccacctatgagtgagaatatgcggtgtttggttttttgttcttacgatagtttactgagaatgatgatttccaatttcatccatgtccctacaaaggacgtgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctgtttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatgtccttcgcccactttttgatggggtggtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttattttaattagatcccatttgtcaattttgtcttttgttgctattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccatttcttgtttttctcaggtttgtcaaagatcagatagttgtaggtatgcggcattatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggcgatgcgggctcttttttggttccctatgaactttaaagtagttttttcgaattctgtgaagaaagtcattggtagcttgatggggatggcattgaatctgtaaattaccttgggcagtatggccattttcacaatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattatgaataggagttcacttatgatttggctctctgtttgtgtgttgttggtgtataagaatgcttgtgatttttgcacattgattttgtatcttgagactttgctgaagttgcttatcagcttaaggagattttaggctgagacaatggggttttctagatatacaatcatgtcgtctgcaaacagggacagtttgacttcctcttttcctaattgaataccctttatttccttctcctgcctaattgccctggccagaacttccaacactatgttgaataggagtggtgagagaggacatccctgtcttgtgccagttttcaaagggaatgcttccagtttttgcccattcagtatgatattggctgtgggtttgtcatagatagctcttatcattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaagaatattggtctaaaattctctttttttgttgagtctctgcccggctttggtatcagaatgatgctggcctcataaaatgagttagggaggattccctctttttctattgattggaatagtttcagaaggaatggtaccagctcctccttgtacctctggtagaattcggctgtgaatccatctggtcctggactttttttggttggtaagctattaattattgcctcaatttcagagcctgttattggtctattcagagattcaacttcttcctggtttagtcttgggagagtgtatgtgtcaaggaatttatccatttcttctagattttctagtttatttgtgtagaggtgtttattctctgatggtagtttgtatttcagtgggatcggtggtgatatcccctttatcgttttttattgcgtctatttcattcttctctcttttcttctttattagtcttgctagtggtctatcaattttgttgaccttttcaaaaaaccagctcctggattcattgattttttgaatggttttttgtgtctgtatctcctgcagttctgctctgatcttagttatttcttgccttctgttagcttttgaatgtgtttgctcttgcttctctagttctcttaattgtgatgttagggtgtcaattttagatctttcctgctttctcttgtgggcatttagtgctataaatttccctctacacattgctttaaacatgtcccagagattctggtatgtcgtgtctttgttctcgttggtttcaaagaacatctttatttctgccttcatttcgttatgtacccagtagtcattcaggagcaggttgttcagtttccatgtagttgagcggctttgagtgagtttcttaatcctgagttctagtttgattgcactgtggtctgagagatagtttgttataatttgtgttcttttacatttgctgaggagagctttacttccaagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcacacaggacttgctttatgaatctgggtgctcctgtattgggtgcatatatatttaggctagttagctcttcttgttgaattgatccctttaccattatgtaatggccttctttgtctcttttgatctttgttggtttaaagtctgttttatcagaaactaggattgcaacccctgcctttttttgttttccatttgcttggtagatcttcctccatccttttattttgagcctatgtgtgtctctgcacgtgagatgggtttcctgaatacagcatactggtgggtcttgactctttatccaatttgccagtctgtgtcttttaattggagaatttagtccatttacatttaaagttaatattgttatgtgtgaatttgatcctgtcattatgatgttagctgctgattttcctcgttagttgacgcagtttcttcctagtctcgacggtctttacattttggcatgattttgcagcagctggtaccggttgttcctttccatgtttagtgcttccttcaggagctcttttagggcaggcctggtggtgacaaaatctctcagcatttgcttgtctgtaaagtatttaatttctccttcacttatgaagcttagtttggctggatatgaaattctgggttgaaaattcttttctttaagaatgttgaatattggcccccactctcttctggcttgtagggtttctgccaagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagtacttctctgtattggttattctagttatacattcttctcaatttttttcaaagtttttaacttctttgcctttggtttgaatgtcctcccgtagctcagagtaatttgatcgtctgaagccttcttctctcagctcgtcaaagtcattctccatccagctttgttccgttgctggtgaggaactgcgttcctttgtaggaggagaggcgctctgcgttttagagtttccagtttttctgttctgttttttccccatctttgtggttttatctacttttggtctttgatgatggtgatgtacagatgggttttcggtgtggatgtcctttctgtttgttagttttccttctaacagacaggaccctcagctgcaggtctgttggagtaccctgccttgtgaggtgtcagtgtgcccctgctgcggggtgcctcccagttaggctgctcgggggtcaggggtcagggacccacttgaggaggcagtctgccggttctcagatctccagctgcgtgctgggagaaccactgctctcttcaaagctgtcagacagggacattgaagtctgcagaggttactgctgtctttttgtttgtctgtgccctgcccccagaggtggagcctacagaggcaggcaggcctccttgaactgtggtgggctccatgcagttcgagcttcccggctgctttgtttacctaagcaagcctgggcaatggcgggcgcccctcccccagcctcgctgccgccttgcagtttgatctcagactgctgggctagcaatcagcgagattccgtgggcgtaggaccctccgagccaggtgtgggatatagtctcgtggtgcactgttttttaagccggtctgaaaagcgcaatattcgggtgggagtgacccgattttccaggtgtgtccgtcacccctttctttgactcagaaagggaactccctgacaccttgcgcttcccaggtgaggcaatgcctcgccctgcttcggctcgcgcacggtgcgcgcacccactagcctgcgcccactgtctggcactccctagtgagatgaacccggtacctcagatggaaatgcagaaatcacccgtcttctgcgtcgctcatgctgggagctgtagaccggagctgttcctattcggccatcttggctcctacccgaaacttttctttttttaagagaggatctcgcttcgtcacccaggctgaagtacagtggcataatcatagctcactgtaaccttgaatctggggctcaagcagtactcctgcctcaatctcctgagttgttaggaggactacaggcacatgccatcacgcctgactaattaaaaaaaattttttgtagagacggggtctcgctgtgttgcccaggctggtcttgaactcctggcctcaggcagttctgtcacctcaggctcccaaagtgctgggattacaagtatgggctactgcaactggcctggaaaaccaaaattgttaacagagatgtgaaataatttacccatacaaaccacccaatatctaatgtgtatagctgacctctaatgtccctagctccattttttccaggctatataattttaaaaataacagactatactgattctacttttgatcttggctgtttatccaatgaatgtctttctgtgacatcttcaaccctttcctcattattttcttaggataaagtcctagagtagaaattctagatctaatatgcacattttagatttttgttatatattacaaagttatccttcataaggataagcagtatacctgatttctcatatcttttcataaataggaataacaataataatggcatctgtttcagttagagatggctggctaatagtagcttaaacaaatagaggaattatctgtccatatctataagtctagagcctctaaaattctcttggtatttcctgtgttacagtcaaggctagaaggaataatagtgtgatctagcaggcttctagttttgtgacagtggccagcagattcccaaatataagagaatctggggaagtaaggttttactattgttatttagcttttctagcctctataatagagattgcaaaagagaaggggtttgggaatgggtgtcaggtcagcttacctatagtgcctgccatagcagctaacattttttgatgtgcttgattgagcaggccctatgcgaagcactttaccaacatttaattcttaaaacaagttgagtagatcttgttcttcctgtttttccagcaaaaacattgaggttttgagagacttactaattttcccaatatcacatagttattaagtgggggagatgaacctgaggagtctaccccaaaacctcattcattaatttttagtgttcgtaatattcagaaactgaaagctattcaactccattagaggtcgtttctttgattactagtggggttaaacatctttccatatgtatattggttctttttagttgtattcttacttcttcttatttgtgtctttcatatatgttcctgatgatgttgtctttttctgtagctgttctttatagtttgaagaatattaaaccttcatcatatatatttcaaatatttttcctgacttgtaatttgccttttaactttatattcatgatgtactccctcaataaattagtacttaatgtataaatagacagatgtcaaaatctgttttccttagggcatctgttttttatgttataagtagcccaagattatgggaatatttaactgtatttttgtctatttaatgtttaaattttttcactaaaatgaatttattttagtatgaggtatgaattagacatctaacttacatttttccacaatgattaaccaattgtcccaatatcccttattgaattacccattactttaaaaatcccatcttaattatatattaaattctaataaagaactgctgtctcaacccttttcccttggtggcagtgtaacatagttgttgagagcatgaacatcagtttgagattaaacctcatctatactgcttattagctgtgggatcttgagttaattacttgacttctaaatgcctttgtttccttatctacaaaatgggaggcaataacagtaccacctcatagacttgtgaagcttaaatgaattgatatacataaactatttggaacaatgcatgttatacagaaagaaaccagtaaaaattggctattattattattttttaattttataatgaaaaatagtatttgttgtattgtgtccataccatacaaactgccttagtaataatgccttattcattaaagaaaatataatctttgaacagaagtggtatgtaattaaagttcaggtaacctttatataccattaattttgtaaagttcattattcatactagattcttgttttttatgtttacttttgataataggtagacattataacatctaagttctaaaatatcacagattatttttattttattgaaatatatggagtgggtgcagtggctcacacctgtagtcccagaatttggggacactgaggtgtgcagattgcttgagcccaagagtttgaaaccagccatggcaccatggcaaaaccccatttctacaaaaaatacaaatattagcccagcatggtggcgtgtgcctgtagtcccagctattcaagaggctgaggtgagaggatcacttgagcttgggagattcaaggctgcagtgagctgtcattgcgccactgcactccagcctgggtgacggggagatcgtgtcttaaaattttttttttttaacatatggaaattatattaaaccgtttgtagcccagtaattgtatcctttaaaatggaatttttaaatttactcatgagttcagaaactgttatttaaaagtcacaatttgtagagtattttgccaaggcaatagaaacaatgaggtggtttcttcctgcccaatatttataatttaatttgggacagatgctgatgagagtatagatgcttcctgtatgttatagtgtgaaaacaggatactgtctgtaaggaatacaagcagtttctctatgccagtaggaaaaaaaaatgctttatttaaaaatagtaaggagaccaggtgcctgcctgtaatcccagcactttgggaggcttaggcgagaggatcgcttgagcccaggaattcaagaccagcctgggcaacatagtaagatctcatctctgctaaaaataagaaaattagctggttgtggtggtgcacgcctgtagtcctagctacttgggacactgaggtgagagaatccctctgagcccaggagtttgagtttacagtgagctaagatctgcactccaggatggacaagagagggagaccctgtctcaaaaaataaataaataaatatgtacatatgtaaaataaaaatagtaaggatagttagactaattagatgctaaagataccaacttttaaatttatttcagtgtcattgtggaaaattttgaagcttttgggtttttgttaaacttataaatctcacttacacgcagcgtttttgaactcaaagtttagtgaagtatagatgcatcctcagttttctaatggttttcttctgacataggaagagaacctgaactattgttaactttgtttaccgattacatctgaattgcattcctctgttgttcaatgagcagtgttttgtgggatatgcttagataaataaattcatgtaaaaattacttatagttcaattaaatgtttgatttggtagccaaagagtatggaatcatagtcttgatcagtgtgaaattataggttagcgtcatcaacataaaaaccaagattctaagtcatccttgaacttcaaggtaattttcagagacccttgagattatgtgttagagatagggatgaaaaattgattttatcttttattccaacccaaatttagtagcagtaaatgcctgcagcaccatggtaagaaggactgcaaagctttcaggcttttcaggaaagaacactctagtactggctaccttggagtttaaggagacttacttttgaccattttgagggccttagcacagaactactcttggtcctagctggttagacaagcctagcttttctatgatcctccaaatgggatctgaataatccagttatcatgttagcattgaagataaagaactagtatattatatttattgggtctactaaaatttcatagacgggtagaattgactcttcagattccagaacaacccttcaggtcttggatatacaaactcctttagtgtagtgtccttgtgagcattgtctgtgggcgccaactttcaagtagttggcttgcagctcacaccagaatggaaaggacatgtttctaggaccctgaagagaattttcattgttcactgtttttatgcaaccaacaggatagtatgataattgtgtgtgttcatttaatccgtatttattgatcactcgtcttacacagtgtacttaggaatacagagataaatagaacacaggccctactcatgaaactcataatttgatagacatggcagcatcaataatttttgagtttgggcactacatagtcctcatgcaattgtttggctttcagcaagtcactttgagcaccagtttctttaaatgggtctaatggcaacattgctggttgagataatgtatgtgatatgtctcacttagtgtctgatacatggtagatgataactatcagtagcttacattttctagtacttttaaggtttacattgcagtttgacaagtaaaattgtattaaattcttatagtgtccctataagcttatattttttactttttcataaaccaagttaactggggtccagatatgttaagtttcttaagttcaagattgccaatcaggtcctaaaacttgtatttattcatacagctattccaacatgtaaatataaatttgttcaaaagaaatgagtgataagatatgaaatgagatggctttaaggaatgccgtagcacaacagaaaatcgtcaaatattgatgcctatgtggagggaagacaaagccaatgaactatgtttgtattaggcactgagtgatccaagcctttttattgttcttgacttagtccaatgagcagcaccagtgcctgcagtaatcagctgtttgtattatctaggagcccacttatagaattgggtgctgagatatcttattttgcattctatttagtagcctatgtatgtttggttagaaggagggaggagggagttgaaaggggagtttggatttcaagtttggcagtagtcattcacagtgagcaattttatatgccattattagaaatggaaatcagtcttgtagccatttagatcatgtgcaacaaaggcttttgaatatttttagttggttagttacttgctaaaattatgcaagaaatatgattttccctttatcttttttcacttttgggcttcttccattttgccttcaaggataacatataggtcatttctggaggaagaatattatatttgatagcttgatccaatgtggtaaactttaataaatactactgccccacttcttctatcaccctctcactcctgctattatccaggagaaatgtgatataatttctttcattagaattgaagggtgtttttatagtctttccattttttcatttattctcaaacattaggctgtgtaggtttgtaggttttctggccagttttgattattaagaatcacagcttttctaccatttaaggtcacatttatgagtgattcactaataaatctaagaactgcagtggcttgggagtaaatataagagaaatgtttctactggaaagagaaacactgagaggcagaagtggaaggctatctggagggttgtggaattggcaatggtcagtgtttctgatccttaggtttgcaagcttataagcaattgaaaaagacagttattgaagacttaattttttctgaaagtactactgtttgattctatatgagcataattaatgatcatgctgaattaggaatttggtttgagggtttctataagaaacactgttggatactgcatttcaaaaatgatagaattttttcttaaatcttcacctcctactttctggatgctttttctttgataatatatctttatttgacccagttatcactagagttcagttgctaccagacttttcctaccagttgttgttggcatctgattccatctgtttactcatttattcatttcccgtaaatttttactccaaatatcccataggcagtgtgtcagaatatttttttttaaccagttgactttacatggcatttctttcagaacattctgccattcatttgtcaagtatttgttgaaagcttactgtgtgccaagcacagtaataggctatgaaacaaatgatcagtgaagttcaatccttatgtctaggaactcacaaattgggaaatttgggggatgaaggggagagaggttaagaaacataaagagacatataagcaaacaataacaatacatgttacctcttttttcaaagcacacttcataacttttctgttctctagtatctagcctttgtaatctttcttctgtactgttgtcagagatatttttcttagatgcagatctgatccaagttattctctgcatagtatacctatggaataagaaccaaacttcttagcatagcatgctggatatactgtttgctctccaaattctctctttaccatactctgttcttggggaggcagacctttatggattatattagctgagctcccttgccctttggtttcctgttgggtttagccaatgggatacggctggagattgcaaactggaaagaaagagaggtcagattatttattctcttggttctctacttgtagggtcattggttgacagtgactgcatcttcctgtatagctacagttgcagccactgtagctgccactgagtgccaataactcttgctctccagagacggattaaacgttaagataatgaaatttaaacttcagggcccctcacttgcaggggacttgcagaggccttaggaatctgtttacaaagctatttatttttgtaacatttgcaaaagttatttttacattctttctgaagaagggccgacggctgggcacagtggcttatgcttgtaatcccagcatttttggaggccgaggtgggtggatcacctgaggtcaggagttcgagaccagcctggctaacatggtgaaaccctgtctctaccccaaataccaaaattagctgggtgttgtggcatatgcctgcctgtaatcccagctattcaggaagctgaggcacgagaatcgcttgaacccaggaggcggaggttgcagtgagccaaaatcacgccagtgcactccagcctgggtgacagaatgagactccatctcaaaaaaaaactggggggggcgggtactaacaaaatggtataatcttcaggccctataaaactggaccctccaatgtccttaaccttgacccttcaagcttaggtaagtataaggtttacagggaagagagactactgaataacatacttgggaaggctattaatgaatatttcatggatgaaataataatttgagttggtgttgtaggatgaggagttcttcaggtgaagaaggatagaaaggtcattacaaatagaagacacagcctgttcaaagggaatgagtattttgatgtctacagtgaagcatactaggtagaaaacaaagaaaatacaaaagtcctgcggcaggaatatgtctgtcagttttgagaacagcatagagatcaatgtggctgtagacaaatgagtgatggggagaatagtaggtaaggttagagtttcctgttacttagggtcttgtaagccgttgtaaggactttgaccttttatcctgagtgagactgggaaacaggaaggttttgagctatgtggacatgatctgactattgttttaaaacaagtagcctggccactttgatgagaatagattggctgtgttgccacccaaatctcatctttaattgtagctcccataattcccatgtgctggggggggacctggtgggagataattgaatcatgggggtggcttcccccatactgttcttgtggtagcaaataagtctcatgagagctgatgattttataaggggagatctgatgatttctccttttgcttgattctgattttctcttgtctgctgccatgtaagatatacctttcaccttctgccatgattgtgaggcctccccagctacttggaactgtgagttcattaaacttcttttgtaagttgcccagtctcaggtatgtctttatcagcaacgtgaaaatggactaatacacagagagaccagttagaaggctattctagtaatttacacaagagatgataatgatttggacaagagagttgatggtagagttggtgagaaatggaaagtacagtattcaggatttgttgatggattcgatgtagggtattagagtgacagaagcgagtcaaggataactctagtatttttgtcctaagtaattgcaatggcaaattgctgtttactgagatggatgagactgggaagagcaagtttgaggaatggtgaaaatcaggagtttttttgtacgtgttaagtttaaggtgctatgttaatctgttctttcattgctgtaaagaaatatctgaggcagggtaatttataaagaaaagaggtttaattggctcatggttctgcaggctgtagaggaagcatgatgctagcatctgctcaacttctggggaggcctcaggaaacttacaatcgtggcagcaggtgaagggggagcccgcacctcacatggccagagcaggaggaaaagagagagtggggagatgctacacacttttaaacaaccagatcttaggggaactcactcactccctatcacaagaatagcaccaagaggatggtgctaaaccattcatgacaaactgtccccacaatccaattacctcccaccaggccccatttccaacactggggattacaatttgacatgagatttggtggggacacagatctaaaccatattattctgcccctggcccctcacacctcatgatcctttcacattgcaaaatacaatcatgccttcccaacagtccttcaaagtcttaacttattccaacattaactcaatagttcaaagtctcatctgagacaaggcaagccccttccacctatgagcctgtaaaataaaaaattagttagttactcccaagattcgatgggggtatagtcattgggtaaatactcctgttccaaaagggagaaattggccaaaagaaaggggctacaggccccatgcaagccccaaacccagcaggttactcattaagtcttaaaaccccaaaatttgactccatgtctcatgtccagggcacacgggggtgggctcccaaggccttgggcagctcagaccctgtggctttgcagggttcagcccccacaactgctctcatgggctgacattgagtgcctgcagcttttcctggtgtaccatgcaggttactggtggatctaccactttggggtctggaggactgtggccctcttctcacagctccagtaggcagtgccccagtgggggctctctgtgggagcttcaaccctgcatttcccttccacactattctagtagagttctccatgagggctccattagcagcaagcttctgcctggacatccaggcttttccatacatcctctgaaatctaggcagaggctcttaagcctcaactcttgcactgtgtgcacctgcttacagcttgcaccctctgaagcagcctcagctatacctgtgcccccttgagccatggctggaactagagcagctggaatgcagggagcagtgtcttgaggctactcagggtggcaggcactgggcgtagcccaccaaactattcttccctcctacgtctccaggcctgtgatgggaggggctacctccaaggtctttgaaatgccttcaaagccttgtccccattttcttggcgaatgcaaatttctgcagcctgcttgaattcctcccctgaaaatagacttttcttttctatcacatggccaggctgcaaattttccaaacatgtatgccctgcttccctattaaatatgttccaattttatgtcatttctttgctcacacatatgagcataggttgttagaagcagccaggccagatcttgaactctttgctgcttagaaatttcttctgggttgggcatggtggctcatgcctataatctcagcactttggtaggccgagttgggtggatcacaaggtcaggagttcgagatcagcctggccaatatggtgaaaccctgtctctactaaaaatacaaaaattagctgggtgtggtgatgggtgcctgtaatcctagctactcagaaggctgaggcaggaaaattgcttgaaactggatagcagaggttgcagtgagccacgatcataccactgcaatccagcttgggcaacaagagtgaactctgtctcaaaaaaaagaaaaaaagaaatttcttcttccaggtaccctaaactatcactctcgagttcagagtttcacagatctctagggccagggcacaatgcagccaggttgtttgctaaggcataacaaaagtgactttttgcttcacctcccaatacattcctgatttccatctgagacttccttagcctgggcttcattgtccatatcactataagcatcttgatcacaaccattcaacaagtctctaggaagtttcaaattttccctcatcttcctgtcttcttctgagccctccaaactttccctttgcctattacccagttccaaagttacttccacattttcagacaccttacagcaacactgctttcctggtaccaattttctgtagttagtctgttctcgaattgctataaagaaacacctaagactgggtaatttataaaggaaagtttaattgtctcattgttctagaggctgtacaggaagcatgatactggcatctgcttggcttctgtggaggcctcaggaaacttagaatcatggcagaaggtgaaggcggaaccagcacttcatatggctggagcaggaagaagagagagagggaggaggtgctacagtcttttaaacagttagatctcaggataactcactcactcattatcacaagaacagcaccaaagggatggtgctaaatccgtcacgagaaactgtttacatgatacagtcacctcccaccaggtactgcctccaacactggggattacaattcagtatgagatttggtggggcacagatccaaagcacatcaggtgcctatttgacattcaaatgaagaaggtgaatagacaattggctatataagtctgggtagagtgggttgggagtacaaatggagtgttgtaagcatatagatggtgtctaaagccatatgactagatgagatactaaggaagtgaatatagatttttaaagggggagaaagaaagtgccaacatctgaggtttgggaccctccaacacatcagggaagtaggaagaactgacaagttaaagaagcagccagagagaaacagagaaaaaacagaaatatggtgatacagagagctaagtgaatgaagtgtttcagtgaggcagaggttgtcaacaattcttggtatatcaaataagataagtattgataattgaccgttggatttagcaatgttcaggtcattggtgatcttgatgatgctcagcagagtgaatttaaaatgaagtgagttcatgggaggagaggaattggaggcaatgagaagagacaacccattaggagttttgctgtaatgggggacagaaagttgttctttgggaaaagaggagttgagaagtttttgtgttttgttttaattattagtgttttaagatggaataaataatagtcatgtttgtatactgatgggaatgatccatcagagaaagaaaaattgctggagcaatgtctttgtccagtcaaggggggatgggatttagtgcataagtggagaggctggccttagataggaacatagacaattcatctgttatgacagaagggaaggtgtattatatggatataattcttgtacagtaggtgggaagatgtggtgggggtttttgaaaattattttcaaatttcttttttctcagtgaaatagaaagcaatgccataagttgaaagataggatagggaggtgttagaaaaaagggggaaaagtcatctaggagaatgagacagttaatacacaaggggaatgtagtatgatttctgggcagaattaaagccccacttgggattagtagtcatgaatttaaattgacatcagccagatatggtgtctcacacctggaatcccagcactttgggaggcggaagcaagtggatcacttgagatcagcctaggcaatatggtgacaacctgtctttatgaaaaatacaaaaattagccaggtgtggtagtgcatgcctctatagtttcagctgctaggaagactgaggtaggagtatcacttgagtctgggaggttgaggctgcagtgagccgtgatcacgccactgcactccagcctgggcaacagagacccctgtctcattaataatagtaataataataaagtgatatcagtcagcagccacattagctgcacagttgcaggtgcagaataagtagaaagttggcctttgctgagcaaataaaatgaagtcagatggaggaaagttgtcagtgtatacaagagaatgattgtgaaacatgaatatttccgattgcatttttcataatagccaaaagctggaaataacctaaatgttcatcaactaatgaatgaatatacaatggaatattagccataaaaggaaatgaagtactgatacatgccacagcatgaatgaactttgaaaacatcatgcttagtgaaaaaccagatgtaaaaggccacatatatgattccatttttatgtagtgtccataatgggcaaatccacagagaagataattagtgttatgattggggctgagtggaggaggaaaggggagtggctgttaataggaacatagtttctttttggagtgattaaaatattctggaattagatagtggtaatagttgcacaactctaaacatactaaaaatcactttagaaaggcagattttatggtatgtgaattatatctcaataaagctatataaaaataacatgctagctcactagaaatttgcttatcccaaactcaacaaattgaacagctcagaaatatagctgagctgtatttgtaatcaactaatgtaggactaaggtgaacaagtagctgtattacaatgtttgcagtctcttttcaggtttcaagattacagttgtttttttctcagacatcccttagtattaaaatgttattggctaagttgcagagcttgtgaggagagaccaattctggctcagtcttaattacttagtatcttcatctctccatcccttcctctccccttccaattaacaaacctttactaagctataaaaatcatcaagcactatcctaggtgctactggttatacaaagatggattggactttgtccctccccttgaatgtgaggtttaatggggaaatgaggtttaggaacttggagcacatttcatttttagggtgagactactctaatcgttcttcagcatcctcccatctatagcttatagataacgtatgcactcaaggcataagaaacttatttggatcttcattacgcttgaaacattcttccttttgtctctagaacatcagacattctttctcctcttactctaaagtattttggggctaccagatgaaaactcataataattttcttctgatgctctagacctgaaatatcttttataaaaacttcaacattcaaaattacgatgtatgttaggcaaagcgtgcatactggtgctatctgcaaaacaaataataatgtttaccttgcaggattgttgtgagggatcaatgagtatacataattgatatatggaagtgtcaaacacacgagctcttcaataaacattagtatactttatcactttgccaaagtctacaaacactaattttatatatggcaatatgttgagattgcagatatagacatagaccttaacagacaaaccctaattccaaagagtttgccattcattgatggaaattaattggttcagagatgttgaccatgtctaccttattatttaataacttaattaacttactacaaatctatcgatgttttccatcttggatttttatatcataaaaatgtagaattcttagctcatgactatatgaaaaatagatatttgataatgctttttaatgattataagctaattatattttgaatctcatgcctaactgaaatgtaatgttgcatgctggactttgaatttactaaaaagttcttttgttgtcttcctagaatggagctggtttgtcaaaatccaaaggaagccgaattggatttgatagcacacagtgggtatgtagaataaacaagaaatttctcaattataatgttcatttagttcattcatttactccgtaagtatttgttgaatgatggcaataataatagctaccttgtgtggtgggtggccggttggtagtggcaggtaagggacaggccctttaccaagtgctttatgcaatgtcttatttagtccctatagaaagtttaagaagtgagtaaatattgttactctcaattcacttagagagattaaacttagttggctgataatttggtaagaccagattctgtctgcctctaaaacccacattcactgagctatggtgtttccctaaatgaatgaatatatgaatcagatttatttgaataagggaaaagtaatgatcaggaataaaaatctattcaacctattcctttataagatgaggggaaaccagcaatatatacaatatatccttgttttgttttagaaatttcagaacctacacattgataaaatatattttcctatgttttaaaactaaatttagaaagaaaaacattgctgggttactaataaaacacaacatttattctgttagcatacattatgggaatgaccagatatttcttgatacacttcaatctttggcttctctataactagagatgtggaacactttaaattagaagtggattttcagatcaccaagcagtggtcattttagatcattgctaacaccaagtagattttgaactactgtttaaaagtaaagtctgggatatcctattatcaggctccccagctctctagtctataagtgtcaatgtaaacttttaatttattaaaaatagcaattgttttgctctgtgaatttagggtattctgaggataaaggtaagcatgatatacttggaagttatactacccagtcacagttataaagattttagattaaattaaaaagaggtattttgtatgcttctctgtaacacttctctacctccatcccacccttaggaaacacatacacctaatacttggacctgatttatcatcttgtggttgaagtaatttgctgagatttaaaattcagtattttaacagccaaaggcaacaggggtgatctttcatacattttaacattataagatgtgatgatacttagagaaacatatatttttcagatttgccatttattaggagtcttcatctgtacactgtaaagcaatttcagcaaaaaatttaaagccgtagtagcttcagttggataaaaggttttcctttatcggtattaaccaacaacattctgacaacattcccaaaccttttagtaaatagagagagcagtcagagaaagtacaggttcactgatacattttaaaatggaatttgtgaaaaatttaaagcttaaaataatagaaaaaagtagcgtgactctatccttttcattcaagaaatgatccttgaggtgggagaaaataatggatttttttcaaagtctttacttccacggtacgcaagcaaaaagttgaagagcagcttaccacattcagtgagttctctttatactcttttacattgaggggactaaaaaaaattgtaaatgtggtcactgaatgactatatttgcaaaatcacaggaaaggagaagtactaacatacttctaaacttttagaaggaataaaaggtgaaatctcatcaatagtgtgatattgagccctggtaaaattctagggctcaatgtttatggagttattaaacagatgacttgggagcacttagaaaagaaaatgatcataattaggaactaggcttttactaagaacaagtcctgccaagactttttaggttttaataaaattttaatacacaggcagatgaatgggctattatggtctcagcataatctcttttcaacaagatgtttttcagtcttataaacaaaatgagttactgaaggtcagatgataatagtgatttagaattaattggatttagaatcaactggacacgtttccaaggagcgttaatgattgtattgataacaacttggaggatgtgtttagaaggtgagttatagaatctctgcttgaccctgacctaatctgtatttatattaataatggtaatgaagctataagtgtgttcatcatatttgtatttaacaccaacctgagatccattcaacaaacattaaagtaccttttatgtagtagttctgttatctcatctttcttccaaaaccatttctttcttgtttttttcctagtataaagcacagaaagtaataaccctaaaagacacacacacacacacacacaaaatagctaaattggactattaaaattttaaacttctagtcatcaaaaaacactattaagaaaatgaataagcatgccacagagtagcaaatatttgtaaaacatgtatctcacaaaggaatggtatcaaagatatatgaagaactcccacacgactcagtaatagattttttgttcatgcctttcatcaagttgaggatgtattttattcctggtttgctgaaagttttaaatcatgaatagatactgaattttgtcaaatgcttttttctatattgaaattatcatagtttttcacttttttctgttgatttgtcaaattttattgattgattttcaaatgctaaagtaagctttcattcctaggataaatactacttggtcatgatatttactttccttttttatctttttttagttactggaattgattttctaatattttattaagtatttttgcatctgtgttcatgagggatggtggactatacttttttttgtaaggtctttgtcaggttttgcttttttttttttttttttgagatgaagtctctctgtcgcccaggctggagtgcagccatgtgatctcggctcactgcaacctccaccttgtgatctcggctcactgcaacctccacctcccgggttcaagtgattctcctgcctcagcctcctgagttgctgggactacaggcacacaccaccacgcccggctaatttttgtatttttagtagagacagggtttcaccatgttggccaggctggtcctgaactcctgacctcaggtgatccacctgccttgacctcccacagtgctgggattacaggcgtgagaagttttgctgttgagtatggcactggcctcttaaaatcagataggaagtattttctcctgctccattttctcagaaagtttttgtagaattggtattcttccttaaaaatgatagaattcaccagtgaactgtctaagtctgaagtttttccttgttgttttgagggcagtttttttttttcctaacaaattcagtttctttaataggtatagggcaattcagattttgtttcatcttgtggcagttttgttaaattgtatttttaaagaaatttgtgtcatctaagttgaattttttggtgtaacattgtttatcctaactttttacttagctgtttctcacactgaggtaataaacccctataaggcagagattattgtattcttggcatttgcataatactctacactaaaaacaaataatgagactgattcttagctttatctcatcctttatccttacaattgatattttgtctatttatttatcttgtatatatttttatgagttccttcagattttctgaataagaatttattcttaatttcatgaagcacctttttgataggcaaacattcctataagtcttgctttcattgaagtaggcttttaagcaatagtgtatgccagatattctgtttatccttgctgttcttagatattacttattcctaagtgtgatttagtccattttcattctactgttgaatttttgtttttttcagtaggggaccctacttactacccagcagagttatattttgaaatattgcagtattagaaaagcacattatatatggcagtcatcaagcaggcagtgtattttggtctgagtcttttgcttagaaagattattaagcagcattacagatatgaagaaaaatggtacaaacaactgaattttgtttttgaaagattaacaagactgatttttaaaagctgacggatagttctctcaattttgcttgaaaagatttagctaatactaagagaataattttttaagcaccacattttcatgtcagataccacttcctctgtgaaatttcttatccttttgatgtatggtaaatttgtagcttactggtctgtacttttataatatgttgtatatgtttttcttgtagcatatttcaccttatattgaaaatgttcatctttcttagaagactgcttattgagagcagagaccatatgtgctatttaatcatttgtattttttagcacaatgataagcatggtatctattgggtaactactctgcattcttatacaattaatgaattaaaatgttataaaatagactgttgtgttggcttactggaattacgagaattctttttctctcaaacagcgtgcagttaaaaaatttattatgttaacatccaaccaaaatgtaccagtgtttcttattgatcctttgatactggaattgattaataagaactttgaacaagtcaaaaatacttctcatggctctacttcacaatgcaagtttttctgtgttccaagagactttactgcatttgcactgcagtatcacctatggaagaatgaggtaagtgacttgctttcagataatggaatgtgtctctttttacaaaatagtataggtttaggctagtttaaaatgtaaaacattaaaaatttttcctgaaacactttataaattgtatcaggaatattttcagctataaataacaatacaactaatcactaaggcaaataggggatttctttttcttatataatgagaggttaaaaggttagtggctattgatattagtttagctagccactgatgtcaggacttgtgtctctgaaattctttattcatttacctcattatcacaggatagctgtcgtagctccacatatcacatccatgttcacaacaggaagatgagaggaaagattctgcttttttgctgggggaaacttctcaatatcggtatttttaggtcatttctgttgaactgtttgatatctcatagaaaaagcctacaaggcttatttttacaaagaatattttataatgtccctttatattccccaaatgaagttcatagaaattataaccctcctatatacataattccccaaatcaatataatgtattaactataatataacctagaaataaaaggaaatgatatgtattgctgtgtgcagatgctccagaatgactacactggaagacataataaagtaattcagatgcttgtatttagaagtaggatcacagaatgtggtagctacaaatataaacccatactatgaatgatattgttgttggcaatatgattttccaaaatagtgagcaagtttccaacaacaaaaaaagtaaaattgtctcttcattgacatgactattgtattcctgagaaataaaagctcagacaattataaacaagtttttcactatgtgattatgtgacaggacatttgaaattacatagtacacaggatagattttcatattttggattgtaggatatctaatgttcttggcctaggactctaaatgccagtttgtcattatgataaaccaaaaatatccccccaaatttctgaagtatctgttgggtacagtcccacttgccttgagaaccactattttagaagaaggggagtatgccaccattggcaaaactgatactaccatagtcaagaggaagaagcaaaagctcagccatacccagaatcagcacatgggttcaagtttattcttcgtttgtttttgtttgtttgtgttgggttttttgtttttgtttttgttttttgagacggagtctcgctgtgtcacccaggctggagtgcagtggtgcaatctctgttcactgcaatctccgcctcccaggctcaagggattctcctgcctcagcctcctgagtagctgggattacaggcgtgtgccaccacgtgtgactgatttttgtatttttttttagtagggacggggtttcaccatattggccaggctggtcttgaactcctgacctcaaatgatccacctgcctcagcctcccaaaagtttctccttttgtacatatgacatcctactattcaagagattcaagagcccttggatagtcccccctaaaacatcccccaatgtggagctaatcagattgttagatctaataatgaaagactccatttgcatgtgatttttctttattaatgccattaccataaagtgagcaaacctctgccaaggctactgggagtggacttttctagcaaaaccttgacctaggcctttacaccaattgatcagagcaactattttgttctttacttctcttgttgatggttataagaaagcaaaccatatcataattctgcctattttgtctgtcagtctttcctcctataacccaaggtcacgttcttctcaagttctggccggccttttaaatatttcctgaatttgtcagctgataatgcctttcttttattctattcagtagtgtctttctctgaattggctaccctccccctcagtcagtgctttctacttctaaggtgtaccaagaaagaaaagggaagaagggaatgttacagttgataatgaaacaaatgatgttggaaaatgaaccttgtcttacagtatgtttgttaatttctaatgatttgcattatgatggtgttctattatggtagtattttaagatgttgggatgtaaactatgagatgaaagaactacttttttgaagtacttttgaagataaaggttattaaaagttaaattaagaattacaagtttaattttaagtgctgtccttaaatcaacatttactttatagaaactaactggaaaacactaacatgagcattctcattccaaggaagggatttgtattaattttcatagagttttttttgttttttttttttgagacagggtctcactttgtcacccaggcttgagtgcagtggcacaatcttggctcactgcagccttgatctctcaggttcaagtgatcctcctggctcagacccccaagtagctgggactacaggtacatgccaccacaccttggcaaatttttgtttgtattttttgtagagacaggttgcccaggctggtctcaaactcctgagctcaagtgatccacctgcctcagcctcccaaagcgctgggattacaggggtgagctatggtgcccaacctataaagagagtctttggctatatctttcctgctacatactttgtatttttgctgctttcctttattctcccaccactaccttctgcccatcaccctcattaaaaaatgttcttacagagcagattagcacaaaaatatggctcaagttcaatataagaatcactttagttttgctactagtatttggctttaaatattcaatgtttaagtgttgtttcttgatgtttgatgcttctttggttctaggaaggctggtttcggatagctgagaatatgggatttcagtgcctaaagattgagagtaaagatccccggctagacgggatagactcactctctggaactgaaatccccctgcactatatctgcaaactggccactcatgcgatccacttggtagtctttcatgagaggagtggcaactacctctggcacggccacttgagacttaaagaacacattgacaggaaatttgttcccttccgaaagttacagtttggtcgttatccaggagcttttgacaggtaagttcagagtcaaaacgtgaaatgtgaaatgagtgttgttcagtcataattcttgcagtgtttttacatttgagtattgaaatctaatatataatttatataagtatttacagtaacattattcttaatgactccaaattagaagccacccaaatgtccttcaacaataaaaggattggctgggcactgtggctcatgcatgtaatcccagcactttgggaggccgaggtgggcagatcacctgaggtcaggagttcgagaccagcctggccaacatggtgaaacctcgtctctacaaaaaaatacaaaaattatccatgcattgtggtgggtgcctgtaatcccagctactggggaggctgaggaaggagaattgcttgagccctggaggtggaggttgtagtgagccgagattgtgataccacactctaggctgggcaacagagcaggactttgtctcaaaaaaaaaaaaaaaactgtaaaggaataaataatttttgatatatgtgttcatacaatgaagtattacacagcagggaaaaataaactaggggtctgtgcacattgtggatgaatcctacaatgctgaatgacacaaggcacaaaagaatctaaattctattattattattatttttttccattcaaaagtttcttttattcattaataaacaatgatatatatgtatacacagcttcataatcataccaaaaaagtttaagtgaactatcctttaaaggctgagaccataactttttgaacagaaataatatggattataagacagtatattgatttttgctgtctttattttaatataaagaacaaattgtgtggtaagactaatttattttcccactttgaaattaaacctctctagaaacatttagataaattatgaactaatctttaaaataccgtattacttcagcatttcaaaatcagtaagtttggaaactgtatttaagttaatattaggaataatataaccactgttgataactaacaatatagccaaaagaaaatgtggtacatacacacaatggagtactattcagccataaaaaagaatgagatcctgtcatttgcaacaacatggatagaactggagatcattatattaagtgaaataagccaggcacagaaagacaaactttccatgttctcacttatttgtgggagtgaaaaatgaaaataactgaactcatggagatagagagtagaatgatggttatcagaggctaggaagcatagtgggagaaagaggggaagagggggatggttaatgggtacaaaaaaatagttagaaataatgaataagactgagtatttgctaggacaacaaggtgactatagtaaaaaataattgtacattttaaaataactaaaagtatacttggattgtttaatacaaaggataaatgcttgaggtgatagataccccatttactctgatgtgattattatgcattgcatgcttgtatcaaaatattgcatgtaacccataagtatacacacctactatgtacctacaaaaattgaaaatacaaaagtgaaagtaaattctattattacttttataaaaagttcaaacacatgctaaattatgttcatggatgtatacccttatagtaaaagtattaagaaggctaagcaagacgtaccaaaaaagactagatagaggacacagagaactacagggaaactggaagaattttatttctgtggtggagactttggtgtttactttataattcattattttgtgcctttatgttatgcactttcctatatattttttaaaaccatgtgcaaaaatttatctttggctatctcaataataaaaatatttcttgtgagaaacagttatttgaaggaactcatgtaaaatttgattagctatagtttataatattaacaattacaggattaaaaacattcttgaagttatacttggagtatgaagtttctaacctagaattgttccttttattctccttttgaaatcagcgataatgatgttacagtctactttgaatagcagaatctgatgtaaaggtagcagtaaatatttgtaaggattttcacattaaaaactccttcttagtaacttccagtgagataattcttatctgttacacttgagaagtgtaagagtatgtttattcttgccttcttttaaaaatatatatatatattatatatatatgttttctctctatctggaatcatgtgagattgccttcttattagtacttaaagtcacatatttgagaatgactgaaaaaggtattcgaaactgaagtcttctatattttttgtgtatgaaaagtcggaacttttctgaaccaagccatattttcaaaatgaccaaaaaaaatgagtagagatggagaacaatactttgtttttattattggcttctcttattttaatcaaaaatcttaatactcactgttctcttaccacttttttgcctgtttttttcttattctgtatttcaaatgaccttctttagggagacattatcttttagttttttaaagctttgtgaatttatttcaaaatttaataacttagtaaagttcaaaattgtgagttacttattaaacataaacatgtgacaatagataaaagctatctctacattgtaaaattttatatgagtaggaatggaaaactctcaaataatatttttagagtatgggatccaaaatacataagatagatttgcagattagcattttacccattaatgagattctcaggccattgtaattaacttgtgtgtcttaagtgttaaaaacatttacttctctaaaagtaaactgataattaaaaattatgtcacaaaatttttgtttctgcttaaaatgccaagtgtgtatgaacaagtacaaatatattaatatataaatacattaaccaaaataattaaaactcaactgtttgatgtcagatttttcaaggtcttattaaaattgctaattgatatctgacataattgatgaaactatgcttgatgtttaggtattttgctaatgtttgatatttgtaagaggctgccagtattctgggttaaatccttttaataaatcttttattattattattattatttttaaattttactttaagtagtgggacacatgtactgaacgtgcaggtttgttacataggtatacatgtgccatggtagtttgctgcacctatcaacctgttatctaggttttaagctctgcacgcattaggtatttgtcctaatgttctccctccctgtttcccccacccctcattaataaatcttaacttttgttttcaggccagagttacagcaagttactgttgatggactggaagttctcattccaaaggatccaatgcactttgtagaagaagtaccacactctaggtttattgagtgtaggtataaagaagctcgagcattctttcaggttagagacaaccaaatgtgtacttttaaattaaagaaaatgttgggattatttttaatatttgagggtggtaagatgaaggggcttatggaaaatagaaaagtaaacatccttttttgatatgtctcttttcttctagattgttttctttcagttttttttagaagtagattaaaaattaaccttaagaaactattttctaagtcaataggttgatatttatttattgttttatttgaataactttaatagatttagcactggcttctgccttaagatagcccattaactttgtgaaaggtggtgtattctcagtccaagtaggataaagccactatagaagatggaccatgtagatttagaaaagacttcatgaaaatacagtttgtttcagagttggcattgaatataattttttttgcatttatgaaggtttttgaagataaatgctacacaaagaccaggtgcttttaaaactttattctcttgctgcagctttcaattcaatacacatttattgtgttccgcaggcttctggccctggggatataaagatgattttgaaaggcatgaaagttcagctctaagagatgacatgaaacacagagatacagtgaaaacaggcaaatttacagtggggttttggtacctgaattctttcacttgccctttattttctggggttccctgccaagaaagctgtgtccacgagggatacgaaaatgaagtatataactgtcaagtgcccaagacccacaaatctgaggtttctctaatacagtgtactggcacctaaagctgaggcctgacagcccaagtgggccttcgtagccctatttccttaagtcattgtggagctgtgaaatttatgcagccagcctcatgaataaaaagctgaaaaaccacatgtgtggatgggcctactctagtagaaaagtgctgcctgacatatgcctaccacataataacaggaagtagaagagatggagttttgtgcttaaacttgaccgctcttcctgtcctaagggagtttgctgtggttgtcatctctattatagcaattatcacagtgaattatgaatatctgtcttgtcctcttatcaaattttatgaacttcttgataacaggagtgttcttttatttacctgtgttggcccagtatctactgtacctggcataaagaaaagatccagtagggtcagttttcaaattaaagtgaacatacatgtatttgaacacttgatggcgccaaacagtcttaaatgtaatgcttggtgtaaagcaataaattaatctaatagacctcatcaagcagccgcctttctttttttaaaataatttttaaaaagcaattttaaatacataaaagctgcaagtacagtaccgataacttttttttttctgaaccacttgggagtaagatgttgaccacaacttcaaaaaatttagtatttttttaaaaataggaacattctctacatgtcctaatatgaaagttaggaaattagcacatacatttttaccatttaatccctattcaatttttgtcagttgtcccaataataacctttgtaataaaaagattcgattcagaatcacatgttgtcttaattttcctgtctctttagtcttcttcagtctgggacagtttctcagttcttttattactttcatgactaatactttggaagattacaagccagatgttttgtgcagtgtccctcatttggggtttgtccgggggttcctcatgttagatttaggttatacttctttagaaggtatagaagtggtgctgtgttctcattacatctcactgggcactgcataattttgatttatcccattactgttgatattcacattgttcacctgattaaagtgctgtctgaaacttcgtatctttaccactatgaagtttctgtttttccctttataataataagcatctggcaagaagttactttaaaactatgtaaatattgttttcctcattacattttcaatttatttgttcatatcaatataaataaattcatggtttcctattttaccctatgggttatagtcaattattttcattatttattttgatcttcagattgttccatatttggccagtagaaactccttcataatgctttctgtgtccttttgacttgtctccgttgttttttgaacactttagtactttttggcactataaaatattctgggttcatcttacaattttcatacctccaccctgggatcagccatttctttaagtcctgtttccttttagaagccaagacctggatgccaggtgtacccattgctatttgggttttgctgcagagagtttctctcagtgaacaggggtagggtgtatatgtctgtgtgtatttatttctgtatctatctattgaaacctctgaattcacattgacatctccagtccggttaaaagttccaattaaacaacagagttcatttccatatttgcgactcccttttcaaatcgtgagaaatctgactcccattgaccttaatgtttacttagttgttcagtctccctgtatgtaacctatcttccaacacatgtcctcccctccctaccccctgttcttctcaccctacctgggcactgctatcctctgctgggctgcacacacgtagaggcattcttcttaccctgttcaggctctgacttcccacacctggctgctgttctgcagagaggctttcctcaccctgcttgggctctgactccccacactggacactctcctactctcttcatgtggatgtcctcattacctgcctaggctctgataccccgtatcaggcaatccctttgcacaaaaacctttcttgctctgccccatctaatggttttagtatcgaatagttcaggaagggcgggagactttatttacttttaattattttctcaatctaccatgaagttcaaaaactagaataatataccttttcctgaatttgattttgttttagcaaaaaccatcacaagataattaatgagctccaggctgttgaatatcagtgaaaaaccaaaaggaaagttggaaatacctgtacacctggcctaggaatatctagataacaatatttttattttatttctactaatttgctctaagattttgggcaaatttctgagccttggtttcctcatctacaataagagttggtaccttctgtcatcttattctttgatataaggtttgtgcttttggattccacgattcttcttgggctttgtgtccccgttcattggctgaacaggaaaaattaaataaacatgatatttaaagtaggatattaattttgtctttttttagaggtatagtaatcctgagatttgtacttgggatttatttttatttgtttacttatttattttatttttaacttgtaagttcaggggtacaagtgcaagtttgttacataggtaaacttgtgttgtgggggtttgttgtacagattatttcaccacccaagtattaagcctagtacctattagttatttttcctggtcctctttctcctcccaccctccaaaagaacccattgtgtgttgttcccctctatgcgtccatgtgttctcatcatttagctcccacttataaaaacatgaagtattaggttttctgttcctgtgttagtttgctaaagataatggccttcagctccatccatgtccctgcaaagaacatgatcttgttcttttttatggctgcatagtattccatggtgtatatatactacattttatttatccagtctatcattgatgagcatttagattgattccatgcctttgctattgtgaatagtgctgcagggaacacacacatgtatgtgtctttataagagaatgaatgatttatattcctttcagtatatacctgataatggaattgctgggtcaaacagtatttctgtctttaggtcattgaggaatcaccacactgtcttccacaatggttgaactaatttacactcccaccaaccgtgtataagtgttcctttttctccacaacctcaccaatatctggggtttattttattttattttattttattttattagtttttttttacttgttatagtagccactctgactggtattagatagtatcgtattgttttttattgcattttctaatgatcagtgatgttgaacttttttcatatgattgttggccacatgtatgtcttttgaaaagtgtctgttcgtgtccttcacccactttttaatggggttgtttggttttttccttgaaaatttgtttaagttcctgatagatgctggatattagacctaatagttaaggtttgcaaaccatagtttgcaaaaatgctctcccattccataggttatatgtttactctgttgatagtttcttttgctgtgcagaagctctttattttaattagatcctatttgtcagtttttgcttttgttgcaatttcttttggcatcttcatgaaatttttgcctgtgcctgtgtcctaaatggtattgcctgggttatcttccagggttttatagttttgggttttacatttaagtctttaatctatcttgtacaggatatttttaaatgaaaaaagtatgtatactataatttttaaaatttatagcagatgtttaaggtatatagctctatgcatgtatgcactttaacacatacaaggatcagttctgagaaatggaatttctggctgggcgccatggctcacgcctgtaatcctagcactttgggaggccaaggcgggtggattgcctgagctcaggagtttgagaccagcctgggcaacatggcgaaaccccggctctacaaaacacacaaaaattagctggacatggtggtgtgcacttgtaatcccagctacttggaaggctgaggtagaagaatcacttgaacccaggaggtggaggttgcagtgagccaagatcatgcccctaaattccagcctgggcaacagagagaggagactttgtctccaaaaaaaaaaagaaatggaatttctgagagtgtcatgttaagaaaagtagattggggtgggaatatgtccatatgggagcagtaccagcagcaggtaactatcagacctgatgtttttgtagagcacaaatttttcatatttgctgtttagtcctttcagtcactctgtgtaataaggcaaggattcttttaacaggtaagaaaattgatgtttcaagatgtcagttacatggtcatcattggttgagcatggactaaatcctaggtctccacctcttaactccaggcttttcctactacaacaagcattataacatgtatctctcattccagtcatttattgtaagagcacttatggctttgaggaaagggatgtattcaaattgaagggatcctgtgtaatttgtatattctgtagacagtgacttatctgcaagaaattcttcttactgaaggtagggtactttttgcttaagattcatatagtccatccaggatctatattctttcctactatattgtaaaagaattacaggatattttaggatgttgcaggcctgggaggggcttagtcaatcatttattcatttgcccattcatcagtatgtgtttttcagatattatgtgccaggcaccattctaaacctgtagatacagtgatgaagagatgtagtacttgccctcagggaactatctttacagtctagtggagggaatataaaattgatgattaggaataaatatgatatgaattatagtaaaagtatttacaagtggtaactattataagcttgttaaggaaaaagataattcatttgtctttgtatatctagaaccaaacataattctttgctctataaatgttgaatagaaacacttcctgaataggaacattggaagaataaatacatatgtcttcctgggaaaactggggaatgttttgcagaggttggagctgagacttgaaagattttattgatcagggccatatcagacaaaggaaacaagtgcggaggcttgaaaagttgtggtgtatttgaggagttacaagttattgtggtatatttgggggtttacaagttataagatgaagtgtgaggagatgcagatgaggctggaccccagtagtcaggaaccagaacacagtgtttatgtccaccaggacaagaagtttagattttgtcccacaggtagcgaagcaacactatagaatttatagtgctttcctcagctccagaacactctaaaaacgaagagaatcagaaaaccaagatgactaaatgatatatatgacctgacaatttgcaagacatttttctccttcaatcttcacagcagtcctgtgaagtataataattatctttaaactacaaatgagaaaagtagatacaagagagatttgtttattacattctttcattcattcagcaaatactcaggcactactctacccactggagatataatgataaaatgaatgcactttcctcatagaaagtgaggatgatatgtacatggtcaaagctaaaaagaagtgcactagatttgataatctgattcaaaatctcaggctttttctactatactacacagtctctaaagaccaatagaatcactgaatggtgaaaacattattaaattctttttgtttcagctatgtttgtagctctcataattagctttattttatcctgattgtccagctactaaattgtgatgtaaaggagggagctgataaaaggatgtctcatcctttgggaatcctggttctattctttcccttttaatttatctctccaagaatctgctcttaagtgttcattttaatgtgggacaaacaagtaactgtaaaatgtggtttttataatataaaaagattatatggggttagttttcttttttttctcctttctttcttttttttttttcttttttgagacagtctcattctgtcgcccaggctggagtatagtggtgtgatctttgcttactgcaacctccacctcccgggttcaagtgattctcttgcctcaacctctcgagtagctggaactataggcgcgggccaccactctcagctaatttttatgtttttagtagagatggggttttgccatgtgggccaggccagttttgaactcctgaccccaagtgatccacctgccttggcttcccaaagttctggggttacaggcgtgagccactgtgcccagcctggggttaattttcaaatttaattcagatgccacagaaaggttcctagcaatttagaaatggctgtaatagctgactatttattatatctgtagcagtaccttgatgataacactgtggaagctgtggcctttcggaagagtgcaaaggaattactgcaactagcagcgaaaacattaaacaaattgggagtaccattctggctgagcagtggaacttgtctaggtaaaattcttacgactttccatttgtctttctgtcattttgtcctctggctttagggattactgcttgagatgacaaaatatcagtgacatttgaagtgtcatgtgtatagacagaataaacatgagtgcatgcagcaaggatctattgatttccttaaagaaattaatttgagaattataaaaaagaatgttagaaaggccatggttgtgtttactcataattataaataatatgtataaaatgtatatcagaacatgtagactatacaatagtccccccttatccatggacaatacattccaagaccaccagtggatgcctgaaatctccgatagtactgaaccctatatacgctgctctttccctatacatacatatgatgtttaatttataaattaggcacagtaagagatgaacaacaataaataataaaatggaacaattttaacaatactataataaaagttgtgtgtgatctctgtctctcagagtatcttattttactgtactcactgttattcttcttacgatggtgtgagatgataaaatgcctacatgatgagatgaagggagatgaaggatgtaggcattgtgatgtagtgttagtctactattgaaaatttcctgggaaaatcaaggaatgtgtcacagaggctaaatctgagccctgaaagatttgatttaacacttctgaattgtttatttctggaatttaccatttaatatcttcagatcgtggttgtccacaggtaactgaaactgctaaaagcaaaaccacggatatggcaggactactatagttgattctcagataatccttaaattagcattttattatttctatcccaaagattgttattgcctttttttataattataaaaaaccctctatttctttacttatataccattcaaacagcttgcattgcaccaaatgtttctactgagaggaacattaaagacagtgtcataaggtcttccatcagcctttcctaggtcattggtagtatcactaactagacatcactgttcatctgacatggacatacagacttttctacagtccttaagcaggttgctattagaatctgtgagtgatttctgggtctctgtccactgtccattaaatcaaacttctttggaatttagaattatttagaatcttaaattttgttttgtgtttatttgttgtctcttgattatcatgatagttaattatagctgtatttgctttttctttatagtaaccatatctgtacaaaagttaattcaactcctgcctttatagggatagggttgccatccaatttattgttcaattcaagagacttgagagtgaaaggaagcaccattaataattatgttggtacaacaggcataaactgggatatacggttatcctatctattagcctttgttgaaaatttacatggttcttcctgccaaggagcttactactagaataagccaaaaaaaaaaaaaaagtacatctcacacatttatgtgatatttgctttaaggtttaattttttagaaacaagattgttttataatgtgtgtcatcaaagacacttcatagtcatttgacatgatttgttttgagttttcagtcccatggttttctgtctgatttaagggcacttatgagggagttgtattagatgatatttaagaaaacttttatttttaattgtttataattctttaatagaattattttagaattccaaacaatattatccaacagcaatgcctataaggataatcgcagtcatttatttacttttgaaataattggaatgaaatgattagaaagatcataggggagacccaggagtccttaataatattaaggtacatgttttatttcttcagaacagtgctatagcaatgaattagagcacatacgtggtaaacacttagaaatatcatttggcagtgtgttgaacattgaagctgctactgcttttctttttcatacggcccatcaggtggtcactgttgagagctgttaggttctacaaattattgctcaagaaaaatatattggttaagcaaaagaattaaatattttttgcatatcttaacagccccctctatcactagagattaatgattaaacattcttatcagcaacttagtgttattaaagctaatggtttattcagaaactaaaatatatcatgaaagtttttgaggaagctgagagtgctcagacagtaaaaatagatacatagatagatagaaggttcaggtgactgctcaaacaaagtcatttagtttgaggtttaatttttaaaaataattttggtgaagcatcttaagtctaatcctgtgaaataaaatccattctatagccccagccactcaagaggccaaggcaggaggatcacttgagccaggagtttgcgtacagcctgggcaatatagtgagactctgtctctttaaaaaaaaagaaaaaaaatccttgttacaaatataatttgttataataactaattttttccaaacctaaattttgttaaaaaaatttaatcttctttttaggatggtatcgacaatgcaacattattccttatagcaaagatgttgacctaggaatttttatacaagattacaaatctgatattattttagcatttcaggatgcaggacttccgctcaaacacaaatttgggaaggtcagtaacaaaagtcggcttcatttcataagtaacatatctcacttgtaaagtttacattaagcaactcagatatggttaagaatgctacatacataattttatcactcagtattgactaggatgagttcagcagaagcctgttaccacttgtaatttctgcactgtctaggcaaaagcaagaaaatctggctttctactgggttggtgcaaaagtaattgtggtttttgccattacttttgcaccaataatgataagaaaagaaggatcttgaactcttataggtgaatgtattgctattatattaggcaacaatgtaatataaaatcaatataatgtataatatacaattaataagtaagaatcccacccgccgtacctgattgtttctcatgagtcatttaatttacagatgtcattatcaacataaaatattccattgattgctaagggatagaaatatagaatcatttcaaataagtacttcaatttcttgtttatcttatatgtcctaggctatagcagtttgctcagacatcaactagggataggtcattggggcctagatgaaatctccctctagacaatttgattcctatgccctaagcccatgatctcttgcaatcatcttgttcttaatttgcttgtcccctcggaggtgttaccctacaagcaagtaaaaatatgtttagtcggctgggcgcggtggctcacgcctgtaatcccagcactatgggaggccgaggcgggtggatcatgaggtcaggagatcgagaccacagtgaaaccccatctctactaaaaatacaaaaaaaattagccgggcgcggtggcgggcgcctgtagtcccagctactggggaggctgaggcaggagaatggcgtgaacctgggaggcggagcttgcagtgagctgagatcgcgccactgcactccagcctgggcgacagagcaagactccgtcttaaaaaaaaaaaaaaaaagtttagtcaccagaaaattattttttccatcataaatagttattttatgttactaaaaaatataaataaaatattttactgaggtcaaagtcaaataacagagctctagttattcagcaaacatttaccaaacattcactataagtatggcactgtcctctgcacctgggagacaaagatgaataaatgatagttcttacccttgagaagctcactgtctaattgggagggggaaaggctgcataaataattctgtgatgagtgctgtggcggacagatgtaccaagtccaatgggaacgtaattatttgtatgataagttttctttagggaaatgttctcagaattatttatttttttaccttaacttttatttttttcttttttccatgtgtgtagtataatgagctagactatttatgtatgtggctatgaggaatgccactttacttaagtacttattgattgttatgagagacttatttcctgatagttttatttggattattaaaggaaataatatttctttggttcttttccttttttagtcagaaagctgctctggaataggatatttctattttttttctgcagtgataattaccataagtcatttactctgagttatcatcaattgtaagaaacattattttagatgcagttaagaaattaaatgatatgttactgatgcatcccaatttcagaggtgccttaacttgaaaaaatgtgcatcttagaatgaatactctatgtatgtaaaacttaagaatctgtttctttatttttattttttaaaaaaaggtttttaaaaatgtatttcctttgtttcagtgtgtgaaggttttcatcttccccataggtagaagacagcttggaactatccttccagggaaaagatgatgtaaaacttgatgtttttttcttctatgaagaaactgatcacatgtggaatggaggcactcaggccaaaacaggaaaaaaattcaagtatgaatcaaataagtacttatttataaaggtactacagaaataatttcaggaggtagaaataaagaagtaactgaaaagaaaaccaaaaatctctttcaagactccattattagctaacactttcttagcttacccatagagtccagttatgcctgtgaagtaagaatacctgtaaggacggtttgtgaggaggaagtgtccctgggtttgtcagtccaagttgatgatacagctggtctattctcagttctgagagagagaatgagaatgagaacctgaagagcatgggttttagagtcaggctgacctgggaaaccttagctccaccctaatttgtggcctttagattttctgaacgtaatcattttatccattacattgagtaatactactgtgtgtcaggcactattctgaacgttttacatatattaacccatctagtcctcaaaataaccttcagaggtagatattctgaagccagtgtgattgctgttgaatctcagctctttattttaccagctatattaccttgagcaagttatttaacctctctgcctaagtttcctcagctgtaaaatggaaattatagtagaaattgccacatagagtggttttaaggattaaaagaattaatacacaaaaagagctttgaggtgtgtcaggaggtcctgggtgctaagtaattattacctgctgttactaatactactatagtagtagtagtagtagtagtagtagtagtagtagtagtagtagtaaagaaaactatttctcttcttattctcatgagaaatttacagattagagacatgtataattatctcaatattaaactgttacatctattcttagagaacttctgtaagagtgtcaccttttttctaagaaagataatttctagagccagtattagagtcctgttattcttaaattactttctaaggcttgaattttttctctcactgacatgatccgaaacctgcaaacctcaaaagaactgttcatttccaactactacatttctggagagaaaaagcttctttcattctgctttaacagctctttatagtagcagtgtttgggaagtgtgaagtgttctgattatttaacaagagaaatgagcagtgatagaactgtctggacagatggtgtgagtcccagattttctatcatgttactgtgaccttaaaaggcagagaaaagaacaggagatggctgagtagagtagtttctttggaagattcccccagccatatgccatttttattcttttcggcactatttactttaagaaaatgtagtatttttaacactactattccttggggatgaagaaaaacaaaatgtttaaagctagttcaagggtctttttaatgtattttaaatttttgaatagattatacattacatagttaaaatattcaaagaatataaaggatgtgtatgaaaagttaacctttctccatcctctgcccctcattttcccgtttctagttgccctttacagagataaccatgattactcatttcttatgtatcctttccgagacaaacatatgctcgtatacatatagtatttacgttcatctctccccctttacacaaatagtattatggcatattacacactgtctgtatgttcttttcctcacatagctatgtatcttggaaaatgttccaaatgagtatgtatagaaatagctgcattttattccattgtatggcaataccataatttattcaaccaattccctattgatgaatatttaggctgtttccagtagtttactgtgaccctcagttctgcagtcactatctctgtccatatgtctttatgcacacgtgtgaaaccctgtgcaggataaagtattagactcaaattttggggctaaagggaatataagcatatttcaattttgatagatattgccaaattgccctccaaagatgtttccccaatttatattctcaaccacatggtttgagaatatgggtttattttttaaaagtgcactatctgtaaagagaggtaaacttgctcaatatttgccactaatcagtaacttatcaattacttgtaatcagtaactaaatctaccatacaccaaatataattgggagcacattagaattactgttcaaactagtcagtataatgtatcatctcaccttctccaaaggtctttttgtctttataataacctattttttattttatatatagttcattctgagaaaagcttaataatatagaatgcttactattttttaaaaggcagaagaggaactcaagaaggaagaaaaaagattttctttctaaactactctgcaggactatagaatgatatctttggtcctaagatttaacagtatattaagagtaataaaaaagataaagcttccaggatatctgctacctatcaggcactgtgataggtagttcatatatatatttatatatataatctggttaatcctcatactatccctgtgggttcggtattctcacctccagttagacattaggaaactaaagctcagagtgaagtaacttactcgaggcttttgactgttaatggcaagatcaagatttaatgccagacctgtttgacccctaagcctaaatgctttcttcttagagttaataggttaagtgagttagtacatctaatgcatttagaacagtacctggcacattgtaagtattgtgtaagtagtagctactgtcagtactgtattattattattactgttactgttattataattaccatgctgcactggcataaggtatggtactttcagcacagtggtaaattggattagtaattttctaggcaggcatattttcttcctccgtctcatgatactcattccgtctttagttctcagtctttcacttctttataggaagcccttcttttacctgaaatccaaattccatttaaaaatattgactggattctttattctgtttttctccagcatccaaatctgccagtaataaaagtgatgaatataataactatgcctccagaatgtgaagttcttaattcaacttcacatttcctaaagatgctgcctagatttatttggtttgcttctttccttcccattttgaatcaactggtatgggtagaagccagaagtttgaaaggtaataataatagttaactttattgaatacttactataagccaatcaatatgccaagcttttatatgtgttatcttatttaatcctcacaataagtttataaaggagattttatcatcatcacctttattttatggatgagcaaattaaggcagacctgagtcagacctaggtgtgtatcacttcagagcccatgttcttactaagttagtgtcaccatgatctctatcatgttgttaataccccttccatgaaaacattatcagggtaatacaactactgctacatcctctaataggaaatctactccttgggctagtagtgggttccttataccttctgacagttgcagcttctgattattggatagatcttcagaaaattcagattcatcctctgtggaccacactcccatccaggtgtggatcctgtgtaatttatcacttcatttctgtaaaatgtatttaccaactgctatgtgctaaggatactgatgtgactgtaacttagtttctgctcttaaggatctcatgatctagaccatgagacatgttaaagtactctgatagcagtactgtaatcaaatatgtataatctatagttgaagtaccaaatcagccatatctagaaacaatggcaaagaagtgtggcttacaagtagagaaatttgttaggtagacttaggagaaatgtgggaaaagtcctaaaaatagatttatttaatgatttttaaattagtttatttctattttttaatttaaaaaattctgtgggcatctgtatacgtaaagtaaaaactttaaggggttgtttccttcaatagatacccaaaggtagaattattaagtcaaaagatatgagccttttaaagagttttgatacatattgccaggttgcattcctaaaaagttatgcaaaattttatacagtcaccaacataaatgagcatgcttagtttgctatatcatactgagtgttgcattgtactcacagtcattcatgactcccctgatagtttctttgagtaacttttcttttcactttcttcttattatcccaaggtatcttctatcataaaaccaggtcagtcattagtagcaagttaccaacaattattacctttctggccaggcacagtggctcatgcctttaatcccagcacttcgggaggccaaggtgagagaactgcttgagcacgggagtttgagaccagcttgggcaacagaataaaccctggctttatataaaaattttttaaaaattacccaggcatggtggcatgtgtctgtggtcccaactacatgggaggctgagacggtaggatcacctgagcccaggaaatctaggctgcagtgagccacatttgcaccactgtactccagcctaggtgacagagcaaaaccaaaaaaaaaaaaaaaaaagaaaaagaatcattacttttctcttaactattcctaacatcaactggcttttagtatacatctaaccccctccctgtcgtcccagtctccctttcaaaatccagctttaaaatattacagtgcattttgaatgtcttgttataggtgtttgttagacacttattatatagagacttttatatttaagctttatacaagtgtgattttagctgagtgagcccaggaattagaagacctgaattcaaatctgagttctatttttttgtgtcatataaccttctgagcttcagatttctcctcttaaaatgggaataacactgcgtacttcacagggtataatgcttcgattaaatactgtgtagttacctgattcagtgcttggcacgtaatagattcacaactgtttgctaattctaaattaggcaggcagagcatagaagtctgattaggaagattcattgctaggtagcaattagaaaaaaaatcacatggtagtgaattaaagcctaccaaatgttacagagatgaatataaacttgtattacatataactgcagagagatatagtttataggaaaaaaacgtgtaaagagtactgattctttggaagttttctctgaaagtgagggttgagtcagcacaatttgaatgaatattgttgaatggggaattgctattaagttagatttggttgcctctaggaaaagagacttagggccatgtaaagatgatatttggcaatgctggtaaactggttaattgccagaaagtcttgttgtttggtggggtttttgactggatgtaataaagaatctctctcataaggcttttggtggagaatgtagtaagacacaagtcctgttgaggaatattgttcttgctagtgtgtgtaggcatggaaagctggtatagtgaggaagacttgggtggttgaggacctatgctaaacaggaggtgaccggaagaaatggtaaaagaacttagcaccatgcctggctgtgaacaaggggagtccaagaaaactaagtgtccaaaataacatataagtttataatcttagagctagagaaaaattaggaaatagtggattattatgtttttaattgaagtgtaacatacatacagaaaactatacaaagcaaatgtatggctccaagaattatcaaatgaacaaatgtgtaaccagcaccccagtaaaaaaaaaaaagtatttgtcagcaccccagaaacccatatcattttccctcacgatcatagctcctgtttcccacaaggtaacagcgatgctaacttctggtattacagtttagttttacctgtttttttattttatataaactagatggtatgttgctggcttcttttcattcaacattgtatttgtgagaaccatccatatttttacatgttgtggctcttcattttctttgctgtgtagtagttaattgtatgaatatatcacaaatatttattaagtccactaacccaaatagtagttggatatttgggttgttttcaatttggggctattataggtgatgctgtagtgaacatttctgtacgtgtcttttagtgccctggtacatgcttatcttagtttgctcaggctgctataacaaaataccataaactgggtggctcataaacagaaatttatttctcaggtttctggatgatgggaagtccaagataaaggtaccagcatggtcaggttctggtgaaggccctcctcctggttgtagactgctgatttctcctcacatggtgaaaggagcaatcaagctcccttaggccttttttataaagtttccattcctgagtgtttcaccctcatgacctaatcacctcccaaaggtcttacctcttaataccgtcaccttggaggttaggatttcagcatatgaattttgaggagacataaacattcaaaccacagcaatgtttttctattgggtttacacataaagtttgggattgcttggtcgtagggtattcttgtgttcaatttcagcatattgtttacaaatagttttccaaagttattccaagttatattccagtatgttatagaactttccattgccccacatttttaccaacgcttggcattgtcagacttcttaatttgtaaccattttggtaggtgtgtagtgttaccaaattgtagtttagatttctttttccttgacttaatgaaggcaagttcatgtttactgaccatttggatatcctcttttgtgagttactggctgagtatcttgtcagggtttttttctgagttgtctgtctttttcttacttgaaaatatcttctcccaatttgtgcctttcttctttattcttttttttttttttttgagacagagttgtcacccaggctggagtgcagtggtgtgatcttggctcactgcaacctccacctcccaggttcaagcagttctcatgcctcagcctcctaagtagctggaattacaggcacattccatcatacccagctatttttgtatttttagtagagatggggtttcaccatgttgcccaggctagtctcaaacccctgacctcaagtaatctgccctcctcggcctcctaaagtgattggaatacaggcatgagctgccatgccagcccttctttactctcttaatagtgatttttggtgaataaaaagttattttaatgtagttcagtttatctattatgggtagtattatcgtgtcctgtttaagaaatctttccctatcccaagataatgaagctattcctcttgtactaccttctagaaactttattgttctatatgtaatatgaagtaaagatcaaatttagactctatactttatttggattcactagcttttctaccaatgtgctttttctgttctaagatctaatccaggataccacattgcatttagacactctaccttttgaaactttattttggtccaagattttaagcttgtcactagtaatactagattatcatacatcactgcatgtcccacttctgctcattcaagggccttacgttgctgtctgtttgaactagcttcttggtaccttgatctggaaataatcttctcttcctctgcatttctatagattttctttttctttccctctctcatgctttattggagtacttttgctgatttgtctgtcctttctatgtgatagataaaatcaggcctggtacatgtttggctaagtgagacctgagccctacatgaaactaagtcagatcctcttaagtgtagtctacactgttttgttaagatgataaggtgacactgggttgatgacttgatccaacctaacgtggttggagaattaaaactatagaattaagttagcctagttgttttcaatcattctgcttcacaagaagttaaaagactagaggtatttgttgaatcctcactcattgtctctctcagcttcacagattgatactgtgctcctacagttgtaactccaagaaacacatttgtctttttagtacttacagctgtgaagctaaaggcaaatttgaataatttctttaaatgagtgtatttaaaacattgacttttctatgaatgatctcgtattttctgctctgtttatgcgtttatattttacaacatacagattatgtcttaggtctccttaattatacctccaaaccgctagtaagtagcaggtgcaaaattgaggaattgagggaagaactttgaatgcatgttatatgggaattgtatacttatacaatatgtagaagtagcagttatttatatagcaagctttgtttatttttttaagagaagattgcctccagatgaataagcagtaaatctttcatttatgtgaagtaagttatgttttttaaaactgtcgaatagtttgttgtttgaacataattctataagatattatataggatagtattctaagagaaataaaagcatattttcagtaaaagacttgtacacagatgtttatagcagtcttactcatactagcaagaaatggaagcaacccaaatgcccatcttctggtgactagttataaaattatgatatattcaaacaatggactaccactgaacaatgaatagcaatgaactactgataaatgcaataacatggatgaatttctaaaacatgatgctaagtgaaagaagtcagataggaagagtatatactgtgtacttgctgttatttgaaattgcacaggaaaaaccaaccaacagtgtaataagattagtggttgcctaggaccagggtgggttgattgcttgactgacaaggggcacagggaactttggacgaggggttggtagaaatgttctatatcttgattattgtggttacacaggtatatacatttatcaaaactcatcacttaagatagatgcatttcattatacttaacttatacctcaaaagaagttaccttaaaagtttaagactgggcacagtaacccatcagcatttggggaagacccggtgagaggatcacttgagcccaggagttcaagataagcctgggcaacatagggagaccccatgtctacaaaaaaataaaaactaaacttaaaaaaggttaaaaagataaaaaacagtttgtgacttagaaaactgatgctaagagaaaaagggtctgagatcacaggttgaaacagagggatatatgggaccaaaagcaatgaatttggtcagggcagacctaattgcaatgataaactttgagactttcacatatgattaaacaaattgtgtaatctgatagtaaagccttttgtattgagtatgaaaattgaaactataatttaattcttttaaaaattatccattatatacaaggagaaatcctgtaaaagtctgaaggaaagcaagcacaactggagtctaactggttgttgaagtgctattagatctagttctgggaagttatgtggttatgtagagctatagagtttttggaagttatgtagttatgtcccaaggctttgtcctctggcattgaggaaaactttagtacttgttttaaattgatagtttttaatgtagtcattatgtgtatgtatatatacatgctgctctaaagacacatgcacacatatgtttattgtggcactattcacaatagcaaagacttggaaccaacccaaatgtccatcaatgatagaatggattaagaaaatgtggcacatatacaccatggaatactatgcagccataaaaaaggacaagttcatgtcctttgtagggacatggatgaagctggaaaccatcattctcagcaaactatcgcaaggacagaaaaccaaacactgcatgttctcacttataggtgggaattgaacaatgagaacacttggacacagggtggggaacatcacacaatcacacactggggcctgtcgtggggtagggggagaggggagggatagcattaggagatatacctaatgtaaaggacgagttaatgggtgcagcacaccaacatggcacatgtatacatatgtaacaaactggcacgttgtgcacatgtaccctagaacttcaagtataattaaaaaaaagaaaaaagaaaaatctgggatggctggctttagtttatactcagctgtgttacattaactctctcaaaacaaaatgcggtagataactaggtcaataaatgtgatcattagttaaaatgtgaaaatgataaaattttctagaaaaataaataccaaaatcaactcaaaaagatctagataacctatattcattcgagacagtgaattagtaatccgaaatcctcctttctccctcttttccctaccagagtatactaaaacctagaaagtttgctgcaaagtttcactgtgccttcacagaacagattatccctgtattgtacagcttatttcaggcaatagaaaaagagaaaactaaataactattttatgagagtgatagcaaaagtggacatgaacaataccaaaaaaaattttttaagggaaattactgtctcagtgaatacagtgaaaaaatactaaatgaatagaattttgtagtgtgtacatattaatgtaattctctgtattaaaggattaaaagattaaaggaacaaaaacactatgattgttttaatagatgacattaacattttttgataaattttataattaaccaaaaggagagagacctcttagcaaatttggattaaaaggaatctaggctgggcatggtggctcacatctgtaatctcaacatttagggaggccgaggcaggtggatcacttgaggcaggaggtcaagaccagactggccaacatggtgataccccaactctactaaaaatagaaaaattagccaggtgtggtggtgtgcgcctgtaatcccagccactccagaggctgaggcaggagaattgcttgaacccgagaggtggaggttgcagtgagctgaggtcgcaccactgtactccagcctgggtgacaaagcgagactgtctcaaacaaacaaacaaaaaaatctgaaatttcttttacctaataaagagaatataacaaaaacctagagtgagcaatcatgtttaatgataaaactttagaagcccttccattaaaatcagaaaaacgttaggaatgtgtgctagccctgcttctattaaacaatatgctagagggcttaggcactggaataacatgagaagaaattaaaagttaaaagaagagaaaaaattggtagtgagaataaaccatttatgttttgtaggaaattcttgtcaagaatggctctactgctccaattctagagttaatgtaaaacttaagtttaaaaaagccaggttcgggaacaggcaacctacaaaatgggagaaaatttttgcaacctactcatctgacaaagggctaatatccacaatctacaatgaactcaaacaaatttacaagaaaaaaacaaacaaccccatcaaaaagtgggtgaaggacatgaacagacacttctcaaaaaaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgactcctcagggatctagaactggaaataccatttgacccagccatcccattactgggtatatacccaaaggactataaatcatgctgctataaagacacatgcacccgtatgtttattgcggcattattcacaatagcaaagacttggaaccaacccaaatgtccaacaatgatagactggattaagaaaatgtggcacatatacaccatggaatactatgcagccataaaaaaggatgagttcatgtcctttgtagggacatggatgaaactggaaatcatcattctcagtaaactatcgcaagaacaaaaaaccaaacaccgcatattctcactcataggtgggaactgaacaatgagatcacatggacacaggaaggggaatatcacactctggggactgttgtggggtggtgggaggcgggagggatagcatcgggagatatacctaatgctagatgacgagttagtgggtgcagtgcaccagcatggcacatgtatacatatgtaactaacctgcacaatgtgcacatgtaccctaaaacttaaaagtataataaaaaaaaatatatatatatataaaaataaaaaataaaataaataaaaaagccaggttcagttatagttgatgttgtctctatctctctgagcctagtaataataaaacactgttggttctgggatagtggaagaacttccttttcatttagcagttgtattcataggttgtgcttaaactgattgtaattaaactgatgaaattatccaactaccaccaagtagttgtatagattttaaggatatctgtgagggaaaaaaatggtctattccaattattgaactactgttttatgtaaaaataatatgaaataaaagtggtatgaaatagaaaatggatggaaggatttttttgtggtaataatatctcttaaacttatattctgatttagggttgccttagtctgcatttaaacctgttcacatgctggatccaatcccagggccttaaagtacaaactgcttagccgaacttagtcttagctttaaaagccaaggtaacattgcagacccatggtgtattttagtcttagtcattatttactggtagcctggacagagtgcatggcatgtgctgttctgtgtcattcactctccttcacttcctccctacaatcctattttataatcagtttttacattttattgtttgtttatctttcctcttaggaagctgggattttctttttgctgaatggattgaaaaataattggggaaaaggaaaccacaaagagtttagagaggtttctgttaagtacaaaaattaacatttgagttaaattgtcttcgaattattttcacattatttatatatttaaaatgttttggctttgctcataaattcttcattgttcaaaacattgcttttgtaaaatttgtagtattccctttcaccttatctatcctgtatctattattatttttccctctttcagctttttgatgagaccacaaaggataatacttagaggagtttcctggcctgtattacaagatagaccatgagttctgcctcaattcaacttcattgtgtcaacttgataggataagacaggtggacattctgctaaccagcatctgattagagagggtggaggctggtgatggattgttaggtgtgatgacaaaataagcaattccgttaacatgagtgtgcagagtaaaattgggaccagcagatggtggggctaagctgtatcttatttctcagctatgagattttccgtggccaccttttcacagtagccagctgggattgtccattaactgggtttgagtaaaagggagttgttgctttctttagaatttgttcagcctctccttttcatgtatggctttatgttcatttggtagtaaaacacgatattcaaaggcagaatatatgagaactgaccttttcttggagaacatcccagttagatcccatttccacaatatgattacactttgaaatctggcttttccctgttctttctttaatcctctgatattttaaattcctgtaatctctgctattgccactttaaacctcattactgaaagttcttcccacactgaaacacttctcagaaaaaaaatgcagaatatagagcagagctataatataaacttaaacagacctgctagttttagctttcttttctagtatacataatttagtttacttgatccaaaggatctttaagaaacatgttttggtttaatttctgtttgttttgtttttttttttgagacagggtctcactgtgtcacccgggctggagtgcagtggcgtgatcttggctcactgcaacctccacctccagggttcaagtgattctcctgcctcagcctcctgagtagctgggacgacaggagtgtgccaccacacccagctaatttctttgtatttttagtagagatggggtttcgtcatgttggccgggctggtctcgaacttctggcctcaagtgatctacctgcctcagcctcccaaagagctgggattacaggcgggagccaccacgaccggcctggtttaatttctaaaacttacctactaatcgacttagttctgcaataaatatagttacaatcattataactagtattccttgggctggtttaaagatgttctttagcatttgagatgaaaggcagaaaccacaggtaggatcatgtaagctatggaaccaaaggaaaagcctggaaatgcaacttggagtcctgcttactctgtatccttggaaaatccagattgtgaaagaaaagaaaaagatcattttcatccatcttttgacagctttctactttgacacttctttcctctacagttccaacagaaagcccaaggctgactttgatttgcctgacttgggtatgttcccatccctgcctcaatcattaacttactggcctgagtcttagtgatggggtcagcctctcctcaatcctatgagcttggaacaggaaaggaaaattggagaagaggaaagggattctggacagtcaaaaataattaaatatccactctcttcccaaagctgtgtaatgggagagcactgtccttcagccaataatgcactagcagctagattccttagctagaccttcttccactgttgaagcctaatccctctgttttgctgcagatacctgtttccgaagtttacactgtgctggactgagtttgtagacatgaaggtccatgtaccctgtgaaaccctcgaatacattgaagccaactatggtaagacctggaagattcctgtaaagacgtgggactggaagcgctctcctcccaatgtgcaacccaatggaatctggcctatttctgagtgggatgaggttatccagttatattgagatagtaggttgaaatgggagaatttctcttttggaaaaaaaggtagataactgtttaaaaaatacatgtctatttgtcaaacataagtgggaaccaaagaaaaaatgtgacaagtttgaagacacagaaagagtcatctgatgtaattctctcacttagtactgaggaattttcatgtgccacatacaatgctaggttacagtggagaagcctagatgaatgagacaaatacctacttcttttattcctccttttggtaaacaactcaattttcctttgagggaaccctcccccaccctttgaagagttcaagttctgtacaggtttttaaaacgtgaagtaatgtttgaactggaagatgagctcaccaggcaaagctaaggaaggatatactagttgaaaagaataacccactcctcttctgggcatttaagctggtatgttagtgctacttttaagattgtggagtctgagttaatattcaagtgatcagactttgagtgacatcaagaaaagatgatatcaggttcatttttcaactaatcttatgtggaattgaattagagaacaaggcattattcttttagggaaggtgagagcttatttgtatcagagcttattacttgtcaggataagtaaatttctgtacatgtactgttttcatatgtgaagtgagaagaaactttatgcttgtttaatgcttaaatttccatccattgtgagaatattttcactgacctctgatggcacttgttgacaaatcattcaagtgagaccatgttactagacatgatcttgaaagaggccatgatttcacaaaactcatttttattttattctcagacagtctgttaggtaaaaatatgagaaattcatgtacattttatattttctgaatttataatctgtgcactcccaattttaatgacactaaaatattaatagaattttttaaatatactctaatttttaaaacatactctttattatcttcatttatcaattacagcttcgtatctctaatttatggtctatataccaatttaaatggcatgtaaacctgcctgtttcttctcctcttctaatatatcagatctccaaaatggaagctaaatggtggacttgacaactattcaccctacctcagatcatagagtttgtaaagtttgtgtccctccccagtttttcagtctgttgaatgtcgatggggcaagaactcagacttctactttaccaagtaccacacactctggaatgctttagtttccttttcccctcaagatgtctgagtcagctaggatgctgtttaccccatctctctcttatatcacttgaatgatatattgtaagtgagaggtaaaggaaaatgtaggcacaataagcactgctatttttctctttgtctaggaaaggaagctgaatcttatatcttatctatgctatttaggactactttctggagcttggcagattttcctctgacaccagagaacaatagtagtctcaagaatggaaacctgaatgtctgagggaatgggctggtagactttttcgaaaacaaattagagaaagtaacttacaaccacccattccggatttgtaaagcaacatgaaaacctttgataaatgataaccaacagtcttctgtcctaatttgcattctcaatgcagaattattgggtctttcataaataacatgagtggtttctggagacatttaagattgtcagcaaacttgtcccaaaatggcacatcatcataatccattttctctttgctagaaaatcagcccatagagtgcattcccaaattctaaatagctgaccctaaattcatttttcatgcttaaaaataatagaacaaataataatactatttttgggcaaaatccaccctacttgatgaggaccatttgcttgtgctcagtatttagaaatgcatacactccacatttctccccatttccaattgggactcccattctttgccaggagatcttacccatcccttttcagattaatcttttatcctttcctgaagtacaaagtcttaagagtgtctgaaatccaagacatcttggcccaattgacacaggttctatattcttccctacatagaccactggctgctgaaatacttttcttgtcttctggtttcacaggcttcagctcatgggttccaccctaacttggggaaacaaaagccttctctagaatctgaaggccaggcttacctctgattctgattcatccatacttcatcttatgtattttaacagttgggttctgtggagtgtccagagaccttgggttaggtatatccatcttcagtacctcattggatcacttttctttcatcacttgagtattctagcagtcattctcctaatctgaccactttcaggtttagtttacctggcttacctggggaagttgacaacttgttggtagttaggcacccatgaatgtctccagagacatcctgagaggcaagattcctcttaattgataaccaggacaaccaggtagtcacccagtcctctctaagcagggagcacttgtccttctctcctctgctgcagctactgatatctggcccctggaataaaaccatagttcctaaaattgagcatccctaagagtagctgcttggtgggacagctgatttctttgattccctagctgcaaaacctgaaattgaccactaggtgacagaatgtttgccagtatccccacaaaacaagttaaaacttaagtgaaaatcattctgcttttgaatcttaaaagctagaaaaaccataatgtaatattctttttaaaccctcttattttataactaaataaataatcacagaaaagaatgatctgaacaagaacagctgaggctaaaacccaagactgccgtgactcctagtccaatgtctgtttcgcatcacaacacagtatctttaacagtgcttgagatgcttaacagagaaggcatccagtgcttcattgaggctaagtctcagggtgtttctgccgcttagtatctttttgttcagattgagaacctaaggcgacagagaggtcaaggggaagtattttctagttcagaattcagaattcttaggcaaccttcatacctttatctggaaaatgccttctctccagacaataagacagttcacatctggagacatcagcctttggtacctaattctctaagctcaagatgcatcccattgccactttaccattctatttcccaagggaaccatcagcaccaacctgctaaatgcctgtatttgaagtctctccccttcctgaagtgaccttttatgaggctctttccttcctaagggacctttccctggtagtagtggtctcattcacaaaaaagaataatagatgtaactggagtcactttgcagttttcaagattttttttttatctgcttggctggaaaggagactagagtatctagtttttagtatttaaactacttttaattatttatattgatactctctgataaatgcaggtagttaagaatagattgtactcattcctttttgagtttgtgacctcaaaccattgtttttattcttacacgactacagtacttcaaatggcacatagataggcaggatattacataggtaagcaggaatttatacattgggtaccagagctaaatctggaaaacacatttggaatgagcttccacacttcagtctaaaatctcacccaaacttatggctacatatttttctaagtttcccccctagtttcactttctggaaagtgaacagttttttaaatcctaaatgttataaatccttaggagaaatattccctcaaaacctagtcaagaaagtgccacattcccaccttctaacaggtaattattagttgtaatagctttaatgcatggaaaaacttcagttactgaccagtcaagagaatttctcaagaaaaatcccagcaacgttccctctttcctccttgtcttccactatcattaagacctgggctagatcacctctaacatctcactcagggaaggcaatgtgttgccataaaaagaccacaagcttttgagttaggcctgaatttgaatttcagcttaatcatgtgggatttatggtgggggccctttcagtctcaatttccacattagtgaactggggaaatgatacatacttctaagggtttttagggggattaaatgaagtatacagttcttagcctcaggcctaggattaagtaagtactcaagaaatgtgcaattttctagttccatgtttcttttctaatcttcaaatggaattatagaaaccatgggtcagaacatattcctttactcaaaagattgcatgactgaatttgcttaagaaaaaaaaaattgtatcaagtcattaatacaattatacattaattatattacattaatacaatatatggtttgtgaattcagagacattaccagtttgcctccttctctcaatagaacttgtattttcattttcttggttaagcagttgtctcctaatattatcccatatgctacctagtttgctggtcccaagcagtttactgtacttcactagatttggtacctgctctcccctggacttctttttcaatattctagcctttcctagatgtaaatctttacctccttgttagtgaaattagatataagccatgatttggagagggaagaaatctggaatacttaatttcatttaattatctatgctgatgaatgcctgtatcattgttaataaaggagaattgaaaatactcatttctactttctgccctcaaatttctgtttctatctcaactaggcaagaatcagcagggtgcatgatgccattttaagctgcttcacatcagactgaaatcctaattacagttcataagtgaaacagactaattcaatggcaataccttttgtataggtcctgtgcttaaaggaggcaagtataaattttctaataagaaatccctgcttcttttgggtgcagtggctcacacctgtaataccagcagtttgagaagctaaggcaggtggatcacttgaggccaggagttcgagaccagcctggccaacatagtgaaaccccgtctcttctaaaaatacaaaaaaattagctgggcatggtggtgcacgcctatagtcccagctacacaggaggctgaggcaggagaatcacttgaacccgggaagcagagtctgcagtgagccaagatcgcggcattgcacttcagcctgggcgatagagcaagactctgtctcagaaaaaaaaaaaaaggaaagaaagaaatctctgcttccgtactatcaaaacttctaccctagaataccccctggcaccttctaacccaacctaatacagagattttgtagggacccattaacaagctcctatataattataagcagctctcacagtagggttgaaagagaatataaggaaaattagaagtactgtatttttgctattggaaatgaaatattgtttcatgcacctttgaaaaaaataacaggattttacagccttctgatgattcattcaaagcatggggaatagttcatatgtttgttaaatgaaaatcttatgtagctatttgtgtgtccctcccacttcataactacaaaaacatatatatgaatttctaaacaaagtgatattttaaagatgaattgattcaatgtgtacttaccagtttactgtgtggttttatcttcaggtacagatagtttgtggtactacttgaaaatacctttaatattattttcatcagaatttgtaatatataatccagtttgggatgatgaataaaatttttctaatctcttgagatatcttgtatttatttttgagacttgcagtagaaataacagacactaacattcacagacaatctgataaaatagtaatcttgccaccagtacagtatttctaaaattcaactatggggaccctagtagtctgcacacatatacctgggtatccaaaagttctcagagataaaacctgccagccaaagaccaccaggaacacacctgtaatcaaacaaagttaggtttattagcttgttgtagtaagaggaaacagccaccatggggaatcataacatatttcagggagaaggaactagaaaggtcttttataggctttgagctgatgtcaaaattgttaaaagtaactgtggtggagtggaaataacacaggacatggagtaaaaagttctagtttgtctgaatccaacagtgccatgaccagtaggattcatttcaggtgtacatggctagttcagccttaaaacagtcaatgtaatgcactgtatcaacaaagtaaagaaaatcatatcaatagacacaaaaagagtctgacaaaatctaaccctcattcatgagaaaaactcagtaagttaaaaatagaagataattacctcaacttgatgaagaacatctaaaaccaacaaacaaaaacctgtatgttttaatagcaaaaaactgaatgtttttcctctaagattaggaacaaggcaaggatgtctgctttcatcactcttattcagcctaatactagaagtgctagtcactgaagtaaggcaaaaaataaataaataaataaataaataaaagacatgcagattgcaaagaaatttttaaaaacttttcatttgcagatgacatgattgtttacatagataataccaaggaatgtattttaaaacaagcaaacacctggagctaataagtgagttttagtgcagtcacagtatacaagatcaagaccaatacccccaaatcaattgcatttctatattctaacagcaaacatgagaacaaaaacacagtactatttaaagtcaccctgaagaaaatgaagtacttaggtataaaattaacaaattatatacaagatttgtatgttaaaaatgctgatgaaatcaaagacctcaataaatggagatgcataccatgttcatggattggaaaacaacacagtaaagatgtcagttctactcaacttgatcaataggtttaatgcaattcctatcaaaatctcagcaaggtttttaatagacatagacaaacttattttaaaatgtatgtgataagtttatttctctagaatatctcaagtaatctttataaggaaaaagtagcagaaagatttggtatcagaagacctaagttcattcttgcacttcaatagataccacatctgatcttataaggtagatgttatttccccttgttttgcagatgaggaagctgcaatttagaggtaacacagatcttaaatccttgttttctgacttgaaatccagtggctactcactctgccaattctacttaactgttgatctgaaaaaaaaaatttttttttaattattacttaaaaccagcctctgatactgaaagtgagaaggatcactctacccaatattaaggtttattatatagctatagtaattgttatgggctgaattgtgttcccttatatccctcaaaattcatatgtttcagtcctgacccctagtatctcagaatgtgactgtgtttggagatagagcctttaaacagctaattaaggtaaaatgaggtcatatgggtgattcccaattcactggtgactagagtccttagaagagcttaggacaaggagaggcacagaaggaggaccatgtagagacatagagagaagatggtcacctacaagccaaggagaggatccctcagaagaaaccagccctgccaacaccttagccttggacttctagtttcctgaactgtgagaaaatagatttctattgttgaaaccactcagctgtggtactttgttatagcagccctagcaatctaatgcagtagtcaagacagtatggtattggtaaaaggatacgcacatagatcagtgaaacaaaataaaccagaaattgacccatatgagtatgtccaactgattttttacaaaagtgcaaaagcaattcagtggaggaaagacagtctgtttttttttattttttcttttatagacagggtctcactgtgtcacccaggctggagtgctgtggcacaatcattgttcactatcacctcgagctccatgggctcaagcagtcctcccgcttcagcctcccaagtagccaggactacaggtgtatgccaccacaccccgctattattttattttattttgttgttgacacggagtctcattatgttgcctaggctgctctcaaactcctggccccaagctgtcctccacctaggcctcccaaagtgctgagattgcaggcatgagcctccacacccagccaagatagacctttcaacaaatggtgctagagcaattggacattcataggcaaaaacaaactcaacttgaatgaacctcacactttgtacaaaaatgtacttaaaatggatcacatgcttaaatgtaaaatataaaactgtaaacccttttgggaaaaaaataggagaaaatcttcatgatctagggttatgcaaagcattctttctttgacttgacacaaaaaacacaatgtataaaagaaaaatggataaattggacttcatcaaaattaaaaattgctgctctgcaaaagcccacatgtaggggctgaaaagtccagctacagactaggaggaaaatatttgcaaactgtgtatcttgacaaaggactagtacctggaatatataaagaacctgaacactcagcagttttttgaaaaattcaattagaaaatgggcaaagacatagacagacatttcattgaagaggatatacagatggctaagaagcacatgaaaaagatgttcaacatcattagccagggaaatgcaaattacaaccacatgagatatcattgcatacctattagaatggctaaaattaaaaataatgataacaccaaatctgctagttgtttcttttatgattttcttttttaatgtgtactgtgcaccgttgtttttactgtgattttactaaagagtgtccttaaacattttacaaacattcgtaataggtaacactcttcataataaaaaggaataaccttgtctgaatttttggaagacaggtttttaggtttttgtttttgcctttcctccaattctttgttgatttactttgtcattttaataaccctctttttatgatttattttctctttattattcctttgtgttcttcgagttttctttaattagatttatcagtaaagccctttagcagctagtactattgttcatagttctctgcaactttatcagtagggcttttacaacctaaaacttctaaattcaaattttttcttccgttaatctcaataatttggaggatgttttctagtgaattttgcaggaaagttaattgagtggccaatgttctgaaaatgctatactaccaaatgtctttcagatgacttagaagatgacagtctcatagttggagagtggaagagtttgctttggagcccaaactgggcaaccgtctaatccagccagatcctgcttagcagaaaaagcaaatttctggcatgtgacctcataaacaagggaaaagctctccttttaggatgatgtcttctcttaccatctatttccccatgtcttagtggaaggagccatctttttccccatgtcttagtggaagaccagagaattatctagagcatggtgtgatgctgcaaatgatgtatctgtagccactagccacatgactactgaatatttgaaatgtggcaagtgtaactgaataactaaatatttactctaattttaattaatttaaaactagtagctagcatattgcagatctatagggttttatgggatcagcaagggttttggatttgtcgactggaatccagagccctccacagcctagttcggtgatcttgggctagctattcaacttctgagttctgaattttttttcaactaatggggctaaattaatacctacctttaaaggttattaaaagaattgtaagaaattgtaagaaatctgcagtgtctggcacactgctcagtacatggtagatgtacagtacatggtagatggtcagtgaatgataactattgttaatattatgttcacatggttttacatctgcctttggcataaatcctatcagcttgtattttcctgataatctcatgtcacaatttttctgtaagattggtatttcagatccctcctgggtagaggccctatcctgagcactggtgttaagaagcgaccctggcctcaagagcacaggtacaaggcctgttctttggggagagagtatgtggggttaaaacataacacttaatggaattgagtctcaaggaccaggcttaggcaaagagacaaaagtcctagactttgtagatggctgtctgagcacccgagtctagaaaaagctccaggaaggaggacagggactgggtaatgaggttcagctgagtcttaggacttgtagaacagaaaatttgaataaatgaagaaagaaaacatttctgagtaagaggagtcagtaaattcacagaataggctttatgggacagtgaataagaccatctgccatatggataaatagtgaaagatacaactggaaaagtgggcaaggaacagactgcaggaaatgaggggactgaatattctgctatgaagtttggatatgagagagaaaagttttgaataggagcatcatgccttcaataaacacttctggcctggttactactcaccggatctgtcctaagggtgaggttcgacaaacattcaggaaaccccttcaaggatagagcagggatttaggagaattcagattcaccgagactgatcctagagaccctagaaccctgatagttgcagggacagaggatagaaacttagccagatgggcataggaccctagtggtttaagtaaggtcactcctaggaattatcagtcagtgctagacatgggcacaagcagtccagagtcaggaagcgcttgagaccaagtgagcaggggacagtttggtgatggtctgggaagtggagctcaagagcagcattgcaagccacagaaagggagtgtgataggacaaggcagggtcttatccagagggttccagggaattagaataggcctttgagagccatgacaaaagctcattttgatgaattgggccaggagagccagtgagattctaggctgtggagaagacatgaaggcaatttttggaagacagcagaggaatggagaccaatggtcagtgctagacctgggcaccacaatacaggcaatgtgagggatgtgggaaagaggctggagccatttctatacctgtcgcttcagttagaaactaggacaggatagacttttcacatgatgatgccacagggcataactgaaagctagggagaacagaagccaggaagggagataagcttagtgaggattttaaattctgggtcttaacttagtcctcatctccctattggctgttcacctctggagactatgggctccaaggcgtaaaaagtaattgctctagttgtactaggagagtagtttgtgctaacaactgaccttctaccctacatttacctctacgagaaggcttgggactccagtggctttctggaccataataaaaacaaggccattttgtcttcactcttcctcgtttccacccagacagattctgctgcctggataagacagctcaggcagggaccgctggctgacgaggcctgggcaagcctataatcccagcagagagcacagggacaatgagtgggaggggagccagtcacaggttgtatcttattaaaccagtctgcatcagctacagtgtaagtctcagaaacagatctgaaaccccagctggtaacctagttagttcaggcagcgtgtaaagaaaccatatccccgccagctaaaaagatgcatgtgctcctgggtagtgcagaagtatctgttatgaaaagcaaaggtaacaacagttgtgggaaattaaggtttcctctgtgtgtttttttattggttgcatttgaggtgacatcctctaattttcctaagcacagtggggcctcctggaaacatctgctggatttgaggagtaaggggatgcttccctcatcctccgggtgtgtgtatttggtttgggatttgtcaggctgggtagctgagggctctgggcagcttgacctggcagatttcccccacttgcctgaaaagcagcctagggggcagaggcccctccccagctcagccctgcaccttcactctaagcgcctggagctggggccttttatttcaagtctggtccccagggagcagagtgggaaatgaggacagctgataagcctgacagtattgactttatggggagtattcaatgaatttactttctgcaagtaggctgcactcttatctgctgcccacagagcatctaaatcctcatctaggagacccatcgatgagtcacgtcccttacacaaagaccagagaataaagaaggaaaggggaattccatccacccctttcttttctccagtacctggtcctgcccaccccaacacctcccctcgctttccccactgcgtttgggtttattggctgaaaacagaagcactcgcagctccaggcctacggagtcaaggccaagccagcctggtcttgagaggtcgacagctgggcacacccagggctgtatgtccctctaactggtaactatgggaagctcacttgaagtagttgtgtgcaccgctttatgctgcaacagtcaacatttgctctggacagaaataccctcacggctttaacgccaggtgtcttggagataaaatgtgggtgtgtgggcgttaccaaggggtcctgggtctggggtgctggagagtggaagttacatgtaagagaaaggcctgatgcgcaagagaagtttttctttcccctctggcttctccctcatccagtcctgggctctgtttcaaatattagaaaaaaataaaagcttcttagcagcacagaaagtaagtaacttgaaggagagaggtgggagccagaatgctggattgggcagatgaaaggaaaaaactgaaagtgccctttggcagaaattagagtcatgtgtttaggttcaccatctagcttttagacagagttttttggtagtaaaaataaaatgaaatctctgtattgagtaactttggtttcattagatgacttagcaccattttttagtatttattccaaagcactaactttttatacattagctcactgaatcttcacaataacccatgagatgatatttctgagttatagctgagaaaactgagtctgggataagttaagtaacttgctcaggatgacaactataatagcatcaaagcaaggatgcaaacaccagccagtctgcctccaaagccaagtcaaaggtcttctcttagctgccacactaaactgcctgctatttggcatttttcaatatcttatctcagtccatggccaatcaatgagtatttattattcccacgttattggaaacaggcttagcaggataccactacctgtccagggccacaaaaccagtgtatatcagagactctggtccacagagtctagcatctctcctaaaggtctcgccctgctggtgcattgcccactgctcaggcagagatgtgggccacatcagtgcgtttctcccttccaggtgccctggtttcctgtgtcacctgctttcacctgctgctacttgcttgataattttcttagttgagggaggttggaatgagggaggcaggaagagcctgggaggatgtgagctgttcactaagttgctctgtgggccctgtgaatggagtagtatgaacatccatgagaatctgcagcttctgcaggctctggaaagatgcctgtctaaaaaccgctagtaaaactgagtcagccatatgcttgtttctttaagtatatgttttagtatttgacttctttgggagaaatacattttttgtttaggataacttgttatgtaactttataattaatatttataattgttcatattgaataagaaaaccttggtgaaatgcctagcatgacacttggcacttaaggttgaataattggggcagaggattaagttcctgggccagagttgatgcttaatgtcaacccctcctcaggtcaagccatcatctcctcttgcctgcattgctttcacggcatcctaactagtccccccaccccacctcttctcttgcccctctccatgtagcagacagaatattctctccttcttaaaaaacaaccaggttgggcgccgtggctcacgcctgtaatcccagcactttgggaggccgaggcgggcagatcacgaggtcaggagatcgagaccatcctgactaacacggtgaaaacccatctctactaaaaatacaaaaaattagccgggcgtggtggcgggcgcctgtagtcccagctactcgggaggctgaggcaggagaatggtgtgaacctgggaggtggagcttgcagtgagccaagatcgcaccactgcactccagcctgggtgacagagtgagactccatcttaaaaaaaaaaaaaaaaaaaaaaaccattctatggccttggaaacatttacctcacagaagcaagctatgtgtctgctgacagaaggcagggcaggctggaggcagctgtctgaagaaataagagctttcttgcattcattcaacaaatatctgatcaagcagcttttatgggcagtgagcacaattcctggggtctagtgatgaaggaaactaagtctttgtcctcatgaagtttataatgtagcaagtaaactagaatgagatttgttttgcagaattcaacatgaaggtggggtctcctttaaagaaaaaaaagagagagttaaaataattgaaatttatcaaaaagagtttcttatgaccaagagtcactcccacgcaccccaaattaagtataaagaatgggcacagtttactttggaaaatgcaaatttaaaagcaggggttgtaatattaatataataaaatgaaattcatggtaaaaagcaagatttttatattgatataggctacaatcctctaagtcaataaaaaaacttccttgagtctttatgcttcaaaagcaatgcagcaaaaaatgtaaagatctaaagcaaacactcccggaaaaacaaaaagaacagaaacaaaatagtaaagggagattttcacacagtgctctcttgaatagatcaaatagacaaaaacttccaagaatacagatttatttaatggatgtgtaaaaagacattttaccattcaaacagagaatatacctccttttctagtacctgtgaaacatttataaaagttgaatatatgttttatcaaagagaaaattctcaataaatatcccaaagcaaaaaacatacagggcatatatttcactatactgcaataaaattagaaactaatagcaaatggttgccaaaaaaatacaacaacaagaaaatttaaaaacactttataaaagaaaaataagcaacagacattagaaaccaatgacaatgatactacaaatggaaacaggatatccccaaaggtctatcagaagaaagttcacagcccggagtgcttttcttactaaacaagaaagagtaaaaataaataagcattcaatccaagagtgatagagtggagaggaaataaacgtaaacaaaagaacagatttaataaagatatagtagaaagtgtatttgaaaatcataaaaatgataagcgaatcccagagctagttttttaggagcaataaaatgaacagacttttgcaacactgatcaagaagagagagagagaaatcataaacacataacatgaggcatgagaaaggggattaaaaaaatagagatgttaaaaagtaactgaataactgtatataacactctactaatgaatctgaaaaggtccaaatttatatgtcaaagtaccaacattaaggagagagagaacaggggaaggaacaaaacctacctagaaggatttactagtaaattgtattaaatatcaagaaccagctaactcatctgtttaataaattaatggtggatggaaaaagtgatgaataaatgactggataaatggagagatggatggatgaataggggcctcgatacatagaattggagattggtaaaggggctaaggatggaggagggaagaagagagttttaagagtggctaaggctgatgcttgacctccagccaaaacaatcttggcccacacccacttggcctggcagaaatcccttccaaaagtcccaggtttgggccctggcggtggctgactcctgtaatcccaacactttgggaagccaagtccggaggattgtttgaccccaagagttcaagatcagcttgggcaagatggcgagatcccgtctctacttttatgaataaaataaaaaacaaaaatcccaggtttggtctttcctgaaactgacaacccctgcatacaggactagaaggccagtattcacaggctaatccagacagatcaattaaaccaggagaaccagaaagcctgacagtgcccaagctctcctagtgacctgcccttccctccccagccctctgtttcctccccaggagctcgcaggtgcagtctctccagggggcagtgagagccatgaatagtaagggttttagctcaagcacacagaggcgtttagctgcccaaatctaatcccccaataatcggcttatgtaaattcctacttcaaccccttcccctgcaggtcctagccccaaaattctctacattgggagactggcatgggagaagacccatcactctgaaggatcactgctagtgaaatgatgcgccaaagattgtttcccctgcttctgaaagtataaaaccaacaataacatttaagaatgttttgaaaagaaaaaaccatcaaccctggtcccaggatgtcaacacaatcgggctcctttctctgtagcccttgtcctttctctgagtccttgtccactcgcacacagatcctatttgacagcttattgtttcgtttagcatcatccatttccaatcttgctaccctgttaccacaattctttttctcagctgtaaaatatgccattcaaaaaaatatatcaccttacagtttttggctgaggtgaagattaatacaggttattgcttcaaaatgtaacatttgctgtattataattgccatatggggaaaacagaggagcagaaagaggagcaaatcagagaagcttactgcaaatattagtttttgtagttgtttgtttttctagatggagtctctgttgcccaggttggagtgcagtggcatgatcttggctcactgcaacctctgcctcaagcgaagcgattctcatgcctcaacctcccaagtagctggaattacaggtgtgcgccaccacacctagctactttttgtatttttagtagagatggggtttcaccatgttggccaggttggtctcaagcccctgacctcaggtgatccacccacctcggcctcccaaagtactgagattacaagcatgagccaccgcacctggccttaggttatgtttctaaagatccctttttaccaactaattttccccaatccaccctccaatctctcctctatactgccaccagaatgagtcttgcgacctgtgactaaacatactattcccatgttcaaagcacacagttgtatttgtctgggctgccctctcctccacccttgcacttgtattataattcctacccagtctttaccacccttccaccaggcacccagcagtcagagcccctcccctggacactgtgcttttagatggcccctctctggccctcctccagtgctcacccaactcctatgtcccaccttctagaacatattctgggaacctgggacccctgaatttctgttcaaatgaccatgaacccttttccagggcctggatagggctattccctaggtccatgtgggctgggagttcgcatcattttcacaaggcccttcacagaaaaagacagagctagcgggtgggaaaagaatggggacggggatggagtctccatttgtacccttatcatggcccccacaaatgtcagagccacccttgcttcaaggcctagtttaaatgccatctgtcccatgggtaacctctgatcccccagctagaatcttctacctttctgtccctaactctaatttcacactctctcgcattcaggactgtctgtcttatattagtcatgttgtcatgtcttctcccttccaatagctgttagtgccttgaaaatagatacagagctttcctcaccttcatgcctacctccccatcctaccccactcccctcctaccaccataacctagcaatttatgcaacaccttttaaatttataataaaactgtattgtttgttttggaggtgggtaaggtgggtggcggtgtgacaaacaaccccaaagtctcagtgacttacaacaataaagatttatttctactcatgttatatggttggttgtggttttgctccatggcatccaggctgcacgagcaaccccaaacataactttctcatggctgagcccatccagcaatcccaactggagtcttgctctatccccaggctggagtgcagtgttgcaatctcggctcactgcaacccctgcttcccaagttcaagcgattctcctgcttcagcctcctgagtagctgggattacagtcgtgtgccaccatgcccggcaaatttttaatttttttttagtagagatggggttttactatgttggccaggctggtctcgaactcctgaactcaagtgatctgcccgccttggcgtcccaaagtgttgggattacaggcatgagccactgcagccggtccagcaatcccttgtaaagcttctgctccatcatgatcaatgttagggctgctcgcattctattggctgatgcaagttgtatggtcaagcctggcaatggggcagggaagtatagttcctccacttacagggaggcactgccaatcacacggcagtgagtggggctatataatcctctccaagggaagggagccaatagttattaacaataatacaatggaccacaataaaatttacaatataccgactatgtgctaggcatactgctaaatgctttacctacttttttctcatttagtcctgacaattctgtcattgtccccattttacagatagggactaaggcaagcataaattctataatttgcctaggatcacataagtgaatagacaaggaatttccacctgggtaatgtaactccagagccctttgctcttatccactaagctgcaatttgtttgtgaatttattgtgccaggtcctataccagatctttcagagagagtggtacctgggaattcattacttattcattcattaatcaacatctgatgaacacctgttcactgggagtagatggggtagggaagaggcagagaagataaataagtaaataatactcaagtggggatgagtgttaagaagaataaagcaaacagaaggatgaagactctgtgtgtgtgtgtgtgtgtgtgtgtgtgtgtgtgtgtgtgtgagcaattttagtttttttttttttaagagacaaggtttcactatgttgaccaggctggagtgttgtggctattcacaggtgcgatcatagtgcactgcagcctcagactcctggcctcaagctatcctcttgcctcagcctctggagtaggtgagattacaggctcactaccacgccagacagatggtgcaattttagatattgtggtcacagacttcactgagaaggtgccatttgagtaaagacctaaagaatgtcagctccttgagggcaaggacttgtatctgttttgtttgaagttgtgtccccagcaactagaacagggcctggctcattgtaagctctcagtaataatgtgttgaacgaatgaaaggaggttagggagggaatcgtggataacttgggggaagagtgtttaaggcccaggaaacagtcagtgaaaaggctctgaggaaggagagtatctggtgagttcctgaaacaacaaagagaccagagtggctagagctgagtgagccccaggaagagaagagacagacagctcagggggatagaaggtatctctgggcccattttaaaggcttcagcttaactcagtgaaatggagagccactgaggggttttgagcagagaagtgaccagaatctgacttgtgttttcatagcatcattctggatgatgttggagaacagacagaaggaggcaagtccagaagcaggaagaccaattaggagtcccttccctcactgaaataaccaatattagtgctgggcattgtggaaactgaaatggataaattcgggaacctgcccagtacagtgaatgttaaattctgctgtgcatcttaatctcctgaaatacttaggttttaaaaatgcagatttcagaccacaccccccatcctgaaaaatcctagtttcctgggtctgggttgtgggtgttgggatcctccttccccacctgtgattctgaagcaagttgttgctgaactccaggtggaggctcactggggcttcataaacatctgatgaattaacaacggatacggactttcccagggttgaatgtgttggagaaggaggttggtaagcggctcccccagcccaggtgggtggcaggacccccttaccgcccccaagtatcacacgaggcggggctctccttcctcccttgctccctttccagggcacaagagagagttggtctccggaagccagggcgcggagagtggggaggaaacggtgggagtccccgtcgggaaggggcccccgggccccgcgagacaaagggcggtgtcctataaaggcggcggcggcggcggcgcggtgtccaggcgagggcgcacacggccggcgagggcgacggctacggcgacgacgcgggctctttgcgaggaggtgcgtggactccggggggacatgggcgcaaccagggccgggctcgtgggcctgcgggtctctcgctgagccatactcacccgggagagcaggaatgcggcggagacttggtagcggccaccgagccaattcggtgggaagaccgggggactttccgcggggcaggggcggtggctcagctccgggggtgctaggccgactctctagcgtgttggcgggcccgcgtcgcttttatgcgtgatgccggggacccccttgtaccgctctcggcggcgcatctcccagagcccttcaaggagctcgcgcgtccccgagcgactcccggacacctggcagattcgaaacttcagccactagatgctttcctggactccctaaatacttaatcattaggcaaggcaatggtttgcaagggggagcaaaagttataaaaagaaaaagggaaaggcctggaagcgaagcgggcaagggaagaagcttgggcagagtattcgagatgcgtccaggctgcacggtgcaggggtcgggtgcatcttagaacaggtggctcccccagcgtgaggctactgtgaacggcgctgaagagcagtattcatactgtgtgctgctgatttaatatatcaacatgcagagttgtgtaagtgagaaaagcgacttgcataatatatatggtgattttaaagggtgtgtgtgtgtatgtgtgatacacacaccaaactggctgcggctggggagtgagactgagtagctagacaggtaggtagccttttattctttacttgaggcacatatgtatgcttgatattttttttcttaaatgagcttgtattacttctataaataacttcaaaaggcagagttgtgcctcatattgcaggttaagcactgttccccaatctaactatataaaccacccttcatggcgagtattttcacttactttcaagagaaaggtgaaagaagagacaaatgcaccggaccaaatgccaggaagataaatttaaagtggaatgaagaaagagctgtatgtgagtgaatgcctgggacaggccccccagtgttagctgtgagcctgtgctgcaccctctctggtgaacccggtcttcgtgtccaggaacccctggcacaaaaagtagcagctcctgttaggggcattggtcacctccttgggggagtgtgtccttcttttctctgctaatgtgttaccttcagtagcgacaatataaacagagaatttatgcatatccatgttcctggcgtttctacctgactttcctccaacctagtcattcttagcctgggatacacaacccccatccacccaggaatatagagatagaattcaggggtgctatgaatttggatggagaaaaattacatctttacttccactaacctttcatctaagcatagcgtttcctttatttatgaatgtgggtaataaactgtagtagtattagccgtggtggtgaatttgtcaccaatagaaatcatagatgcatgcatttcatgtcacagatgttgcagatcttttgaaaacatcatttacataccactttttagagattatcgtaataagtctagttatttaatgtgttaaatatgaagcacatgtattgctatattgtattttaagttattttaataactactaaatatagttggttgttttctgtgtctatgtattttaatttatggacttaaaataattattctgaaatgagaaccaaagcctttttactttatatatttaaaatcattgttctgaaaacaaatctgtccctaggcttccccagactgctaaaaggtccatggtacaaaaaaggttatgaaccctgacccggcaggagtcctcaatggtgacataaatgcatcaatatccaggcctgggacacaggctgtaccactgattccctgtgtggcctaaatgcttcacgtctgttttgccatctatcaaatgttctctgattctgtggcatctagtgtatttttttttttagctcttacattactctgagatcacgattagcagcaatcactccttgcgactggaaaaacactaaatgcagtgcttttccagcttgttaaaccactgatttctatttcccctgtggagaaggagaggaacacacttgaggataaatcaacaaggaatgattaagcacctcctaggatggcagactacatttcagaagctagtgttctctgttttttgttttgtttgtttgttttttttcctgtctgtttctagtacaataggatagagccctcttagaaaagaacaccatcgttagtttatcctgcctaatcttttttcctcccagcttgaaaaagacccccccatgggactatggttgacttagtgaatgagctaaaccctgttgtgataagagaagcatgaatgtaactttgctcctgcaatcccagccagtgtcagtgtggacaaaactggatagttttctaccttaaaatccccttgattcaggtttaaacttttatattttaggtatatacttgggtatagttctgacaacactcaaattttcattgtagaaccaaaggtcagattattcagaaatgacttaggttagataaaaggcaatgtggcctggcatggtggctcacgcctgtaatcccagcactttgggagcccaatgcaggtggatcgcctgaggtcaggagtttgagtccagcctggccaacatggtgaaaactcatctctactaaaaatacaaaaattagctggctgtggtggcgggcacctgcaatcccagctacttgggaggctgaggcaggagaatcacttgaacctgtgtgacgaagttgcagtgagccgagactgtgccacgggaggccaaggttgcagtgggcaccaagattggccactgcactccagcctgggtgacaggagcaaaactccgtcaaaaaaaaaaaaaatggaaatgggtggggcattgtagcatttctgagttgaatgaggtcctggggatcacctggcccacccctttcagttttggaaggagacctggcctgcctgggaacccgctagaatgcctggctagctgctgcttctctgctcctgcagtcgcaatgcttccctcacacgttaatacaatcagccagctcctcaacactcagcagcaagcacaatacctggctcgtagtgtcagtaaatgttggtcccaaagcttggagtgcatagtattgtaattggtccatgggtccaactaggaatgtctccacggagagaggatgtgggtgcaagaggacagtgcggggagccggaagccatgtggtgacctcgggctgcggtgcttccagttcaccatgaattcttagcacagcactggactccccaacccagacacaagcaggaaaggcaacaagaaaggaactaggatggggaaatgtcccggggggcatagagatgattgaaaaatgcagttggtgcagtggttcgcctgtaatcccagccctttgggagactgaggcgggcagatcatgaggtcaggagattgaaaccatcctggccaacatggtgaaaacccttctctactaaaaatacaaaaaaattagctgggcccagtggcgtgtgcctatagtcccagctactagggaggctgaggcaggagaatcacttgaacccaggaggcagaggttgcagcgagctgagatcgtgccactgcactccagcctggcgacagagcgaaactctgtctcaaaaaaaaaaaaaaaaaagattttatatatgtacacataaaacaataccaaaaaaagaataaaacaccacaagtctcctttttttctcttctcccaatctactgtcctctcccaatgaaccactgttgacagtttggcctgaatccttccaggtttttgctctacacacacacacacacacacacacacacacacacacacacacacacccatatattcctgtaaagtgaatcaaaagagcacataaacaaagctaagaccttctctaatgcatataacttcttcattaggaagaaaatgataaattacaacatttatttttcactgttttatttttaaagataataattgcaatcattaattttctttttttttttgagacagtctcgctctgtcgcccaggctggagtgcaatgacgcgatctcgactcactgcaacctccacctcctgggttcaagtgattcttctgtctcaacctcctgattggctctgactacaggcgtgcgccaccacgccctgctaatttttgcatttttagtagagatggaatttcaccgtgttggccaggctggtcgtgaactcctgacctcaggtgatctgccaccccccccccccccgacttggcctcccaaagcgctgggattacgggtgtgagccactgagtcccgccaatcattaaatatttattgagcctttaatatgcactagacactgagctaaggtgctttatgtgtatcatttcatgtgtcctcacaatgatgcagtactcctgtactgatctttacttatgaggcatttgaaacacagagaggttaagtagattgctcgtcacacagctagggtgagtataaccaacagccaaaccggggttctggccttggagcctgtgctcttgaccaccatgcatatggttccactgatggctgagttacgtgaagactcctgtagagtcagggcttggaaagggaagatctcacctgctgtttaaagaaataggtaagtagagagtggggaggaaattcaaggaacagaaaatgacaatgtgcgaaagtgtagagttgggaatattcatgagtcttcggaggaactagaaagggcccagtgcccagaggagctgagcgtggagcaggcagcagaccaatagcagtaagccaagaacatcaaactgcctggggctagacttgggcttgtttgccagtgcctcccaagtgttcctattagcacatgttaatccaagccacttgaaaaaagggactcttgcctctaagagtgaaaaatgcctgcataatgctcggcagtatgtgatgataaaccactctcctagacttggaaaggtcatccaatgcagccccaaagaggcccaagtatcttctacagaatccacgccaaatcaccactcccacctgccccttgtcttttcatttttgcgagactaaatacccccacttctgttcttcatacaccagggtttcaagacccttcatcattctgttcctgctcctctaaatatagtccagtctggatattttagttcttacagagaggggctgaatcctccaggtgaggtctgccagctaacaagagagctgtattgtcttctctattccaaattttattttattaacgaaacctacaatcattttctttttttacttcattctgataatacattgttgattcatattcaactctctgttggtggccgggcatcgtgactcacgcttgcaatcccagcactttgggaggccgaggcgggtggatcacctgagatcaggagtttaagaccaggctggccaacatggtgaaaccccatctctactaaaaatataaaaactagccaggcgtggtggcaggcgcctatagtcccagctactccggagactgaggcaggagaatcgctcaaacccgggagctggaggttgcagtgagctgagatggtgccatggcactccagtctgggtgacagagtgagactccatctcaaaaaaagaaaaaaacaaaaaacaaaaaacaaactttctattggccaaacatatgttgcatttatacataaactcaatcaatattgtacctgattctgaacaattaggaagagttggttataaaggaagaaacaggagtattgggacaaagcaatctttcaactggaggcttcaaaacagccagagagaaaaagctgaagggtgttgttcttaccttcccctgttgtttttaagttaaaaaaagaaattatgcataattcatagcgtcactgatgcctcgaaaggtgagaggcatatgtttgtgtccctgtggggttgttttcttttttaaaaacctgaaaatgaggaaatgaatctcgtaagctctgagtcgagaaaatctaacatctcaggttcttggcaggacatgtgataccaatcaggcctcttataagatattggccctgagggccctttctctttccatctcaggaactcaaacatgaccaggaagatcttcacaaataccagggagcggtggaggcagcagaatgtcaacagcgcctttgccaagctgaggaagctcatccccactcaccctccagacaaaaagctgagcaaaaatgaaacgcttcgcctggcaatgaggtatatcaacttcttggtcaaggtcttgggggagcaaagcctgcaacaaacgggagtggctgctcaggggaacattctggggctcttccctcaaggaccccacctgccaggcctggaggacagaactctgcttgagaactaccaggttccttcacctggtccaagccaccacattccttagtgtggctctggctgtcatctcccagggcagcacttgcccagaaatcactgcctgtggacagacttttgcatgttccagagttgacctgatgataactcgtgaagcatgaattctagcttcctgggaggtggctcagagacagctgcagggagctgaaagaagccatgaggaatgtcacttgtgggccgccaccccccagggatgtcaggtagagcggcctacctctgcctattttaaatccaggttctgcataagacttttggagaaaaaattctaaataaaaaaaaaaaaaggctgaaaatcactgtttatactcaatgtcttcagttataagaaagaagttttctcataatggatctcagatgaataagtagaatatgcttccttcagaacatattttaaagtttgttttgaaaaatgagatttgatcaagggtgaacaaaataaatcttaagattgatgggccgggcacggtggctcacgcctgtaatcccagcactttgggaggctgagatgggcagatcacctgaggtcaggagtttgagaccagcctggccaacatggtgaaactccgtctctactacaaatacaaaaatgagccaggtgtggtagtgcgcacctgtaatcccagatactcaggaggctgaggcacgagaatcgcttgaacccgggagggggaggttgcagtgacccaagatcatgccactgcactccagcctgggcaacggagcaagactcgctctcaaaaacaacaataacaaaaaaagttttctcataatggatctcagatgaatgagtagcagcatatgcttccctcagaacagattttaaagatggttttgaaaaatgagatgcatttgatcaaaggtgaacaaaataaatcttaagattgatgaatagaaagataacccctgcagaaaccaacctgggagacttgcgggaaaaatctgtggagaaaagacaccccccgccccccgcccactaaggtgtggggattacaggaatgcagcagagatatgtggaacagttctgtgtcctttcaactctgtagaagtgtgaggtgctacttgtgctgagccatttgtacatatgtgacttctaaaggcaaatagtggattatatctgtgagacgaaacaactggataatttatgtgttagggctcgtagttttcttacgaaaaacagttagctgaaataagttagctaaagccttcacttcacatgtcatgcattaaaacgtttcactcagcctgaactcctgctgattcaagacctgtaaaattcaattataattatgaaaatccaaacattaccatttaatgactcatttaacagagagcttagtttaaacaaaacatttagagtaaacaatagaaatgtaataccagacgctaatgaactaatgaatttgtaatttgtcttctttgctatggcacattagccttctcaaaaagaaaaaagtttctcataatagatctcagatgaatgagtagcatatgcttccctcagaacagattttaaagttggttttgaaaaatgagatgtatttgatcaagggtgatcaagcttagtcttaggcttggaggcctggtacccaacaagtcagtgaaatagcacggatctggcagaatccatcaccatatgccaccctgatgatacttggagtcaaagataaatcctatagttgaacctggaatacaaataatgttatttgattatctctgggacattttccttccccaaagttcttgacagtacattggttttaaaaccttctaaaccatacgtaggaaactgatggatttgagattagggatttccagtatatacacaacagaggaatttaaatttcctgccactcagaaataaggtgttttacttgtgaaaggttgaaatgagcctccttggtctggtgattggaagaaagctggatgaaactcttacaatctcattctcccgaaatagaaaggtcattatgtcattaaattctatacagcattcacacttgtaacacaatgcatttatttgaaccagtaagatttccttctaggccctttatttaaactgtatttggtaaacttccccacggacccagcatagtccagggaaacacataagaaaagagatcaaaatggttttcctgaatgtgcatttttttttttctcactagcttatgtggacacaagcttacccccaaattaccaggtgatagtacatttcaaagttttgatgacagttgtcaattaacatcacttactctctcatctgaaattaaatcaaaataacacttttgacggtatttttatattagctttgtttcaacatgttgccaaggaaagcacagagtatctctttgcctagatataggattttgcccctctacccaggatgagtccacttttctgctgctggggccatgatctgtgtcaaagggggccatgatcttcgacaaagagggcctttccgctgaaatgtaacagagtgctcctgaaaagtcatgaggagatcaagttctcattaaactatgtgagggggaaattatttaaagaaatttgcaaataatcctataattaataaatgaaactttaaatcattaatttatgtatttcacctcctaaatgatttcttttgcctgcttgcatttttgtacaccaagtcatgtttggttaaagtgactgttacgtcaggtgtgttggcatgtgcctgtactcccagctactcgggaggctgaggcgggaggactgcttgatattaggagtttgaggccagcctgagcaacatagtgatacctgtctcaaagaaaagaaagaaggaaagagaaaaaaaagaaggtgtctgccaaaaagaaaatatagtcaattgtggaccaaaaccttgacaaggtatccatgagactggaagctaactcaaaaatcattctagagtcttctctggtgtcctatacttaaggcttggtgatggcagtagcaagaatttatgattcaaaaacattacggttcactggatggtacatctgtttatagatcatttgagcccaacagaatagtttgaacagattatataacctatgctactctgtaacttaaacaaaagtgtttggcggtgggcaccgtggttcacacctgtaatcccagcactttgggaggctgaggcgggaggatcacctgaggccaggagttcgagaccagcccagccagcatgttgaaaccccatctctaaaacaattagctgggtgtggtggcgggcgcctgtaatcccagctactcaggaggctgaggagaaagaatcgcttaaacctgagaggtggtgtttgcagtgagctgagatcgcaccactgcactccaggagacagcaagactctgtctcaaaaaaaaaaaaaaaaagtgtttagtctgctatggacaccactagaaacttctagaaaccaggtataaacaggtccattgattcatatagatcatttgatggtctaatgccggtccctcattttacagaggagaaaatggttctagagggatttgaagtgactgtccagaggccacatgcgcagttagtggaaacccaggacccagatctaggtctgcagacactgtgtttagcctttctacggccctgttcagccaccaagtattttaggattgaaaatgaaaaagcaccttatcattatgcttgtctcttttcaatagcattcagtaatcttcttcatatgtctttttactgaaattaaattattgtactttgtaaaatgtgattagatatatcaaccaaagattttatttgttgatgttttgtgagtttttaaccattgactataatttgttatttaactgttaatttattgcaaataaattatttaagaaaacaaattgttcatttaaagaaaaatttcataaatttactaagcacattcaccccttctctcatcttcacagccactatcctggctttgacatgtccccccaccccccaccagctcccccgtggtctttagtatagaaaaaaacccagcgtcacctgaaatcagtcttcttcctcttcatgtcacttttctcacagctccctaatggtccttctcaaatcacggctgtagtcatatcacttctctgctacaaaaccttcagtatcttgtctaccagattgagacaaatgccataccctagcaaaccaggccctctgcatcctggccccagtgtgtccttcccttcaccctccacaatgcctatacgtatggtacatgccaatgaaactactttagttaaagatccccaaacatgcccactcttttttactcctgactttactcctgtgatgccaaaggcttggattaatgctcccattctcacttgttctactcgcccctccacctgtgccaaattccacatggctgatcttttttcttctggttggagtgcagtggcaccatcactacagcctcaaactcctgggctcaagggatcctcctgcctcagcctcctgagtagctgggactacaggtgcatgtcaccacactcggctaaaaatttttttattttttattttttttgtagaaatggtcttgccatcttgctcaggctggtctcaacctcttgggctcaagcaatcctcctgcctcaacctcccaaagtgctgggactacaggcatgagccactgcaccagcccatgggatcttaaacaccatctcttacatgaagtcctcctagatttctactacttaatctaacctctctttccttagaatccccttatatgctttatgatccttacttctcctaccttctgttatagataactgtgtgtattctgtttcccctaaaaagctaaaatttgcttgagttcaggaagagtttctaatatttaatctctacagcagcactgcaaatgacccccactttcaaaatgtgaaaacttatgtcaagactggctctgttaagagtactcttttagctttctctaaaagatgacattgaaatgaaacttgaacaggctgaatttttctgagaaacccaaagtctaatactcttctgaaaagttagcttctcattattcctattcaaggatacccctggcagcacctgccttatgaggtttcatcacctaagaatggcttgagacggccaaaataagtataagttatgcacgactggctttgtccctaaaaaggcaaaagatgaaagagcctgggagaatgaacagcttaactgctgacccacaggccaaaggttagtcaaaagtcacatcgttaaataaaaaggtcaaagataaggaggaaatctaaaagtccaatggcaatgcaaagtgaaggatttaaagggcaggtgttaggaagggaatgccaaggaatgaatgcagttaagggattacagaaagcagggacaaggtctcctgaaccacacttgcacttctccgctgtttagagtttactgtaaacagagaaatgctccattttattttctctttattgctaatggcttagcacaaagagattttgaagagcactagatttatagataagctttatgtttgtaatctaccagctagcatttattctaagaatttaatttccagagccaagaattccctgatagtccaatgaagcaaactattgaattgtctttattagtaaacttttaaaaaagaatgtagtcaatatgctcatacacttgaacctaagtcattatccttcgaggaacctatcaaaaaacataattgggctgggtgtggtggctcacgcctgtaatcccagcactttgggaggccgaggtgggcggatcatgaggtcaagagatcgagaccatcttggccaacatggtgaaaccctgtctctactaaaaatacaaaaattagctgggcgtggtggtgtgcgcctgtagtcccagccactcgggaggctgagacaggagaatcgcttaaacctgggaggcagaagttgcagtgaaccgagattgggccactgcactccaacctagtgacagagtgagactccatctcaacaacaacaacaacaacaacaaaaattggaattatgatcaaagaattatgtacataagtatctatttcacaactatttacaacattcataaaattataatattaagaggtaaagtcaagattagccgagtgcttccttttttattttatttttacttgttatttgttcttggaaacagggtctcactatgttgcccaggctggtcttgaactcctggcctcaagtgatcctcctgccttggcctcccaaactgtcgggattataggcatgagccaccacacctggttggctgagtgctttctacataccagcactatgccaacagcttcctgtgtatcagctcatctaatctttgtaacaatattatattattaatataatatgagctatgttatattaattacatgactatattatattaatatcactgttcccattttgcagataaagaaactgaagtgtagaaggttatctaacttgcccaaatttccactgcagagccagaatttgaccctcagttgtttttactcaaaatcactgcattctgtaaagtcagggttgcttttcacagatagctttaattctttttgatcctaaccaccttaatggaacctcgtgaactaggtatattacccaataatgatattgggtaaacaaacacaacccctggaaaaaaaaaaaagcttcctatttgggagcaccaggctggagttaacaccacgatgagacaccatgaaaagaccatcatactgaggcaggcttgaatgtgatacctgcaggtacaacttgttagttccatggtctggacgtggtgacgtgccaacatgacatgattttgttgttttcctgtcactgcctttaacggggctctgcttaatcttcctttcccatccagtcatgacaggttgggctagtttgggccaatttgaaagtccatctcatctccttcctgcctccaactccaccctggctcaagcttgacctatgcctcaagtgtgtgtttgcaggggaggtgcacactcccagggtgggagatccactcctccacatcttctgctgtcccccttttgcttttagctcctctggagttggggaggaaggagggtttaaggaaacggacaaagtgttttgttcactagatatggaatagcattcttgctgtcttcatatatttttaagactttttgcatcagttctttttaactattgatatacaagtacctggtttaaaaagactgaagaacagcatacaacagcctcttggattcaacaagactgtaccttgcacatagtctcatagccactgagatcctcttcccactttggaggaagtggaacgttgtgctgaaatacctggcgtctgcaccagtagccagatcacttaagcatattttttgaacctttcactaaataaatcaagatttgattttaccttatggcatgtggatatgtgtatatacacatatgtttgtgtgtgtgcacctgttctctttccgctgactatagtacacctgagatggtacaattgtgcctctcacacctcatataggcaatacacagagtatggattttgaaagagatgttgatagtaagacagtggtgactgaaaaatgcctgggaaggactggatagtctgttacatgagatcgtttggtctgtaaaaggaagtaggggatgtcataacagtgaaatctaccggcattccccttactcctttcagtttggactagtgaatgactagagaaggtaagagatgaggctcagctggcctaagacctagggtcttgggttttctttaacattctagccaaagaggtggagggcatagaagatctacataatgagctaaatcccaccgggaggaggagcctggagcaagggctgtaacctaggtgttctgggaatgttcccaatctcgtcacttggtatggtaatattacaaatggaatattaccctagagacaccccctcctcagctcctgttagactgaggattagtgaccttccctgcaaaaactggttccatgctcagtttttaagcagtatgtgggaggagagccaaaaatgctctaattatccctggatgaatagattttaaaaggaagaagagagagggcaaccgaggacaaaacaatcaagtaaacaaatgaacaaacaatgtgtttgccaaactgcgacaggaggcctctaaaaatcagtttttaccttggatccctaatctgggcaaatagattgtgaaatactcaggtgcaaaaatttgttttcagaatacagtcacatttatatttaaaatggggtctgtttaaaattattattatacttcaagttctcggatacatgtgcagaatgtgcaggtttgttacataggtatacacgtgccatagtgatttgctgcacctatcaatccatcatctacattaggtatgaaatggggtctttttaagcaaaactttaaaaacaccagattttcaaggtgtaaacataattttttcccttaagtattcctgtttaaaaaaataagtgtgacctggtcaggtttaagtagatgagctaactgtgtaaaaatgtaaaaatctgtacatattatcatgtgtgggttataattatattaaattaaaatggcctcaattcaactgcaatcttttataagttgatggtgttttaaggtctataatttgaatattttagaagtcaagtttaagatacaattaagatagagaaaaatgataatatgcccaaaagatggttattgaaaagtcattttctaaagctatttttaaaggaaaaaaaaaggtaagagtgggattaataacaggagcattttttcttttggaaagtatttttgagtagataatttacttatatggtataagaatcaaaattatactaaaagagaaatattgaaaagtcttatttctaccttgtatctatcaaccctatctcccatcccttttcagagtttaattatcatttagtagttcattatgcaaatacagttggttcccaatttacagtggtttgaattgggatttttcaactttaagatggtgagaaagtgaaatgcattcagtagaaacagtactttgaggacccatataacatttctgttttttactttcagtacagtattcagtaaattacatagtaaagtaaattacatgtactttcagtacagtattcaataaatagtcaacactttattatataataggctttgtgttagatgatttttgcccaacactattgtaagcatcctgagtatgttttaggcagactaggttagttatggtgtttggtaggttaagtgcattaaatgcattttcaacttagaatattttcagtttacagtggggttattaggatgtaatcctaaattgaggagtatctgcataactatatattctcatgtcttcctcttattcacaccatcttgctgctttttctttttttctttttttttttttttttttttgagacagagtctcactctgttgacgagactggagtgcagtggtgcgatctcggctcactgcaacctctgcctcccaggctcaagtgattctcctgcctcagcctcccaagtagctgggattacaggtgcgcacaaccatacccaggtaatttttgtatttttagtagagatggggtttcgccatgttggctaggctggtctctaactcctaactcctggactcaagtgatatacccacctcagcctcccaaagtgctgagccaccatgcctggcctgcttttctctggtaacactataacctaaagatcttcccaaatcatagaggactttctcattctttttaatatctgcatgtattacatcatgtccatttgtgttgtttccagtcttttgctgatactaatgctgctgcaatgaataacctgtaacatgtgatttcccaagggtgcaggtacacctgtagaatgaatgcagtcttagcagcatgtatgggtgttcttgtttctgcacaaattcaccttcatgttatgttgacaattgctgggatacttgccaatctgataggtgaaaatgttatctcaatgtggttttagtttgcctttttctttttatgatgaggctgacatcgtatgtgatgaaagaaaaacttcagccaaataaaatttaaaggagcttaattgagcaatgaacaatttgcaaatcaggcagccttccgagccagagcaggctctgaggctccagcacagccaatgtggtgaaagatttatggacagaaaaaggaaagtgacatacataaaagggaagtgacatacataaaagggaagtgaggtacagaaatagctggattggttacaggtgggcatttgccttatttgaacgtggtttgaacagttggctacatttgaatggccaaaacttggtgattggcacaagtgtagactatggtgggtttacttgttatgggttcacgatgtacagagaaacctttagtctgaacttaaaatatgtaaggaggcagcattacgctaaacttgatttaacatgtttgtgagttgtttgtatttctgtttctgtggactctcttaaacgtcctttgccctttgtttctgctggacggttggtctttttttcttccccaatttctaaaagctctttatatatgaaggagatcaactctttttctgtgatgtgggctacagatattttcccccaatatttcatttgtcttatgactttgtttatggtatgtgccagatattcaaattttattttaatgtagtacaattaatcaatttgatggtcctggattttgagtcgtagttagaaagtcttcctttactctgaggtttttgactttctggattcagtttaaaatcttgctgtgaggtcctatctttgaggcttctgatgaaagaaatagggggctaggggatgctgaatattctctctcttttaataaagactacttatgaacttaaaattacgtatttaaagtaaattccaattgaaaaaaaaaattgctccctcaccacattctaaatttggctctaaaaaaaggagtttcaaaaacatgctccctagaactctgacacaaggaagagagaggaccctgggtccactaggtcttgatagattagtaccctgtacattgacccttagctggctgagctaagaggacacatacccttggactggaacaaaaagaaaatccaaaagaggaaggaaacaacaataaaataaagtttcagttgacaacaactgcttggcaagtggggccccagagtgagatggctgggtaaaggtgaggcccgggtctcctgctacccactgctagtccccagggtaactggaacccagggaaggtgtggccatgggagggggaggggctgtctgaaagcagctatggttgtagatatgggaagggggataaataccttgacctgtttctctcctcccacctgctgttctgccaccgcattccattggccaaaaccaaccagaacccaaccagagggcagggaggccagagtgatggaggctgaggtgtgtataggtcagcctcctggggcatagagcaggcagagcgtcttcactaccctctccctgcaaaaagaaccagataataatttttttttcttttttgctgaaggtcattctatccgatgggtaataaattttaatgaaagatcttcttctgatagctattgagatggatatgatatataatattttcttgcattttggataaatcttacttggccatagtataattttattttcatatgcagtcaaattatcttcctcatctatatcttaaccatgataataaaatatttctgaaaaagtcaaatgttcccacaatgaacctttactaaaatctatatggaaaagcacaaaaataatttatataagcagaggaccatgtctgactaaggataccttgtccacttgcttttatgccattgccattccaccactctgtctctgtaagaggatgcatgaaacaccatgtgtccacctgcagcctgagagagatatgggctgtcagagtcaatgagcttcctaggccttccccttacctgcttcttaccgttccctctggatatgaggcctccagatccccatctctcacttaaggtgttctgaatgcttaccttggcttctagcagataggaaaccatcctggccaacacagtgaaaccccatctctacgaaaaatacaaaaattagctgggcatgatggcgcacgcctgtagtcccagctgcttgggaggctgaggcaggagaatcgcttgaacctgggaggcagaggttgcggtgagccgagattgtgccattgcattccagcctgggcaacaagagcgaaactccatctaaaaaaataaaaataaaaacaacaagaaaaaagaaagtattttcctacctgccttcccagactaaatttcttccccaggcttcagagtttctgaaaacaaccttgcagtgtctccttcatccctctctaagaggctttatggctctaggctccaggggtaaagatgccccatcacggaagttgagaaggatggatgagtatgagaaggatgtatctgagtatggcaagttttatttggggaaagagtcaaaatataaacacttcaaggaagtgtttcatattcattgcatgcctattacaggtagtttataaaagctatctttaatccttctaacaacaatttaatggaggtatttgctccagcttacagtttgggaaattggggcttaaaatagttttaagaggcaaacttcagatcacacagccaacagcaaggcaggctctgagcccatgtctgccttcagcaaaggccaaatttcttttaatatgttcttttacctttaagaaagaaacttcctgtgaaagaaatgctcactgcaggcaggcaatgattgaaataaagaaaaaaacatgcatggattaatttggttgatggtctgagttttctgtccagaagaattctttggtaaagaaaaaattatccaaaataagtgatggggatgtctgttgctctcagcatttaaattacgttgaatgacacttaggaagatatctcaacagaaacaagccttctctagctggaggtgtttccttttcttctgcacctgaccttagaggtaaatcatgtcatagatcaggcctaacctatggcttcctttcagtcccatagagttaaacatattttatattccctgagaatcatggaaacattctcagtcctcagaaagtgcagagacttctgtgtctcagggctccttcatattttttgagggggcagggggtggttgggggaaaaagtcttttttcaactaagaatggtaaaagaaattacttgcttgaaatgcaacatttacttctcaaatacagtccctttcttatcatgaaaacttcaatcaaacccataaactgtctatagtacccagtcaaaaatgttcctgtgttacctattctaacaagcggattgttgggtttttctttggtggttttgagtacgccttacccaaaggcctaagacaactaccgtcgcctggctttttcttttccagaaataaaggaaagatacggaagtccaattcagaaagtactgaaatcaaacatccaatggacattattccctgcaaggaaaccccttatcagtctcttgcagagattctaaaacgttatctcgatagaccagattatggggctgacccactctccatgctgagtaggaatcaaacggacattcttttctgtcagcaacccctgctttgccaatccagataaatcaattaatgggatgcagagctgctgtcttgcctttctcttccccatgcttacctccctgagctcccctggactcctcagtcccctgtttaataccatctaagagtccttatttacaagagggcttgtgcaggtgcaggctttcaggccagcagcacaggagcaattgccctccctccccttccatcctccaggctcccctctttgtgagacacttttttcttttctctgcttttcagaccaaagacgcccctcagcagctaatctaatcggattatgctaatttgtacttcatgaacctaaacagcataactagatctgcagagggctaaggccaggaagagagggacaatgactttgtcagtaaacctacccacaaaaaagtgcaaaaagaatgtatgtcctgtgtttagccacacaaagctgctcctctgggaagcctacagagctcttgacaatttagagtgctcaggagcggtctatgttcagaacagaaaaggcggcacagtgaaggcacaataaagaccacaatggcaaggctgtttctccctgtgaaaaagtaaggccccacttcttcctcttcccagtttacttactttcacctcttggctaatcaatttgtaaatttggaagctgaagtcaggtggtacaattcaacaaatatttattggcatctactacctgtcaaggactacgctcggtgctatggggtgcacaaagttgtctaagacttggttcttgcccttcagaatttatactttgataaggaaagatattctaggtacagttctttctgcctcatgttggctgactctgctagtcattttccataatctcccacagatggttttgatcattatttttagttttttgttttgttttttttttgagacaaggtctcactctgccacccaggctggagtgcagtggcacaatcatggctcactgcagcctcaaattcctgggctcaagcaatcctcctgcctcagccttcctaatagctggggctataagtgtgtgccacctggtgcacctaatttatttttattttttgtagagacagggtcttgctgtgttgcccaggctggtctcaaacttctgggctcaaggaatcctcccgccttggcctcctgaagtgctgggattacaggtgtgagccactgcacccagcatcacagatagtttttaaagacaatgtatgttcatacaaagctttatattttatcaaaatatataagtatatagtgtaattttcataatagactatgagataaataaaactggtattttcaaccccattttgaagtcttgaaactgagattttgagatattaagtggctccaccaagagaaatcctccagttaccaattagacttctgattccagagctagtgttccctgtcctctcagcatgctacctcacataaggctggaggggaccttacgaggtcagcaagtcagttctcatgcatatgagtaggattgtacacaaaactttaaaaattttacactaatagcctttaaaaagtcttcacgcattgtgaaattggagaactgaccctctttcccatgaggttcttgatgtcctgggtggttgacactcagtacttttgcttattagtttctaagcaggctattcctttggatgatgaagcccaagcagttggagacatcttccctggagattgtctgccacacacctgtctctgtcacagctggcagtggaatgcgcctttctcttatccagaggactcattccctctggatctctcactgagttcctgcttctgatctgagagactcttgtaattcacagtccatttacacagctgaaaagatttactaccctgaaattaatgaattactgaggccttctcagtcagatgctcattttgccacatcttcctttccaccacccctgaaatagcttaaacagactgcaacaaatatgcagcaatgattagtttctgtcaacagaagaaaaggagggcacttttcatctgttttcattcctgccccctctcccttttaaagctaaagaacatccttatgaattctcatagcctcagatgctggtttgggatgaggagtggaagggcagagggtcggaggtggaagatttcagataaatttaaataaatgatttcttaacaccaaaatatccttattcaactcacaattgccttaggatagctttttgtctggaaagtttccactaatagttttaactcaattttcttagatggttaattattacagatcaatttcagactttcttttactactagccatctaaacaataatgaatatttaaacaccttaaccttggtgttaattttgctgtggatggctttcttttgctgatgtaatgctgccctgttggatttttgtgctccatccacattcttttgtcaaattatcataatggactaacgactaagggttagggtggatgtgggctgcagtgtagatgatttaccaaactatttaccttgaccactttcaaattaattatcatagaaatcactctgtgaataagatgatttgtttgtgaaaactgtagtgatatagatatttttaacctagaggaattaaaaaaatctggctaacatttaaaaaaatccctgatgaataggaaatctttgtattgtataaggttaggtaagacctactaataaacattattattatgctagaaattgtattactgaatctattctgacagttttttcccttttgtgttgtttagattccaggattctccataggcagagtctaactgatccctgatgtagaatactatgtcaactatcctccgaaccccagttatacagttgagtgcagtctctaagagctgctgctactgttagtgtaatacagacaaaacgaagaacggaaaggagttatatgtcaggttagaataggcaggatgccaaaaaccaagtccaaatagctttgggtgttttgcctaggatcagtttctagggtagcacaatgggaattcccacatgcaaatgcaacataagaatcaaagtccactgtcacctctgggattaaagccagagaaagtcaacaaacagaaaagaccagacggttatcagatcccctggtttggtttatttgggcttcttataaagacatgttgtatcatctctgtgactgtccttcattatttataacgacacagctctctggacttgtgtgtcagtagcttcccactatggcattctttcccccaactttgtactaggtgtctagtcagagtagtgctggtctttggactttgccggaaggtggctgtggaaagatgccatatgtttgaggtatcgcagaagtggggggcaacttttcagtttcactcatttaccttttccccagctcccgatccccacccactaaacactgcagttgctctgatgccagagggagtccttgagctctttcttcatcattctgaagaatataaaaatttatctgctttctgagcctagtctttggtagatgcatatgccatggatcaggggccaatataccaatgaatatagcggtgggcctcagagattcccaatatgatgctggaggaggggatgtttggggtgcttgagcccatggttttgtggttagatatataaacagaaacaagagaaggagactgttctatggaatagtccatcatatggtggccaccttgcctgcacgacacctgttcttccacctacttaatacagaaatttttgcgtcagttcatggacttggatttgggcttctaggaggcagctattgtggatgttggggctcagaaaacaataccccaaaatgaaggcctcagaatcagccttaagagcaaaagtttttctttgatcttttcctgctgtcctgtctttcagtcccattctcccctgaggctagccatagaaggtattacaagtaatggcaaaaaccacaattacttttgcatcaatctaatagactccttcttccccaagatgggttaaattagtagtaatcagaaccccttttccccaaagctagccataaaccctaaaaatattactctaacttgctttctgcctcatgtcagtgattttcagcaa

SEQ ID NO: 30 - DNA, 155572 bp, Homo sapiens
tcccctgctagtcaggcagaaatctaattactcttgtttgatctactatggagaggtaaatgtgagaggtatagattatggacagttttatggattttaatcttagaaatcaacaagtgaaggttttacacttgcacatagttacttaactggtgttaagaataaaacctaatcaataatttttgttttactgtgatttgctctagttccaattatgatgttggctatttcatagtccctttgtttatatgaatgctttaaagataatctctctctagttgagtttaacgtgggactagttttcatttcatacaatgtctcagaaacaaaaccagaataaaggaaacttaataaagacaagttctaggaaaattgggaacataaagagagatgaactgaaatgagtctcttttcctttaagttgtgtcaatcctcattactgttttgaatagttcaatccaacaaagcatgagaatgagatggaccatatgtacatgacaggtgtaaggtggaatactcttgctttcctttgcaaaatggtgcagtgagaagacctaggttctggacctggatctggtccttaggagctgaatgacccggtattgaaagcctgatataacaaagggctgagatagcattcactgatccctcattctaggcgtggtgctaagtactttatacatatgcttccttttcatcatcaaaacaattctgttaagtaaatggtattatccttttttttttttaacagatagtaggactgaacttctgagaggttaagcgacatggcacagattacacagaagagaaagattttgaagatcagatgaagtagttaccttggaatactgcagaagaaggtatccaaaggtttaggggtattggaatgttagagttatgatgtaaacctgctcactcacccaaggagggtccagagggtacacctttcaccaggactgtcagaaagaaatttgcgagggcacctcagcatcccctaagtactctaactcaaatcatcaaaacagagagtcacagttcctttgtaaaagtattttaaaaaagcaatttgaaaattgacaaatgctataaaaatttcaactactgttactattattattttagtcctcagcaaggaaaataaaaatttgttctttctgagtgctctttccagacaggcttccacttattctgcatcagtataataactgcctcccaaaaaagggcataattagtgtttgcagttattccattggccctattgccacaattggtagacacagttatttttgccaagttgatgactggtccaagaggaaaacaaaaggaaatcaacttttcttactattctgttaggacctaataaaatctcagtgtgttaagaaaagtcatacactttatcatatgtgtgggaatcactgggctctgatgacttgcatcataataggtctcttgggaagggtcactctttactgatgacttcactgccttgtctctttttatgcacacaagcagggcacacataacctatttgtcaatttcacaagcactcagctgtaaacaacaatgattcttagattatcttggtagttggtgtgtcctgagagataagactgtttttttccccagctgcctcactcctgaatgaccggcaacttctttagaagaggctgctgccctttcccttacataaaggttatcaaaatacccaccatccaattctctgttttccctgtggccataactactattaaaacaaccttcttatgggaatataataccaaacagtagggaaaaagaggcaaaacttcattcccacgttctgactaggactatgtggtttgttacatcttttctcaaccaaatgttactaatgatactttctagcctattttgcctcccaggagtcaaatcatcaaatacagcattttgttagttctcacgaccctgatgcattctgatccccatttatttagtggtgaagactgagggaattctcagcaggccaataatagaaagcattaggaaaagctctggactgagaaatctgattacatgccattctactgtattttgcatgtcacaagtgacctcttttagtgtctaaagtttctttctccataaaaaaagaatgtacctttttagggctctaaacaaaatgagtgaaatatatctaaagttgtatatgtgatccacatcagctcacaattgttctgctacaatgacatgccaacagatttcctcctcctaagtttctttttaaaactctggttgcttggaagcagtatggacattgacaacgacaggccttaagagctatctggtcccattttgagagctgggtcttgcttattcttatccaaaagacttgagagcagggcctgatgaagtctcaaagtatggagcaatcttattgattgaagccagaaggagagggtcaatccaaaatttggaggaaggccacacaggcataccactactttcacaggatctttaaatatgttgttaggttattatataatattatctataaatacaagattaaattatcattaaagaaaatatgtttatctgaggccccataacaactagccacgatttttttctctaaaattaaaaattattattattattattattttctttttattattattattatagtttaagttttagggtacatgtgcacaatgtgcaggttagttacatatgaaaaattattttcttatttgtattctgtgtctcaaagtaactatgactttttaagataataattttttatttcttgcatgaataacattgcagtagtgacagattaaaacacttaaaaatcttacctcacaccaaatcaatagttttggttcacttttctatgttcatttctgtactggactatatctatatataattttatgcaattgaggccactgcatagatataattttatatgcttttttttccttcagagaggaaaaaaatttgacatttacgtaggatctactagggtagggcactattttagactcattaatatactttatatcttttatttctcagaaaggtatatatattattattctcttgtttatgtagagagattaaataactttctgagatcacattgaaaggcaatgcggccaataatcaaagggattcaaacttgtattttttttcattatacaatgctgcctcatttaattttttccctatactttactacaaagtttttttgttttgttttttgtttgtttgttttagatagagttgctctgtcacccaggctggagtatagtggtgcaatctaagctcactgcagcctccgtctcctgggttcaagcgattcttgtgtctcagcctcccaagcagttgggactacaggcgcatgctaccacgcctggctaattttttgtgtttttagtatagaaggggtttcaccatgttggccaggctggtctcgaattcctggcctcaagtgatctgcatgcctcggcctcccaaagtgctgggattacaggcgtgagctaccatgccctgcctactacaaagttttaattttaatagcctcttaaaatttaattagattgtaagctccctgattaggtctcatttctatcctcagcactcaatagatgttcaataaatatttattcaataatgcaaacctctattcactcaattcattctcctttccctattccttgggatgaaaagctcagggacactgagacctatatcatatattttatcccttatatttatttggcttcttttcatttagtcctcataacagctcagtaggatatgtactattatcacccccatccattttacatataagcaaaccacagcactggaaataaacttgagggttggggactccaaagtccaaacttttaattattacactattttattctacatagatttattattcaaagttgcaagtaaatcatatgtttatatgccatatgtaacttcaattcacccaaacagcttgttttacataggaattatgtcatgaatttttttttctttttttgagacagggtcttactttgtcacccaggctgagtggagtggcataatcatggctaactgcagcctcaacctcctaggctcaagcgatcctcccacctcagcaacctcccagagtagctgggactacaggcatgtgccatcacacccagataactaaaaaaatttttttttagagatgaggtctcgctatgctgcccaggctcgtcttgaactcctggattcaaacaatcctcccacctcggcctcccaaagtgctgggattataagcgtgatccactgtgcctggcctgaaatagtttataaagcaaaataatacctcccaaatttatttagctgactccagattttcttagacattaaattttcttacagtaatagccatgagtttttaaaattgaggaaatattgagtacctactgtgtgccagatatttgggatagaatggtgggtaaattgtacatagtttttaacctcttggaacttatagtctagtgttgtgtgttatgtctaggcttcgagaatccttatcttatcatctgcgcattttctttatgctcctatagcatcctgcctttattatatactttaaaatttattttattatttttaaatgtatcccttgagtcatactttattatattaagatataataaaagtataaaaatatactaaaatatgcatctgtccatcatacagttgtaaataggatattacccatagaatatttccaatgaaaccctctccccagttgtattcaattccctttcctatagaaaggaaagcattattctgatgatagccattagctattatggtaacatgtgtgtgtgtatatatatatatatatatatatatatatatatatatatatatatatatatatatgtgtatgtcatggggcctcagataaagattttttttttgagatgaagtcttgctctgttgctaggctggagtgcagtggcatgatctcggttcactgcaacctccaactccctggttcaagcgattctcctgcctcagcctcccaaatagctgggattacaggcacacaccactgcgtccagctaatttttgtatttttagtaaagacgggatttcaccatgttggccaggatggtctcgatctgacctcgtgatctgcctgcctcagcctcccaaagtgctgggattagaggtgtgagctaccgcacccagcccatattttctttaatgataatttaatcttgtatttatatataatatatattaaaatttgtcattttaaccatttttaagtgttcatttcatggcattaattacattcacagtgttgtgcaaccatcaccacaatctgtttccaaaactttttcatcaccccaaacagaaattctgtaaccaacaagcaataagttcccattctctcctccatccagcccttggtaatttctaatatatttcctgtctctatgaatttgcctattctacatatttcatataagtggaatcatagaatatcttgtctctgtctctgaaaaaaaacgtgtttttttttttcttttttttttttttgagacagagtctcactctgtcacctgggctggagtgcagtgttgtgatcttggctcactgcaacctccacctcccaggttcaagcgattctcctgcctcggcctcccaagtagctgggattacaggcgtgcaccaccacaccggctaatttttgtattttcagcacaggtgggggttcaccatgttggccaggctggtcgtgaactgctgacctcaagtaatcttcctgcctcagcctcccaaagtgctgggattacaggcatgagccactgtgaccagcctagcataatgtttaaagtttcatccatattgtagcatgcatcagaacttcactccttgttaaggctgaataatattctgttccaaatatatatattcattttgtttatcccttcatctgttgatgaaaactgtattgtttccatctttcggttcttgtgaatgatgctgcagtgaacactggcatacaactatctgaatctctgtttttaattctattggctatgtagctaggagtggaattgctggggtgtatggtaattgtatgtttagctttctgaggaactgtcagactgttttccacagcagctgcataattttacatttccaccagcaatacataaaggttctaacttttccacatccttgccaacacttgttattttctgttttacaaaaagaattgtagtgatactgataggtttaaagtgatattttgttgtagttttgatttgcatttccctactgactaatgatattgagtatcttttcatgtgcttattggccatttgcatatcttctttggaaaaatatcgattccgttcttttttttttttctttttttgagacagagttacgttctttcacccaggctggagtgcagtggcccaatttcggctcactgcaacctctgccttccagtttcaagtgattcccctgcctcagcctcccaagtagctgggattacaggtgcctgccaccacgcctggctaatttttttttttttttttgtatttttagtagagacagggtttcaccatgttggccaggctgatctcgaactcctgaccttgtgatctgcccgcctcagtctcccaaagtgctgggattacaggcgtgagccactgtgcccagcctcaattcagttcttttgtacgtttttgaattgggttgtttttttgttgttgagttataggagttgtgggtttttttgtttgtttgtttttatttttatttttttgagatggagtctcactctgtcacccaggctggagtgcagtggtgtgatctcagctaactgtaacctttgcctcctgggttcaagccattctcctgcctcagcctcctgagtagctgggactacaggcgcttgcaatcacgcctggctaattttttgtatttttagtagagacggggtttcactgtgttagccaggatggtcttgatttcctgacctcatgatctgcctgccttggcctcccaaagtgttgggattacaggcatgagccaccacacccggctaggagtttttaaaatattctggatattacatgcttattagatgtatgacttgcaaatattttctaccactctgttgattgtcttttcatttccttgataatgtcctttgatacacaaacatttttaattttgatgaagtccaactttgttttttcttttgttgctcaggcttttggtatcatatctaagaatccattgccaaatttaagctcatgaagattcacccttttgttttcttgtaagagtcgtatggttttatctcttaaatttattttggatcattgttccattttgagttaatttttgtatatagtacgaggtaggaagcccatttcatccttttgcacatgtatatccagttgtcccggtcccatttgttgaaaaaaactatgttttccccattgagttgtcttggtaaccttgtcaaaaatcaattgaccataaatgtaagagtttatctctgggatctctattctactccattgatatgcatatacacacacaccccccaatataaatacatatatatatttataaattaaaaaaatataattataaataaatatatatttggccaggtgtggtggctcacgcctgtaattccagcactttgggaggccaaggcaggcgtatcacctgagctcaggagtttgagaccagcctggccaacgtggtgaaaccccatctctagtaaaaatacaaaagttagctgggtgcggtggcatgtgcctgtgatcccagctactcaggagggtgaggcaggagaatcgcttgaactcgggaggcggaggttgcagtgagcggagactgcaccactgtactccagcctcgataacagagtgagactctctcagaaaacaaaacaaaacaaatatatatatatgtatatatttatccttatgccagtaacacactgttttgattactgtagctttgtagtaaattttggaattgggatgtgtgaggtctccaacactgttcttaattttcaagactcttacgggctattcaaggtcccttgcaattctacataaatttgaaaatcagcttttccatttttgcaaaaaaaggcggttggatttttttttttttttttttttttttttgagacagggactcactttgttgcccagactagagtatagtggcatgattacagctcactgcagccatgacctcccccactcaggtgatcatttcacctcagcctcccaggtagcaggaactataggcgtgcaccaccacaccctactaatttttaaaattattttgtagagatggggtttccccatgttgtccaggctggtctcgaactcctgggctcaagcgatcttcctgccttggcctcccaaagtgctgggattacaggttgagagccactgcaaagctgctgaaattttgatagtgattgtactgaaactctagatcaccttgggtaatactgactttttttttttccttcacacagggtctggctctgttgcccaggctggagtgcagtggcatgatctcaggtcacagcaacctctacctcctgggctcaagtcctcccacctcaggctcctgagtagctgggactacgggcatgtgccatcacactcagctaagttttgtgttttttgtagagatggagttttgccatgttgcccaggctgggctcaaactcctgggatcaagtgatctgcctgtttcagccttccaaagtgttgggattacagctgtgagtcactatgcctggccacattgattttcttatgttgagccattcttgcatttcctaggataaatcccacttggctatggtatataatcattttaatatactgttggattaggtttgctgctgttttgttgctgattttcacattacattcataaagttgtttggtctataattttcttttcttgttatgtctttatctggctttggtagcagggtagtgctggactcaaagaatggacttcctcttcaattttttggaagagtttgagaagaaatagtgtcaattcttttttaactgtttggtaaaattaatcactaaaccatctggtagtagacttttctttgcctttcatcatatttgggaagtttttagccattatttcttcaaataatctcttcgtatttttctctatcttctccttctggaactcccataatgcatattatggtcagcttggtgctttcccacaagtcccttaggctctgttcagttttcttcattcttttttttttctttctgcgcctcggacttgataatttgaattatcctatattcaagttccctgattctttcttttgcctgcttaaatctgatatagtgaatttttcatctcagttattgtattttatagttccagaacttctgtttggttcctttgtgtaatttctatctttgttgatattctaatttcattcatacatcattttcctgattttctttagttctttgtccatgttttcctttagcaattttagcatatttaagacagttgtttttaagtctttgtctagtaagtccagtatctgggcttcctcagggataatttcattggtttattttgttcctttgaatgggctatactttcctgtttgttttgtttgtttgtttgttttgtttgtttttttgtcgctctgtcactcaggctggagtgcagtggtgcaatctcagctgactgcaacatctgcctcctgggttcaagtgattctcctgcctcagcctcctgagtagctggggttataggcgtgtgccaccatgtctggctaatttttgtatttttagtagagatgaggtttcatcatgttggccaggttgatcttgaactcctgacttcaagtgatccacccaccttggcctcccaaagtgctgggattatgggcatgagctaccgcgcctgtccactttcctgttttttcttttgtatgccttgtgatttttattgaaaattggacatttgactattacaatgtggtaactctgaaaatcatattctccccttctccagggtatgaacttcagtttttctttcttttttttttttttttgagacggagtcttactctgttgcccaagctggagtatagtggtgtaatcttggctcactgcaacctccacctcccaggttcaagtgattctcctgactcagccttccaagtagctgggattacaggcgtccaccactgtgcccagctaatttttgtatttttagtagagacagcgttttgccatgttggcctggctggtcttgaactcttgacctcaggtgatccacctgcctcggcctcccaaagtgctgggataacaggtgcgagccaccatgcccagccttggtttttctttttattgaaggctgtagtagtctggttgtttagtgacttttccagattatttttgcaaagatgactgtattccttgttgtgtgtgatcattgaagtctccattctttcaaagatttccttgaaggtcaggaactaaaaaataaatgaactaaactaaaataaataccaccctccccccaaaaaaatagtaaagaaaaacaaaaatatatatacaaaaaaaccctaacaactctcccagtctttgcagattagctctgtggtggggcattccaacacatatataggcttgcactgaagctagggatcagtctgaggtgaaagcttcaggtcttcttaggtcttttctgagcatttgtctaaatttgcttgtatatttctcatatacataagtacttctgaaagtccttatttctcacagaatctccctcagattttcctcctaggacttaagtggtctgctgtatctataatactttactccaggcatctgtagtttgttagtttgccttgtagttttgaacactgtgtggcttttatggcctgagtcctgagttaggtgaaacacagacacactttgagacagtccttcagatagcccccagagaggctggaatagacatacacaacactttgcaaataaggtctgctttgttcctctggaaccaggattcaggatccacactaggacaaaggctgctgctgttccaactctgctaccatctaggctggaggcagagcaagagcaaataaattccacaaatgttttctattgctttcaagttgccttttttcttgattcaatattcatttggttgatgtaaacctttgactattttccagtattctgacaaagttggtttttagcatttctgcttgtttttcagtatttctatgggtggacaagagagcttagagctgcctactccaccatttttgctgacatcactgccattaacttttaattcacaagaacttttgggttacaaagcacctcaaatttctatagtgactcagtgtttctggagtattttgagatctacttatttgtccaatttagttctactcttgatgacggatattgttcttaatgatgaccataatttccgtatttaggttcctgtaagtcagtagttctcaaccttggctgcatattagactcacctgtcgtagttatacaaaatagagatgctgaggaggaggcagagcaaaatggccaaatagcagcctccaccaactgtcctccccacaagaacgccaaattgaagaactatccacacaaaaaaacaccttcataagaacaaaaaatcaggtgaatgatcacagtacctgtttttcacttcatatcactgaaagagacattgaagataatggaaaagatactcttgaattgccaatgcccatcccttggaagcagccatgtggcacgaagagagaatttgtgtacttgggggagcacagtgattgtgggactttgcattggaactcagtgctgccctgtcacagcagaaagcaacaccaggcagaactcaaccggcactcatggagggagcatttagacaatccatagccagagaggaattatacatcccagcagtcagaacctgaattccagaaagcctcgccattgtgggctaaagtgctctggggctctaaataaatttgaaaggcagcctaggccagagggactgcaattcctagcaagtcctagtgctgtactgggctagaaaccagtggacttggggtgcatatgatctaatgagacgccagcaagggtgcccaagggagtgtttgcgccactcctcccccaacccaacgcagcacatcttgcagctctgggagagacttcttccctttgccggaggagaggagagtaaagagtaaagaggattttgtcttgcaacttggataccagctcagtcccagtagggtagggaaccagtcagagtcctgaggcccccgttacaggccctagctcctggatgacatttctacacacaccttgggccagaagggaaattgctgccttgaagggacaaatccagttgtggcagggttcatcacttcctgaataaagagctattgggccctgaataatcagcagtggtatccaggcaatactcaccatgggccttgggagagactcagagacaacatactgatttcaggtgtgacccatcaccttctcagctgttggctatggggagagacttcttccacttgagaataagagagggaagagtaatggggactgtgtcttgcagcttgggtaccagctcagccactgtggggtagagcaccaagtggactcttggtttccccaattccaggacttggctcttggatggcatttctggacctgccctgggccacagaggagcccacttccctgaagggacagtcctgggcctggcagcattcaccacaagctaactgaagagcccttgggccttgaatgaacatcaatggtagccaggatgtactcaccataggcctcaggtggtggtggctatacagagagactcttctgtttggggaaaaggggagggaagaggggaaagagtttgtcttgtggcttgggtgccagcacagccatagcagaatagagcaccaagtagattcctaaggttgtcaactctaggccctggctttcagatatatctctggaaccacttgggaccaggggaactcattgccctgaagggaaagactgaaacctggcaggctttgctccctgctgactggagagctctagggccttgagtgaacataggtggtagccaagtagtggtaactgaagaccttgggtgtgacccagtgctatgctgtcttcaggtctgacccagcagagtttcagtggtagtggccacaggagtgcttgtgtcactgctaccccagctccaggaagctcagcacacacacacacacacacacacacacacacacacacacacacacacacactatttgtttgggagaaagtaagggaagagaacaagagtctctgcttggtaatccagagaatttttctggctcttatcaagaacaccaaggcaatacctccatgagtctgcaagatccacagtgttactgggcttggggtgcccccatttcatgaaattacagctgcaatgaccaaaaacttagatccaatacccaagtcctttcaaatatctggaaagccttcccaagaaggacaggcacaaacatgcccagacagtgatggctataataaatacctaacttttcaatgcccacacactgatgaacatctataaacatcaagaccatccaggaaaacatgacctcaccaaataaactaaggcactagtgacaaatcccagagagacagagatatgtgacctttctgacagagaattcaaaatagctgtgttgaagaaacttgaccaaattcaagataacacagagaagaaattcagaatcttatcagataaatttaacaaagcaattgaaataattaaaaagaatcaagcagaaattgtggagctgaaaaatgcaattgccatactgaagaatgcatcagagtcttctcttttttttttctttttttcttttttttttttgacatagagtctcactctgttgcccaagctggagtgcagtggtgtgatcttggcttactgcaacctctgtctcccagttcaagcaattctcctgcttcagcctcccgagtagctggaattacaggtgtgtgccaccatgcccagctaatttctttgtattttcagtagagacagggtttcaccatgttggccaggctggtctcgaactcctgaactcaagtgatccacctgcatcagcctcccaaagtgctgggattctaggtgtgagccactgtgcccagcctacatcagaatctcttaacagcagaattagtcaagcagaaaaaataattagtgagcttgaaaacaggctatttgaaaacatacagtcagaggagacaaaagagaagagaatgaggcacgcatgcaagatctagaaaatagcccctaaagggcaaatctgagttattggccttaaagaggaagtataaagagggtcagggtagaaagtttattcaaagggataataactggtaactaacttcccaaacctagagacagatatcaatattcgaatacaaaaaggttgtagaacaccacacagatacaacccaaagaagactatattaaggcattgagtcattagacacccaaagtcaagaattaagaaaggatactaaaagcagcaagaggaaacaaaaaaaaataacatacaatgcagctccaatacatccggaagctgacttctcagtagaaatcttacaggacaggagagagtggtatgacatattaaaagtgctgaaggaaaaaaaatctttatcctagaatagtatatccatccagtgaaaatatccttcaaacatggaggagaaatagggactttcccagacaaacaaagctgagagattttatcaataccaggcctgtcctacaagaaatgctaaagggaatttttcaattttttttttttttaagatggaattttgctctgttgcccaggctggagtgtagtcgtgcgatcttggcttactgcaacctccacctcctaggttcaagtgattctcctgcctcgggctcctgagtagcagggatcacaggcacccactaccatgcctggcttatttttatttttatttttatttttctgagacacagtctcactctattgcccatgctggagtgcagtggcacaatctcagctcactgaaacctccacctcctgggttcaagtgattctcctgcctcagcctcctgagtagttgggattacaggtgtgtaccaccatgcccagctaatttttttgtatttttagtagagacagggtttcaccatgctggccaggctggtcttgaactcctgaacttgtgatctgcctgccttggcctcccaaactgctgggattacaggcgcgagccacggtgcccggcctcggcttatttttgtaattttagtagagacgacgtttcaccatgttgaccaggctggtctcgaactcttgatctcaggtgatccacctgccttggcctccaaaagtgctaggattacaggcgtcagccactgtgccttgcctagggattcttcaatcttaaagaaaaggatattaatgagtaataagaaatcatctgacggtacaaaactcactggtgatagtaagtagacagaaaaacacagaagattataacaccgtaattgtggtatgtaaactactcatatcttgagtagaaagactaaaagatgagcttatcaaaaataataattacaacaatttttcaagatatagacagtataataagatataaatagaaacaacaaaaagttaaagagcagggaaaaaaatgtcaagtgtagagtttttattagttttctctttgcttgtcagtttgtttatgtaatcagtgttaagttgtcatcagttttaaataatgagttataagatagtatttgcaagcctcatggtaacctgaaataaaaaaacatacaacagagacacaaaaaataaaagcaagtaattaaaacataccaccagagaaaatcactgtaactgaaaggaatacaggaaagaaagaaagacagaaggaagagaagaccataagacaaccacaagacaaaaaacaaggtggaaggagtaagtccttacatatcataataacattgaatgtaaatgtactccagtcaaaagatagagttgctaaatggataaaaaacaagacccaacgatctgctgcccacatgaaacacacttcacctgtaaagacatacagagattgaaaataaaggaatgaaaaaatatattccatgaaaatacaggaaggttacagaatggaaaacaaaaacaaacaaacaaaaaaaacaaaacagcaggagtagctatacttatatcagacaaaatatatttcaagacaaaaaactataataaaaaatgtcattatataatgataaaggggtcaattcagcaagaagatataattgtaaatacatatgcatttaacactggagcacccagacatataaagcaaatattattcaacctagagagagagacccaacacaataatacctggagaccccccaactttcagcattggaaagatcacccagacaaaaaaatcaataaggaaacattagtcttaatctgcactataaaccaaatggacctaatagatatttacagaacatttcttccaatgggtacagaatactttcttctctttagcagatggatcattctcacagactatatgttaggccacaaaacaagtcttaaaaaaattcaaaaaaattaaaattacatcaagtatcttctctgaccaaaatggaataaaactagaaatcaataacaagaggaattttggaaatgatacaaacacatgaaattaaacaacatgctcctaaatgaccagtgggtcaatgagaaatgaagaagaaaatttaaaaatgtattgaaacaaatggtaatagaaacacaacatgccaaaacctatggaatactggccaggcacagtggctcacacctgtaatcccaccactttgggaggctaaggtgggcagaccactttgggaggctaaggtgggcagatcacttgaggccaggagttcaagaccagcttggccaacatggtgaaaccctgtctctattaaaaatagctggacatggtggcacatgcctataatcctagctacttgggaagctgaggcaggagaactgcttgaacctggaaggaggaggttgaagtgaactgagattgcaccactgcactccagccccagcaacagagtgagtgagactccatctcaaaaaacaaacaaacaacaacaaaaacaacaaaaaaacaagacccgtgggacacagcaaaggcactaagagggaaatttgtagctataagtgcctaaattttaaaaagtagaaacacttcaaataaacaacctaacaatgcatcttaaataactagaaaagcagaagcaaaccatacccaaaattagcagaagtaaagaccagaatgccaataaatgaaattgaaatggagaaaataatagaaaagtcaacaaagtaaaaagctgattttttgaaaagataaacaaaattgacaaacctttagctagactaagaaaaaaggagtagactcaaattaataccagagatgaaaaaggagacattacagctgatgctgcagaaattcaaaggatcattagtggctactatgagcaatcaaacaggaaaatgtagaagaaatggataaatttctagacacataaaacctaccaagattgaaccatgaagaaatctaaatccttaacaggccaatgagaaataacgagcttgaaaccataatacgaagtctcccaggctgggcatggtggctcatgcctgtactcctagcactttgggaggccaatgtgggcggatcacctgaggtcaggaatttgagaccagcctggccaacatgacaaaaacccatctctactaaaaatacaaaaattagctgggcgtggtggtgggcacctataatcccagctactcaggaggctgaggcaggagaattgcttgaacccaggaggtggatgttacagtgagccaagatagtgccactatacttcatcctggacaacagagtgagactctgtctcaaaaaaaaaaaaaaaaaaaagtctctcagttcctcccctcttcttttctccccttcctctcctaaaaaaaaaaaaaaaaaggaaaaagaaaaagtctccctgcaaagaaaaccccaggacccgatggcttcactgctgaattttaccaaacatttagagaagaactaataccaatcctactcaaactattctgaaaatagaggaggaggaaatacttccaaattaattctacaaggtaagtattaccttgatacccaaaccggacaagggcacagcaaaaaggaaaactacaggccaatatccctgatgaacactggtgcaaaaatccttaacaaaatactagcaaactgaattcaacaatacattaaaaagatcattcatcataaccatgggggatttattccagggatgcaaggatggttcaacataacacaaatcaatcagtgggatccatcatatcaacagagtgaaggacaaaaaccatatgatcatttcagttgatgctgaaaaagcatttgataaaattcagtatcccttcatgataaaaaccctcaaaaagctggatataaaaagaatatacctcaacataataaaagtcgtatgtgaacagacccacagttgccatcatattgaatggggagaaactgaaatactttcctctaagatctagaacacaaggatgcctactttcatcaacatagtactagaagtcctagttacagcaatcagacaagaaaagaaataaagggccaggcacagccattactggctcacacctgtaataccagcactttgggaggccaaggtgggtggatcacttgtacccaggagtttgagaccagcctagacaacatagtgagatccccatttctacaaaatattagccaggtgtgatggcacatacctgtagtcccacctacttgggaggctgaggtgggaggatgaattgaacctgggaggtcaaggctgcagtaaattatgaacatgccaaagcactccagcctgggtggcagagtgagaccctgcctcaaataaaataaaataaaataaataaaataaaataaaataaaataaaataaaaaaataagtaaagggcatccaaattggaaaggaagaagtcaaattatccttgtttgcagataatataatcttacatctggaaagacttaaagacaccaccaaaaaagtattagaactgataaacaaattcagtaaagctgcaggatacaaaatcaacatacaaaaatgagtaatatttttatatgccaacagtgaaaaatctgaaatagaaatcaacaaaacaatcccatgtacaatagctacaaataaaatatctagaaattaaccaaagatgtgaaagatcctacaatgaaaactaaaacattgatgcaagaaattaaagaggatataaaagatggaaagatattccatgttcctgaattgcaagaatcaatattgttaaaatgtccatactacccaaagcaatctacagattcaatgcaatccctgtcaaaatactagtgacgttcttcacagagatagaaaaaacaatcctaaaatttatatggaaccacaaaagatccagaatagccaaagctatcccaaggaagtagaacaaaactggagaaatcacattacctgactttaaactatactacagagctatagtaatatagtagtatagtttttaaaccattagagtatacggcatggtactggcataaaagcacagatcaccggaacaaataggaaacccagaaacaaatccacacacctacagtaaactcattttcgacaaaggtgccaagaacatatattgaagaaaggacagtctcctcaataaatggtgctgggaaaactggatatccacatggagaaaaatgaaactagacctctatttcttgttatatacaaaaatcaaatcaaaatggattaaagacttaaatctaagacctcaaactatgaaactactgaaataaaacattggggaaactctccaggacgttggactgggcaaagattcttgagtaataccccaaggacaggcaaccaaagcaaaaatggacaaatgggatcacatcaagttaaaaagcttcttctgcacagcaaaggaaacaatcaacaaagtgaagagaaaacctacagaatgggagaaaatatttgcaaactctccctctgacaagggataaataaccagaatataaaggagctcaaacaactttatagggcaaaaaaaaaaaaaaaaaaaaaaagccctaataatccaatttaaaaatagccaaaagatcagaatagacatttctcaaaagaagacacacaaatggcaaacaggtatatgaaaaggtgcacaacatcactgatcatcagagaaatgcaaatcaaaactacagtgagatatcatctcactccagttaaaatggcttttatccaaaagacaggcaataacaaatgctggtgagaatgtggagaaaagggaaccctcgtacactgttgttgggaatataagttagtataaccacatggagaacagtttggaggttcctcaaaaaactaaaaacagaactaccatatgatccagcaatcccattgctagatatataccccaaagaaaggaaatcagtatactgaagagacacctacactcccatgtttattgcaacactattcacaatagccaacatttggaagcaacttaagcgtcctttagcagatgaatggataaagaaatatggttcatatacacaagggagtactattcagccataaaaagaatgagatcctttcatttgcaacaacatgcatggaactgatagacgttatgctaagtgaaataaaccaagcacagaaagacaaacttcgcatgttctcactcatttgtgggaggtagtgagtagaatgatggttaccagaggctgggacgggtagaaaggagtgggaagcaagttgagatggttaatgcgtacaaaaatatatttttgtacatatattcatatgtacatactccaataccaaataccaaatactcccataagagctagtatttgataatacaacagggtgactacagtcaacaataatttattgtacatttaaaaataactaaaatagtataattggattgtttgtaaaacaaagaaagcataaatgttcaggggatggataccccatttatcctgatgtgtatgtctgtatcaaaatatctcatgagccccctaaatatttatacctactatatacccacaaaaataaaaataaaaaaatagagatgctcataactcttctcagacttggggaatcagaaactgagggtgagtagcaaaaggaaaaaactagcaactagatctctagagttcaattatcaaggataatatatatttttgacattgagtaaaccattatggatggcattatagtaaagtgtaagcatagatccatcttgaataatgaaattaaaatttacttataggaattctaatatttttatttttatgtatttttcctcaataaaggcagaccatgctatttaaagaaatgatagactttgacaacaggaaggtacacacctgattagtttttctaattacgtgcttattacatatacatatatgtatctctagttctatccatttatatacataattaggaacatgttttttctaaaaatagaatatttaatgtaatgtttaatttttcattattacaccttaataggaaaaaatggaatactaaaatttatctttaaatatatagtttcatggtcagtagtattaagacaatactgtttatttatttagggctcataaccttaggatttttaactttcaggaaataccagcctaaagtaaattattaattcaaggatgctagataaagactcttcatgaaaaagaaacgctataccctgctgtgttgcaggctctcaaactgtccctcaaaacgttcctaatactgctcactgcactaatttttttttcctttgtcgtctccctttctatagtcagaagctatctagtccctccctctttagtctccagggaaaaggtgttagctcatttacttgtcattattgagcttctttctttcccacaaaagccagtctatttatcattcttctttttaggcttggacaaaaaagagaaaactttatacttttttttaagcagaggcacattaatattaaatcccttaagcaggaatttcaaggagaatgtctcagaacaacatttaaaccaacatcataaatgcttcctccttttaataaaagaaactctctgaaataatgctgtcctcaagagggtcatctgatagttttggtactatcttctcatttctactatctttctacaattgttgttgtgaaaagtattagagaaatagatagatgctctacacaaaatcttcacaatatggtcaacttcctttccccctcaagcccacctttcatgcatgcacacatctatgctttgtttttaacttcttatattcaatttttattcttgttattgaatgaagctctgattggtttactatatgacaaatattctttgcattttaagaatctcaggtagctctctatcttttttcacattggttagagaggcagggatcaaagtacaaaactgggacagtcactgcttatgtttgtgctttatctcattaagtgctgatcaccaggaaggcaaacagcctgtcacgaaatttgccttgcaaagaatataataaagaaatcttatgaaaagaggctgaacagaaggtatgtttaatctgttgtaatgttggttagccccagtttcagaccaagagtgatgatacttggaaaaaaaattgggagtctgcctgcgggcaacatttaccccgatgtagagattgctacagaaacctaactgtgggaagttttcaacacataagtaaggatttattaaaggaattaatatctttgaaggctcagaaagcaatcctattttcctacaagatggatgaaaggcagagatttcaaaacatttgctagaaaacatcaatagccaatcctgctgatttaattttttcaatccctcaggcatcaaaagaagttgtgacttgtctacattgcctcgaaagcaaagcaatattgtaaattaaaaatgactggagcttagctggctgcatttcatttttaattagttgaattttcaaatatttatcaacatttcttaagctcagaagctaaagaacttcccctcacattttttttctgaagaaggttggtgatattcacttacacgtcaaggaaaaagtcgttagatttagctggctatcacaaatactagaagaaatggtatttagtcatctccatttctcttcttttttattcttgagcaagcagagacttcctattctttttaaccagttgggaactcacaaaacataaactcagagattgatggtaaaaatgaaaacagattctgacaacatgttacatcccaatcacaaaagtgtaacaaaggcaaaaaatttaatcctcattagtgtagtagtgagaaacaaaaaaccaaattttttttttttaaagcagctgattttgctttaggcatttcgtcgaggtgtgtggttaattcataagcggcaggggcaaggtagccccagattttggaattggtttgcctctgagaataaaaattaaaatgaaaagaataaaaatgtaatagatgaggctaatcatctattcaaaaatatatattttattgactactcttttatgtcaggtactattttaagcacttgggataaagtggtgaaccagaagtcaaggtccctgacatcatgaagcttatattcatttatagaaatatttagtcctaaccaatactctgtgaatggtagagttctaggagcatctaaactcttttcaaggtaacaagtatattttcaagaaaatgtgtctgtattagtatatctaaatctttaaccttgtcaattatatttaatcttacctgaaaaatgtgttaaaaaaggagactagaaaaaggagaggccaagagcaggaatttctcagtgtgtcttcagcatggccctgggcagaggaagcaacttccactccccttagcagcttccaatcccctttgcaagtctattctcaacagtgaagatggatacatcagacaagcttgatgccattagtaatggtgatccaactaactctcactgccatgaatccaaagtgatcaagcaatctttggttacagtgtggcttcccatatggattttcccacagagagaggatgtgttctttacagccccaaggaccccagtccttttaaagctatagttcttaaatcagtcagcattaaattcttaattaattaattcttaaatcggtcagcattaaacttaaattcttaattaattaattcttaaatcagtcagcattaaacttaaatcagtcagcactctagtttatatttaagtatctcaggggcttgattatgaatctgaacatttttgactattctgacaaaactgaatttctagaatgataaagttttagctcagaccctcgaacagtatttcgccaagaaaagttaaaatttatggcatgagaatcatctagggagcttgttaaacatacagattcctgagactcatattgtacttatactaaatcagaatctttaaagatgaggctcaagatctgcattttaccaaggcttccaaatgattctaatgtactttaataaagctggaaagtcactgtctgagaagcaagggatcgcatctaatgaagctctgtttgggcatttggccagtttccgacatatcatctccatctttatacattgtaacaaagtgtttcagcgaattcctgtcaaggcttggtgtctttcacaatccggcctcacttttccagtctcatttctcacctttcctctcaatcactttatgcttcaacactctgaatacacgattttcatggctctaggcctctacattacttgagggtttttctttttgggggagaagagggggtggacgacaaatagcatcccagttccttgcctgagttctaaaccaactgaaggaggcagtttgagaacaaaatatcactattattaccaacaatgcctagattggagaatgtggcttatatatggaaactaaaagccttcttaattctgaagcccagaattagacatacttacccatcctgtctcaggaagaacaggataactactggcctcatctctcataagcaaccaattatttctaagcttatgtaaggccaagagcagaccaggtctatcagacagaggagggaggaaggaagtggctgaggctgagtcaagcataccaagttcctgctccctaactcattagttaaaataagcaattcctctacaactgggaagaaatgatgagtgaagggatggaaagagtccaggaccattgctctaatggatgtcccttgacaagaaaggaaacaactggagtggagagtaatgcacccccatgacagcatgccctactggtgcttgaggtaccctattactctccaatcctttctcttagtttgactaccttattcctactcatctttcaagatatagcacaaatgttcactcctctgtgaagcttgaggaactgaggggagtactcccaccttaatgctgtcataggactttaaatgacttttattatggtacttttcatgtaatacacttagctattttctttctcttatgagtgcagggattgtgacttatatgtctttatatttccatagtaggtgtccgatgaatttttgctgaatgactgtgaaaaagaaggtacattcaaatatttttaaagcttagtatttttaagcctgattatagcaccaagaccaacaagaagactagtattttcctttataggattttcttttctgaaaaaattgactaacaaatctggtcaaggctgatattgcctatttaagccccatcatagaaacccaattggcatcatcttattaacatggcatatatgactgatgatctgatcctaaaacaggccttctttcagttactgtagctttacctactcaggataaactagtaggtaataatcacttaaaaaaattctccaatgaagtagaaactactaatagagaagttatttcaggtaaaacttgaaatttcaaagttcaattataaatttatattatgattaatgatttgcatgcatgttttataatgggaatgtttctctttcttttctttctttctttttttgagacggagtcttgctctgttgcccaggctggagtgtagtagcaggatctcagttcactgcaacctccgcctcctgggttcaggcgattctcatgcttcagcttcccgagtggctgggattacaggcgcccactaccatgcctggctaatttttgtatttttagtagagatagggttttgccatgttggccaggctggtctcgaacacctgacctcaggtgatcgacccgccttggcctcccaaatactttctctctttctctccaagtatatatgttgtctctaattgtgtaaagaaaggataaaaggcattttacttttaaatttcaacactacaggccaggcatggtggcacattcctgtaatcccagcactttgggaggctgaggtggaaggatcacttcaggtcaggagttccaggccagcctgggtaacagagggagatcccatctctataaaacatagaaaaaattagcctggcatggtggtgcacgcttatagtcctagctacttggaaggctgatgcaggaagatcacttgagcccaggagttagaggctatagtgagctatgatcatgccactgtaccctagcatgggtgacagagtgagaccttgtctcaaaaaaaaaaaaaaattcaatactatatgtctttatagcagggatgatttataattatgaaatggagatataattatgaaatgaaacataagattttcagctttaattgatagcaccaatttgtagatccttgtaaataacacaaaaagttatttgtgtggtactcttaattttaagatgaacatttgacgttagagaatatataactgtccctgtgtaaaactggcttgttttcaaacttaccttttgtttcaattattagttgtggtaaatctcccaaatgatttgtaaatagcatgtattaagtggtaaaatgcactgagctaggatctgctcaaggctaaatctctccctgttcatttcgaataacacaaaacaaaaaacaaaacaaaacataccaagtagaaagaccaggagcggtggctcatgtctgtgatcccagcactttgggaagcctaggtgggcggatccgttgagctcaagagttgaagaccagcccagtcaacaaggtgaaaccccatctctaccaaaaccaaaacaaaaacaaaaaactccacaaatattagccagacgtggtgatgcacgcctgcagtcccagctactggggggctgagatgggaggatcacctgaaccctgagaggttgaggctgcagtgaaccgtgattgcaccaccacactccagcctgggtgacagagtgagactgtgtctcaaaagaaaaaaaaaaaaagagagagagaggaagatacaactacttaaagaacatcccagcaagagatatatttgacctgttctgttaaagagatccaacggatttgggagtggataggacaatcaaataattttcaaaatcagcctttaatgtcattttaatacatttatttctattggtataatcccagacgttctttaattctgtttcaaacaggtgtctgttagtgtactttcttccgtttaggacctaccataaacttaaaaattgagctgttttgtcaatcagcatctgttaaactcagggtctatatttcagtaaatgtgcttctgtttaactatctttttacggtcataagagaaataaacatataaaataaatgcatgtcaatgcatagctgtgcaggagtacagatgttttattaatgaaaatgaatccagctttttgtaagtcatggcagcaatataacatttcattgtttgcttctgtgctagacagtccctgctgtttccacatagaaattcctgtaatgcttaatggacatctggaagaattcagccaattaatcgaattcatgtaggaactaggctaatggctgtctgaaaggcagattacattaaatcaaacttgcaatatgaatgaaagcacttaatcatacatgcaacattcattagatgcgacacagcaagtgttttgattactttaatgaaagatcaggtaaagtgcatcagctgaacagattgaaaagacagcatgcttacaaatgtttgattatgctgaatatcaacagaaacagtgccagtaatttatagcaaaacatatttgtaagtgtctagagctggtgaactcagtgaaattcaaagcccatgctcaaaacaataattaatagccatatatgataaaactttaatcggatgtcaggaaaagagacagattgccagaagtttagtaatttatagtcactgggtgccttcatattttgaatggcttgaaatatctttgaacctcaatttcatttactttgaggtacacagttcttgagtcataaggtgttattatactaaaaacactgtactaaaagaggaattaaatttgtatgttgggctttaaaacctcatgccaggaattaaaatgctattcttaatagttgtttctgcctatttcatgaatatttccactttttcctttttaattatctcatcgatttttccctaatattctacagaaagaaaggctaaaaagtacattttctagataatagtattataagtcttgtaatatattatagcaaatgctatttgcagctttttggataaaataaaaaagatacagcagtggtccccaacttttttggcacaagggactggttacatagaagacaatttttccatggacaggggtgggggtgggaatggttttgagatgaaactgttccacctcagatcatcaggcattagattctcataaggagcaccaacctagatctctcacaggtgcagttcacaacagggttcgtgtgcctacgtgaatttaatgctgctgctgatctgaaaggagacagagctcaggtggtaatgctcgctttcctgccactcaattcctgctatgtggcctgggtccatggccctggggttggggacccctaagataaaggatatatgtatccttttatatttcatatattaaataattattttataattaataaaattatgaaatgtatattttacataattttccatatatatatatataaaatttcctttcggttctcttttttttttttccccagagatggggttggtctcattatgttccttaggctggtcttgaattcctaacctcaagtgatcctcctgcctcagcctcctgagtagctgggattacaggtgccagccatcacacccagctttctttctttttttcttttttttgagatgcagtcttactctgttgtccagggaccggtagttggtaaagaaggtggtggagcaagtggagagcacagtggcacagcctctgctcactgcagcctccacctcccaggttcaagtgatccttctgcctcagcctccccagtagctgggactacaggcgtgcaccatcacacccgggctaatttttatatttttagtagagacagggtttcaccatgttggccaggcaggtcttgaactcctgacttcaagtgatccacctgcctcagcttcccgaagtgttgggattacaggtgtgagccaccatgcctggacacccagctttctgtaagtacttttaatactagacaggactgactttaaaggtggtggaaaccacttttttttgggtttaacagaaggacttttttttaacctctgaactttttattggcttcctgttccccaaagggtatcctgcttctgctggctcagtgtctcagaacttctgtgtcattggtctcagacactactttgccatccactatcctgcaggtggtggtcttgtggatggtttgcatggagttgctgctgtccagggcatcatcaagattgaagtcctccctgtcttccagcaggcggtggtaggtggtgatctcagcctccagcttagctttgatgttcagcagggcctcatacttctgggcctggtgctgcccctctgcccgtgtgtgccagcaagatcccattgagctgctccatctacatgggtaacgtgtctctacctctctcaggctgttctgcaagctgagcttcagatttctcattgggtccaggtcgatctccaaggactggactgtatgtctcagctccgtgagtgtattctcagcagctccaatctcggcgaactgcgtggtgaccactgtggtgctcttttcaaactgctgggaccagtagtctagctcccctcagttcttttgagccagcttgtcatattgggcccaggtgtctgccatgatcttgctgaggtcctgagatttaggcgcatctacctccccagtcaacccagagctggcaatctgggcttgtaggccttttacttcctctttgtggttcttcatgaagagcagcttctccttgagaacctccatctctgtctccagctgcagctgagtgacattggtgtcatcagtgatcttgtggagcccatggatgtcgctctccacagactggcgcatgaccattctgtctcatagttgactctaaagtcatcagcagcaagatgggcactgtcaatctgcagaacgatgcaggcatggctcacagtatttgcaaagatctgagccctcagatccttgatgttcttgaagtaatgcccccaatctctgacctggggtcccttcttctgcaggtgctcctgcattttgctctccagcttccatttcttggtctccagactcctcactctgtccaggcagtaggccagggagtcgttcaggccttgcatggtctccttctcattctggatgccctccactcctgccagacccctggccatccccacagccaggcccccagaccccaagttgccccagaaactggtggagtgggacatggagatctgggagcccaagcccccagcacctgcatagatgttggccatgctgctgactggcagggcgccatagcttggcggcttgatagagccaagggactggtagttagtagagaacatggtggaccaagtggtgaagctcatgctatccagggaggaaagcgagagggcaggactcaggttttgctgaggtccagaaggactggtttttatctctctagagtgatataagtgtgattctgaaaacagggaaatggacataggatctttcaagtcctttttagatattttcttcaactcaagccaatgaatatgcattaagcactcaactgttttaggtgctatgggttatatcaagatgtgagatagatcgttgtggctataaggagtttataatactctattcaccaaaacaacacaaagaaaaattaaagcaacagcaaaaacaaacaagagaacaacacaccgtagaatatattcaagaagtagaatgtgaagtgcagatttataaattttgtagaaaattaaagaagagctaaaataatgaggaagtttgcatttgagctgcttaatttacttgataagagatataatttcaaagaattaaaatttcattattctagaattgtcttagtctgtttggctgctataacaaaatgccatgcaccgggtagctttcaaaaaacagaattcttttttgtcacacttctggaagctgggaaatccaagatcgactccagtagactcagtatccactgaggccccactttctggttcacagatggagatggtgtcttttagctgtatcctcacaagatggaagggataaatgagttcccttaggcctattttataagggtactaatcccattaaaaggctccaccctcatgacctaatcacgtcctaaaaggccttacctcctaataccatcacctgaggggtaaacattcagatagaaaaatctatgaatactgttttgttttcttacagagatttaaaacattgagtgtttctccaagcacttttcaaacatcaaattgtacaacatatttttaggttaaatgagttgactgtttttacaacaggctagaaattctttctcttaatttcctctcattatacacacattcacagaaagggaaagaagaactcactggctcagaatatgaccattgtttatagtttacctaccaaataattctttttctacctatgacctcttgaaccctagtaacatactaagaatataactaaaaggaaagcctcatgcaatgctacttaagccttcctaaaacatttagctcagttacttcaaaatgtccacattgttagttacttaaactatataatcacacatcatataacatatttttagtcaatggaccacatatacaatggtgatctcataagcttataataccatatttttaccgtaccctttctatgtttagattgcctacagtattcagtacagtaacatgctgtccaggtttgtagactagggacaataaggtatactatatagtctagatgtgtaataggctataccatctaagtttgtgcacaaagatgaaattgcctaacaatgcatttttcagaatgtatgcacttcgttaagtgatacatgactgtaaagtaaaaaacagcagcccagcgtggtggctcacacttgtaatcccagcactttgggaggctgaggcaggaggatcaagaccaccctgggcaacatagtgagacctcatcactacaaaaaataaataaaattagctaggtgcagtggtctacacctgtagtcctagctactcagatggctgaggtgggatgatcgcttgagctcagaagtttgaggctgcagtgagctatgataatgccacgggactccagcctgggcaacagagcaagaccctgcctctaacactaacagaaaaacaaaagaaatggcattgttgttctgaactctctgctctgtcccatttatttgtcccatctcttattataaatggttaaataatctcagaatttcaagttgttaatgttctgtttggaaatgtaataattatttgtattagctcaagtaggtagaaataaactaaaagactttatatttctctccactggcaaaccctcacctatttctttgtctgattgatcaagaactgtctcttcaaatatgtttttaatctcttttggagcataaagtttgacgtcattcaccatggagaaacctcctataatgggatttcactaataataattcctatatgtcagtttattagtcttcctatctatccagttatctatttgtctgtatctttaatttttctaagatgtcttctatgaattttttcctcaagtagtttactgggaaaaagtagctgtatgtatctactcccgtttggatttgtgattatcttttccagaaatttgtgatcatatgtaagatgcctgaaagactttttccatctaaaatatagtcttttatattcctccaattattattattattttttgagatggagtctcgctgtgtcgcccaggctggagtgcagtggcgcaatctcggctcactgcaagctccgccttccgggttcacgccactctgcctcagcctcccgagtagctgggactacaggcgcccgccaccacgcccggctaattttttgtatttttagtagagacggggtttcaccgtgttaaccaggatggtctcaatctcctgacctcatgatctgcccgccttggcttcccaaagtgctgggactacaggtgtgagccaccgcgcccggcccaatttttttttcaaaaagagaatctcagggtgaagaggcagagttactatgcatcctttcatctgtgtctaaggactccccatttttccagatttctgaaataaaacattactccagtgtagagtgtatcatttagtactaattcctacatagaacctacaggaataaggtggggattttgtaatcagatcaaatgtttgcctcattgcactctttcttatttaaactggctagataatccaaggacttgtgatatctagagatcctctttctcaaagagcatctctatgacaaaagtggaaggcattttatttcaaactcagtgatcttattattcttgatttataattctttgaccaaaggtttcaccctcaagagtgagataggatagagaaagttgtcatttcctgcctaggcaatgaaaagactccttgttgttcaatatatgaggctttcccttgggctattttcagtagtgtttcatctttattttggttaacgtaactcttcagttgctcattttcaaaaatttccatgatgtgttttctaataataataataccttttattgaggtattatctacattgggccaggcatgtgtagtattatttacagtaaatgatcttcacaactttccaaggagagtttttctttaaggatgaggatgtagaggttcagaaaggttaggtaaaccactccatgtaacacagctagcaagttgcccagccagctggatctgtctagctttaaggcctctagctaactaatttactcaacatcatccttttattgtatactttgtgtattcctttatttaatttgaattgtgtgctttcattatgtactttgatgcttctaagagtacctttctgaagaaatagttgtataatagcaaaggggctcatatctttaaatcttacaatggaatcctctattagcgctccagagagaagggttcagtcaagatttggcttgcagataataaaaatgatccagattaacttctagggccttgtcaggcaattctcaatattgaaattactttaaatttggaaataatgggcagcagcatatttaggctcagttcaatttggctccaatgatttctgcagtacagctatcttagaaagtatatttagttttatttaattactttgaatcatgtattcaatacttactataactaaaacattttgttgtcctagtgtggtggctcacacctgtaattccagcactttgggaggccaaggcagggggatcataagatcaggagttcaagaccagcctggccaagatagtgaaaacccatctctactaaaaatacaaaaattagccaagtgtggtggtggatgcctgtaatcctagctactatggaggctgaggcagggaaaattgcttgaacccgggaggtggagcttgcagtgagccgagatggcaacactgcactccagcctgggttacagaacgagactccaactaaaaaaaaaacaaaaaacaaataacaaaacccccaaaaaccaacaacattgtgctaggtactttgtggatagacccagtcacttctctcaagggtgttcacaatttaatgagagagaatatattcattaatacaaatatgtaactgggggacagagaacataaatataaggtcacagagtggcatatggtggcaatagtgttcagtaatgccctatgaagtcttaaattatgaattagtatttgggaggctccttggctgtaagattagactatgtccaggtgtgttacctataaaacagatcattcatgactcagttcatggaagcaatgattctatggtagtgaaaccaaaaggggctcacaaagaaataaaaatagaagaagttgaaggaaataaaactaaatttcaactttcaatagcataatatttctccttaacatccaaacgatagcaacaaaacaaaaaagaaaatggccaatttgaaaggaactggaagaatagatgacaatacagtttttatttccattaaccctcacatctaaggtttctaaagtactttacagaagattatacctcacaatatcttgatgagtgaggcaagtgttattatctccatataaaggtgggaaaaagaaggcacagaggtttgcttcttttatgccaagtgaggccaaatattttgtggagtatttgaaatgaaacttgaaaatagagaagcaaagagagaaggctggaagaatttgtaattgaggggcataatttcacaccacataagtgtctagagaacgttaatatagcgaatcttcatttccagtgaagtggaatgaaagccttgaattgcttcaatgcaccatgtcgtgcaaatagcaatttcagtttcagaaaatcctccactcatggtaaagttgttcagtgaaaatggtcatgatgaggctttctcacataattgtccaatatatgttcgtagttgtaccctacacacacacacacacacacacacacacacacacccttacttgaaatattaaatatttatgggcattgtgtagactcttgaaatacactaatggatatctaatatgttttacgtccactatgttactcattcacagatttctttttcttcccccaacttgcctttttatctactgcttttccgtgttctcttttgttgtcactttctttagggggttctgcccagggaagatagatataatagcttataagaataaatattgtagtcctagtttcttatttacttatttagacagggtcttgctcccatcacccaggccggagtgcagtggcctgatcacaactcactgcagcttggacttccgcagctcaggtgattttcccacctcagcctcctgagtagcttggaccacaggcatgtgccaccatgcccagataattttttgcactttcagtagagatggggtttcaccacgttgcccaggcggctggtctcaaactcctggcctcaagcgatctgcctgccttggcctcccaaagtgctgggattacaggcgtgagccaccgcacccggccctagttttttatttattaaaaatcctattaatacatattgatttcctttaagtaaagactttaattcccagtgaaaaacgtggtgcttatagttatttgttctttcacatatatctattttttttcaagatggggtctcactctgtcacccaggctagagtgcagtggcacgatcatagctcactgcagcctcaatttcctgggctcaagctatccttctgcctcagcctcaggagtagctgggactacaggagcataccaccttcccaggttttttttttttttttttttttttttttttttttgaggcagggtctcactttgtcacccaggctggagtgcagtagtaccatgatcacaacttactccagtctcaacctcgcaggctcaagagatcctcgtgcctcagcctcctgagtagctgggatcacagacgtgcaccaccatgcctggcttattttcattataattatttgtagagacgaggtctccctattttacccaggctgtttttgctgttgttgtttagcagagatgaggtctcactatgttgcctgggcttgttcttatattttttcaatcaagtggttgaagttgaaacctttaaaaagttaggttgtctatcaataagctgctgaccaaactaggaaaaacctattgattttgacagcaagttaggactttttaagcagtagaaatgaattgaatgttaatgaatataccatgtggcttttgtcttaattaactagcactctaattcttgatccataaaagatttgagataacaatgctgctttaattgttaaacaagtttcaaaggttaatcacaattaaccttttcagggagcaaatcagtttctttattcataatagattttataagaataatagaaattatcaaagctgcatacataagtttcaactatattttgaagttacaatgtactatttaaggaattatgtttaaatatagtggtaagtctttcttgactggttttggggaaaattaagtcctggtacttttaggaatccattgtgtataacaaacgaacttctctcctgtgtatctagaatggtactagttatgtgccatccttgggagaagtgagaaaatagtcgagtaattttctgtgtactgtagttcagatgagaaatcttggtttagaatgttaaagttttaaggttctcttggtttagccttcttggttttctactgtctcttaacaacctcctctacctagcaaaacatcaacaacaaataagcttttggggaaatctgcttattgtaaagcataacaccctttacatatgagcaccacagatacaatgtagcaaggcaggaaaaggttttattactgacaggcaactctgttagacaataacaaccaggctaatattctaattaccccatgtgaggtccccagagaaatataaaggaagtaaaggaaatgtagccgagattttcaatcttgctctctcacaataatactgtcctctttaataatcatttccaacacacccccgccaaaatactgtacttaatgtcttccactaaattagcatggttgatatttaagcagaaaaaataaaagaacaagaaatatgttacaatttattctatgagctatcacatccttaattaaaaaaaagaatttaccaacaaaaacagttaagattagaggatacaatgatttaatgttatagataatttcctctagtctgctcatgtttctcctgggttttgattcattcattactggatagagaaactaactattagtaaaggagatacttgtagtgagtaaataatgacagtctttttgaagttattctatttatgctgccttgtagtatcctctctcaagttactgtttcgtgaactatgtgcatttggtgctacaaatgctgatcaaaatggctcccaagcaaaaaatttacacatacattctcccagtgggcaaattattccctgggtattataactgagtgctaaatctgggttggtttggttgttttaaacatttataacaaaagttgaacatcggggaaactgtatatgtcagtttaggctgagcctggttgaaattaaaacataggaatatcatcaaggttatagtgagctgtgatcatgctactgcactccatcctgggcgacagagcaagaccctatctcttaaaaaatggaaaaaaaaaaaagatacaggaataccaaagggaagtaggttgttcatctctcctggaaataatgctttgtaaatccattaaatttgttagctagttagttagcctagggcctttttgattttcccaaagttaacatacagtttaaggcaaatgttacttatggaaataagccacagactacagaagccctcatttaaatgtaaaagaaatagcatcaacaaatttacccattttgtgtaatgatacggtaagcaatgaatagagtttttgttcatttaccttgaaatacagaacaactatcatttttcttggatgaagcacaatgatcattctggtgtagtataatatataacaatttttctaatgaaataatttcacatccagtgtatctcattattaatttctgatataatactcaattttaactaaatctaactatgtagcatggaatccagtgttaatgtgtcctataagtacatatgaaagaaatattctttgttttgacctacatttcctattgatgtaacaaaacactacttatgacacccagtataatgatttaggtaataatgtcaccagttaaaactatgacattgatataatacatagtttcagttagttatcagatacaaatcttcaggaaactaggctttattggttcagatacttgcctgcttgcttcacagaacactttgttaagtgaaaggaaaaataatgtctccatttgaaaaacagagggagtttggggctggcagaatgcaattgcccaagttagagggaaccaaattgatctgaaatcatttagataacaatgtgatgggcagaggacagcatttgtttatgaagacaaatcatgccaggcaaatctgatttatttggtcttataaaattactcaacaagtttgtggataaagaaaactccatggacaaacaatatatctaaatgtttgtaaaagcctttgatgtgggtctgcgtgagattaagataattgaaatgctgggaagatattgcctggataacaatgcaatggtgtggttatcagatttaaaacagaataatcataaaaatagatcataatatttaactgatatatttggcagaagactataaaagagctagtatctttataggtcaatatggaaagcaagtatgaaaatgacttagtccaaaaaattagcttattctttcttcaggaggtacacatatcataagcaaaaattatttcaaaatgttttactacttgtccaaaatgaactattactttattttggcctttactgatattaataaaatttggaatctatgatgtctgctaaaagcattaaaatagataagtttgataaatgtgtaaagcatagcaaaattcaatgaaaagcttacataggtttgtgaataaattcctttgtagatttttaagaactgagagataatttaaaagaaaatagctagagtagtagtaatagttttgggagagagagcaactaattataagtaaaaattaagaaaagagaatttggaaggaaaaaggaatacagtttgatgcatttaaaagtcttactggctaggcacagtggctcacgtctgtgatcccagcactttgggaggtgggaggatcgcttgagcctaggagtttgagaccagcctgggcaagatagggagaccccatctttataaaaaaaaaaatttaaaaattagccaggtgtggtggctcgcccctgtggtcccagctactggggaggctaaggtggaaggatcacttgagcctgagaagtcaaggcttcattgagccatgattgtgccactacactccagcctgggtgacagggtaagactctttctcaatcaatcagtcagtcagtcagtcagtcaattgtcaaatgggaaaaatactttatgtatccacaggggttatgttaaaatatttaacaatattatgaaatggttactatccaatcagaactgataatggccatagagctggagcagggccctagagccccattggtatattgggcgttaactctttagctgatggataatggggaggtgggtagtgaagaggctacaataactgaccagagtcaaggggaagagcatttggaaaggtagtggttatttgctaatgttatggaagtattttaatattttaataactgaaatggttttttctggtggaaccagctatataataaacaaaggactctgagaaaaataaacagaaaatttgaataggttaaattacaaagagtaaaattacaatttcaataaatagattataagatgttaaacttcattaataataaaatacaagtttattttcgcaaaacaacacttttatttatttatttttttgagatgagtctcactctgtcacccaggctggagtgcagtggcgcgacctcggctcactacaacctcctcctcccggtttcaagcaattctcctgcttcagcctcccgagtagccgggactacaggcgagcgccaccatgcccagctaatttttgtagtttttgtagagactggtttcaccatgttggccaggctggtcttgaactcctgacctcgagtgatctgcctgccttggcctcccaaagtactgggattacaggcgtgagccaccgtgaccggctacactttttacttatcttactggcaatattttttctcatgtttgacagaacatagttgagagaacaggaaaagtggcactcctatgcctgctgacagaagtataaataggcacaatcattgtgaaggatagctttgtaataattaccaaaaacttttaaaatgttgttctgatttaatggttctggtaatgttaggctaaattaagcagataaatcctcctagtgaaaataactaacagagctggattttaaaaatattcttaaagcataaaagagtatgaaacacagtaaggaattactaaaggtgaaggaaaaatgggaacccatatgtggagactgttctgccctgaggaaattttctgactcatgacaattagaatcttcattctggtagacttgcagggcaagggagacagaaagaaaaacccaggatgtgtataagatagaaaatctaatagaagatcctccccaacaagatactgggactccaaagcccttgagaatttactgcttgtattcaaattgcctgggtcagtgaattttaagccttgaacttgggttaaagtaattctaaattggtagtgccagaagcaaatataaatcctctttgaagcaagacacctttattataggcctaaaatcatttctagaaataattcttcaaatgtaatgttcagcacctaataaaaaaataacagatacataaggaaactagattaaacgggcaagtatcagtagagacaacagacaataaaaacagactcacaaataactcaaatattgaatttatcagactcagactataaaataagactacaaaacaattatgaagagtatgtttaaagacaaaagaccaacttgatgctgtctacagagaacagaaaaccacaaagagtaacgcagcaggtttgactttgaaaaaagaatcatatagaattttattgtgattttaaatatatttttattttataaataaaaataaattttatagctaatttttaaaatacaaatttaaaatccagggccaggtgccgtggctcatgcctgtaatcccagcactttgggaggccaaggcaggcagatcacgaggtcaggagatcgagatcatcctggtcaacatggtgaaaccccgtctctactaaaaatacacaaattagctgggtatggtggtgcacacctgtaatcccagttactcgggaggctgaggcaggagaatcgcttgaacctaggaggtggagattgcggtgagccaagattgcaccactgcactccagcctggcgacaaagcgagactccgtctcaaacaaataaataaataaataaataataaaatccaacagattttaagtgtatactacattagacatacttcaagatttagtaaacctgaagaacatcagaagaaatattccagaggcaagaaaagaaaagaaaaaaatatatataagaaggaaaaagacacagaaggtacagtgacaatgtctaacataggtttggccagggttctagaaggagaaaaaaagataagacaaaatagaagcaattatctgaaaagttaactgctgaggatttttcaaactgacattacttcaaagcactgatttttttttttttttttttgagatggagtctcgctctgttgcccaggctggagtgcagtggcgcgatcttggctcactgcaagctccgcctcccaggttcacgccattctcctgcctcaacctcccgagtagctgggactagaggcacctgccaccacgctcagctaattttttgtatttttagtagagacggggtttcatcgtgttagccaggatggtctcgatctcatgacctcatgatctgcctgccttggcctcccaaattgctgggattacaggcgtgagccaccacgcccggcccaaagcactgattttaacaagtcttacaaactgaaagaataataaatgaaaagaaattcatacctaagtgtactaaagtgaaacttcttaagactgaagactaaaaacaaatattaaaataacctaggccaggcgtggtggctcacgcctgtaatcctagcactttgggaggctgaggcaggcagatcacctgaggttaggagttcaagaccagccgggccaacacagcaaaaccttgtctctactaaaaatacaaaaattagctggtcatgggtgcctgtaatcccagctactcaggaggctgaggcatgacaatcacttgaacccaggaggcgcaggttgcagtgagctgagatgcccctgcactccagcctgggcgacaagagcaaaactccatttcaaaaaaaagaaaacaaaaaacaaaaaaaaaagaatccagagaaaagaaaattactttcaaaagagtcctaatatactaacagctgactttccactagtaaaaatgggaaagaagagacagtggaatattattttcaatgtgctgaaacaaaacagttaccataaaataatgacatttgagatatactagaggagacatattttgccactatcaaatctacaatgaaggaaattttaaagcatgtatttcaggtaggaggagaatgatctcacatgaaaagtcttagatacaaggaattaagagcaaagaaaatggaaaatgtttaagtaaatccagtgtttaagtgtataaaacaataataatagtcttgtggactttcaaaaatacaaaattaaaatacacaacaatagcatacaaatcaggaaagaatatatggagttcaagtgttctgacttccttatattattaaattttgacaaattaaaaatgtgtaatataattttaaaagtaatcaataaaataatacaaagaatataattttaaactggtaaagaggaggatttgatacataaaaatcagatatccatctaaaagaggacaaaaaggagagaagaagaaatgtaatagatcagacaaatgaaagcactttggaagatggcatatttaattctaaatatagtagcaagaaatgtaaaaggactaaatggttcagttaaaagctaaagattgactgttaaaaaaaatccaacagctaataggagacacatttgaaacataataataaagaaaggttgaaattaaaaggaaaatacataccttgtaaacaccaacgaaaagaaagctgatatgtctagaggaaaacatcagacaaaacactttaaggcagaaagcattagtacagataaagagggatactttatacttatgagaggtttcaattaaccaaacggatattgtttttcattcatatgaatcttaagactatgagaaagtctcaagattttatatagcaaaagttgagagactataaagagaaataacataaattaccatatatatgtggaggggtgggcataatataaaacttggtatgtacaactgcaaaatatacattcttttcaagcatgtgaatggaatcttaaatataaatatatagatatagataaaagttgacatggctttttccccgtccagccaggtagcaattttcattattcccaagtgtttatttggaacacatataacacattatttgtgtacataaaagcaggttagataggctctacccttattacaagcaatgcaaacacaccaatgttgagcacttggtaagagccagctctgtagaggatactagtttatctcctttaatttaactctcatcctattatgtcggtattattatgcctaatgtggggaaaagaactaagacacagagagattgagcaaaaattttaagatcagcccccactttttttttttttttttttgagatgaagtctcactctgttgcctaggctggagtgcagtggagtgatctcgactcactgcaacctccgcctcctgagttcaagtgattctcctgcctcagcctcctgggtagctgggattacaggcaagtgccaccaggcctgggtaatttttgtattttttgtagagatggggtttcaccatgttggccaggctggtctcgaactcctgacctcaggtgatctgcccacctcggcctcccaaagcactgggattacaggcataagccaccgcgcccagccgaagatcacctctttagtaaatgacagtgctaggattcgaatctactctttattagcaatgagccagctccagaaaatacttattcgtttaaggctggaagtagggaggtaagcattcctatcggaggatctctaataatattaggaagctatctttgtacaacattgacaaacgtttaagtgtctgcaatatagtagaattacatattgagccaaagaagtggctaaaatagtttgatgagagagctgtcttagaagacacagttagtgctagtgatttggaatgtgagaatggctgagagtaaagaactatcatgtacccagcataaagaaattaaaaagcctcttctatttgacatcttatgctattgaaaatcctttccttctagttcaagttcactattttcccattgcttatacgtcctgaagtgaatttcaatctcaacagtctttcatgaccaaatgaaagtcgttataaattccctctgctttcaagtttttagaatgtgtattatctattttactgctcaatacagggaggaaaacatagataagtataattatagagtgtatcagtcaattatttaaatctattcaatatttgaataattaggcccacttcatcttctatcaactgttttaatatttgttcagctgagcttcacgcctcaagtctcatcccactttcttaccttctccacatctttccctcagcctcacagctgcattgctccaacatagccatacagttttcttttcaaagcaaatatttgattatatcatttaaatgctttaaaaaaaagcagtagctttcacttaaaaatatccgcactcaatttagtgtggttataatgggctttgcaatcttgccccagtttatctttccagtctcagcttctccactccttacaccctcttaggacaaaaataacagactgatggcccatttatggaaaatactgtactgtgttgtcatgcctatgtgacaagaaactgaagccagagaggttaaacagcctgtttaagtcacgcaataagaaaatggcagagccgagattcaaactcagatctgactgactccaactcatgggcataacccagtacactacattgccttcttttgtcttttacatcttttgtgaattttgttttaaccacatgaaacaaaattaattttgagcacattaaatggtgtgcataatcactactgtcttgcatcataattgggtataaaatatcagccagtcacacaagaaattattgttatttctgaagaatttagggttgccattagtgtcaatagtcttccttcgcctcagacacttaataacaccctcttttcatttaagactcactatgtgccatgcattgtgataagtattttataaacacaataacatgtaatgcccaaagtaccctgtgagataattatttctatttccatttgtgatgaggaaactgagggttaaaaaggctaaattgcttaagattaaacagctagtagtggagctggaactctactaaactcaaactgtctaactttaaagcctgtgccctcaactaactaccctatacaacctccctttaaatgtcctagattgaacttctcaataaactggatcctatcctgtacatcttatttttgcctaaaattccctgtttcctaaacatgtagttttctcttgccagtcttatctttcctactaagtagctgaccgcttctttctgctcccattcttctagtatcctgggtactaaacagcttaaaataagaggctcctgtcatgaattggggtttattttccctataggtaatggcttcagaggaagaaaatggtggtgatctaagccatgggtcaagtggctgaggtgggaggaaaagacttccaagggcatatgatacaagaaagactttcctattcctttcatttgtctggactaagattcccaaatgcctaggatctagaactccttatgactttgtatactttcttttgtactcagtcagggtgggcttcaggcctgtgggttgcagtaacaagaaactgtgatgctttttttttgaacctggtagcttatgattttagacatcaattcatttatatatgtcaggcattgatctagataccagatgaaaacgaagctgagaacaaaacaaagaacctaccgtcctggattttatagagacaacagacaattaacaaatacataatacagtggcaaatagtgataaatgctatgaagaaaaagtaaagggacagaaaatgatgaagatatccttcaggcagtagagaaaaagaagaaaatgatgaagggtgatggtgggttagggctgttattttagtttgggtggtcagggaagatctttctcaggtggtattatttgagtaaagatccacaaatgaagttaagaaacaagatgtgaacatatctgaagaaaaaacattctggcagaataaacagccttgaggtggaagtgtgcttgtcatgtttgaggaaaataaggtgtccacttagatggagcagactgaatgaggaaaagaggagtgggagatgtggtttaagaatatccagggaccaagcagagctttggattttattctaaatgtgttgggaagccacttgaagattttgaacaaaagagtgaaagaatcagatttatattctaataggatacaacttgctgctgaataaagtatacactataaggaggcaaggatggaagcaagagaccaaatagagtaacagtggtagagaatttgagaagattcagattcaggaaatgctttgaaaatagagctgataagaactgctaatggattgaatatggggtgtttagctttaacccaaagtctttgggttttggctgaggcaactaattgaatgaaggtgccatttactgggatgaggaaaactgagatggggattaagtttaggagaggaaatcaagagtttggttttagatttgtgagagactgtttgactttcaagttcctagggacaatgggcctgtagtagctgcagctggtgttaaccttttacagggacatgtctaagtggaggtgagggggcagagaaacagaagaaataaagttccttctgagtaatctcccagatattcaagtgataaaaagcaggttagtcatctgagcctgtcttatacacactgatttcagggcaagaagaagtctcctctctcttcaaaaaatgttccgatttctattgtctcaaaatttctgaatttaaattaaatgtatcccgcaattagagaaagcagaaaatgtaaatagcttgagagataatccagtgcgtatgagtttttaccaaagtataactgagagcagatgaaggtcctgaatgtttaatctttttgtgaagagaaaggaggtagatattaaataaaacaaagattttataatcttgctttggcaatgccctatttatcgtaatttttaagtgagaaactacagaaagagtgtttgtatcttgaaggatcatctaagtttatacccaaggggggattacgcatttaaattctttctcttccccacattttaatcctttctatcttttaacccttagtcttttcccaaaagtgttcttcaactagaaggcctgtggcatgattgaggcttgtcaactctcttctagggccagatttcaaacagatggccctggagaatgctacttatctgtacagttctccatttgatgttgcagtgtgctagtatcctaggggaagggtaccacatttaactccagaaaggatttaaggcagttttgcaatttttttttttctgattatcagagtaatatacgattattgcaaaatattttaacaaaaaagttaaaaaaagactatttgaattcctacttactagaggcaatcccaacaacattttggcatatttccttccactgtcttatatgcatttcgtttttttcataactgagctctttattgtacaagcaacttttgctgcctgctgtttttgcttagttatggtatatatgtttgtctctatcattacatttttaaagctacgtaatcatctataacacggctatactatagtttactcaagatggtttctgattatttataattacaaataacactgtgataaacagctttgtgcataaatcttcgctcttcttttggatgacttactaaaggaggaattggtagattaaatgtatacatactttttaaagcttctgatgtaaattgttacaatgatttccagaaaggatgttattaaattacacttgggaagggaaggagagagctattggaactatcggatctggtagaaaatatctgacagcaattcttacaaagtactatgcccctggggaagagtcctttctctctctggaaaaggggttatcttaaagtattaaaattattacatcagattttccacaccacacaatatgtatggatcatgaggaggaaaggagaattgagaatttgagttagaagtcacatataagctgacatgtcagaaatgaccaatttgggaaactaagtttaccaacactgctaaaggactcaaatattttaaacagtggttcagatattgtgattatgcagtatcaggtttatttaattttgtatcatttcatgctatttaatgagacaatataatgagtgtttttcaaactgtgggtcctaatccatttgtaaattatgaaatcaatgtattttctatgactgctatttttaagaaacaaaatacaatacaatgaaaaatatgagaatgcactgcaaacatttcaatgtatgatttcataatttacaaatagattaggacccacagtattattttgtgagacttttgtttcagttacatgtgtgtatatactatagaacacatttattattgtgggatgtgattaaggaaaaaaatagtttgaagccattggtgtagtggaaagagtctgggctttggaattagccagaacaagtttgaatctgagctctgcttggcttttacccattatctaactaaatggctcaatcaccacattgaaaaaagagagaaataatatctcctttttggtttgtgtgtgtacatgttgtgtgcgtgtgtatgaagattagagattacttaagcagaatgcctataacatagtcaatgattaatatataattacttccaaatctttctcaaaataatgttctccctgtaaaaatacttcactgaagaaagacaatgtgttttattgatgactacatctgttatgctatcgtgtacttttaaaacacctctgtcagtctttttctccaatttggtttagtaaggagacttgtgcacatagtctttccccttcctgttctcacactttatttacctatattatggatcttggcactttatatctgtcatagatggtctaattgttgcctagttcaattactactaaacactttcaaacctcttctagttctcaaaatagtggtgggagcattgcagggtgccagatgaaaatctgttgagtttgctctacagcacaccttttgcaaagtatcacttgtggtgtacggggaagcagctgtaatgctgattccgccggcatttctcactcaatctactccatgctaaacaggccggttaggaattaagtcatactctgggtagtacaagtggaaagtgtgaacagagaaaccactttatgcgaggacagtggaaaatgagatcctcctttcctctccctactcctgctcctatcgagaagcacttaagagcgcagacgcccaggacccagccgcgctcgggcgtcccgactcggaggctggcggcgggcaggcacgctctcccgcgctgagagcccttctgcggagatgaactctcgagtgtcgccgccgcgcgcgggcccgatcgataccggcgggcggacgtgctcccgccgccgacagcagccacagggcggtgcagtcagctgtccggccgctcggtcgcacttctcatcagctcaatacccgcagaggacgtgcaccggttccctcccggacacccaccccgtggtctccgccgcaccttctgcccaccgccccttccgctcggccgtccggcgcagagcgggagcttttcagccagacgccctcgcgttgggggcagccgggtcccggcccgagcggagggcgtcgtgaggtggccttttcgcccggctccccagtgggacgctccgcggaggcagccaaggcggggagtgtcgagctccctcacactctggaccttaccttctggcgtcttcgcccgggaggctgcagggggaggcggacccagccggccacaggggcaggttcgcggcgctgtgaggcggggctgggcgtgcgccgccgccgccgccagattcgtctactccagtgaatcggcacgggagaaagccccgcccccggcgcccgctcccactcctgattggccgggccagcccggggaggcccggcgggaccccggcccgcgtctcagctataaagatagccccggcatgacagccgcggcgaagctcttctagttcatctgctggccggctctcagtccccgtggcgccccctttcctcttgtcccagagcgctctcgactccaccatgccaaggggattcctggtgaagcgaactaaacggacaggcggcttgtaccgagttcgccttgcggagcgtgtcttccctctgctggggccccagggggcgccgcccttcttggaggaggctcccagcgcctccttgcccggcgcggagcgggcgacaccccccacccgagaggaaccaggaaaggggttgacggcggaggcggcccgggaacagtcggggtcgccatgtcgggcggctggggtgagcccggggacgggcgggcgggaaggcgcggagtggcgggcgggtggcagggaaggtcccgggcccagccccagccccagccccagtccagcgaagccggcaggcgcagagctgcgtcgggcgttcctggagcgctgcctcagctcgcccgtctccgccgagtctttccccgggggcgccgccgccgtggccgctttctcctgctccgtggcgccagcagccgcaccgaccccgggggagcagtttctgctgccgcttcgggcgccgttcccagagcccgcgcttcagccggaccctgcgcccctctcggccgcccttcagagtctgaagcgggcggccggcggcgagcgccgcggcaaggcacccacggactgcgcgtctggacccgcggccgcgggaatcaagaagccaaaggccatgaggaagttgagctttgccgatgaggtgaccacatcccctgtcctgggcctgaagatcaaggaggaggagcccggagcgccgtcccggggcttggggggcagccgcacgccactgggggagttcatctgccagctgtgcaaggagcagtacgcagaccccttcgcgctggcccagcaccgctgctcccgcatcgtgcgcgtagagtaccgctgccctgagtgcgacaaggtgttcagctgtcctgcgaacctggcctcccatcgccgctggcataagccgcgtcctgcggctgcaaacgccgccacagtctcctccgccgacgggaagccgccttcttcgtcgtcttcgtcctcccgggactccggggccattgcatcttttctggcggagggaaaggagaacagccgaatagagcggactgcggatcagcacccgcaggccagggacagctccggggcggatcagcacccggacagcgccccgaggcagggcctccaggtgctgacgcatccagagccaccgctgcctcagggcccctacacggagggggtgttggggcgccgggtacctgtgccgggcagtaccagtggtggcaggggatccgagattttcgtgtgcccatattgccacaaaaagtttcgtcgccaagcctatctgcgcaagcacctgagcactcacgaggcgggctcggcccgtgcgctagcgccgggctttggctccgaacgcggtgccccacttgccttcgcttgcccattgtgcggagcgcacttccctacagcagatatcagggagaagcaccggctgtggcatgctgtccgcgaggagctgctcctgcccgctctggcgggggctcctcccgaaacgtcgggccctagcgggccatctgacgggagtgcccagcaaattttctcgtgcaagcactgcccgtccactttttttagctctccagggctgacccggcacatcaataagtgccacccctcagaaagccggcaagtgctgctgctgcagatgccactgcggcctggctgctgagggacgagagaccaggatgatttcgaggttggccttagaggaaacagatcatgggaatttctgtggggctttcttcaacttgcaagtttactttcattccttcctatgttttaatcccctaaaattctccctgtagtcaatgttccaccagaggagcggacagtgaaatgtaatatccctctctagagcaggtatgtatatggtataaaccttgagatcaaagactgtcagctttaaatccttctcactttccccactaaaataggatttttccccttaaaactctggagaccctaacgaatcctatatgatttgtaattcctatggaaagtcgcggtgaatgcgtgcatgtctcaatgtccacaaaggattctggctaccctttggtagccaatgttttttttgtcttgtcatcacaggcgcctatacagcttctgtctcaatagggtcagatattttgcactgtatattctgtgaattaaaagttatgtgattggtgtcaaacttaaggagattcaagacctggcagaaaatgtaagaggatttttgctgcttttggggtgcatggggatctcccctgtaaactttcctttgcccaattatatgtacatgtccattcttaagttggtgtttggaggtggggaggatgctactttactggagttgagacaccccctaaaattctcaccctcagctattttgtgggcagtattcaggaagagctacttcaaacctttctttaaatggctttttggaaatacagaagtcgtttcctcaagtttgactgttttaatggggtttcacccaaattgtttaatgcttctgctgtaaatgtcatactgtgtattcattatgaaaatatgtacagcttaaggaagatgttaacacctgtaatccactaaggaactgaatggcaatttgctcaatattcagtattttcttttcagcggcaacttgtttttgatttttttaaaaaaccatttcagtgtacattgtgtactaattccctactagccagtttgggacattggctgagcactgcctgacagaaagcccgtatttgtaagatgcttaccaccaaataaatgtacatagactgtgcttttgttgtgttctgtgtttgtcttaagaatcctgttgaacacagcctattttcaaagccacatttcttatctccccaatgtcggtatcctgttttagaatgttagtgacccatttggacagaatacaaagacggaaatattttgcaaatgaatgtgatggtgcaggaatgcaatgaaaaattttcctttgaagtatggctgcaaagactgagctgcaaaaagcaaggaatatgcactagtctttgaatctaaaaaagacatcccccccaagaaatgtcaaccgaaaacatattttaaatatatatatatatatatttcaagctagtgaacagtgttacctgaagatgaaaagaagtattttaatggtgctaattaatttcattatttcaggtttgtatttttactccatattgttatatatcatcaatccattagattttttatagcactttagaaacatgtatgcagttactctgattttcctttttgtaattcttcaccttggctgtaggaaattgtctacattgttcaatcttcttcccaaggactctatccatttgtttatcttctacatcagcttacataggacttttagttttcatttataagaaaatgaaattgggtgcacagaatttctgaaagattgtcttagaaacttgttagtacgaagttttattgctgaaagtatattataaaacaaagtaaaatttaagaatcaaaaaaacatgaagctgtaatcccagcactttgggaggccgaggtgggcggatcacgaggtcaggagatggagaccatcctggctaacacggtgaaaccccgtttctactaaaaaacaaaaaacaaaaaacaaaacaaaacaaaaaaattagccgggcgtggtggcacacgcctatagttccagctactcaggaggctgaggtaggagaactgcttgaacctgggaggcggaggttgcagtgagccgagatcgcgccagcctgggtgacagggagactccgtctcaaaaagcaaaacaaaacaaaacaaaaacatgaagctgagataaactaacaatctaaccaactgcattgggtgaatttctggccagcctttatgaagacagaaaatttcctgtgtttttaacgactgtggtaggatctgtgagaaataagttggaatgtatcttgaaaagggaattcaagtttatttttgatgattagctaagataatctaggttcatgctttaaatctcctcactactcatatagccctgcttattgaaaatatatgaaacatagaagacaaatcaacactcatggataggaagtgataagaatatttttattgtattattaaataccatgtcatctttcccccccactgttacaaattatagatactacatgaatgatgatacataatttatattttacggtttgccagtatgatgtatttacacatgcagttagtaccaatgtcatgctacatttcctcaggagatgcccattcaaaacaaaatgtgagcagcttatctactgtaagaaaatacttctagagggtggaatgtataccaacctggacctgcaagttcagtattaacaatattagatttaacttagactcctgggttatgttcctttttcttttttaaataatactcataatttgaacaacatatttatatcagaaaattttccttcttttcttccccatcttctttttggtgcttaaaaaagaacatagaaacaccaggatctagcagccaataataaaaggccacaatctgaaaacaaatggcatttaacagtgataccacttgaaatgcaaaacattagaaaaatacttggaagctaaacataaaagttcagcacagtgatttttctagttattggatataacatggcatcacctgcacagccaagaaatgagacattgctttgggaagaagagttaatactaaaatgatttcagttggaatttgagatgctaaagaccatttattttgagtgttttattgtcataacaaataatctgtacacattctgtgtattaacaggtacatcttttgctgtaactttacaaatgcttaaatgtaaaattttacatttgtaaaaaattatatatttattgaaccataaagttgcaatggggcacaataaataatgagactaattgtccaattgtattttggctcacagttaaccatgaaattaaagataaaactacttagacataattatctaggaaggtaaagggtgtagaataaaactccccctgccctcaaaatatggcagcttggattgtgggaaaaaaaatgaaacaataaataacttaaatctttaatattaagctacaaattatttaaaattatttaaatccagtgttttctcaaataaatgtacaggaagaaacatgcatgttatggcagacatgaaggcctgaaagggttaaccctatgttcgtgctaaggtggctactgctgatcactgctgggctgcttgtctccttaggatttattggctgagccagaggaacgacgcagcttcatggacatgcggcttttgctagttcgaggagacattggagaggccaggtcagccccatctacctgcgttgctgtgggagtttcactgggtagaatctctgggtaggagcctgtaggaaacagcaagagcattactacagttatccagcctctcatcccctgagaaataatctttctgctactaatctgcagcaaggatcccatcccttaataagatctttcgagggaaaaagcaagccccaaacttgcttgttacaatagcctactaatgtatttaaaacccagcaatctggtggctcatgtcattatattagcaagaaagcgccaatcatcattcccagggctagaaccctggaaaaagcagtgggaagcaaaatctttgagccagaaagaacagggatccaaagcaccatcagcatgcagggaaggggtcaagaagcaggtgagaaggaccaattcctatctctaggattcagggtacaaccaagaaaagagccttcactactcaaacttgaaaaacagcaccaaacagttccaaacagttttggaaccacgggtttcaaaaaggaagtcagtttcactagatgcccttataaacaaaacaaaacaaaaaaaggaactcagcactatgagatcatatacatgctaggtatttaaagacggctttaagaaggagcaagataaatttgtggatgaggggaggacaagaattctcctctgaatgtcagttaaaaaaaggcaaactgactcccccaaaatgtcttaatttaaaagacataaacaatgcttttgttttcattaacttaaacttttgcaggtatcttattcaatcataagcaagcaggtaaccagtagaattagtagatatacaattttagaagtaaaacaaaatcaaataggaaagttctttgtgtcatttataaagtagtttttcatctctgtgctttatttctataaattatcattctctaatatgcagcaatactacagaaccttgcacactgtaggctttcaaatatttcctaaacaaaatgagtaattaattaaaatcacattaaaaataaaagtccttcagaaaaaaaaatctgaaaacaataacagcaagagattctggatattttaaggcattttaatccagattttctgggtcttaagtacatgaaaattttctttatgtgttttacaaacaaaaacaccacacaggttgcaggtttaactgtacacatacatgtccttactttacagggagactttcagcatatttgttagccaatgtagcacctcattgatacttcaaactaggaaataattatgctagcactttcatatctatgaaatgttttgtgcttaaactgaagttactgaatgtttataaacaaaaacaaaaagttcagtaaggggtgaagatcctattgagatgtcttaagcaattaagaatatgtctttgcagaacacttcaattttttttttttttttttttttttgagacggagtctcactctgtcgccaggctggagtgcagtggcacgatcttggctcactgcaatctccactgcccgggttcaagcgattcccctgcctcagcctcttgagtagctgggaccacaggtgcgcaccaccacgcccggctaatttttttgtattttagtagagatggagtttcaccatgttggccaggatggtctcaatctcctgatctcatgatccaccctcctgggcctcccaaagtgctgggattgcaggcgtgagccaccgcacccggccttcaaaaagtttttaagaccaaatgttagagttatacttaagaaaaaatatatgtttccaaggaaaaatattctgtcactcataatccaggtcaattgcccttcttctcaaagtaacttttccagcattattttctaattgaaataagactggccttcaaaatacaaggagaaggaaacatatttctgttcacctttactcttcctgaagatctgaattggttcatagcagacccatactggaaaatttatgggagaatatgaatccatgaccccctttagggaagcactgcagatggatggcagaaggaaagtgaagagcagtagtagctcatgcttttctggtaatgcatatcattcccggccatcacgagaggccctcccattgctgtttaccttgagatggccaatgttttctagcggaggttttgggaggaagagaactatcactgcatttctttctttgttgtgaatgaagaaatggagtagcaagcagaagtgagaaagcaaaagagaagatagataacagatatgagagacacagtgcagaattttctaggtgttaactgaggagcagagagagaggaatcaaggtttttattatgaaatataattgggcatgcaatgcattagggtgatggttcacaatgacaatgctttgtaaattcaaatgttatacttaccaactaacaaaacaagttcaaataggaaaaaagaaaagaagaaaaaaggtctatgagagattctgtaaatatctaccttttaaagtgttcactgtactgttggcatgttatcctaatcactcagacataaaatctctagagctgcattgtccaatgtggtagccacagccacattaagtttaaatttattgaattaaaatgaattaaataaaaattcagttcctcagtacactagccacatttcaattgttcaacagccacatgtagttagcggcttccacattagacagtgcagatatagaacatttccatcaccatagaaggagggctttatcagagagcattgctctacattatggcaaactcaaataatattttcctcaaaaacaattcttccatgtcttcctcactgcctttaaagtgaaatctcccttcactcaacagagtcaaataaggatttttagtgtgtgtggtgtatagttatcagtacttcctaacaatttagcaaattacatttgtggtatatattcaacattcccaaactctataaataatttacagtagaaagacctcaattttagatgtaaaaaatgtagtaacaacctacatttcatttcacatcctactctacctattgatttatactacttgagtcataaagaatgctgatttatttctattattaatatatcctcaaggatgaggttttaaaagtacacatgagctcctatgtttgtgcataccgtatctgttactaacattcttacagtgctcacacagactgtgtaatctgatgggataaattgattcatatattgcacattgattacaataaactattattacaattaacataatggatatgacttttgggatatatagggattataagagggagctcaaaagatcattttttattgtggtttcgtttgtactgtttggtgacaggtatgactggtttaaagctgctaattattgggcagatatagccctataaaatattatatctttaaaagcaatttcaattaatactgaactccagcgacgatgtgatttgttagaaagaacatgggcataggttagacagtcctagattaaatgccgactctgtcactttaccagctgtttgatcttgggcaaactgacttgagacatttttgtattcgtaaaatggagctaatacttgcaattttgtcaagtcatcccagggattaagattacatatgcaaagatattggcacatagtaggagcacagtaagtatagctacataataatgctattaaacagagaaaaataaaagctgatacattttgaatcagaacagatgaggattagaaacgaagggatagaaatgaggaacatttttgaagaaaatgaccacctatacaaaatattattgttcaaatgtgaaaagcacaacataccattaaatttagtttgaaggaaatttatcctctcttatgttgatagtcctataaaatataaccttatattaaaggttaaaggctacccaaataaccttgcttttaatatttttaaaggagttgataagttattaagattagcatggatggcactgaatatcataaaggaaataacacaatttattttttatttttatttctttattttgagagggagtctcactctgttacccaggctggagtgcagtggcgcgatttcagctcactgcagcctctgcctcccgggttcaagtgattctcctgcctcagcctcctgagtagctgggattataggcgcatgccatcatgcccagctaatttttgtgtttttagtagagaagggttttgccatgttggccaggctggtcttgaactcttggcctcaagtgatctgcctgcctcagcctcccaaagggttgggattacaggcgtgagccaccatgcctggccaggaaataacataatttaaaatagtagagaaataaaggcaaacatgtggtttcattttaagatacattcaagaactactagtattttagatttagaacaaatcaggccaagcttgtcatattttacctcctccttacaaaggaaaaaattgggagaattgattaatttgcatttatatggataacaactggcagaactaggatttaaatccagattagtttgattccaaagctcatacttctcccctggcaaccttaaagatatatgggggaaaagagatttttcaatgggtgggaaagtaaaacccttaaaataaaaatctttaacaatttataatttgtaaatatgacaggttattgggcaatatctctctatcaacagcaggaaggggatgaaaatatttagactaaatgggtaactgtaatagttaagatcatgccctctgaaatcagatcagtctaggttgaaatactagcttgacaaagtaccaggtgactctgggtaagcattttttaatttcataatgtatgtacagtaccgagcacagtgtctggcactcagtaatagcacaattattattttattattttcattacaaaaatttcacatctcagtgaatgttctatgtggaaactgaaccagcagttatcacaaaaggttagtgggtcttatttaagattattacttgcctcttggtcaacaacatataagccaaatttccaagttcaaagtatcaaatagaacatatctggctgcctataatttcaggctaatctaatgataaattaatatgcgtaggaatctgtttttaaaaacattaattagccaggtatggtgactcaaatctgtaaccgcagcaatttgggaggctgaggtgggtggattacctgaggtcaggagtttgagatcagcctggccaacatggtgaaatcctgtctttaccaaaaatacaaaaatcagccaggagtggtggcatgggcctgtaatcccagctacttgagaggctgaggcaggagaattgcttgaacccgggaggtggaggttgcagtgagccaagattgcgccactgcactccagcctctgtctcaaaaaaaacaaaaacaaaaaccaaaccattaaataaacagatttatagcttatgttacatattgcaggcaactaattcttctgttggcacttactaatatttaagatatttataaaataactatcttctaaggagctaaaatattttatttcagatcatttcaaagcctgagtagtttaaataacttttaaaggacattgagctaaaaaaggttacctaaagcaatggctaaattttgatgatccatcccactcaaagattcaaagaaatagatctgaccatcataaattccatcctatctacatatgggaatatagattttgcaaattaacagcacaactgaggttagaaggcagactagatactactctaggttttcatagtcactcttgattatctctgaatttggtatcataaaaattatatttgaattttattaattttataatattgctttaaataggaacccctatattctccaaaagtaattataaaaagtgttatgtatgtatagatatatgtttgtgtatgtatatatatgtatatgaatacagaaagacagaaacacctatcaacactttaactgtaaataactaaaatctgtaacttaaagacataatactccaaaaaattatgagtatatttttaatgttgaaattgagaaagttaaaccaattaatatttactatacactttcagcaaaacaggatcctgtttcttgttgtcattctagaatttctcttattacaaaataaaaaaagataatattgaaaagacaatataacattgggagaaacatgtacatatgaacaaacagtgtaatctggccaagaagagcagtaatttcattttaaagtttataattaaaggagaggtatttgtaaatatgaaaaaactttaagaagtcactaaaaacttttgatattttccacacacatgcctgacaaagataaagggattttttcctgtaattttttaaaaataaaagacaagaaaaatctaataatattttaacgtagttatgaaagatcaacaaagtgtgacatcacgatatttccctcaatgaccttagggataaaaataatttcccttaagtatcagtctactgccacagacagtacattttgagaaaatacagttatgaaatttatggatcaactatgatgcaccaaaatctttcatatctattttaataatactgaaagtaatacggaaaaatgttttctcggatttaaatgtcaccacagttgatttgcacgttaccgctaaccagaaagtgggctttagataatcttgaaccaaattaagaaatcttaaaaaaataatgctaaatgacgagttaatgggtgcagcacaccagcatggcacatgtatacatatgtaactaacctgcacattgtgcacatgtaccctaaaatttaaagtgtaataataataataataataaatattatttttctatactattccactgaatataattatgttatagggttggttagacagaatataatcaccattttggcatttctttaaaatttaatttcaaatgaccatattagtattgattagtactattttatatacatagggtgtgcacaggatatctaaagttgatttttcaattgcaattatgaatccattttttcaatgtggtgaacacattttatacttctgctaggaaaaagattaaaaactttacactattatgtcatttttgcaaaccagcagtcaggtccaaactgctattatacagcttattttatgtcttctctgtccactttgacttataactttaaagggagctctatatgtatgggacttatgacagaaaagttaagatttgagataactggaaaaaaattatttttcagattctatgtttttgctactcttaagagtaaatatttcatttttattttgtgttgaactgagaaccactctgataaaaatttatgtcataactattaaagtctgcaaaaacttatatagaaacgtattcagtaatactggcacaagttatttacaagcaaaaacacccttttgaaaatcagagtgcatattaaaattagaggatggttcttaaatgcagtgacaactcttaaaaattaactgaaaaaatctgtagcacaatattaggtttatgttcaaattcacatttttactactatttagacaatcataagtgttattttaaacaacttacacaataattttgtaagacacattaaaaatgaagccaacagaaccctgacttggctgctgtagcatcctttaatgtctcagaagtgagatactactcacttccacaatacctggccaaatgtgcaggataacatgcaaaatatggggagaacattaagatgacaaatacgaaagagtacagctggtaaacaacgacacatgagaactgaacagcctttatcaatctaagggggaaagttagtccaagtgtggttctattatcaatatttttcacttgtgaaatttatggcttgactataggatacacaagtgttattcatatctcttttaatataatctgacattttatcggacattctccattattaaacaagaaaattgccagatatacttaattagttattttgctgttcattaatttaatatttctcttttaccatcttttttaatgccaaactgggtaattttggatagtgtcaatccattaaagtgaatcttagactttttatctctttcaaaagattcaacctggtttaatacggttttgtctttgctaggtcttttatactatctgaaagcgatctaaattttttgtaaaattatttttctaatagcaatttaatgatgacaggaatggaaactttaatttcactaactaaatctcaattgagaattacagtaactttttccaaataaattaggctagaaaagaagtgttgtgccttttgaatttatttaatataaagaaaacttatttaatataaagagatttgaaggtttattatgataaacttcaagcatattatgtcctcttttcctgcttcccttgaataccattacaacagtcatctttgtatttcaggtgcctagtgaagtgcaaggcacacagagagttatcatttgatgagttaggatatccaataacaatgcaacacatcacaaaatacaaagacacactacttcagttcaatagtactactttttcatgctgagaaacagaaaaaaaaggtcaatataacaaggtgtaactaatttcaaccaagggattctattattagttatttttatccccaaaccatgttagtgtttcatgcagacctgggttagtcagtataatactggaaaaaatttagtgacaatttctgaaatgtttagtatgaaccggacagtgttaagtttacttattgtttaagttacaagcttagagcctgctaattttgaaaaaaggaaatgggagaagaacagagggtgttttggttgacactttgtcttaccttcagataaacagaactgatatttaatgatctaaagagggaaaataaatgaaacaatcataaggagagcaagatattacagaataggaaggccacgagtcatttattttcttactgatttcttcaaaattaatcataaaatgcagtaccctcttacactctttaattattgtaacataaattacagtattaagtacttctaaatctagaccagttatattagctttagctgtaaaatcagagatgatggggtgatattcttggccacaaaatttgatcctctgaagttcagagtgcatgcttaatttgtatttcttttgcagatacttcagaaatgattccagaagatgcaagagtcattgaatattagctcatataaaatgtggtacatgtacttttatgaagatagttgactttttaaggaactgcatttaggtaaaagaaaccataaatcaaatttataggccaaattcaaatattaaatagtgattaaaaattcatatttcaatgattagaatttttttcaagcaagtttttagaacaaaagggtactgcatttcaagttccaataacaagtaactaatactcgcttttaatcttaccggcatcagatggtaaatggtggtagggagctggagaaaaaacctgtgctgcaaaatcttcaaatgttgttggttctaagtggtgctggacaattgtttgcaggtatcgtgctctctcctcatagctgatttcctttggttaaggataaacttaagtgcagcttatactggaaaaaaaatcttatcaaaaaggactgctatgattgctaagccattacttcttaataaatagaattattcactaattattcttatatattgttaacagtatggctttttaaagtgcaaaaatatagtttttaatgtatgtttactcttcatgatcccagtataaatgacaacttaacagggagacatttattagataataattacaataatactaaactactgaaatgaaggaagttaacagtttacttgagaaaggattcaatttctatcaggagtctaggctgaaatttatatcggcctaggctcatcttatcttgttaatcagcttccatctgcagatttactctcaaaagccacgcaagaaacattgtaatgttgcttaagatactacgtccaaaattctgtttttcatttgtaaagatttattgtgaaaaattcctacatatcttcttctttttctaaaatccctgcattttctcaacaattgttctcattttgaatggaagattactgttgctgtaatcctcgaataactccatgtggttaagataaatacatagctgaatctgtatgctgggaaaaaatacctagtcaattataacactgaaacaagcaggaatatttgcaaagagtccacaggactcctaaatactgtctaacaaagcatctccagggcactgacactgacagaaaaatactgtagttccttttcaccacattttcttctctgatattattgacaagcaaccagtaccttgaagcgttgttgcttttgaacaacccactccaggcttcctgtttcagcaggcctgattgtgctgttagcacagagagggcgagaaagagagagaatatttctgttgttcacgaaagcaactatggaaatggctgtcaaaatgtagagcagcaggcagcaacatacaattatcaggaaaaactcacatgctgacttcatgtcatatagttcctgaactgagaaatcagttaacctttcttttaaaacttttaaaagtttccctgtggtactcagtgtgctatgctgacaggctttacataagacatttaaataaggataataaaaatttgtctacttgttcttctttttttccactgaatttttccccaaagtccactttaatattttccctcaaaattccttattttttaaaaaaatgcaatttaattattatatagttctaaaactctagaaattgtagactaagccaagacccaaaaaaataatttgagaggaagataattttaaataattcaatgggagataccatggccagttagttatatttacaagttcactgagtaagaagagaaaaaaaaagtataagagttaaaggcaagactatattcattatgcacttgactttgattgtggtaacttttgctaagtggctttcatattacaatttatctgcttctattacaatttatcttatgtatcaaatattaaaataaccttgaatcccaattctattaccttccattctgtacactgggggtgaacttcaaaagaattttacttttgaggtgggaagcaataggacaagatgcatattaaaatgatcagcatcaaggattttacatgaggataatacggacatttttgagtcttaacataaacaagtaatatggcacacttttaaagggggtatatggttataaatagaagaggatgaaactgatggtacaatctaaataataccacatatctcacaacttgttggaaagtacttttttcattgggggagattcacagctgccgaattttctgcagttaatagagtcctttgattcacagcagtgccccttgtacaaaaaatactggcctttgtgtattaccagaaactaattttctatttggctgaaaagggaaaaatggggttattgcttctccctcctacagagcttttcattatgcctgatgcactcaacttctaagctcttctgagaaaaaaaataactgaagaggcaagaggtagaaaaatgagcttgttagcacattagaagtgaagtatcttggtgggccctagaaattcccagtggtgtgttaacttatcactctatgcatgctggcactgatagtcttccaattgatcactctcttttcgcaccaaaggtgctgccaggaagcaaaggctgaaggcccacaggagaacagtctgctatcaaaacaagctgtttttaaaagtctgcttgaatgggtaaaatgcttcatgaaaagtagggtggagacacctacctgcttttaaaaatgttctactttcagagggcctataaatgaaatattttacattatatttagaatttatataaaaattaggcagaaagaaagcaaatgttaatatttctaaagcaggggaggatatttccaatgtagtaaattcatcaaagcaagaaaatgattatctagctaaaatacattttgcagactaattctacttccttatacaaagaggcttataaaatggaaaaaatcctaatacacagctgcacaaaactaaaattatccagatataacatactcattttgtataaaaaatatatttaatacatttacaataaattaattaaatttcattaatgaaaacaatgctttctaaaattattttaaaagttcaagtcaggatggcagagtgaagggaagcaatcattaacggttgaatttaaatgaaaaaactacagtgctcatcacttattaggtaagtttcctttttggggggtcaaacactgttagcttggtaaaataactatatctaaggtaaatcactttctaaaagctaaatgatctttataagtttcccagtttgatgtagccaaataaataaataacaacatgaaaacaagccaacccaatctacaggacttacatccccccccggcccccgctttttttacttctgaaaacatgtattaaggaaatataataaactctaagcacttagaccacagttctgagtccacaacgaggtgctttttgtgattgagatgattaaagttccaaacagtgctgttagaatctgcaattgtaatcatccaaagcagttaattcctatatctcattataataggttagacacttactccataaaaggcatctctctagggaagagttattagtacatatacattgagtggcacacaaactccacagctggcaacaacaggacaactcaagctatcgttttatatggtgagtgcctgttgccattggcattgaaattaaaaaaccgaaatggataagatgataaaaaggtgaaggtaaataaaaaaattcagaacaaaaatttaaagtacaaatctaagttgaagtaagcagattttggttgtaaatttaaaacaactcaagccaaaattagctaataaaaaccatttgatgagggagacttttagctagtaggaatctttaatacagaactagccaatcaaaaaaaaaaaaaaaataacacacaggtgctgcaatcacagcaatataattatccactaatcctccttccgctttctacaaaaggaaaaaaggggggaaggaatattattattctaaaaataagggaacaaaatgtctatagcgtaaagaaacagtttaaatgtaatctgtaattcattaatattaagttaacatcattacatattttaaattattactcttgattttaagcttcaagaccagctattaagaaactgggttcaatttcagactgatcctggaaagataagcataaattttctgtgccataatttatctgtatgttaaatggggatacatctgtaagttaagtggggataccatcacctgctcacttcatagggtgttgaagataaaggatacaaatacggggtaacacaaaagtgccctgacacctgtcctgaaatactttattttgacctttggctcacatctttgtaaacagcaggtgctgtctctaggagggcaatttttgatgtcagtttaagaaatatacctgtattcatgtgcaagaactctttgataatactactactatttcttgtttgcggcacgtacagagagggaattttgacttattctgatgcaaggaaactgatttctcatggaggaaaaggacaaaagatactgcagaaggttatgcagtatcaagtatttcaactttattaacacataaaagaatagataaaggtagatttggttttaaagaagcaacacctttcgttctccacaataattttattaatctggtaattgtgaactgcttgtaatgttagaaaagggaaagctttcagttttgtaattccatggcacaaccagtaggctgtataaacattcagttcaaatctaatttgtgactagtctgaaagaaatggaaatgtgtgtgtgtgtgtatatatgtatgcgtatacatatgttatacacaagaatgaatataaggtataattttcacaaaaaggaattataaaaattacaacttgtaagcagatatcaaaaatctgtataattgcttattttcctcttaagttcaggtttcatgttttatttcctaaacaagaaaaaacgattggctcattttaaaataaaggcaagtataaagtgtttatatctgtgctcaatggcatagtctcagggatttaaggcccattctgaaattcttaatttagtaagcacttccctacactcatatatttctatggcttctttgcagtttcagcacttaggaattttatctcccttctctagacagaagattccaaaaatagtaagcacaggaagagggagtgttccaatagttacttagaaatgttgcctactgatttaaaaaaaatttttggtgagtacaacttaaatcatatttgagttgtaacttaaagtagctgaaatctgagtactacttaagttgagcagattagagtaaattattcaatactcataaagtttgtaaggttggtagcctgaaattggctatggtgagtttccacatcatacatcttgaagattgctgcaaaacgcccacctgccaggtcccctttagagaactctttccttaggcttgttcttctactaaatacactttcttttttttttttttttttttttttttgagacggagtctcactctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctaaatacactttcttaagaaatagtttttatacccgattcttgggggcagatttggtggttcttcaatgttacttcttcactttagagactactaatccagccattctacttatgttattgaaatttttatgatccattttgtggttacagatagtggtgagaccaacgccatggggacagagaccttgtcttcttatatttatgtcttcaacacccaacacagggcctggtagtattcaatgactgtttacaacttctagaaggaatgaataaagttggtttgatagtagattaggagatgtctgttatgctgacagcccctttcctctaatccccatatggctctgtaaaggcaaaccttttagggggaaatatagttggaactttcctagaactggatttagactttgaatctttcttgtgagaaagattttggttctaccatgccccttgatcttgctggccctctctggaaccaaaaaaaagtaaataaagcacaatgtataaatatgtaaagtattacattaagagaaaagaaaactgataattacttctttaaatcctcataatcttaaagaaggattttttctttaggcaatgtaattataactcataatttagcattgaaataaacatttcccccattggttgtgataattgtttaaatttttttcataaattctacaatggcatgagaaatgaatttagtcaaactaattctatttgcttaagtggccatttatagagaagggaaaaaaagggaagaatgagaaaatctttacagagaaaattaaatgaagggtaatttcaaatcattttaggcagatttccaaaactgctctgtataccataagaatagaagtaataatacccttgaaaaacaacacttgaaaaatgttaaatatttaggtttttaaaaaggccaccttgaaagaggttatcccaagacaaggcatcatttatcgagaatatttaggacagtttgaactagaggaaggatacatccatcaacattacttccaggaagcttggtaaaattagtttattttactaatgtttataggcagcaataaggcttgcctgaatggagagtacagagatttgcttggataaacaaagctgctgatggatagagctgggactagaatcttggtcttttaattaatagtccaatgctctctctacatccaatctcaatgacctaggtgttgtgcggtgaaaaagcaaaggtatattaggccttttagttatgtcaaaataatgaatattagcttaaattctaagactggcaatttttgaaagatgtttgtttacatattagtagagtaaaatactatttgctatactatagtttactatacattagtgactatactacagtaaaaccccttgcatgttctaaaataaaaatttgaaaacaaaccacatttggcacttcagttttaaaaggccttgaaatatctttaaacattctgaggcaatatcattacacagggtcttgaaaaaagaatgaaaaataagaattttattgagacatagcatatgggtagacatattttgcaagtacatctcaaggatctcatggttattatcggtagtaaagtagcaaattttccgaaatacaccgggtaattagtatctcatggactaatatataatatacactgttcatttataagatgaaagcaaactatactgcttaccttataaagcaagatctgataaattaagatctggcagagggaaagatattccatttctttcctactgtaactaattttttccagaaacatgcagtctagttcacatgtagtaaaaaataaaattcccctaaacaaattgcatgaatcttgttattaatattgcttatactatgttaataaaaattcttctgaaagtctgcaacaggttatgacaaattattgtctatttttatgatgccttatattcatgaaattctttagtagttgatactatctacaccatgaaggaaaagctgtgatttgtcagagcagacaaagctgggctttaatccatccttttaaccatattgccaagtctatattgttttcactgcgtctcaattaggagacaggcaggacacctggtacttctttatctaagtcccatgggctgccagatgactcaaaatccataacaggtgctaaggcagtgtgaggatagccctattattgaaagctggagttgaataaaatttggaccacatataattgctcataaatcagtcaattactaaatgaaaacattaagtaaaaagttgataagcccaattccaccaaagtttgtgtaaatacatttaaaaagattaaccttaaataaataggcttaaaaatttaaacctacctaaaggctctgaaaatccttcctgatttaataatccagtaatcattggtgggtttcaaaaagcactaatatgattatccaatatgtatgtgtgtgtgtgtgtgtgtgtgtgtgtgtgtgtgtgtgtatatatattctattttcatgaaagttgtacgaagcaaaacaaaaactagggtatctggatttcaaatttagtgaaattataatgtcctctcatttaatgaaattataatgtcctctcattcttggaaagatctacttggaccctgtcagaagactgcaaaaagaaaaaaaaaaaaaacccaaataagtgaaattttacagtgtacaattacttaagtgttatctctacttaaatgtgcactaatttaattaagattttatttaagtgctataattattgggaatacaaaaaaagtgattttattatcatagtaagtagaaacaaagtacagtaaactgtcatttaagacagtgtcatagaatctatgataagcagtacattggcttaaactaatgcactatatgcccccagggaatgataggcatagacactggactttaacatcaaaatctatccattaatcttgacttaaatacaatctattctgcagtaaaaggaagaatgggcattcaatgaattactgtttttgaaatactgcactggtgcccatttactaaaattacttaagagaacacaggatatggaatagtagtaaattttacagatttactgattttacaaaacatgcatttgaatttccccaaatctagcaagagcatcccattaaaaaaatttacagatttaaaaggtttcttaaaatatctcttccttatcctatttaagaacatgctgcataaattataatactgcaatataatttagtcaacttcatttcagctgaaaagaaagaatcatctatggggtcagaatccctggagtctgaaaataagcattaatttttttttcaggttgtagatcattgtttctttgcaacaaaactacacaactgcttgctgataaagctgaccaagaaaacagaaaggccaaggagtgtttatataaatatcagcgcatacaatatttcataaaaaaggaaacaaccctcacattaaaaaaaatccaaccagagggaattcaatgagtgagataatcatacacgactgaaatagttatgagctactcacttaaatgataaatctggcatttaaccttaagatgtgctgactaatttatctttagtggattattttagcacttgtgttatgcagaaagttaatttacatttctatactaatatcgtttatatgtattcagatggtatttgggaatcctaaaaagcaaagtgtaaattaaaccaaatttataaccttatctgacatgtgaattgtgacgattttatccacttcacctcaattaaattatgaagataaaaaattccttattttcatctaataaaaaaataaggcaaaactgacttttgctctgcaataatctgatgggctaaaaatagataatggcatgttaataaggaattactacaggtggttgcttatattcatttgccttcttttttgatagtagttacatgctaaataagtcaacattcttagcaagagagtaagtaaatgtagaaacatcagttctgcaacagctatttttgcttcttctcttttctgaacagcaattagtaaagcaaccccttcccctcctccctagtgctgtcaagctgttcagagcagtttgcaactcgacaatggtaccattgtgaatgctctctgggcttccttcccacagagagttaaatgggcagttcctgctgcccatgattggtgtccagtgaaataatactcaagagccaggttttatcagcttcacgccaaagaagtgaagccagggaacccaagccttcatatcatactggaccatatgccaaccctgatggccccaaaggtttatcactaagaatcaggatccatcatgtcccttgtgaaatttcacttcacataccttatgtgaaatgcaaagcttcactaaaaactgaaccttctttacaattggcatgaacagatgggcggtaacagtggtttggcaagcaaaagttaagatttaaataggctctattctagtgtttgagaggaatagcagttagaagaaaatggatagatttgtgacccatactttaattttaattccattattattaaaaatttaatatcaaaaggcctatgtttagtcaatgaaaagaatgaatgaaaaccacttcaattcctatgtcaaatatgtttaaagactaatttctgctttacatcctttcttctttgctctttgaaatcccgaaatagcatctgaatctacagttgttttcatatttaaagagtagaataaaagttgtacattatgtagtaggtgtggtgaacaataatgtgagtggagcagtgcacagtcatcacaaactgcaacatcatagggttttaatacaggaaaaaaaaaaatccctattccagcacaggtgagaagttgataaagatagaagcaaacttcaagtttcgttgtttttagggaatactgtactttgtccgtgccctgatggagttctctttcttctcgtgcactgtgatatgacccaactgtccagattggcatatgtggaccatactgttacactaaatttgacaaaacagataagatggtggtaatgctttcttttggtatttttgtcgttgttgccatgaagtcaatgtattataagactaggacaaaagtactttattcatcaataacgtgtaaaagtgtaataatgtgtaaaaactcaataattgtataaaagtatctcataggaaaagtgtaaaggattgttgtgcaagaatgaagagtatcatgagtctatcataagaaatatgaaaatctcagatgctcttttaaaaatgatacatatgtataaatactatcaaacatttagagatcttagtctcattgagaaaatgcaatactggctattagcctggcaattattgctcaactaattatcataaaaaagactttatgaaaataacgatcaataaacattttggaaaggcttcgctagaaaatgaaaaataagaaattcaagctgtaattgtttcgctagtcaacgggtaaaaaacacacaatagcagaaggaactgttaccttagacactggctgccataaaacaatcagtagcattagaaaaccacatttatgtttattttctttctgcttgactgtattatctggttttgacctacttcttgatctttatctgccactgctcttccctttatatcatccagcagtactgaacaccttttatctcttgaccatatcacatttttatgcctccatgtccacttcttacccttaaaaaattcttccctgaccatatctgtctagaaaagttccatgtgtctctgaaatattagcagaattcttccatagtaaagccattcctctaatttccatcccatcctctcaccctatcctctcccacttaaaattaatcacctttaccatcctacttggtctatatcactattgctgaatgaccccaaattgcttaagtttatcattagtgcattaagttcttggtagaagataaaaattgaaaatatctctagaattaaaacaatgttaacagaaatggaagttggccatatactgaagtcatttttgtgagctcccacagtttaactgtaagtaattattggtcaatattagtaaaaccttaaagactgtctctagagaccattaagagacaatgctattttcagacagaataaactttctttactattatcacaaagttattacatatcagagattcacatttattgctttttgaaaggacaaggatttgctagaccaaaactaccatctttaaaggtatgcagtacttttaaaatacggtaacatcgcagggcgtggtggctcacacctgtaatcccagcactttgggaggccgaggcagatggatcacgaggtcaggagtttgagaccagcctggccaacatggtgaaaccctgtcactactaaaaatacaaaattagctgggcgtggtggcaggcacctgtaatcccagctacttgggaggctgaggcaggagaaacgcttgaaactggaaagtggaggttgcagtgagccgagatggcgccactgcactccagcctgggggaaacagcaaaactctgtctcaaaaaaaaaaaaaaaaaaaaaaaaaatacagtaacatcatcaacaggcatatactgccatttttgaaaagaatagctaaataaattaaaactgacataatcaaaaatatactagagtcactgtagaagtgtggcacatatatggggcccctgtttaaataattactctgtatacacagactacaaagactacaagacttggcagcaaaatccatgacaaggggatgtgtaagcacagcaaaaaattctttaattgtaatgccatgtctttaatataggagttttttttttttttttttttttttttgagacagagtcttacactgttgcccaggctggagtgcagtggtgcaatctgggctcactgcaacctctgggttcaagcaattctcatccctcaagcctcctgagtagctgggattacaggcgtgtgccatcatgcctggctaattttttgtatttttagtagagacagggtttcactatatagcccaggctcgtcttgaactcctggcctcaagtgatctgcccaccttgacctcccaaagtgctggtattacaggtgtgtacctgtaatacctagttacagccaccgcggctggctgaatacaggagatttaaatccttcaattatggagcagattgttaggtaaagaagaatgtttgtctgctcttggagagatcctactacaatggttagtaccagtagcacaatggctgtgagcttttcaaagaccacaaaacctggatcacttagctggtaagacattttatttgaagaattatcttctcttcttttgaagagaatgaccataactatacatcttagttaaaaatcaatttgacttaacaactaatcaatttgatttaacaactaatcaatttgtccatgatatttaagaccttcatagaaagcatgaagaacaaatggcacaaaattttgagagctcctaatggactcagtaacataggtggtacaaatgttaaagcagcaaaattggaaacctcatcagcgtctagactcccattgcttccccctactgctctcctgttgctaccactttccttgccttacagcaggaagtgtgagccttcagggctcagcctcatgctgcctcctccttggaggggacaccaagatgtgtcctccccaagtcatctgccactgccatcaagtcagagatgtcttagctcatttttctccctaagagatctcccaaccccaaatgaagtgaaaaccctcattaatgaatgacgtctgaaaattatcttcagtaaactataatgggctctaataaaaatatactactgattaagtagtcaaaataaaaaacccttgtatgtgtgctagcctggcttattgatgtatcagaggcaattttcactgatcctaggtttcctcttcttacctacccagtaaactcttaagagttgtagcctagtctaatacaaatcacaaactataagttactacaaaaaatatttggggcttttccattcttaaaagaatccatggccgggcgtggtggctcacacctgtaatcccagcactttgggaggctgaggtgggcggatcacgagttcaggagatcgagaccatcctggctaacacggtgaaaccccatctctactaaaaatacaaaaaattagctgggcgtggtggcatgcacctgtagtcccagcgactcgggaggctgaggcaggagaactgcttgaacccaggaggtggagcttgcagtgagctgagatagcaccactgtactccagcctgggcaacagagcgagagtccgtctcaaaaaaaaaaaaaaaaaaaaaaaaaaaagaatccatgctaaatctaaacttcaaaaagatagataataaatacatccaccttgttctaattagaataaattactagccatctaccataggctaggcactgtgctggaagttagtgaaacaaggagggtaagtaagacttgctaatatatacacacacagtaagtactataacaaaatgttttgaggcagtgtaaataatagttttacatagtaaaggaggttttttttcttttaaaacaaaggatatttgggtcatgaataataaatatgttaggtagaaaaagtagagatgggcattactggggtaacaacatgggcctgaaaaagaagagcattcaggaataatgaatatgacttagctggacacataaggtgccctgggcgtcagtgtggtaggagatgagggtaaagatgggggatggagctggggaggagtacaggtatattggacaaaactgcagtgagaaacataagggtagggagggtaaggtaaaaataattgcttccaggtcatcaaaaaatttacacttgtttcaataagcagttaagagccatcttaagtcttttagtatacagatgtttcttgacttacaatgggcttacattccaaaatactcatcataaattgaaaatgcatttaatacacctaacttactgaacattataacttacccgaattataaggaatataacttatcgtccactttaaatgttcttggaacacttacactagcctgcagttgggtaaaatcatctaatgcaaagcctatattttcttgagatggagtttctctcttgtcgcccaggctggagtgcaatggtatgatctcggctcagtgcaacctctgcctcccaggttcaagcaattctcctgaattttgaatcaaaattcaaaattctaagtacgatttctactgaacagtgtattgcttttgtaccatcataaagctgaaccatcctaaactgaggactgtctgtacttaggtttgcattttagaagaatatcccaagtgtcaatgtagatgataataacgatagcatcattaactcccatgtagctaccattttctgaactcttgctacatgacagataggttacctagtgcttcatgtggataattttacttaatccttacatcatcctgaatttggtactattatcctctttttacacattaaattaaggataacccatacttattgatgttatcttctgagaaaataatctacaaaagacagtagatacataaaattacatagtttctcaataaactcattttcttctaacgtgaaatggcaacaatactgacagacccccccaaaaggttttataatgttttattataacgaaaggcaactgcattagcagaaccaatcaattcatcaattccattccacttagttttggctttcctactttgcaacaggtactggacatttgagtagcagagcttgagggagaataaactgtaactaattgaagaataatcactgacttctggtaatctccctgatcaagttaaatagaaacccaattctggtatttaagaaaaagtcaaatctaaacagattagaagaaatcaaacgatactagttgtggtaggaaagaatattctaaatcgaggaataaagtattcttttaaaatgccatttaattatataatatcccccatactgtatatttcagaatattatacttctataatatacatatatgcatacaaaaccttaggactataaattacaagaattaaaacagacatgttgcattccatctactcaaaccccaccttctgaggcccagattttctaaacactctttcctgatcttcttactccaaagtaatttcttcacccttggaactcttatagcattttatctataaccctaccaggacattttcatttagtcttctattataattagtaattacatattattctctccttgttaaattataagcttatgaggacaggattactatctgatttgtctttgtatccctctcaaaatctttactgtgtaagtgatcaataaatatttttgaaggaagaaaaactacaattctatttcttgacttgttgatagttaaactgtaataattcattacctagtacatttatgatttatgtattttctcaaattataatttgtaataaggataaaaagaaaagaaaaacaggatatgttggttaattttatgtaaacttggctgggtcatgggacccagtttttggtcaaacatcagtctagatgctactgttatattttataatattaatataatatataacatatattatactcttaattactgtacaatactgttatatttatactgttacagttatattttagatttgattaccatttaaatcagtagactttgggtaaagcagattaccctctataatgtgggtgggcctcatccaatcagttaaatactttaagagaaaacactgaggtcccctgaggaaggagagaattctgccttcagactcagactgcaacatcaactcttccccgagtctcctacagatttcgaacttgccagcgcccacaactacatgaacaaattccttaaaacaaatctcttttctctctctttatatatacatcctattggttctgtttctctgagaaccctcactactacaacatgattatatattgtaaattctgcaaatttctatgtataataaatctcactaaaagaagaaacagtatttacctaaaagtatcatatttaacatttgtatattcagaagtcatagtcaaaatgtctttaggatcaaaagaaataattgctttaaaatttttatttaaggaatagaatcatgatggctgaggtcatgaaattaataatttgggattatgattcccactgaaaaaacagaaacaaaaaaaccatgaacactctttcaataggtaactaataaacgatggctaggattaaagctgaaatacctctctggtccaatggttacacagaatctgcttggttttcctccacagtgttgcatttcaattctaattgcatgattaaactaacaaattgagctccagacccctcccctgcctgaaaaaaaaagtacctagctgacaaaatcagaagttgtaagaaaatgcttttccagtacaagtaatgtaagaaacaagtgcagcgaaggagaggtttcagcttgaaagacagtcatcaatacggacagattactgtaattctggctgctggtatgatcgatttgggtagcatatgacaatcaatactgtccccatttagtgaacaacattagattcatggtttcagaacatgttcctaggataaaatttaaactgtatttaatgatcataaatagcacaatttatgctttggaatcttagtgagtacttttattgggcataaaataactgacacagcagtacaattatccaaatataatcaagcttattattttttatcccttcatttcttttatgaagagtaaaggattaactggtggtttccaaagcctacctgtatctcaatttctgttgtaatttatgttaactaaattgttgaccaattttaaaatgcttgattttttccttaatgagaacgtaatctgatatttcaaaaaggtacatcttaaaatttaatacattatgtttctgaaataagtatttatttaaaattaagacagatgtacctgtatttcaatatcttaaaatacaaatgtctagttgtagtttattatataaatgttcatttgaaaatcaagtaatccacctgtatgaagtcatttccccccaacatttagaatatagaactttgtacattatatatatatatatatttgtactatatatatatatatttgtactatatatatatgcatatgtatgtatgtattaagtagagatactatactactagcctttgctgcatgtatatacatactacactaggtatatatactacactcaggtagcataggaaaacaacttcctgtagtttctaaactcaagattccaagtcaagaaaaatttgtttgatctacctgatttaatgtatttactctgtgtcccagaagtaattttgctggtagaaaacttcagattttctgtttaaataaagtattcatgtttactattttcatcaattttctccaatgtggtatctattaacatcttagcaagattggctattaaaaacatgatgaagtaggcctgaaaaatccaacccaatcgatcaacctaccaatcaaccaaacataaaaatccaattaggcaattccttggtgttgggtagacttgttttatattgactgtaatctttacacataacaggattaatcattgcacaaaataatgtaacttattattatatctactaagtacatccaagttcattatctcatttaatctttacaacaattctgagatggttattagcatcttttttactgctgaagaaagtgaggttcagagattctgtgacttggccaagatcacaaggcagagcttgagttaaaaattaatgctttctaactgcaaagccagcttttatatacctttagtgtaacatgaagtctgaaatagaagactatgaacagggatgtagaaaaaaaaattaagccatattcccaaaactcttgagtttgcattttaaaactacttggtaaggagtgcatcttaaatgttgttgtacctcatgtcagaaagtttgtgcttgctcaataagttgagttcctattttatgacacaagaggcaaatagagttttgcattacaatctaattgatctcaccactttccaaaaagacctaagacatttatttacacaagaaagtacaaactcttccatatctacctctatgctccactttcaattgcacctttaatgaaatgacagaggacactctcagaatggacattaggatatagtgaactgtgaaagaggcaaaggtcagagagtaaacatccttgatgaagctaacagagtggataaaatttatgggtaataacctgtatattacatgttagattagctactgttctagagatattcaggagacaacaaactgaaaagtatatgccaataaacagattaaaactacaaagcttttatggaagtacaggttgagtatccctaagctgaaaatctgaaatctaaaatgctccaaaatctgaaacttttgagctctgacatgacactcaaaggaaacattcattgaagaatttcagatttcaggtattcagattagaaatgttcaattaattggtaagtataatgaaattttccaaaatccaaaaaaatctgaaatctgaaacatttctggtctcaagaatttcagagaagggatattcaacctgtattacaatgagataaaaatcagaataataaaaatttagaaaaagtagactaggaaagtgagaatttgtcagtaagcatcttgttttgtttaaaggaaaaagatactgtatctagggaatgaagccgtaattcctaaaaaaggcacatggtatgtgtggaccttataaatggtaagctgtgagtatgggtttcacaaatcattctccccatagtttattcacatctggggaaaagactcaagattccaggccccaaaggtaaaggaaatgaaactgattgctggctgagctcagcagggttcacaaaaactcaagggtcttcttgaatagttcctcctaatgcttcaaacaatcaacagacaatatagtcttcaaaacaatcttcagaaacaatcaacagactgtatagtcaaagacaagtgacttagaaataaactcgccatgtccatactactcactgaacttgcctaccgaaatttcttttcaattgataaatctctacttagtggatgtctccaaattatacttttgttaacaattcaaggctcattttagtcattatgatttcactaaaatgactacttcaaatatgagttttcagtttaaagtaagtgaagatataaatgctatgaaaaagaaatactacagaaatgtcattaagcttaatcaatgtaacataccatgatccacctgcaattccatttcactgtgtcagaatacatgagaaattacagagtaatcagatagcttaagtcaattttcgtcaaaagaagaaaatgtacgtggtaaactaccaagttaagataataaatctatttcatgtggactggaacataagatatttttaaaaactttcctttaaagcttatcatttacagtttattatataaaaaataaaatgttttaaatcatatagaaaaattatatgaaaaacataaatttattttagaaaggaatatcagaaaacaatttaaatttaaaactttgtgtatgttgtgtgccaggcactgttttaagagctttacacatattgactcattattagttgtcataacaccatgagctagatattattatcattctcattttatagacaagaaaactcaggctcaaaaaggttaaataattttcccaagtctacacagctaagaaagcatggccagcatttgagtttaggcaatctggctctggaagttatgctcttaaacattccccatcttctcatacctccatgtctctgattatgttgttccctctgcttggaaggctctttggctcttccacctgattaactcttatttgtccttcaaaattggttcaatcctcactgtttcagaagtgtttcctgacaacaccactccatccaggtgagtgagagaccccttgttactatatttctggaatacctgcccatatctctattaacaacatgtacgctgaatacagtatgtttccccaactagattgaattatttgcaatgactattttgattacttctgcaactccagagtcgtagagtacctgacacataatgggactctaattaaccaaaagattagtactgattaaaagtatataaaagagggctgggtgcagtggctcaggtctgtaatcccagcactttgggaggccgaggcgggcggatcacccgaggtcaggagttcgagaccagcctggccaacatggtaaaaccctgtctctactaaaaatacaaaaattagctgggtgtggtggtggatgcctgtaatcccagctaattgggaagctgaggcagaagaattgcttgaaccccagagtcggaggttgcagtgagctgagatcgtgccactgcactccagcctgggtgacaaaagtgagactccatctcaaaaaaaaaaaaaaagcatgtgaaagaaaatatatcattcaaatataactgctccaacactggggaggaactgaaccatctatacatcaataaacagggaatcaggctgggtgcagtggctcacacctgtaatctcagcactttaggaggctgaccaaggtgggacaatcatttgagcccaggagtttgagacaatcccgggaaacataatgatactccatttctacaaaaaataataattaaaaaaaccctagaaaataaaaggctttaacaatatataagaaatatttacctttgtgagtagacatacgttagagtagaaaccattacattaaaaaaaggatacaagttttgatacaatggaatcagagatttcagagcacggcttgcatttatagctgttgctctaaccataatgggtagaacctttccattcacaatagcaccatcaaaaaggggaccaaagaagggaacctgattgagaaatcagaacataattttacattcaaattacagacagattgtaaataagagcaatcaagacactttgcatccaaaagtatttctgctgcttctttagttcttccttcagtaaaaatactatttgaattcaattcttttctgtgatgggtcactcatactaggacaataaaaatgtcaaaggtttatagggtgtctattcaaaagaactatgtgcttcatgtaactgagtaaataatttacacacttagccaatttccaaattttactagtttcaattgtatacaaaaagccaacactagaagtaaatttccttttctccattgagtgaacaaaagaaaaatatatacttataggcaagaagttagtttttcattatttttgtgacactagctttactacagaacctaaaacccttattacacagtttattagaaaaaatatctatgttttgataattaaatgttatttttttgaggtgactcactcatggtttcaaaacttagaaattctgtttgaataaggttggcataaatggcagctgaaggcaaggaggtaagctctggataagatggtaaatattttagattttgtggtcacatgttctctctgttgtatattcttcaattttttttttttttaattctttaaggctgggcgtggtggctcatgcctgtaatcccagcactttgggaggccagatcacctgaagtcaagagttcgagaccagcctgaccaagatggtgaaaacctgtctctactaaaaatagaaaaatcagctgggcatggcggcaggcacctgtagtaccagctactcgggaggctgagacagggaattgcttgaacccgggaggcggaggttgcagtgagccgagattgcgccaccgcactccagcctgggtgacagagcgagagccagactccgtctcaaaaaaaccaaaaaccaaaacaaaaccaccaccaccaccaccaccaccaacaaaatgtctttttaaaaatgtaaaaaaacccaaaaccaaaaccgaaatattcttagcttgtgggttgtatgaaaccaggctatgggccacagtctgctggcctctggtttaggtgaaccctgaagaaacctaaattcacacataagaaattcatacatgagaaacttaatctaattcaaggaattctgaagattcttaatcaattgtcaaatgtaggttttctagaaactgaagaattcagtttaaaaaagggaaggaacacaccaaaaatactaccaaacttttattatcctggaagaaaatatttctgcaatagtgtgtttgaattctatggtgtatatataagacatccaactataggataggtgactgaaccatttggcttattttttttcaatttgtagaatcctcatttattgacatgactaataatcatgcaatcttaataagatatatcaactaaaaatataggaatcatatagtcctattataaagtaaatgattacttcttactgtgatttttaggaaattgtaattgttctcttaataaaaggtaagtcctttttgagcttggtacacaggaactttcactctggcactacctagccaaatcctccatttaaacacagtttcttgctatttattctgttttagctccttctgaaccaggcttaggcaatccatgtagctaccagggtctatgtaacatttaccctcagtttcacaacttgatgcctactccaaattttattctgtaacatggaaagaaacccatgaacccctatagaaccaaaatctattactaaaatggaagataaggagttcttacctctggttttttcattatctgaatactgaacatgtgatttttcattggatatattacaataaggacatcaccaaattctgtgggaataattcctctcctgtagtctctagtatgctctgaccaaacaatgtgcacttcatcatttcccaaatgtctcaactggaaagacaagaaaacaatttatactgctttaaaagctctttgagtacagtcatacagtcacatacaacataaaaaggggaaaaacgaaattaaaaaattgttaaattgcacttgatcagttttacatatgaaacacaaacactcaaaaacatcaggagacactgcagaagaccagacaatttcaattgtcaataatcaatgggtaacagagaacttagatttaaaaagattcacatatagcccaaatactctccttaaccagcaactgcaccaattctccactaacagatcttttaaaagattgttttaaaaaaagaagtaagtaactcataaattggataatccccagttgagtaagagaaagttgattatgtttcgtttaacgaatttatttccaggttttctttgcccatgaaactcaaaaattcttccaaatagatgtcttgagaattgttagaccctcaagacgttatttaaatgtttgtggggtttgcttacaaaggtgtttctggcaatcagagagagttaacattatgataattaaaactgtaaaaacacaaaacattcagaagttggatttctaataaggtgttaaaaaaatgaacttaatgccctttagtcttaagttttcttcatagagactgctataatgcattttattataaaatttcattatactagtacgtttattgattctgccactgtgagcatttgagttgacttttagtgcagatcttacatgggatttccattagtttcagataactagacacacggcaggtggaaaggtttagaagagtaaacctgggataactgtcatcaatatttacgctatcagctaacatacgggcaatttctatctcagaaatatgtcatttattttggcttaaggatgaacatagggtaggaaaaagaacttaatatctgatttaaacaaagaaaggagttaagtccaattagtgaaagcctctcttctgtcactccttaatcctggagtaactccttatatgcatacacaagttgaataatataaatgtgtgggacttgggctttgtgacatttttaaaaagcaaaaaagattacacaactcagaaaagccatggcttcataatttcattttttaatcaaaatactttaaaaatatccttcctatacagccatccccatgtgtcagcttccctaataggtttatgttaactgaatacaaaagaaatgtgaaataaatttaaccaggagggatgatccaatctaattttgatacattaatgtcatatgctgtacatgttacaatagcagccagatctaatactaagctccaggctatactgagatttccaaatggcagattgttctaagtgatatcaagtataattgaagtaataaacgatagtaaaagctgagcacactgtcaggaagaatttaggtatttactttttaaaattaaatgagttaggtaaggaaagacaagacaactgaaataatgcaggtctcaatttacagaaaattccttttatttatctgctacattaacccttgaactcttgccaaaactatctataatttctagtgcccacttatctaaagaaacgagaaaaaagggcaagtatacttttattttataactgaagcttgttcaaatatcttctgtatagtattaaaagtctgttaaataagtttaatggaaaagaacaacatatttttgccaagctgttgtaatgaagatttctggcacagaaccatgtacataacaaagtcattctaaacatgttcaaacattttaagcgaaaagcttcatgaaatcccttatcatttacattcaaatgctaaataagtaattattttaggctgtcataatgagatatgacattatgatatatcttcttcaagatatgtttttatatctttaaaatctcttacatagtaattagacacaaattgagaaattgctaatcattgctatgtgtcttgggaatttttgaaagactactgaaaaaatcaatttttaatggttaagcattaatagaaatttcaggcatatgtatgtttgacaaactttatatattatttaatattgattttatttattccttatctctatggacttacaagattgtgtcctatggagcagggtgtggtggctcacacttgcaatccgagcactctgggaggctaaggcgggcgaatcacctgaggtcaggagttttgagactagcctggccaacatggtgaaaccccatctctactaaaaatacaaaaattagacaggtgtggtggcatacacctgtaatcccagctactcaggaggctgaggagggaggattccttgaacctgggaggcagaagttgcagagacctgagatcatgccactgcactccagcctgtgcgacacagtgagactccatctcaaagaaaaaaaaaaaaagattgtataaccagtaggttttgctatactctaaaaccaccaaagaagttcctatctacatgtttattgacccagatgctaattcatttctgaaatagagtagaagacttctgtacatgggataggtctgttaaaacgattggcaaccaaactactcttctaaatttctttcaactgctactgaagtcattttggaactcaaggtatataacataggctacagatgactattattacttgaagaagacaaagcagctaaatgaaatttaacatgtgtacaagtgaagtcctcaaatacactagaatgttaatactggaagagaccttaaagttctaatttcccacctgatacaggagcttgtgccaccatatgcctgataagtagacatcctgcctcggcttgaatacttctaaggttggggattttatgaattcacaaatcaacccatttcttatttatttattttgagatggagttttgctcttgttgcccaggctggagtgcaatggtgcaaccttggctcactgcaacctccgcctcccaggttcaagcgattatcttgcctcagcttcccaagtagctgggattacaggctcccacccccacgcccagctaattttttatttttagtagagatggggtttcaccatgttggccaggctggtctcgaactcctgacctcaggtgatccacctgcctcagcctcccaaagtgctgggattacaggcgtgagccaccgtgcctggcccccatttcatttttaaagagctacaatcattagaacatcttaatactaagctaaaaactgccttctggatgctagctcttccaaaatgagccttaccaaataaatccaatctgtattctatatattttctgttatctgaagatcagtctaatatatatcttacctttccttttccaggttaaaagtgttcttcttagctcctcttacagtttacaaacatattcattatcttgggttattgtctcagtttactaatatttctattaaacttgtgtatggaatagaattacagtatcaacacatgctctggataatacagcaaacccacagtggggctgtttcttccttcagtctgttcaataaattactttctgcattttaaaaatgatggctcaaatggaacttgtagtcagttcaagttgctaagtctttttcttacaaagttcttttaagcaggtacaattgactgctagaactaaagaagggatttcataattttcccttgccaggttcagattatctttaagcttatgaaggtctattgttagcctgactatgctattcatgtgctggctctctgccagatttgggctatccttaagttcaaattccagtgtcttcatttacattttggacaaaaatgtcaaatgggacaggcttggttaagagccttacagcaagtcattacagactttcctcctggttaaaaaaatccacaaaaccctatatttattaaaggtatttattaagtgcttactgcttactgtttgtgacaattcattaaatttccacaacaacactatgaagtagtaataattattattatccctatttttacaggagaggaattgaagcttaaaaggatgaagtaactcgcctaaggtcatacaaatagtaagtggcagagccaggattcaaaccaaggcaggctggttctagaacctatactgtaaccacctccctatattgtttcttgttaaataattaatttatgtgctatgaatatgattatacaatcactcatgaatatacttatcaaactcttattaagaccacatttcttcaacttgtccacaacaagcaacttagttaaatgctttattgcagtctatggttttccctaatctagtaatcctattaaaacaaattaagttattttgatgtgatttgttatggtgaactcatggtggctcctagtgatcactacacttcattatctaagtgctcacaaaccatctgtttaataatcctattttgccaggcactgacatgaagctcacgaatgttggttaatttctatagtctatggcctgctccatgttcttctgtgaaaatcagatgttcacccattgctacagactgaatgtttgcatcccatccaccccccaaattcatattgtgaaatcctaaccccccagtgtgttggtatcggaaggtagggaactctgggaggtgattatgttatgcgggctcctttataagggattaatgtccttataaaagagaccccagagagcttacttgactcttctgctattatatataaggttacaatgagaagatggtcatctgtgaacaagggagtggtccctcatcagacaatgaatctgtcagcatcttgatcttagatttctcagcccccagaactgtgagaaataaatttctgtggtttataagccattcagtctatggtatttttgttatatcagcctgaatggactaagacattcatcttatggcaatgcactcattctccatgattaccaacaggaattccagagtcaattctagatttcctcagtgccatataatatcacttatctggggctggagactagaattcttataaagtaactgtattatgtctctcactaaatcaatttatcttcctgacttctccatttctgttaaaagtacctaacaactaattataatcactcaggattaaaacctgattgtcttttagtcttttttgattactctgttttccttactacattgctaatgagctcttcatttttttaaaaaagtatattccttttctgtactttccttcctattcctctactgctgtcctagatcacatgctactcatcctacataccacacatactaattcatgaggtcttaaaagtcttttttctcttccttccctcctccatatccaccttctttcattcataaccaaatattgagagctgaccaaatgctagcttttgcagatgcaacaatgagtaaaaacagacatggtctctgctagcaaagctttgtgtacagtggaggagacagagtaaaataaccatacaataaataaataaataatttaaaaatacaaatgatgctctaaatatacttttctcaatacaaataacaaaggacatggatctataatagctcttgaactaaaagctgaagaacacacagaagttaattaggttacgcaattacttcaggagataggggtatacgtgtagaaactgtaacttagtattcttactgccccaagttcccattctttcccccatctttcaggcactcacacttagtaaaaaacactctatgatataaccctcaatcatgtgagaaaacatgctttaatataccttctaatagtcacacatattttcctacattcacttgctgtttagattattcatttttagcaatcaggaaaagtttcttgaaaacaacaggcacagcatccaatactatgccttagcagagtgggcattcaataaatactggtgactattaaaaagataatataacaatacttatcttgcatttttttcctatcattacccagtacatagcataaaaatagaattatctgcagttatggcatttatttaaatatgtcactttgataaagacaaaggtgtctatagatagttcttttgatttgtggctatggtagctgtggtaattcactgaaaaaacatttgttaaatgccaacaggcctggtactaggtgctggagatacagcagtaagcaaaagagacaaagtccttgttctcatgaccttgatattctagtgggaggagtcagataaacatatacaaaaataaacaaggtaaacttacatgctgataaatctataaagaaaataatatagggtaatgtgataaagttcctgagtagaaaggggcttatttagctaggatggtctaaaaaggtctttctgagaaactgtcatgtgagtttaagaacagaagaattagaatgaggaagcctgataatgtggagaaaaaacatttcaaactgagagagtagtaagtgtacacagcccttaagatgtgaatgagtttgacatgttggaaggtcagaatgtcagtcagtgaggccagattatggtaaatgaaaaggaaaaagacaggagatgagatctagaggtaggcaggctggtggggccaaatcacgtagtgccatagtgaggaattagaattttattcccggccgggcacagtggctcacgcctgtgatcccagcactttgggaggctgaggcgggcagatcatgaggtcaagagatcgagaccatcctggcaaacatggtgaaaccttgtctctactaaaaggtggtgcacgcctgtagtcccagctactcgggaggctgagtcaggagaatcgcttgaacccaggaggtggaggttgcagtgaaaagagatcgcgccattgcactccagtgtggcaacatagtgagactccgtctcaaaaaaaaaaaaaaaagaattttattccctatacaatgagaggcctctgctatctcacccacataacatttactgtggtaagataaacttgcattgaaccatttatattttctgttttctcaatcctctattcttgtcatcaggagtatatatgtaaaaactggagttatgggcagagtttcttctataagattgttatatttaggactcaaacaatgagtataatttcacagcacttattaactataatcctaacttcacttttactaaaataatgaaaaaatttaaaaattattccttaaatttattttttaacaaattcatttttcagactatatttagcatatagttctttggaaagtatcttatatttctgtataaaataaagaaaaacagatttaaaataaaaaatcagaccaagcagcactacaaggttcatttatttgcacaactattgtgagtaaatttcaagacagaaaatgaaacactttccattacactaatagtatttcagaggaaatggacttaaataaagtgcttctttccccctattttggggggtccaggaaatgaaacatagactagagagttcaactaagtatgttacaattatctcaacttgatcttcatcaaacttctaaaaggatgattcagctacctatgaagcagagtatcagcaagtggctagaacaaggagacagaggaaatgagagaggctcctatgaacactttataccaatgcttgcagcacttttgatttttaggggtgaatacactcagttaagtggaaattatttttaaccattttccatcaatcttcctcaggaagagataatttatagaacagattgcttggactggggttatatcaggatttttatatggtggtgcaacatttctaagagaaacttagctaaactgaatgtttggctaatttgctcaagaagtatagtctatgttgtaaatattctgctgctactgtcttgagccttgaaaaagcttctcttcacaagaaatataaatgctacatttaaataggtccaaggatatttacttctcattctgagaaaataaaatgtttgaaaataatttacaaatcacatattttaaataaaaaatcagaactaaaattagtttctataaaatggatataaatgattttaccctaccaagtttaaagcaaaggaccagagtcataaataattctagcttgccagaggcatggctatttctttatactgactgtcgactatctaatttaattagaggtattaaactccttgctgaggtcaacaagccttacttcctccaatattacacttcaacccgtgctcattaatgtgtctactgaatggattaacacacctaaagatatatgtacaaaggataggggggacaacctaatgatatccaattgttcatttataataggacacatgttctagcctcaacttattaccactaatgtggaatttattaaattcaggagaaaaaataccaatacagaaagtgattttttatcagggacaactggtataagacaactggcttctacgattaagtttaaacatttaacctatcaaaaataaagtgatactaaaataaaactaaaatataagcctgctacttagaaaaatcttatatactagaactctgaggaaaagattaaggcaacagtcattaggtatagggaaacgggaaacatcagtatatagagaaatcaatgtttataaggttttaaaaaatttctacgaaaagaaagtttaagctaattacactgaattatgagatcaaataaaaattccctttctgttggacttaaaagctgctattgtttcttggagaatcgcagtatcaggacgtatatgaccacattgttcatacatatagagctgaaacattgctttaatttagtttgacgctgacaaagtaaattttacttaaattgatttaaattactactagagaaaataagacatttctccaaagagtatatacaaataggcaataagcacatgaaaagatgctcaatatcattagaagggaaatacaagtcaaaagcacaacgaaatatcatttcacacctactactatggctataattatttttttaaaacagaaaataacaagtgttggcaaagatgtggaaaaattgcaacccttaagcattcctggtggaaatataaaatgatgcagctgctgtagaaaacatcctgacaatttctcagaaagctacatatacaattaccatatgatcccagcaattccactcctagctatatagctaaattgaaaacagggattcaaatagatatttgtatgccaatgttcactgcaacattgtttacaagaaccaaaaggtggaaacaacccaatttccagccacagatgaatgggtaaacaaaatgaggtatatacttgcaacagattattattcagctttaaaaaggaatgaaattctgatgtatgctacaacatgaatggatcttgaaaacatgctaagtaaaacaggcacaaaaggacacatattttatgattccacttattcgaggttcctagaactggcaaattcatagaggaagtggattagaggttaccaggggtagtggaaggaggaatggggaattactgtttaatgggtacaaagttgctgtttgaaaatttaaaaaagttctggaacaaaaacaaaaaacaaaaaacaacaaaacaagttctgggtcttccagtttctggtgcagcatataaaggtttggaatcaccactttgatctaacaacaaataaaatgccgaacaaactgaaaatcaacaattctttttagcatcatcagagacatgaagtcacaggaaaaatgctcccctccccattcctggtgtcccactggagagagacagataattacagctgactgatggaatctagtgccagtgtaggaaaacctgaactaaaattgaactgctggaagctcagtgtggacaagtctaagagttagcaactccaggagaaaccagtcttatggggaacttccctacttttgtgagttttatttccaagagctctaccaggtcctcacagtgaataatagagaaaaatatcctcttgctttatggagggggaggggaaaaacaattatttgaaacacaccaaaacattctgttcttctttaaaaggcctgccctcagtagaaactattttaccaaagcctaatctacctgggagaagaaaaatagccaactctggctccttggaaggtcatactgtcccacctaagggaagagactgaaaaacactagtgaagttcacaatccagggccacaggctcagcaaaatactgaaacctaatgatgggacaatggagtgcctccccttcccccacaccttaccaccataccactaaaggcctatttaccagagttccttttactgagcatatgttcagatttcaacaaaaaattacaagacaaaaaacatagtctaaagagactgaacaagcatcagaacagaataagcaccagagtcagatgtggcagagatgctagaattatcagaccaggaatttaaaacaactatggttaacatgctatggggctctaatggaaaaagtagacaacatttaagaacagatggacaatgtatgtagagagatggaaattctaggaaaaaataatcaagaaaaaatgctagagttaaaaaaacactggaacagaaattttaaaatgtctttgataggctcattcacagacaagacacagctgaggaaagaatctctgagcttcaggatatctcaatagaaacctccaaaacagaaaagcaaagagaaaaaagatttatattcaaacagaatatgcaaaaactgtgggactaccatgaaagatgtaaatacatgtaatgggaactccaaaagaagaagaaagagaaaaaggaacagaagcaatatttgaagcaataataacagaatttccccaacttaatgtcagtcataaacccagatccaggaagctcagtgaacaccacgcagggtaaatgtcaaaaaactacacctaggtgcatcacatttaaacttggaaaatcaaggggaaagaaaaattcttcaaagaaaccagaggaaaaaaaatcttacctatagagtagcaaagataaaaattacttctgatgtctcagaaattacataagcaagaagagagtagagtgaaatatttaaagtattgagagaggaaaaaaaataccacacacctagaattctgtaccctgtgaaattacccttcagaagtgaaaaagaaataagactttctcaggcaaacaaaaattgagggaatttgcagcctgtagacctacctttcaagaaatgttaaaacaagttcttcagagagaagaaaaacatatgtgtcataaacttggatctacatgatgaaaggaagagtatgcagaatgaataagtgagggtaaattaaaacttttatttttcttagtcataattggtttaacagaatatagtttaataatagcagcaatgtatttgaatatgtatgctcatattcatatatatatataggtttatatatacctaaaacaagcgaaatgaatgacagcaatgatacaagggatggaaaggagggattaggaatactttgttattgcaagcagtaatatataagcagtatagaataattttttttttgagacagatctcactttgtcactcaagctggagtgcagtggtgcaatcatggcccactgcagcctcaacttccccaagctcaggtgatcctctcacctcagcctcccaagtcgctgggaccatggggatacaccatcatgcctggctaacttttgtgtttcttgtataaacaaggtttcaccatgttgcccaggctggtcttgaactcctgggctcaacagatctgccagcctctgccttccaaagtgctgggattacaggtgttagccactgcacccggttggtatagtgtaatttgaaagtggacttgtaacttggattaactacaaatgtatagtgtaaactctacagcaatcactaaaaagttaaaaagttaaaaaaagaagcataattgatatgttaagaaaggagagagaagggaatcatataaaatgctcaattaaaaccagaaaaggcagaaaaagtataaaagacaaaaacaggaacaaagaacaagggcaaaaatagaaaacagaatacagcagacaaaaatagaaaacagtaaagaatatagtagatattaattcaactatattaataatcactttaagaattaatgttataaataaaccaattaaaagagattgtcagagtggagctaaaaacatatatattgtctacaagaaagccactataaagacaaatatagactaaaagtaaaaagatataccatgctaacactaatcaaaagaaagcaggagtaactatattaatttcagacagaacagacttcagagcaagaaagttatcagcgataaagagaagcctcatataacaaaggagtcaatactagaagatgacatagcaatctgtacatgtaggtgcctaacaacaaagcatcaaaatgcatcaagcaaaaactgacataacttcaaactcacaaggaatattcaccaagacagaccatattctgggccatcaaatacaccttcggaaattcaaaagaacagaaatcataaaatgtctgctcttgaacaatggaattaaattagaaatcagtaacagaaagatagttggaaaaccccaaaatacctggagattaaacaacatacttcttaaaaacacatgggtcaaataatatatctcaagagaaattaagaaatattttgaaacaaatgaaaatgcaaaagttctgtaagagacagtggtgatggttgcaaagcactgtgagactacttaaagccaatgaattagttaaaaatggtttaaaaaatagttaaaatgaacttattctctaataaatctagtgcataaaagtttcatcgtttcagagtacaactttaattaaaactcaatctttttttgtataaggtttaaggaagggatccagtttcagctttctacatatggctagccagtttccccagcaccatttattaaatagggaatcctttccccatttcttgtttttgtcaggtgtgtcaaagatcagatggttgtagatgtgtggttttatttctgagggctctgctctgttccattggtctatatctctgttttggtaccagtaccatcctgttttggttactgtagccttgtagtatagtttgaagtcaggtagcgtgatgcctccagctttgttctttttgcttaggattgtcttggcaatgcgggctcttttttggttccacgtgaactttaaagtagttttttccaattctgtgaagaaagtcatttgtagcttgatggggatggcattgaatctataaattaccttgggcagtatggccattttcacaatactgattcttcctatccatgagcatggaatgttcttctatttgtttgtgtcctcttttagttagttgagcagtggtttgtagttctccttcaagaggtccttcacatccattgtaagttggattcctaaggtattttattctctttgaagcaatagtgaatgggagttcacttatgatttggctgtttgtctattattggtgtataggaatgcttgtgatttttgcacattgattttgtatcctgagactttgccgaagttgcttgtcagcttaaggagattttgggctgagacaatggggttttctaaatatacaatcatgtcatctgcaaacagggacaagttgacttcctcttttcctaattgaacaccctttatttctttctcctgcctgattgccctggccagaacttccaacactatgttgaacaggagtggtgagagagggcatccttgtcttgtaccagttttcaaagggaatacttccagtttttgcccattcagtatgacattggctgtgggtttgtcataaacagctcttactattttgagataagtcccatcaatacctagtttattgagagtttttagcatgaagagctgttgaattttgtcgaaggccttttctgcatctattgagataatcatggataatcatgtggtttttgtctttggttctgtttctatgctggattacgttcattgatttgtgtatgttgaaccagccttgcatcccaggcatgaagccaacctgattgtggtacataagctttttgttgtgctgctggatttggtttgccagtattttattgaagattttggcattgatgtttatcagggatattggtctaaaattctcctttttgtgtatgtgtatctgccaggctttggtatcaggatgatgctggcctcataaaatgagttagggaggattccctctttttctattgattggaatagtttcagaaggaatggtaccagctcctctttgtacctctggtagaattcggctgtgaatccgtctggtcctggactgttgttggtttgtaggctactaattattgcctcaatttcagagcctgttattggtctattcagggatttaacttcttcctggtttagtcttgggagggtgtatgtgtccaggaatttatccatttcttctagattttctagtttatttgcgtagaggtgtttatagtctctgatggtagtaaactagttcaaccattgtggaagacagtgtggcgattcctcaaggatctagaactagaaataccatttgacccagccatcccattactgggtgtatacccaaagaagtataaatcatgctgctgtaaaaacacatgcatacgtatgtctactgcagcactattcacaatagcaaagacttgggaccaacccaaatgtccatcaatgatagactggagtaagaaaatgtggcacatatacaccatggaatactatgcagccataaaaaaggatgagttcatgtcctttgcagggacatggatgaagctggaaaccatcattttgagcaaactattgcaaggacagaaaaccaaacaccgcatgttctcactcataggtgagaattgaacaatgagaaccttggacacagggtggggaacattacacactggggcctgtcgtggggtggggggaaggggtagggatagcattaggagatatacctaatgtaaatgatgagttgatgggtgcagcacaccaacatggcacatgtatacatatgtaacaaagctgcacgttgtgcacatgtactctagaacttaaagtataatttaaaaaaattaaaaaataaaactcaatcatttaacaacccttttattttatttttttgagacagagtctcactctatcaccaggctggagtgcagtggtgtgatctcagcttactgcaacctccgcctcctgggttcaagcaattctcctgcctcagcctcccgagtagctgggactacaggcacgtgccaccacgcccagctagtttttgaatttttagtaaagacggggtttcaccatgttggccaggatgctctcaatttcttgacctcatgatccatcaatctcttgacctcacgttccgcccgcctcagcctcccaaagtgctgggattacaggcgtgagccatcgctcccggccaacaactcttaaatggtgctatcatgcctaaaatttgtcttatttgctatgataaaggattattaaacatccatttcagatgcttcttttaaaataattaagggcccttgtgactactttgagggaaacaggcatcttatttgacatttctacaaaggtcacaggaataaactatcaagtgccatataattagcaagtttaatacagtgaagtaaaaatatcctgacatagttttctttaacaaaaaagtcattttaatagaaaataatctactttgttccacttttaggtttgcaatctaagatactattaatttttacaaataaaaccatgatgagatatcctattagaatgactattatcaaaaagacaaaatgtaacggcaaggatgtggaaaaaagaggactttgttacataggtagtgggaatttaaattagtacaggcattacggaaaacagtatgggggttcttcaaaaaattaaaaattagaactatcattatgatccagcaatccccctactgggtatatatccagagaaaatgaaatcagtatgtcaaagagattatctgcacactcacgttcagtgcagccttattcacaataaccaggatatggaatcaatctaagagtccatcaattgatgaatggataaagaaaatgtggtatatatataaaatggaacactattcaaccttacaaatgaaggaaatcctgtcatttataaaaacacggattaacctgaaggactttatgttaggtaaattaagccaggcacaaaaagacaaaccatgatctcacttttaagtggaatctaaaaaagttgaattcatagaaagatggagtacagtaagtcctcacaatgtcatcaataggttcttggaaactgcaactttaagcaaaacaacatatagcaggccttcaaataatgtcatatccttcataatttcattataaatttgatgataaaatacaattggtttcattatatgccattttccttaaacggagagagtcatcacttatggggaagagtttgaaaatggagagaagctggtcaagggacacaaaatttaagttaggaggaatgagttaaagagagctattgtacaacataatgactatagttaagaacaacatgctgtatacttgaaaattgctaagagaatagattttaagtgttctcaacatgaaaaactggtatgtgaggtaatgcatattttaattagcttgatttagctattccacagtgtttacatatatcaaaatgtgttgtatatcataaatatatacaatttcaatttatcaattaaaaaagtaaatgtttaaaaaagaaatatatgagaaatatacttaaaacagtcactattgtaggacagcagaatagtaatatattattaattttaaactctgcattggggtttaaaaattatgcccatggagccctgattaaatttatgtatgtatttatttatttatttatttatttttgagacagtgtttcactctgtcactgaggctgtagtgcagtggtgcaatcttggctcattgcagcctcaagctcctggactcaagcaatcttcccacctcagcctccaaatagctgggactacaggcatgcaccactatgcctggctaattttttttgtaaggacagggtgtcactatgttacccagactgatatcgaactcctgagcttgagcaatcctcccaccttagcctcccaaagtgctgggattacaagtgtgagccactgtgcctggcttatttatctttttacactatacttataactgtgtctactttgggtataatttattttcatagagatttaagataaattcctggaacaaatggtttatgtgaagttttaacaaatctttattccaatcctatttaacatcatatactattatcagtattgatgtcttatcttgtacttctaaaaagcatatgccaaaaaattctgtaacaaacttttcactgaatatgctttcatagacttattaattacctctaccccaccactcattgcaatctaattagtacccatatattagttttcctagctattatccatttattaggcaatttctaacaatattctaaaatgtaaacaaaaggcataaaaggtagttgatatagtttgcctttgtgtccccaaccaaatctcatcttgaattgtaatcactgggtattgagagaggaacctggtgggaggtgattggatcatggtggcagttttccctatgctgttctagtggtagtgagttctcatgaaagctgatggttttataagggtttgacagttactccttcacatgctcacactccgtggcctgccgccatgtaagatgtgcctgattccccttctaccatgattttaagtctcctgagccctccccagccatatggaactgtgagtcaattaaacctcttttctttataaattacccagtctcagtattctttatagcaatgtgaaaacagaccaatacagtagtcaatcaaatcttataaaagatttgtaaagagtcctaaacttccttttaaaaacagtatgttaataaccctgtttcaaagcttattagtgaagtgcgaagagctttgatatcaggcaacagagtatcaagtgaaatggctgatcatgttcagttggttacatttagtaatagttttggataaactgaggataggattttcaatagaaaccctggggcaaaaacaaacaaactgagaagaaagaggagaaggaagaggtaaaggagaaatgttggataaagttttacttttaaaaatgtttctcacaaaaccaaatatgagttgaatacataaaactgtactctgaggtatctctgtagctacaatgacttttccatggctgtgtgagatacagcaaaatggtggtgtaaattttaacagttgtggaccatcaatatcattctatgataccccttacagattctaaggtagcaagatttatttcaattaagtaacacttatttgttacattagttttagctcaaatgtataggatacagcatgttatattttaagtgctatgtatgtatgtatgtatgtatgtatgtatgtatgtgtttttctgagtcagggtctcacttggtcatctaggttggagtgtagtggtgtgaccatggcacactgtagcctggacatcccaggctcaagcaatcctcccacagtagcctcctgagtaattgggactataggcacatgctaccatgcctggctaatttttaaatttttggcagggggtcttgctatgttactcaggttggtctcaaactcttgggctgaagcaatccttccaccttggcctcccaaagtgctgggattacaggcataagcaagccaccacacctggcctggaataatttctgttttattttttcctctccctcaatcaatataaacattgtatcagagtccatgtactaagggccttgaaatataattttaccaatgtaaacaaacacagaaatctttcaatttgttatatcccttgatacagtttggctctgtgtctccaactaaatctcatctcaaattgtaatccacatgtgtcaagggaggaacctggtgggaggtgactggattatggggaaggtttcacctgtactgttcttgtgatagagaatgagttctcatgagagctgatggttttaaagtgtggcacttcccctttgttcgctctcttgcctgcagccatgtaagatgtaccttgcttcccctttgccttttgccacgattgtaagtttcctgaggcctctccagccttgtggaactgtgagtcaattacacctcttttgtttataaatcacccagtctcaggcagtttctttatagcagtgtgaaaacagactaatatatccctattttcttgaaggtaaatcctttgttaagactgtaaccaatcagaaatgaaagtgaagacattacaacaggcacttcagaaataagaaggattataaaggactattataaacaactgtatgccaacaaattggataacctagaggaaatggataagtttctagaataaaacagcctaccaaaattgaatcaggaagaaatggaaagtctgaacagaccaataacaaagagattgaagaattaattagaaacctttaacaaaaagcccagaactagacagcttcacagctgaattctaccaaacattcaaagaattattaccaatatttaaactcttccaaaaaacagagtgaaggggaatacttccaaacattttataaagccagcatcccctcgatccctaagctagacagacaccagaaggaaagaaaactacaggtcaatttctctgatgaacactgatgcaaaaatcctcaataaaatattagcaaactgaaccaatccaacaacatatcaaaaagattatacacccagacgaagtgggacttatccctggcatgcgaggctgatttaacacacacaaatcaattgatgtgatacaccacattaacagaataacagttaaaaactatgtgatcatctcaattgacgtagaaaaagcattcaactaagtccaatatcatttattgagtaaaactcttgacagtttaggtatagaaggaaagttcttcaacacaataaaggtaacttatgaaaaactcatcactaacattataaccaatgaggaaaaatcgaaagcttttctattaacatctgatacagggaaaggatgcccacttttgctgcacctattcaagatagtactggaagtactagcaagaacaaccagagaagaaaaagaaatataaggcatccaaatcagaacagaaaaagtgaaattatctttatttgcagatgacatgatatgctatgtagaaagcccctgagattccacaaaaacagtgttacaactaacatatgaattcagtaatggtgcaggatacaaaatcaacatacaaaaattgctagcatttctatatacaaattatgacttagctgaaaaatcaagaaaacaatcctatttatgataccataaacatacttagaaataaattaaccaaggaggtgaaagatttatactctgaaaactataaaacattgatgatagaaatttaaaacacaatgaaatggaaagatatcttggattgaaataattaatattgttaaaatgttcatactacccaaagaaatatataaatttaatggaatccccataaaaactccaatggcatttttcacagaaatagaaaaatcaattctaaaattcgtatggaaccacaaaaaaccctcaaatggccaaagctaaactgagaaaaaaacacaaaggggcatcatattccctgatttaaaattatattacaggctgggcacagtggcttacacctataatcccagcattataggctgaagagggattgcttgagctcaaaagtttgagaccagcctgggaaacatggcaaaaccccatctcttccaaaaataaataaattagtcagcgtggtggcgagtgcctatagttacagctactcaggaagctgagggagaatcacttgagcccagaagttgaggctacagtgaactgtgattgcaccactgcattccagcctgggtgaaagagtgagaccctgtctcaaaaataaataaataaaatattatattatattatattacaaagctacagtcatcagaatggtacggtactggcgtaaaaacagaagcatataccagtggaacaaaacagagatcccagaaataaatccaaacatatacagtaaactaatttttcacaagggcaccaagatcaacagggaaaggatagtctcttcaacatggtcttgggaaaatggcatttccacacggaaaagaataaaactgaatccttatcttacaccatacacaaaaatcaacttaaaatggggaaaagaccaaaatataagacatgaaacctagaagaggacatagaagaaaagctccttgatactggccttggcaatgattttttggacatcacaccaaaagctcaggctacaaatacaaaaataaataaatggtactacataaaactaaaaagcttctgcagaacaaaggtaacagtcaacaaaacgaaaaggcaccctacagagggaaaacatatttgcaaaccgcttatctattaagggattaatatctaaaatttataagggtcttataagtcaatagcagaaaagcaaataaacggattaaaaactggacctaaacagacatttattcaaaaacataaaaacattattgaggacctaaacagacatttattcaaaaatggtgaactggtatatgaaaaggctcaacaatctcattaatcatcacagaaatgcaaattaaaaccactatgagatatcactttatactcattagaatgctattgccaaaaaggtaagagataacaaacatcggtaaggatgtggagaaaggggaacactagtacactgttggtagaaatgtagactgtacagcaattatgaaaaaaaaaaaaaaagtacggaggttcttaaagaaattaaacatagaactaccatatgacctagcaaacctttttctgggcatatactcaaaggaaatgaaatcaccacctcctcaggatatctgcattcctatgttcactgcagtattattcacaataaccaagatatgcaaaactgtccatcaatgtacaaattgataaactgtggtatatatgcatacaatgtaatattattcaaccttaaaaaaggagattctgccacttgctacacatgaatggacttggaggacactatgtgtcctaagtgaaataagccagacaaagaaagaaaaaatattgcatggtatcacttatatgtggaatctaaaaaaaaaaaacaaaggagaaaatatacagagatagagaataacacagtggttaccaggggtggagtggggtatgaaattgggacaaggagctcaaaggatacaaagtagcagatatgtaggatgaacaagtctagagatttaacgcacaataaaaattgtatggtatttggaattttgtagattttagctgttcttgtcatacacacataaaaaaactagatgagatgatagatatgttaatttgcttcaatatagtaaccgttttattatctatatgtatcccacaacatttcatgttgtaaaccctaaatatacacaataaactttattttaaaaaaagactgcaacctttaaccatatcattgtttcttaaagaaaacatagtttgctgtacaaccaccctattttcaagacagcactgggtggagtggtgtactacaaccagaaacagtgcttgatcaattcgatttcttacttacgtattttctgtattaactgtctcaattatgagcattttaatttgaaagcacttctcagcacttacttttttggtcaaagaatcatcagaatcagaaggcattcttgttgacacgtgaaatattacctctactgtagaggtagcaaaatatggagtggtcaatccagtgcttttgtttttttgtagtcctcccataaaaccacaatggtttgtaagatttacctagaagtaatgaagagtcacataaattaattaaacaaaacccaaatacactacagagaaagactcaaacttcttgcttaagaaaaaaattgggaacaaagtcttttgcatgttatcaaccaatatttaatctagaattgttagaattgatttgtttgtactggtactttttaagtatttgaggatttctaattagtaggagttaaccaggaaaggtatcaactgctgtgtactatgcatcttttgttagcctactaggtgttaatggtaaattataaaggctgtcagagcacaccaaggccagggagaaaaagatcaagtatggaaatagtttggggaaaagttaaaatggtaatatcagtttgacaaaatgattaatttggtgtgttgtatttactcataaaactggcttcctgatttgttagtacttattacagtccacaacaaaaattagaaatgcagaacttaattacagtttagttacatttaaaaaacaacaaggtgacctgtaaaaagattttaaacaatttttattttctgattataaatataatacatgttaatatcagggttgttgcattggatgatattccccggacctgtgtgatgtacagaagccaagaatttgtgttcattacagaaaattagggaaatacaggagaataaaaaaaaattgaaaatcgccagtatttccctacttagagaaaaccatttatatatatgctttgcaattaaaaaatgagaataacaggtaaaatggagaattacaaaaaaaatccctgcaccatatgaactgaacacatgtcaaatatcagtgtcagttactaatggctgaatacatatatgattgttagatttttgtgccattactgtaagattacctcaatctcttccagtttaaaatttatttttaactcagtaatacatttacataattaaaaattttaaagcattaaaaaagcacaccaaaattcttcctttcatgtctctcgcctgcaactactcagttaccttctcagaaagcaatttaagtatctttagaaaaatattatctgcatatataatcaaattcttatatgtttgtatgcacacatccattcacgttagtgtgcacatacacacagtacatgcatataaaacattctgcatcttgcttttggaattaatataccttgaaaaacactccttattagtaagtaaagagattcctcatttttggttcctggcttcacagaagttcattttactgaggtacaatcatttagtcccctacttgaaggacatttaggttgttttctgtcttttgctatcacagtcaatgctgcagcaaataacactgaactcatatcatgctccatttgtgaaagtacagctacggacaaatagttaaacgtgaaactttaagtcaaagggcatgtggacttctaatttcaaaacacactaccaagttgccctccacagatgccaccaacaatgtatgagaatgcccgtttccctcatagcctttgaaatatagtatattatcacactttatgatctttgctaatctgataggtgacaaatggtatctccaggtagattttttgttttgttttactttagttcagaaagttacttattttcaagtcaattctctgataatgtaaaggagaaagtctcagtttagtgttcctttgctgtaaacacttcacatttgctgatctctattgtttaaattaaacatctggagagtcatatgaagaaatgaaaaaaataaaaagaaatcccatgtacactttacccagagccccccagtgcaaaactctatcaccaccaggatactgacgacattgatatagttaagagagcatgttcaaaaattcaagaatcccccatattgccctcttatgtgagccatacccacttcactcctactctatcccctccttaacccctggcaatcactcactcatctgttcttcacttctataactatcatttcaagaatgttgtacgaattaaaggacataggatgtaaccttttcaagtgtttggagattttcctgttatctttttgttaatgatttcaagtttgattccattggggttcaaggacatactctattatttcaatgcttttaaatttgttgaggcttgttttatggcccaggatatgatctgtcttggtatatgttctgtgggaacttgaaaataacgtatattctgccattgttgggtggaatattttacatatgtagattagatcttgttggtagctgctgttgttgaattcctccatatacttgctgattttgtctagttttcctcttaactgttgaggagtgaagtctccaaccataattgtgaatttctctatttcttctttcagttctatcagctttagtgtcacatattttgtagctctgttatttggtgcacatgtatttagcattgctatgtcttcttggtgaactgatccttctataattatataatgtccttctggtctccagtaattctctttgctctaaagttgatctgatattaatgcagtcactctggcttttctttgattgatgtttgcacaatataactttttctatccttttactttctgccagtctatattgttttatatatatatattttatttatttatttattttttgagatggagtctcgctcttgtcacccaggctggagtgcagtggcgtgatcttggctcactgcaacctccgcctcctgggttcaagcaattctcctgcctcagcctcctgagtagctgggattacaggtgtctgccaccacgcccggctaatttttgcacttttagtagagagggggtttcgccatgttggccaggctggtctcgaactcctggcctcaggtgatctgcccaccttggcctcccaaagtgttgggattacaagcatgagccaccgtgcccagcctatattcttatatttcaagtgagtttcttttaggtaacacataggtgggtcatattttttaatccactctgctaatctctgtcttttaattggtacatttagatcatttatatttcatgtaattattgacaggttagggcttaagcttgccatcttattttctgttttctgtttttcatttctctgttttatttttcctgcctcctgtggctaacttgaacattttctagaactctgtttttaactatcattcttttgagtgtacactgttgtacagttttgtagtggttgctctatgtcttacattatatatacataacttatcacagcctactagtgttgtcattttaccagtttaagtaaagtaaccctaccttactatatgttcctttaccatccctgtttgaaatatagttgtcataaatatttcctctacatatatttgaaaacacattagacagtgttataatttttgcttcaacagtcaaaaataattaagacaactcaagatgagaaagcacagtgattgtatctatccatttttttcttgccatggtctgccttcctgatgtttcaaaattcctccttttatcatttcctttctattaataaaactgctttcagtgattgttttagggtaggtctgctagtaacaagttctctaagtttctcttcatttgagaatgttttgaccttctcttcattcctgaaggatatgtttgcaagctatcagattctgggtctgctgggcacagtggctcatgcctgtaatcccagcactttgggagggggaggtgggaggattgcctgagaacaggagtttgagaccagcctggccaacatgttgaaaccctgtctctaccaaaattacaaaaaaaattagctgggtgtggtggcgcatgactgtaatcccagcttcgtcgggaggctgaggcacaagaatcacttgaactcaggaggtggtggaggttgcaatgagccgagatcatgccactgcactccagcctgaatgacagagtgagactccacctcaaaacaaacagacaaaataaacaaacaaaaaacagattctgagttgacagttcttttttctttcagcacctggctcccacagtttctgataagaaatttgctatctctttaatagtttccccccacagataaggtacactttttctctggatgctttcaagaatttttgtctttagctttcagaaattaaattatgatgtgtgttactatagatttcttttgatttatcctgtttgggtttcaccgacctttttgaatctacagctttatgtctctcaccaaatttaggaagttttcagcactttcttcaagtatttccagtactttttcagacccaggctctttctcctctccttcttggactcagataacagaatgctagacttttttttttttttgttaatgtccctcaggtccctgatgctctgttcattatttttaggtttcttttcttttccttttttttctttttctttttttctttttttttttttttttgagacagggtctgctctatcacccaggctggagagcagtgacatgatctttactcactgtaacctccacctccgggactcaagcaatcctcccatctcatcttctcaagtagctgggatcacagttgcctgccaccacacctggttaatttttgtatatttttggagagatgggatctcactatgttgcccaggctggtctcaaaactcctggctcaagcaatctccagcttcagcctcacaaaatgctagggttacaggtgtaagccaccatgcccagcctaagtttgttttctgtgctgtttaggctgtttctactgttttatcttccagtttactgattcttctgtacccccattcccactccacttggttgttgggtacaactacatagccttttatttcagttattacatttttcactctaaaactttcatttggttgttctttacattttctatttctttgctgagactatttttcatttgtttcaattgtgttaccaattacttactgaagcatttctatcaaggttgttttaaatatttgtaatcttggtgtgggcatctgctgtctttttttaaaattcattttgagattttcctggttctggatatgatgtgtaattttttattgaaatgtacacattttcataagactctggatcttatttaaaattcctgttttagctggttgtttgaagactctgctgtatgcgggaaaagagcagagaatcaggtgaaagtgctgacttgtttctgtcaggtggaggtaaaattatatgttccctactcaatctctgttgacacctgggaaacagggaagatcctcattactgatatgtggaagcaggagttctggcttcctatgtgatgttcactgacacagtcgtaagggtgacctcactactgctgggtgatggtaaaagtcccaattctccatgaggcctcctctgaaatgactccagtggacagcaggtgcctcagtaatattggtggcgatggaattctacatttcccatgtagtctccactgactcttgggtgtgaatgggagactcattaccaactggtagacatgaaagtcttggatttctacttggccttctctggcactatttgatactagcccagtgtggtgttgggggcacctcattacagcctcatgaagatggaagtctaggctccttacctgacctttgctgtgaggttggggatggggtcaaggaattgtctgtggtgtttggctacagtagtgcagttattatctaaatgtttttctgtctttttaggttgctcctttcctggtcctttggctaggaagagcaggctttggttggtgctttttgtttgcacccattggtgtttctaggttgctgacttattcagctccaagtctgggatatatgaggcaaaaaagaaaacccagaaaatgcgccactatgtcattcttccgtcctaaagtccctagttattctgtcttttctccatctttcagagtcttcttatgcttgttttatatgtaatgtcttatgcttattgtactcagtaggaagaatacagaaagtatatctatttgactttcccagaagtggaaatctcctctgtacaatttaatggatttcaggatattcacagttaagtgcaatcatcactacagtcaattatagaacatcttcatcatttcccaaagaaaccccatatcttttagttgtcacccccctcctccctcatgcccttaactagccctaagcaaccattaacctactttctgtctctataaatacacctattgtggatattacatataaatggaccattaatatgtgatcttgatgattggtttctttcatttagcacaatgttttcaaggtacattcatgctgtagcacataatcactttcttcctttttatgaccgaataatattcccttttattggatacaccacagtttagccattcatccattgatggacatctgggttgtttctaccgttttgctagagtaaataatgctgccaagaacattcatggccaggcttttgcatggacatatgctttcatttcccttgggtatatactttgggggtagaactgtttggtcacatggcaactcaacatttaactgtttgatgaactgccagaatgttttccacagtggctgcacattttacatacctactagcagtgtatgagggttcagattgctcctaatcctagccaacagttgttattacctgactttctgattatagttatcttaatgggtgtgaaatgatacctactatggttttgatttgcatttctctgacagcaaaggatgttgagcaccttttcatgtgcttattggtcatatatcttttctggcgaaatgtctattaggtcctttgatcattttttagttgggtatcttctaatcattgatttgtacaactagtttgtatattctagatactagtctcttatcagacttcaccttgaagcacaaaaattttaattttaataaagtacaattatctggttttgtctttgttgctcatgatttgtgtcttatctaaaaatcctttgcaaaatccaagataatgaggatttattcctatattttcttctaaagttttaaaattctaggtcttaacatttaggtctgtgatccatttggagttaatttttgtatatggtatggggtaagagtctggtttcattctttgcatatggctcatggtctcagcaccatttgttgaaaagactattctttctccattggatggttgtggcacccttgtcaaaaacggctgaccacaaatatggggtctatttgtggactctcagttctattccactgatctatatgtctatccttgtaccagcagtaccacactatcttctttttctttttcctaagttctgccccaggatctatccacactaccttgattagcattgctgtgtagtaagttttgaaatcaagaagtgtaaatcttcctaacttgttctttttcatgtctcccttacttttactaatacttttatggtattttactttttttaacagaaaatctacttaggatgttttttatacttttcaaagcattttcacatacataagctcaattgaacttcacatcatctctgttgggtaaaaaagtatactacacgtttgacaaataaccaaagaggcaaaaagagcttaaataactcacttaaggtaaaacagcaggttaatatcatccatcaattccactactgggtatttattcaaagaaaaggaaatcagtatatcaaacagatacctgcactgccatatttattgcagctttattcacaacagccaagatatggaaataacgtaaatatccatcaacagatgaatgaataaagaaaatgtggtatgcatacacaatgcaatactattcagccataaaaaggaatggaatcctatcatttgcagaagcatggatagaattggaggtcattataagacaaataaaccagacacagaaagacaaacataacatgttctcactcatatgtgggagctaaaaaagttgatttcatggaggtaaagaatagaatgacagttaccagaggcaggtgaaggtggtggttgtggtgtggagatgaagataggctggctaatgaatacgaaacatatagtgagatagaaggaataagtcctactgttcaatagcacattagcatgactgtagttaacaataatatattatgtcagaatagctagaagaggagatttgaaatgttcccaacacaaacaaatgataaatgtttgaagtgatgggtatcctaaataccctgaactgatcactacacattgtatgcacttaccaaaattatatgttccacataaatatgtacaattattatgtagcaataaaaatttttaaaagaaatgaagtcagtaaaaacatactgatctaaatactaccaacaaccaccttgacctaattgacatacctagttcattacactcaataacgacagagtatacacattgttttcaagggaacagggtacctatactgggttatattatatttcaaaatactgatatcttacagagtatattctgtgatcacaatggtatagaattaggtatcaataacgatatctagaaaaaactcacatattttgaaattaaactacacatttataaataagctatgtatcccaaggaaaaaataataaaaaaataggttagattagccataaaaatctatataaaacactaaaggctgacatatcagacactgtgaaaggcactgagaattaaaaaaaaaaatcactgagatgaaaatgcctgccctctagaagcttatagtctaatgcagtgctctttaacaattttgctcatatactctctatagcaattttggaaaactattaaattgaaaactgtaataataatttttatcaaaagtttaaatggtagccaaggatacaatttccagtgtactatataataaatatatgtgctttaagtgtattttcatcaaaatcttggagctacagatttggctgattcaatatatgtaaaatgtctggtattaaactgatcacaagccaattacccacatcagatttactttctgttagaacatgtctggtacttcatttttcaattcaaataaacatacttatacaaatccttatgacaaatacccaccttctgagttataattctaagacagacagatttggtacaggaaccttgacatgggttggtttcttgaatgacataaagtataatacctttcaatatttcttgctttgctgacagggactttctcctaaaagtatacccactagaactgtctattttgttggtgctaaaaccctctgggacaatgtaggatttgggatgggtaagcagtatgcttttcttttacaaagtaaatgagagacaagagactgtagaagggttttctggcattagttttggtaaacttgaggatctggaagctaatttcctcaaaactgtgtatacccacacattcctggaaagcctttgtgtagccattaggtcctagtttgaagaccaccagtccagtggtcacagctgtaaggaaaatccagatcttataaacctatgagtttagtactctttcacaatatactgtctcataaaatagtcaacatctttcctttcaaagtcccaactgctgctgtatgtgcagacaaaatggaaggcagaaacaataacaaactagttgttaagttgttgtatctcctaaaataatacttctataataagctaggaaaaaaaagaaaaataagcttatgcttccaaatataaatatttcgtataatttaaaaataatacctcccaaccaagaccagctacaaaatcttcatatgcttgacttcctcctgtattggtgagaatggagtgtttgtcttcttgtccttcagcaacataaaatactgcaatcttgtgtgtctctcggctataaaacaaaagattacaccattaatttaatcactattttatctactcattcatccaacaattaagttctatgtacaaagtatgtagcaataaaaagatgaaaaagaattagatcttatagtctacagaaggagatataaatgcaatgtaagtaaaaaattactacaaaattgccattagaataaaagacaggcacgatcacttttgactgcaaaaacagaaacttaaaggagaagataaaattgagttagatgaaggtaagaaagatttgacaaatgaagagaaagagcatcaggaaggacacataggtgtgaatacataagcatcttaagagttgtctgttttgcaatgtagccgaatcccatggttgaagggactgcattttagaactaagtaggagtacagagatgagtgagaaaggacccaatccttcaaagtacttacgaggtagaagaagaaacacacacagttatgtgttgcttaacaacagggataaattctgagaaatgtgtctttaggcaattctgttattgtgtgaacattatagatgtactcacataaacctagatggtacagcctactacacaaccttggctatcaggtatatcctattgttgctaagctacaaatctgtacaacatgttactgtaggaatactgtaggcaattatgacatactgttaagtatgtgtgtgtgtaaatacacctaaacagaaagggtgcagcaaaaataaggtattataatcttatgagactactgtcatatatgtggtccattgttgatgaaagcatagttatgcagcttggtttacaaatataaaactgtatggagtaatagccaagttcttagacattttatttttagtcctctctaaaattaaaaatgtttataaaagcacatttcttgtttgaaatttagctttgaaatttggctttccaagctaactaagtcatgctacatttactttaggttgatttaacaaagcttgggttaaaaaactttaagaccattagtaaagttttcactactataccatgtaggaattaaaaaaaaaaaaaaccctgcaacaacaagtaaataaggattaaagttctttaaagaatttagtctgacaaccaaattttcccacacgtctggagtaagttaccaaatcatgatagtgggttgaatatcagcaagaaagatgttttagctgctttcaataatggaatattttactttaggtgatgagcacataggcaaactttcagtgcgtcagatgtatcagtaggatatgctagtgtaagcagtaaaatatgatttggggttgggtagacttccaaagctgcagaataagggtctacacagcctctctcccaagcaaaacacagcttatctgctgaaaaaatttaaaacattatttaaagtccctgtatattgtcctaaagtcatagagcaaacagggaaatattcattcaaggaaactcactaaatctcagtaacaacacagagcttttgatatatgaattacaacttgtttccttgccccactccctcagctcaatgttgcagaagttttgccctgggcattctactcaggcctagaagacagaggttccctctctctccagcttccaatctggagctatggcttcatcagggaagagacaggttactagaggcatttctcatccttctctagccccatgttacagaagatctattttagataggtgtggctgaaagaaccaggtctgctctccctccctccctctcttagggcagaagctccaggaacaaaacgttgagagtctcaatcttccccattctagcttgctcatagggtagagattctgccagaagagcgagctaagaccagggactgccaactcctcccaagtgctgacttgtagagtgacactgccactccaggaaaagctggtccgtgaccccaggtcaggttgtagtgagagataggttttgcctaaggtgaaaagcaggttataaggacaaagaactctgtagcagttctgcctgaaagggctgacattatttgcaacagagcttggaggaaagcaattaagagaagctggcagccctatgacaagcaaaacagacagaactttaatagaatcaggaaacgagacagccaagaaggaccctttggggatcacagtcaattttggagttcaaaaaccctgtgcacatacactaggctgcacccaataaggaacaattagagtaagatgtaggacggacagacatgaaagcattcccaaagtcacacagagacttatcaaaacaaggtaaatcctcactggcactgaataacctgaactcagggtcgactcctgggaagctaagacttaaaaataacatccagtcattccttgcagtctggaagaccgtgtgcatacccaaggatgtaccctctttagagtaatcaggagtgaaccttcaagctattagtctcctggtgcatgtgggacaaaaaaaacataaacactctaaactgtgatagtagcctccaagccacacacatccaacagtaaatgataaaaatcaaatggtaaggggaaaaaaatcatactggtaaggggactaagcacaaactttgaccaataagtacgtgataacccagggaagacccctcattagccaggctaaaagaaaaacaatttttaaaaaatctgagcatggagatcagaggctaattactggggggaaaccaagttgttagaaaataaacaaatgaccaagcaaacaccaaccaacaatatatttttggattcaaagacacagataaagttgaagtcaaaggaatggaaacaagtaccataaaatagaaaccaacagagctacagtggctatactaatgtaagactttagaacaaaaaatgttagagatagagatatttcataatgatacaatgtcaacctaacaggaaaatatgaaaattacaaatatatatgcacccaaaaacagagccccaaaatacatgatgcaaaacaaagacagagctgaaggcagaaacagacatttcctcaataatagttgaagattttaatatcccactttcaataatggacagaacaactagaaaatatcaacaaggaaacagaagacttgaacaataatatgacaaccggacctacctgacatctacagaatactctatcctacagtagcaaaaaatacattcttctcaagcatatgtgaaacaacttacaggatagaccataaaacaagccttggccaggtgcgatggcttacgcctgtaatcccagcactttgggaggctgaggcgggtggatcacgaggtcaggagatcgagatcatcctggctaacacggtgtaaccccgtctctactaaaaatacaaaaaattagccaggcgtcggtggggggtgcctgtagtcccagctacttgggaggctgaggcaggagaatggcgtgaacttgggaggcagaggttgcagtgagccaagaccgcgccactgcactccagcctaggcgacagagcgacactccgtctcaaaaaaaaaaaaccaaaaaacaaaaaaaaacaagtcttgataaatttaaacgatttgaaatcatgcaaggtatattttttatccacaatggaatgaaagtagaaatcaatgaaagaaaatttgggtaattcacaaatgtgtgaaaatgtaacaatttactcctaaattaccagtgggtcaaagaataaatctcaagggaaatgagaaaatacttagagatgaatgaaaataaaaaatgaaaataaaaagagagaatgaatgaaaatatggcctgtaagtaaagaagtgctcattgggaaatttacagatctaaatgcctctattaaaaaagatttcattcacctcctttcagaatgaaagaacaaaaagttttaaaaaagatttcataccaataaccaaaccttccaccttacaaaactggcacagtggttcatacctgtaatcccagtacttggggaggccaaggtagaagaactgcttgagcccaggagttcgagaccagcctgggcaacacagagagaccccatctctacaaaaagaaaaaaaccagctgggtgtgatggtgcacaccagtggtcccagggcccctacttggggaggctaagatgggaggatcacttgagcctgggagttccaggctgcagtgacccatgattgtgccactgcactccagcctgggtgacacggtgagaccctgtctccaaaaaaaaaaaaaaagaaaaaaagaaagcacaattaaattcaaagcaagcagaagaaagaaaagaaaataataaagactacagtggaaataaataaaatagaagagaaaaacaatagagaaaaaaatcaatgaacccaaaagttggctctttaagatgatcaacaaaattaaccatctttagctagactaagcaataaaaaaagactcaaaatgactacagtcaggaatgaaagaagggacaccactatatattttacagaaataaaaaatattataaggaaatgctataagcatttgtatgccaacaaattaaattagataaaatgatcaaattcctagaaagacacaatttttttcttttttttttttttgagatggagtctcgctctctcgcccaggctggagtgcagtggtgtgatctctgctcactgcaagctccgcctcccgggttcacaccattctcctgcctcagtctcccaagtggctgggactacaggtgcccaccaccacgcccggctaattttttgtatttttagtacagatggggtttcaccgtgttagccaggatggttttgatctcctgaccttgtgatccgccctcctccgtctcccaaagtgctgggattacagatgtgagccactgcgcctggccaaaagacacaatttctaaaaccaaccttaaaaagaaacagaatacccgaatagacctataacaaatgaagacattgaattaataatttgattagaaaggaagaagcaaaaatatctgacttgcacatgaggtgactttttatatagaaaatcctaaggaatccgctaaaaaggctattagagctaataaacaagttcagcaaggctgcaagatataagatcaaatacacaaaaactgatgttccatacactagcaataaacaagccaaaaacaaaaaacaaaattttaaaaattcttttataatagcacccaaaagaataatacttgggtataaatttactgtgaagtgcaaaacttatattttgaaaattataaaacattgttgaaagaaattaaagatctacattaaaaaaaagtcatgttcatgggcctaaagacttaatattgttaagatgatagcatcccccaaactgatctacagatttaatgtaatccctatcaaaatcccagctgcctttgaaatagaaattggcaagcttggctgagtgtggtcactcatgcctgtaatcccaacactttgtgaggctgaggcaggaggactacttgaggccaagagtttaagaccagcctggggccgggcatggtggttcatgcctataatcccagcacttagggaggccaaggcgggtggatcatgaggtcaagagatagagggggcgagaccattctggccaacatggtgaaacctcatctctactaaaaatacaaaaatcagctgggtgtggttgcgtgcgcttgtagtcccagctactcgggaggctgaggcaggagaatcacttgaacctgggaggtggaggatgcagtgagctgagatcatgccactgcactccagcctagtgacagcgagactccatctcaaaaaagaaaaaaaaaaaaggaaaaagaaaaacacccagcctgggcaacacagtgagaccccgtctctacaaaaaaaaaaaattggctgggcatggtggcacatgcctgtagtcctagctactggggaggatgaggtgaggtgggaggatcacttgagcccaggagttccaggctgcagtgagctctgatcatgccattgcactctaggctgggcaaaagagtgagactctatctccacaaaaaagaaaaagagaaaacaggaaaaaaaccctctgaaattgactagctcatcctaaaattcacaggaaaatgtaatagacccaaaatggccaaaacaatcttgaaaaagaatagaattggagaactcatacttcttgatttcaaaacttgctacaaaagtcatcaaagcactcatagtaatgatgtaagatgagacatacaaatcagtggaacagaatcatgtgaccagaaataaactcatatttatagttaattgctttttgataatggtatcaagacatttcaatgaatagtgttttcaacaaatggtactgggacaacgagatatctacatgaaaaagaatgaagttggggccaggcacaatggctcatgcctgtaatcccagcactttgggaggctgttaggaagactgctagagctcaggagttcaagaccagcctagacaacatagtgagacctcatctctacaaaaatttaaaaattggccaggcgtggtggcatgcgtctgcagtcccagctacctgggaggctgatgcaggaagatcacttgagcccaggaagttgaggttgcagtgagctgtgactgcatcactgtaccccagcctgggtgacagaatgaaactctgtttcaaaaaaaaaaaaaaaaaaaaagaagtcagactcttccaccatataaaaaattgaatcaaatgactcataaatcaaaaatgtaagggcggaaactataaaactcattaaaacaaaaaataaaaaacaacaaaggatcttacattaggcgaggtcttcttcttcttcttcttctttttttttttttttgagacagagtcttgctctgtcgcccaggctggagtgcagtggcgcaatctcggctcactgcaagctccgcttcccaggttcatgccactctcctgcctcagcctcctgagtggctgggactacaggcgcccgccaccacgccccgctaattttttgtatttttagtagagatggggtttcaccatgttagccaggatggtctcgatctcctgacctcgtgatccgccctccttggcctcctaaagtgcggggattacaggtgtgagccaccgtgcccggcctaggcaaggtctttttaaatacaacacaaaaacacaagtgacaaaataaaaataggtaaactgaactttgtcaaaattaaattttttgtgctatgagtgatgccatcatgaaagtgaaatgacaatttacagaatgagaaaaaaattgcaaatcatatatctgataaagaacttgtatctagaacatacatataaagaactttaaagtcaatagtaaaagaccaattttattttattttgtattttattcttttttttttttgagatggagtctccctctgtcatccaggctggagggcagtggcacgatgttggctcactgcagcctctgcttcctgggttcaagcgattctagtgtctcagcctcctgagtaacagggattacaggtgtgcaccaccatgcttggctaatttttgtatttttagtagagacggggtttcactatgttggccaggctggtcttgaactcctgacctcatgtgatccacctgccttggcctcccaaagtgctgggattacaggtgtgagcctccacgcccagtcacataacccaatttaaaaaataggcaaagacgtttatattattttcctagggtttctgtaacaaattacacaaactaggttgctttcaacaaaaaatatttattctctcacagtgctgtatgctaaaagtcagaaatcaaggcatagacagggccatgcaccttccaaaggttctaggggagcatccttccttgcctcttctaagattctagctgttgctgacaattcttcagcatttcttggcttgtggctgtatgactacaatttctgcttccatctctacatacccatctttcccgtgtatgcagaagtgtttcttcacgtggctttcttataaggacacaagtaatcagatttagggtcaaatctagtgcagtgtgacctcatcataactctgaaaactctacttccaaattgcactctgagtttcagggtggacatgagattctgagagaatacaattcaacccagtacacatttaaataggcattttttcaaagaacatatatatagtcaattatcatagcaatgaaaaatactcatgataagtcattagggaaatgcaaatcaaaatcatgagatattttaggctgatcaaagctgtacaggaaaaagcaatactaaaaaaatctcacaaactcacaagattccactttatatccactaagacgagtataataaaaaagaatgacaataacgagtgtaggctagggcatggagagtatgtaacactcatacaccatcggtgggaaggtaaaatggtacagctggtgtgtaaaacagtttgcagttcctccaatggtgaaacagagagttatcatatcatccagcaattctactcctaggtatatattcaaaacatgtccacacaaaaaactgtacatgaatgttcacagcagcattattcatattcgcccaaaagtgaaaccaactgaaatgtccatcgactgatgaatggataaacaaatatttatcaatataatgagatattttctggtaataaaaagaaataaagtagaaacatgctgcatcgtgaatgaactttgaaatcatcatgctaagtaaaaaaaaagctgccacaaaaacccacatattatttgattccatttatatgaaatttccagaataggcaaatttatagagacagaaagtagatatgtgttatctaaggctggggggaaagaaaggctggtgggtaatggataccaggtttcttttcagagggactaaaataatctaaaaatgagattggggtgatagttgtacaaccctgtgaatatactaaaaatatgtacactttaaatgaattaactgtattgcatgtaaaatatgtctcagtcaagatattaaaattttaatttgaaagcatctattaagtgtaaattctaattgtgaaagaaaaaaaactcagtgtttttgcttcttcaggtaaagggctatcaattagagctcataaataataatttataaaattgagaagagctggatagaaatcttcatctaatactatataaatttaaaaggtgagagaagtatatgtgccatataggaaaaaaacagaaaataaatctttaaaatgcaataaaagagaagcagagttcagctgccctttatgtcaattaatctttcactactccttcttatttttctccttactaactatggctgctaaaatgttttatattgtcattagattaatatgcaccacaatagtgaataatgaggcaaatgtattagaaaaaatagttaaaattagtgaacttgcaactacaaatgttctataagaatatgtatagtactggcaaaatattattagctcactactggaaaactcaaagtgacatctgtcaagttttaagcatttctaaatccctgtatataccttgcaataaaataataatacatatcattttgtgatttgaaatttaaaactctggtggttcaaccacaaggaataggaaacaattagtctaggcaaagaaaataaagaatctataaatggtctagtgaggtaagtctgttaacaaagtaatctttcattttctcccgccctagtcctccctagacaagtaatcaggtttgtttccaggtttcctggtttaagaggaaagctcaaaaattgtcttactgtcatgtaattagaatgaattcttacttgagctcattgtattgaaaaaactatgtagttttctttaaaattatttttaaaaagcaaacaaataaatgtcatgcattcatttaatgtagtgtataaaaaaatgtatgctgactcaaggcaatgtctccccttcaaggtatgcatgagaatggaggtttgtatgagaattgaggtatgtattcataccacaattcattcaaggtatgtatgagaacggaggcagtttagcaggagccaagaaataaaaaagcataaggtaatttaaataaactgaatagccaagatggctggtatgggttgagctctagactgaagagtctggccaggcattattacggagtcactaaggagtgttctcattaacatcaaattttaacattagaaagattatgttagtggtcaggattgtctagatggggaagagtcaggagatgagatcccacagagtacttagacagttgttaaaactgtcttggaaagaagtgataaggacatgaatcaatgagttgggagcggtaaaggcaagaagagacagagttgagagataaaaagaagaatggacatcatgattatgaaaacctaaaggcaagggaaagggaaatggtcaaatttgggtaactctgaaagggtacttctaaacataaatatgaccatcaggaggaagatccgattttgaaaagaaatgtgacctagaaatgatagtagagaggcaggtaaaagaaaaatgagggagatacctatgttatgaaggtaagaaacagaaaatgaaccagtgaagacctggaataattagagaattaggagttgaactgagtaattttagtgtcatagaagttggggcagaggactttaaaatgatcagagagaattttaaaaagacaaaatagataacaatattagatatttaatataggggatttaatatacaatagatttttagagcagtgaaactattctgtgtgatacgctaatggtagatacatgtcagtacacatttatcaaaaccaatagaaagaatgagccctaatgtaaactttggacttcagacactaatgtaagatgtaaataataggggaaactctacagggggaatggagaatatatggaaactctgtactttcctatcagttcttttgtaaatcgaaaactgctctagttttaaaacacacctatgaagttaaatttaaatttaatcagataaattaatgaggctggtgaggactaaaagaactttagacttgatggtcaggatgctaaccttcagaaagacagtttcagtatagcagtagaggtaggagctaggtagttctgaggtaagcaagacagaaaaagtggtatgattcctgttcccaaggacttgaccatctagtaccaagatatattgttatggagaacaatcagaattgagaacccacagactacttagagagttcttataaccgtcttggaaagaataagaatagctaaacaataatgataataataactatgctatatgataaatgctatgacagggacatgctacagggttctgtgaaagcatatggaaggagattcaaacatagtctgggaaggaaggtgaagcataggagtagattaaggtaaagctttccatataaagtgatgtttaagctgagacttcaggagtggacaggagggggactgggaatggtggttcacacctgtaatcccagcactttgggaggctgaggcgggtggatcacctaaggcgaggagttacagatcagtctggccaacatggtgaaaccccgtctctactaaaaatacaaaaattaggctgggcacagtggcgcatgcctgtaatcccagcactttgggaggctgaggcaggcagatcgcttgaggtcaggagttcgagaccagcttggccaatatggtgaaaccccatttctactaaaaatacaaaaattagctgggcgtggtggcgcatgcctgtaatcccagctactcaggagtctgaggcaggagaatcacttgaaccccgaaggcggaggttgcagtgagccgttatcatgtcattgaactccagcctgggtgacaacagcaaaactccatcctgtgtgtgtgtgtgtggggtgggggggggggggggaagggggtgaatttacagcctaagattatttcattgttaaataataaagtatgaaacaaagataaatagaaatcaattccagatataagaaaaaggaaataaactttataaaaaagaaaataatgaaacagaaaataatgagttagaaacagaacataacagaatgtaacaaattaggacctgtttctttgaaaagactgagcagattgtctgcatcaagaaaattttaaaaaaccacaaaaaactaaaatgaaaaagaaaatttaataaaaattataacaccatgtatgaatctctactagtatctatttagaagtctcaatgaaatggatttttagaaaatagaaaacaaaacaaaacaaaaagtaaaattttcccaagagctaaaacctggaaagagtaataaggatgaaacaaactgaaagaaaaattagaaatgttatgatttcttccaaaactttaagcaacagataatattcatgttatgaagctgggtataacctcaattctaaaaacataacaggaacaggacaaaaaataactacataatctgctaatagtggactataaccgaactcaaaatgaaattctggtaaatctaacacaacgagaagccaaaagatcaggcagggtttagctcaaaaatgcaaatatcatttgatattagcagtctagtgatattaaaatacaatatacaccaattagttaaaaaatcaaaactatatgaaaatttgaatagatgctgaaaataattttgatataatttaacatcctttccatataagaactcctagaaaacagggtactttttcagcacaataaaaattatctttttaaaactaataactaatatcttccttaatgatgaaacagaagagttgttttcatcagaatcaggaaagacaaggatgtccactgttactatactattaaacactatcctgcaagttctggtcagtgcaataagacgtgatataagcaaagacaagcataactactagaaaggagattatctgtagataatgattatatatctagacaaatcctgagacagacaataaaatgcttaaaatcaataagagaattcacttcagtgtttgtaaacaaagtaaatattaaaaagagaaaaacctagaaaacgtaatgggggaaaaatcctattcagaatatcaataaaacaataaaacacctagaaatatacaaacaagaaatgtctgggtctcagaataaatgaaaacatactataattactaatgggaagaatgatgattatgatggtgctttgctttttctacatgagagttttattgaatatccaatcaaataccaatgggatttttttttctgaaaaacaacagcataattttaaatgtatctggaagaataagtaggtgagactatcaaagaaaagaggaataatgtgtgtgggtgcagtgaggaagaagacttggcctatcagatattaaaatatattataaagctatattaaagtgtaatatttacacaaaaatgatagacaaatctaaccagaagactgtaagtgttagaaggagcaagattacatgaaaaaagataaataaataaaagagtacaactagaatgtaacaaaaagaatgaataccccattttccatgatgtgatttattacacactgcatgtctgtatcaaaacatcttatgtaccccattaaatatatacacctacagggaaatttatagcactaaatgcccacaagagaaagcaggaaagatctaaaatcgacaccctaacatcacgattaaaagaactagagaagcaagagcaaacaaattcaaaagctagcagaaggcaagaaataactaagatcagagcagaactgaaagagataagagacacaaaaaacccttcaaataaatcaatgaatccaggagctggttttttgaaaagatcaacaaaattcatagactgctagcaagactaataaagaagaaaagagaagaatcaaatagacacaataaaaaatgacaaagggggtatcaccaccaatcccacagaagtacaaactatcatcagagaatacttaaacacctctaagcaaataaactagaaaatctagaagaaatggataaagtcctggacacatacaccctcccaggactaaaccaggaagaagttgaatctccgaatagaccaataacaggctctgaaattaaggcaataattaatagcctacaaaccaaaaacagtccaggactacaaaccaaaaacagtccaggaccagacggattcacagccaaattctaccagaggtacaaagaagagctggtaccattccttctgaaactattccaatcaatagaaaaagagggaatcctccctaactcattttatgaggccaacatcatcctgatatcaaagcctggcagacacaacaaaaaaagagaatattacatcaatatccctgatgcaaaaatcctcaatgaaatactggcaaaccaaatccagcagcacgtcaaaaagcttattcaccacgatcaagtcggcttcatccctgggatgcaaggatggtccaacatacgcaaatcaataaacgtcatccatcatataaacagaaccaatgacaaaaaccacatgattatcttaatagatgcagaaaaggcctttgacaaaattcaacagctcttcatgctaaaaactctcaataaactaggtactgatgcaacgtatctcaaaataactagagctattttatgacaaacccacagccaatatcatactgaatgggcaaaaactggaagcattccctttgaaaactggtacaagacaaggatgccctctctcaccactcctattcaacatagtgttggaagttctggccagggcaatcaagcaggagaaagaaataaagggtattcaattaggaaatgaggaagtcaaattgttcctatttgcagatgacatgatcgtatatttagaaaaccccatcgtctcagcccaaaatctccttaagctgacaagcaacttcggcaaagtctcaggatacaaaatcaatgtgcaaaaatcacaagcattcctatacatcattaacagacaaacaagagagtcaaatcatgagtgaactcccattcacaattgctacaaagagaataaaatacctaggaatccaacttacaatggatgtgaagttctcgtcaaggagaactacaaaccactgctcaacaaaataaaagaggacacaaacaaatggaagaatgctcatgctcatggagaggaagaatcaatatcatgaaaatggccatactgcccaaggtaatttatagattcaatgccatccccatcaagctaccagtgactttcttcacagaattggaaaaaaactgctttaaagttcatatggaaccaaaaaagagcccacattgtcaagacaatcctaagcaaaaagaacaaagctggaggcatcatgctacctgacttcaaacatactacaaggctacagtaaccaaaacagcatggtactggtaccaaaacagatatatagaccaacagaacagaacagagccctcagaaataataccacacatctacgaccatctaatctttgacaaacctgacaaaaacaagaaataggggaaaggattccctatttaataaatggtgctgggaaaactggttagccatatgtagaaagctgaaactggatcccttccttacaccttatacaaaaattaattcaagatggattaaagacttaattattagacctaaaaccatcaaaaccctagaagaaaacctaggaaataccattcaggacataggcatgcgcgaggacttcatgactaaaacaccaaaatcaatggcaacaaaagccaaaattgacaaatgggatctgattaaactaaagagcttctgcacaacaaaagaaactgtcatcagagtgaacaggcaacctacagaatggaagaaaatttttgcaatctacccttctgacaaagggctaatacccagaatctacaatgaactcaaacaaatttacaagaaaaaaacaaacaacgccatcaaaaagtgggcaaaggatatgaacagacacttctcaaaagaagacatctatgcaaccaacagacacatgaaaaaatgctcatcatcactggtcattagagaaatgcaaatcaaaaccacaatgagataccatctcacaacagttagaatggcaatcattaaaaagtcaggaaacaacagatgctggagaggatgtggagaaacaggaacgcttttacactgttggtgggagtgtaaattaattcaaccattgtggaagacagtgtggcgattcctcaaggatctagaactagaattaccatttgacccagcaataccgttactgggtatatacccaaaggattataaatcatgctactataaagacacatgtacacatatgtttactgcggcactattcacaatagcaaagacttggaaccaacccaaatgtccatcaatgatagactgaattaagaaactgtggcacatatacaccacggaatactatgcagccataaaaaaggatgagttaatgtcctttgcagggacatggacgaagctagaaaccatcattctcagcaaactatcacaaggatagaaaaccaaacaccacatgtgctcatccataggtgggaattgaacaatgagatcacttggacatagggtggggaatatcacacattggggcctgttgggggattgggggctggggtagggatagaattaggagaaatacctaatgtaaatgatgagttgatgggtgcagaaaaccaacatggcacatgtatacgtatgtaacaaacctgcacgttgtgcacatgtaccctaaaacttaaagtataatacaaaaaaagtaaataaatatatacacttacaatgtgcccacaaaaataaaacataaaataaaaatgatagacaaagcaacagaaataaacagctgtgaagcagagagcttaatatttaataaaggaagcatcaaatcaatggcaaaggtatagtttattcaacaaattattaaaatagactgtttttcaacattcaaactagttccagttatcattccacaaatcagaatatatttcaaaatgaataaagaattaaatgtaaaataattaccacctcaatgaaataaagatctagaaggacaggctgggcacaatggctcatgcctataatcccagcactttgggaggctgaggcaggtgaatcacttgaggctaggtgttcaaggccagcctggccaacatggcaaaaccctgtctcttatactaaaagtacaaaattagccaggtgtgatgtgtggtcagaaggctgaggcacatgaatcacttgaacctgggaggtagagactgcagtgagctgaagttgtgccattgcacttccagcctgggcaacagaggaagactctgtctcaaaaaaaaaaaaaaaaaaatctagagagaaataaggaaatgtactagaatatttaactgatttcaagacagaactgtttaagcacaacaaataattcaagaaatccaaagaaaaaaattgagagaaatgatacataaaacgaaaaaatatgtaggttaaatgatctgaagttgacaactgaaaactaaacaaccaggaaagctcccacgaatagcacgaaagttaatctctctctctctctcacacacacagacatacacacacacagacacacagacatacacacacacacggagagttcttacaattaagaaaaattcctaaatagataactagaaaaagaacaccaacagagaatttgaaaacagatgaaaatttcctacaaatatgtggaaaatattaacatcactagcagaagagaaaaaaaaattaaagaggtaccatgatctgcttctcaagctataaaggttaaaaaagggtgattagtatctggtgatggccaggttgaagttatataggtgttgttacaaaatgttggtgaaattacaaattattacttaatagaagcaatttcccaatatacatggcatgaaatatcctgatacgatttgacctaaataattctattcctgggactctatcctgcggcaagaaattaaaaacaacttaaatgtccaacaatcataaaacctggcatcataaaagattatttttaggccgggcgcggtggctcacgcctgtaatcccagcactttgggaggccaaggcgggtggatcacgaggtcaggcgatcgagaccattctggctaacatggtgaaaccctgtttctactaaaaatacaaaaacaaaattagctgggcgtggtggcgggcaagtgcctgtagtcccagctactctgaaggctgagacaggagactggcgtgaacccgggaggcggaggttgcagtgagccgagatcgcaccactgcactccagcctgagcgacacagcaagactccatctcaaaaaaaaaaaaagttatctttgaagagtatctaaatgactgaggaaatgctcacaatataatacaacgcaaaaaaaaaaaaaaaaaacaacttggtaatatccctatgattccagttccgtaaaaaaaaaaaaaaaaaaaaggagtccagtgttatatagattatatttttgttttatattttctgtaataaccaaataattatttttaagatcattttgagaaaagctaaaaacaacaaccaaaaccagttagaaattacaggaagtgagtaaagatcatatttctccataaatttggtagtaaaaggaatgagagatctggataggactatagcttgaaagtagagtaactgaggaaagttttgttttatgctttgttttgtttaaaggcagataacaaacaagtttattaagaggaacacgaagaaatataacataaagaggagataactttttgaagacgatcctgaagcaggcagagatggcagaaagcagaagtacaaatagaaaaaaaaaaaggcttttctcaaactgaaggtgagcaagaaacgatggctcaatacagaaattttaaagaagagaggaagatatagaattgtttgatgtgggaatggtctgaatcatcttactcactatgcattcctatgggtagcttttttcaaacttgcttcccaatctgtcagaatcactggatttaattaatgagagatgtgactaaggtttgcttaaacatgggaaaaaccaaaggctattttacaggtccagttagttttctgtgattcaaaagatgattctgaaatgcataaaaaaggcataaacaagccaggcgcggtggctcacgcctgtaatcccagcactttgggaggccgaggcgggcagatcacaaggtcaggagatcgaaaccattctggttcactcagtgaaaccccatctctactaaaaaatacaaaaaaaagttagccgggtgtggtggtgggtgcctgtagtcccagctactccggaggctgagcggagatcatgccactgcactcaagcctgggtgacagtgggagactctgtctcaaaaaaaaaaaaaaaaaaaaaaaggcataaacaattcaaagacacccaacattctatgcagtcctaaattttccttaaaaaacttttgctcagaaagttataaatcaataacacagtattatatactatttaaaatattattcacagtattattctaaaagagaaatacctgagagttgctagttatgtgaagattttccaacaacttaccactgccttgaatccaagttcctaagttctctaagtagcttttcatttttcttcaggagatgaaagctcctcctaaatagagagatttataaacattttcatcacctttgcagtgaatgacaagacagtcccggaaatactttccactctactcatgcaacttttctacttttcttgccttttcatacttctaacacaaaggagaacagaccctaaaaaaaatgtaaagaatatacgtcattatttccaccaggtgttcatacatttctgctagtggatcatatcaattggccacttgaatctttccttgcagatgttgtgagcctcctaaactcatatccaggaaaatggataaaagtactttgtatttcttttcaagagtctcataaaaatatgtgagaaagttgtatctcatgagaaataaaatattcacagaatctatatcattatcaagtaagcaagtgtaatccagatggaattttctttcttccttgttttataatttttagactacaaagcagtgaataattttaccaaatcccttccatgggtgctaaatatgtacaaattattttcataaaatcaatgcttgctgaagtaaaatacagcttctcatctttaatttttcccaagggacaacatacggaccattctacagcaaaagagagtagaatgcatttataccataactgacataactgagtggcaattacctatatttggtcataccatatggcaaactgttcctgagatataacatttcctataaggcagaggatattctcttctaataaacggctttcctatattccttattcccttctaataagaggctttcctataaggcagaggatattcccttctaataagcggaagagttttaaatcaagtaagagtataaacactaagcaaacaagcagatctctatttcaatgcttgacatacatttgaattactttaagatttgttcgttcactgatatctgagcttcccctcctaccataaattgacagagacaatacattacccctccttccactacctacagggtttcatgacataggaattaaaacctaaatgtatattaataatgctttacattagtgtacaatgccagtgttttatatacattatctgatttaattcttcccagtatgtgaggtgggtactactctcaatttgtagactgtagcctgaggctcaaaagttaagtaactttaagctaggtcttctgatttaagcccattgttcttttcatttagctcctacctaacttacttgaatacctcatgagtttattgtaagtttttaataaggttttgtaacatgcatcagaaaacaaaataatttttaaaacttcagattctttttttgatttgaccttgaatcctgagttaatttccctgattcaaaccggaaataatcatattgcagtttctaaaaaaaaaattattaggcttacatgaaggttgaaaaatgagctataatttctaagtcaaatagttccagtagttattttgaaaatattgataatttgctggattattttattcccctgaatcccaatataactcagtggtctcaaaaaaaaatctgcaaaaaaatgagtcaaagaactaattggtagataaaatttagtgaggaaaagaacagaaaataaaatgctttatcagaagatgaataagaccgaaaaaaaaaaaaaaagaaaaaatttctcccttatgcttaccgtttgtcccaggaattcattcccaatatactaagaagcaatctgcaataataaaatgctgactgaggtttttgaggtattggttcatcttgttccacagctttcatgtttaagtcattaaagtgcttctcaacaaattctttttcttctgtatgttgcttaaggatagcattaataacatcattttcttgtttttcagaaatgcacacaggttgtggagcaggaatattaagtgagattccagttctctgtaagcattcaggactagtaacacccaaatactgcaagagctcatcaagaacatcttcttcatctcttattgtatcccaagttggtacagtttctctaaatcttttaaactggagagaaagtccatcttttacggttatatcttctaagcattcattagatgtcggaggctcttctggcttctcttggtgagacaatgaaagcatgaaagatgtaggttctgacaagccacttacaggaggtgggccatacagtatagcagaatcccatgaatattttccagagagatcacgtactatgattctgacatttgaattggctgatgcaaggccagcagataaacctcctccaggcatattctcttctgatctgatctggatacaggacactaaggttgtattatttaacacaaagaactggatatttggactctcaaagagttcaggagaaagttcagtactttcactgtaatgattgtcgtgattttcacacacctgacttgttagcatagcaggaccaccgctcattggataatggcccaggtgatttaccagatgtgtaataacagtgcgggctgctatagagattaatccatgctgcatttgagttttcactggaaataaaaaatataaatgaatgggaatattgctgcttcctagggaatcatatgacaatgaaatattagacaacaaatagggattttatcacattgttaatatttccagtttagattccataatacagtaatgatggcaaaaaaggaggaaaaccattctttgatgaagttttgtttataaggaagacctttctgaaatttttgctaatgggtccataatttaaaccaaggcctttatatatagatcactttgaagaatcagaagtattataaatcaatcatgaaatcactaatgcacattaaaaagccaaagacggccaggtgctgtaacacatctgaaatctcagcactttgggaggctgaggcgggaggattgcttgagaccagtctgggcaacatagggagactatgtctctataaataaaaataataatagtaatactaaaattagcccagtgtggtggccactgtactccagcccaggtgtcagagcaagaccatgtctcccacaacaacaaaacaaaataaaacaaaaaacaaaaacaaaaacataatgaaatctgttcaactgataagtttcttatctccattaatagattccagattcagagacagtttgtagatgccttaaatgtcatttaaatctggcttttacagataatgtaaaaatgtttcagaaaaggtgacattccaagtaaactccgggaatcagaataaatttaaacagcaagtcagtatagctagtacctgtatgcaaaagagattttattttaaaagcaaaaatatttgctggatctacttatatttttctaaggtattcttcaggtcaatgtggtacagtctagcagtcagttgtatgcaagaaatatttttttccctcaagtacaatacagaggaaaacaggtaagaagcatattcatacgagtaactaaaaaaatcataggaaacagtcaaaagagaaaactcaaagaatatagtagtttaagaggcctggaaaggcaagatgcccaatgtcagaatctgaaggaggaggaaaagggaggggagggggagaaggaagaagggaacacagagacagtaacgaggtaaaggagaaaggagacagacaataatttgtcaaagccaactagttaaagaccgccattctaaggagggctaaagactgtgattctgaggggtgttgatgtggaagccagtttgggattgagtggtgtcaggaagtagggacaactagctgactgttatcttaatgcgtttcatctaagaggtaggaggagagttgtttttggtaaagaagcattagtcattcatgttaggatgtttagggggtgtgtgtgtgtgtgtgtgtgtgtgtgtgtttaaaacattcttgtctctacttaattttagacataattacagagtgattgtgtttctgtattattctaccacagtaacagagtgatcttgtcttgagtatttatattctctgacagttaattagttgggaacaccagggcctgtcagaacaactaaggatttgtcagaataaatacaaatttatttatttatttatttttttatttttgagatggagtctcgctctgtctcccaggctggagtgcagtggcgcaatcttggctcactgcaacctccacctcccgtgttcaagcgattctcctgcctcagcctcccaaacagctggggactacaggcgcgcaccgccacgcccagctattgtatttttagtagagactgcgtttcaccatattggccaggctggtcttgaactcttgaccttgtgatccacccacctaggcctcccaaagggttgggattacaggcgtgagccactgtgctgagccaaatacagatttaagaatgttctgatttacatacatgcccaattttatgtgtttagtttgatgacttttggtaattatatataattgtgtaaccaccaacataatcaatataaaaaattccctcatcaaaaaagaatattttattttatgtaaactatacctcaataaacctaactttaaaaaaaaagggagaccagtttgtgcactgatggtataatcactttaaaagaggcaagagaaaagaatagtgttacattttcaaggctttagccttcaagattcagaaccaataccactgggtataggcaaaccaaccaaccagctgctatgccattgatgttaataccatcttctccaattccaaaaaagaatagtttcctttgggctttggttgattttaaaatgttgctgagtatcaaaattttaatttcccattatcagccaagttatgtctacataaatgtaaatataaacatttcttagcttatttactggttttttttttttgggacagagtcttgctgtgtcacccaggctggagtgcagtggcacgatcttggctcactgcagcctctgcctcccgagttcaagcaattctcctgcctcagcttcccaaatagctggtattacaagcatgtgccaccacgcctggctaatttttacattagagaagaggcttcaccatgttggtcaggctggtcttgaactcttgaccccaagtgatccaccagccagggcctcccaaagtgctgggattacaagtgtgagtgactgcacccacccaacatttcttagtctaaaagttccaattaatggctgggtgtggtggctcacacttgtaatcccagcactttgggaagctgaggcgggccaatcacctgaggtcagtagttcgagaccagcctggccaacatggcgaaaccgtgtctctaccaaaaaatacaaaaattagctgggtgtgcctcaggaggctgaggcaggagaatcacttgaacctggcaggcggaggttgcagtgaactgagatcgcgccactgcacttcagcctgggtaacaagagtgaggctctgtcttaaaaaaataaaaaagaaaataaataaataaaagttccaattatattgaaatttttaaaagttatttttatgattattactaataaccagccattcaatactagattaataacactaaatgattaactttaattcaatccttcatttttaagaatgtaaggaaagtaaaaagtattttgagctatatgacaagaaataggtagcttgaatctagtgtttgctttcccttccctaattataacctagaatataataaatgttcacactataaggggataatctagctggtattcctcattttgcacatgaggacaaatgggttcgcaaagttaagtgatttgcctgccataggagatgtcttttgcttcccagctcagtgttatttccctctttaccacagctctaatttccatacttttttctcttttgttaaactgtctttttctttatgagatatggaaacaatgaattcaaaatttatttttctctctgtataagaacttcaaaaaagtattacttaggataaattactaaataaaaagcaaagatcaatggaaaaaaatcaagactaaaccgaattttaaatggtaacaaaaattaaaattagtcattttaaaatttttgatatagaaaaagatttttctattcttcactctcccttttgagtgacatacttaaatagatgactcattctaagcattaaatcctctttgcataacatagaagtttacactctgaagaagggaaagagtataattgaaaagaaaccaccatagaaaagagaagaatccctggctttggcttgctctgtgattcatgatcacaaatacataagattccttaaactccatttttctgtaagaattgcatacttatttgtaaagatgagttaaaaacttttacatacaaaactggatataacagaaacaataaaaaatcattcaatttaaagagcattataagtaacataggtcttatgagtttctttttcaaacctacttataaataaactccaagaatgagccaggtctttccctaaaacataaacctcgaagctcaggtaccagagtatcccatatgtcttcttcccaaaggtagagacaatgagaatgcagtttaaatgagcttgttcacaagtctgtcataattactcacattgaaaacacgtaaagaataaatttaaatctcagatgtaggtaaagcattttctgccctaagttgcttctctaaattcaggatatatgtctgtatataaaaggataaaaatctctcaaattgtttattgggcaataaatttatttatacttatttttgagctataaactatagaacatacatatctctcttctacttatctactaaaatacaaagaagacatgaaattctctagtttagatatttaaaataaaattctaaaataaccagtcttgtgagaaaatgtaaaatggagatatcgatgcttctaaggctttgtgtaactagcattcatttaaataactctattcagggttgtctcttcagattgtcagattaaacaaatcctacagcatttgcagcaaacccataattacagattattatggcgtacaaaagcagcaagacataaaaagctgctgcaattcactgcactgtaatagaacatgcagaggaagttaattttggcaaatgctttaaatattagctttgcataataagtataggtgaaactataattaggacagaatgaatcctttggagcctcctttcactctgacccggcaaatgatgactttttgctaataagactactgccatttgacaaaaagccaacttcactaccttgctttattctttagtaaatttaataattacagccactcctgacaatagttctcaaatcagacttgttcaatccagtactgagcttattagggacactcaatgtttagaattctttggccaaaaaagtacttgaagatgatgaaacatgccttagacaagggcacaatgatcactcattttcaccacattaaaaaacacccagagcatgtagtcactacagaccagagaatcatgtgctgttagctcacagctgttcctaaaaggttctgcatttatctggtccttaaaacctttgaggaagtccaaagggaacaacttgatacgtttagagaagggtactgcacagagtatttgatatcaatattaagctaatctatttacatcttttcctttgcttcttttacagtgactgatattggcacagtaaattttgtacaaaatctaaaattaaaacttcctttgaaataagcaaactctattgctttgttcaagaaacatactatattgtcttgaataaaaactgccattttataccttaaatgtgcaaaggtcaactattattttcacataaccatatttttaagtaaaataaacatggtatcttattacgtcaaatctaaaaatataattttaaattgcttatataaattttgtctaattgttttttgctttatactgcttgttatacctcttttatatttgagaaacaatttaaatcttaaattcctatttcaatagtgtatttatgttctagacaacctatctgtaccttctgggttaactggccaaatcaatctaatataccaggagtcagtacactttttctatgaagggccaaataataaatacttttggttttgtgagccacgcaatctctactgttactcaatactgctgttgttatacaaaagtaaccataatgacaatatggatgtatcacaataaaattataaaaacaggcggtagcaatgggccataatttaccaactcctataaaatactattatcaaaagtgctcttaatataaattgtatcctctatctccctttcttaaaaccttcagcaattgctgggttcctctactttacctctatatcttatatatacttctattgttacactcctattacattataaggttatttgcttctattacatctttctcttctatcagagagagaatgctctgaatgcagaaacgtggcttaaaaatgttactgagttaactatgtactaagtaaggattgtacaaagggctttacatatattatcttacttagtacttaaaaaaaccttagaggaaactaatatttgcattttacaaataagaaaacagatatttagcaattgagagtcaaaattcaggtcagactccaaagctatattttttattctatataaattccattatatataaaatatcaaaaagaacttctaagaataatttagccagaagtacatgttgagtatccctaatctgaaaatctgaaatccaaaaattttgagtgttggcatgatgctcaaaggaaatgctcattggagcatttcagattttggattttcagattagggatgctcaactggtaagtataatgcaaatattccaaaaggtgaaaaaatccaaaatctttaacacttctggtcccatgcatttcagataaggaatactgaatttgcataaaagcaatgtcaacatataatattagtaattgtgcatgtgaagttatttctttaattaataatgaacttgtgctatacatacatggttaaacaactacaaagtaagacatactctccttctccaatatttccacccatggcctcaagttataccttgagagaacccaagcaacaatattgtcctgaacagaattcatgttaccttctgttactggctggagtttagaagatcgttctgagtcaggagagtgcagaggctcaggctctttcagactttccaaatgcataaaaggatcataatctacagatgccaaatcagagaggctcatgggaaaataccttggattgctaaaacactgagctccataaacacacccatgtaaaacctgaaaatacagggggaaacacccagttttacttaaaaaataaataaataaataaaagttaaaggaggataaaaatcaactggtaacacaagagcctggcaaagattttaaatattttaaaacatcaggcctggcacagtggctcatgcctgtaatcccagcagggattacagggaggcccagccaggtggatcacttgagatcaggagttccagaccagcctggcaacatggcgaaacgctgtgtctactaaaaatacaaaaattagccaggtgtggtggtgggcgcctgttatcccagctactcaggagactgaggcaagagaattgcttgaatccaggagacggaggttgcagtgagccgagattgagccattgcactccagcctgggtaacaagagtgaaactccgtttcaataaaagaaaaaaaaaaatcaaggtaaaattcaatacctcttacaaagaatgactaaaattaaattatactcatatgtaacaatgatctaattcctctcaaaattttgcaatgaaacaacggtgtcttgtaggaagcacttttaaattacccttaggcactgtaagctaaatatgtgttcttagaaattttctagctctaaaagaataaaaatgttatactgagaaatgttatttctctaggttttaaaaactcttggttaccaaataaataataaagcaaggaagtttaccttataaatgcaattgagaacagatttttctgttttatcgctttctgctcccgtagcatgaaatggttggagcagtgtctttagaggtaaggccatgatccagtccagaaggcagagaagtaaagatactaccaactgtaacaacaatagaatcattataattgtacattcataaaatatatgcttcttaaaaattcattttcttattcttgagtttccaaaatttgtttctggaatcatcaaccctaagttccactattaatatttacccagatctaactgattttaagatattgtatatgaacattattgtgggtttctctttcatatgtcagggcaagcataatgaaacagtaagcataataaaaacagaaatgttaaaattaatataaaaacagcaagcttaaaagacaacacatatcaattaactatacttattccattgcacaaggaatggaacacaaatggaagtccatatatattataatcacttccactttccttttctaacttaacaacatctcactgaatagcctgccagtaagactaccttaagtactttttgaaattgttactcattttactaaatgaatccactgaacacgcttttttgtttttgttttttttcaaagagagggagtcttgctatattgcccaggctggccttgaactcttgggctcaggcaatattccagcctcagacttccaaatagctgggactacaaggtgcacaccatcatgcctggatggacacttttaaactaatgaatgctataaacaggtcactttttatacaaaatgtagaatacaatagcagaattcattgtattaaagaatcacaaatagtgccatgaaactgacaatgaaatagcaacaagagacttgctaatctttaaaaacgaactctccaactcaagtaattctggtctacatctcccaacatatcttccaaaaaataaataaaataaggaacaataagaaggcccaataaaacctcacaaaacaacagcttccatattatcagaagacaaagaacatccaaacttcaaattatctatttttttaatttttatttttgagacagtcttgctctgtcacccaggctggagtgcagtggcatgatctcagctcattgcaaccttcacttcctgggttcaagtgattcttgcacctcagccacctaagtaactgggattacaggcatgtgccactgtgcccggctaagttttgtatttttaggagagacgaggttttgccacgttggccaggctggtcttgaactcctagcctcaagtgatctgtctgccttggcctctcaaagtgctcagattacaggcatgagccactgcaccgagcctcgaattatctgtaagtagaaaaatatgcagcaaatcccagcatctttctcccattctcccactgcaggttttcatgaaaagcaagggtagtttgggaaaaactgtgaaagagagaagatgggaacttgctgtgaatctaagactgatctaaaaccatgccagaaagaaaaagtccaccttaagtgtgagaatattaaaaaagtatactggtagatcagagtagtgagtaaaaagaaaggatgtagaagtacacataggaaaggtaatgcttagggggagaagacaaacaaacccagactgcgaagactatgataaatacctaactcttcaatgcccacacaccaatgaacatcaacaaacatcaagaccatccaggaaaacatgacctcaccaaatgaattaaataaggcaccaatgaccaatcccagagagacagagatgtcacctgacagagaattc

SEQ ID NO: 31 - DNA, 183046 bp, Homo sapiens
tcttgcctcttctagcttctggtggctcgcagccatccttggcattccttggcttgtagcagcatcattctattctctgccctcatcttcacatggccttctctctgcctatgattttctcctgttgatgtgtcctctcctcttataaggaaaccagtcattggacttgggctcaccctaatccagtatgaccccatcttggcttaactaattgcatctgcaaagactatttccaaataagctcaattctgaggtttcggatagaaatgaattttggaggtacgctgtccatctcattacagccattatatggaaagagcctatctgagaaataagccaaaaaggaagctagagggttacgccctggtatgctgtatcagactccccctggactgaccagttatgtaacctggtgaattactcctcccttttttccccccataagctgatttgaagtaacagaaggaaactgattaccactcctccttttgcaaaattaaaaaatcatttacacaggactaatgttccaaacttctccccgctatattcatcctccaaaagtctctgacaaggattgagcaatttcatttggaaattctcttagtgccttggatttacttcatttggctaggaaactaacttattttgacaagcgagatgatctcttacaatgtcttcagccattccttataatttttattgtggaaaattttaaaaatatacaaaaatagagaaaatagtgtaagtctccaagttcccatcaccccacttaaaaaaaaaatcaacatttagccatgtttatttcatctatacccccaacttccctccacctcctgcaggattaaaggaaaattcagataacatgtacagtagtacccgcttatccatcgctttccgatgtctcagttactggaggttaaccgtggcctaaaaatattaaatggaaaatttcagaaataaaaaattcataagttttaaattgcacactgctctgagtagtgtgacgaaatcttgccctgtcccttgccatcccacccaggacatgaatcatccttttttccagcttatccatactgtgtatattgcctgctcattagatagctacccattagtagctgttttggttatcaaataaaaaaaacataggatgatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaacgaaacaccgcatattctcactcataggtgggaattgaacaatgagatcacatggatacaggaaggggaacatcacactctggactgttgtggggtggggggaggggggagggatagcattgggagatatacccaatgctagatgacaagttagtgggtgcagcgcaccagcgtggcacatgtatacatatgtaactaacctgcacaatgtgcacatgtaccctaaaacttaaagtataataataaaagaaaaaagaaaatgtggcacatatacaccatggaatactatgcagccataaaaaaggatgagttcatgtcctttgcagggacatggatgaagctggacaccatcattctcagcaaactaacacaggaacagaaaaccaaacaccgcatgttctcacttgttaagtgggagttgaacaatgagaacacatggacacagggaggggaacatcacacgctggggcctgctgggggttgggggtgctaagggagggatagcatttagagaaatacctaatgtaggtgatgggttggtgagtgcagcaaaccaccacggcacatgtatacctatgtaacaaacctgcacatcctgcacatgtatcccagaacttaaagtataataataataaaaaaggaaatataaaaaagaaaaagaattgtcatcaatcttgaaaaataaaacaaaataaaataaagtcactcttgtacacacacacacacacacacacacacacacacacaaaaacataggatgtatgtagggttcaatacaatcagcagtttccagcatccactgggggtctgagaacatatacccaaggataagggtggactactgtaattaatttaccctcttcaaccactatcctgagcttaaaattcgctcataactgcatttgataagctctgtcgcctgcaagacaaagcaagttactttacacataggaagtggacaattgaggtttgtaaatacagtccctgccctcagaattttcagtctaataggagagaaaagacaagaacctcctccaggtgctcaccaaactttaatgtggatcacctggggagctgttaaaatgcagactctgttcaagtagttaggaactgcattctggagttccaacaagctctcgggcaataccaatgctgctgatccacagatcacactttgagctgcaacgctctaaaccatcatgcaaaggagataatgatagggtgctgtataaggtagagataatgggccacactgtttaagacctggcttgttaaatagcttcccacaattatccaaattaattttttaaatattccagaatgagactaacatcaagccaaccaccagggagccacaaaagaaatattataaactctgggaagagaaggcacagttacctaccagttcaggaaacatatatgatagagagcaaacatgtctagccagctcagggtgactcctttctccacaaacttgcccctctttaggaagggtcctgggtagccatgttgatactgcttgaccccagcctccagccacagctgtctgggccaggggtgagcatgtgacccaagttgggctaatcagatgatttctcctgagaatttagatttgctattccggaaagctagtcggcccctgggtgtggctggaattgagatgatgtaaacattccaccttctgccaatgcacagagaagcaaagaaagctgagagaatgaaacagaccacagacagagaagtggacatagaaatgaaagagaaatacccatattcctgaggcttctttgcccccattctggtctttcctgaagcctattagcatttctgcccatggtttctgtgccttagaactcaatccccttatattaaaaatcgtccaagtgttgtaccagtgagtttcagatctgcaaaagcaaagagactggctgggcgcattgactcacacctgtaatcccagcactttgggaaactgagatgggcaggtcactcgaggtcaggagttcgagaccagactggctaacatggtgaaacccggtctctattaaaaatacagaaattggcctggagcagtggcgggcgcctgtagtcccagctattcaggaagctgaggcacgaagatcacttgaacctgggaggtggaggttgcagtgagccgagatcgggccactgcactgtccagcctggcgacagagtgagactctgtctcaaacaaaaaaacaaaagaaagagactgatgaataaacacagttctacaacaagcaggacaaagtcagagagggagagaaggttaagagcctagaaatgcaggtcagtgtgagtcccccaggtgggtaggtaggagagaggccattcctgataggagtgaagtttcaggaaccagaaaagaaatttccttcctgcaggcagagtggaagccacctggttcatgctccctggctgccgggaattcctcacctgggaactcccctcaaccttcttgtttgtgtaggatcagccatgccagaatgcaccttgttccagtcaagctctggggccacggtagccctgctttactgctgcctgcggtctgggggagctgttcccagctggctgccactctgcccattttcctaatcagcatgccactccccaggtccccagcctggggatgtgtggcttggctgagctgcaggtgggtcccgaagtccatggcgatgatctgtgcccagtccttttgttccaggtagacgaccaacttgtcctgcctttcccaggaccatcccagttataaaatgaaaagtcccaaatctcaagaaccctctcagttctggggaaactggtagggttagtcaccctaattatagagaccccaggtcctcagtggaaactgcctgagcattgtgccctgaagacagcatcccaaccctgaggaccccagacctccaaactctaccctcttaaggagtcccacacaactggatattcctgaaacccccatatctctccatagacctgtgtgcagtatgagtcagattagattctgaagcctcccagtcttgaactgggtgacccggacatgttacctaacttcactgtgtcttatctggaaagtaatatccaaaatagcacatgtgcctcatgggatcatgggagtattgcctgggaattcccctcgacttcctgattgtgtcaggaccagccatatgccagaaagcaccttgttcccatcaagctctggggccacagagtccctgccagctgaggctgtagtttggccccatagaaagttttattctctcagctttaattttcaaaatattctgactatataaaagtcagcagttactttcatgaccttaccctaatctagtcattgcctcctccttcccatggcccacctcccactctgttgggtacacatcagagtgccagtggtatggcacagtttctgcacaggcagtgggaggacccaggctgcctgcagaggcttcacctagtccttcctctctctggtgttagaccagggcccgatttctgtaatctccaggctgaatccctggagggggaaagctcatggagctagttagaagggcctagcaggaaaggggctgtcaaaggacttcagttgcttggccagcactctgatacgagcagaggaccctgcgtctctggtccccatgttcttacacctgtcagcaagaagttccagctcaggagggactgtcccctgtgaaccctggaaatacggaagaggcatgagcacattttatgcatgcacagtgggggcagctgatgaagtccttgcagccagctctcccacctgacaattgtcacatgggggtgagggctgtctgctcacaaaggcaacctggcccacatagatttcttaattgctgttcaccacagagaagtgtatacactaatacgggcattgtatgtcccaacgacagcaaatcccaaagccccggtgctgggtttcaggccctttaaggagaaaaccccagaagtgcatggaagtctcaccacctcctctgcgccagccacactgagtcggctctcaaaggcctcttgtgactgtcctttctctcatctttccccacgttgataaatgttctgggattagcccttctgtgtttattggatgagcaatttgtgtctgtctgaaaagctacatctgaatactatttggcatgagctgaagaaatgtgatctgctgcattcccctccagccaactctctggagctagcctgtctcctgccagcagggcctacagctcttcagcagggtctggcagcctcacacgtttgctgaggggagtggttgcacgcaggaaggtggaggaggtgcctagggtgggaccgggaacccagagagacagaggcaaagcaccttagcaaattggccagtagatctagagcccctctaataatttagggacatcacagatgtgtgtggtgagccccaagccctagggacaggaaaagcaggtcccccatacagctcaggagcctgagtggtttcctgagcccagtgtcctgggtatgaactgcagcagaggtgattcaagagagtccagtgggtagcatcccagatcccaggtctgggagggattagtgttgagctcttgagatttgtgtgtttgtgtgggatgaaatgggagagaatgggcaggagggttggggagggcggtagaataagctgtaccgaggctattcaaatgtttcctgactccatcagcacaggtcctggaattgggaggccagagcttgcagctgtggcaatcaagggcccagttaaaatacgctaaggagtgtaggggaagagagaatttagttggtatggatgtgggtgtgtcaacgactttccctagcccatattccccaacccaagccttctgctgtgaccccctcagcactctccctgctattctcttcgggccacatcacttctccttgtatcccatcactcatgtctttgtcttccctctacctcttccctacccttcccaagtcagggatcccagggcaggacaccatccttgtgttcctgatagtgagcattgaactggccaccaatgaggcatcaataatggtttcctgaataaaggaataaatgagagaggctgggaattcaaacttcagtggccacaggttcacaagaagatgacaaatgacagatcagacagaggtaacaatacaggagatcagctcaggagtgaaaacatcatccttggagtgcaaaggagtaggtaaagccagctcatgacaggaacttgggcacttcagcagccagagtccatctgatgaatggcaaatggtgtttcacatggttccaaatagtcagcaaacagcttttgaatccctactttgtaccatactccataggacaccatctgtctccacaagcagttaaaaaatatgtgcactcctaaaaagataggagcaatctgtgctctaacagaggtgtacagagagggttatatagattcagaaaaggaagaggttaatttcacttggagaagcaaggaaggtttcctggggatgggggtgacgttagacctgaatctggaacaaggtctgcaaatgcatcccaagtgtgctgtttcccctacacacacacccaatctgtacatctatagtggatttttgcaaactgatccttttactttttactctttagacttgtgggtgaggtttgtgaatggagaacagcggatggtgtggctgaaaaaataggttgaagcaatatctggattaggattttgtcaagctaaggaatgcgggctcaggcttgcagagggagagggacttacatagctgtgttcaggaagacattctggcagcagcgcacagggagggctggggtgggaggtgggcagaccagccagacgtctgtcccaggcaacaagtgatgaggcctcctctgagctcctgccatacttggctgaaacatctgtttgacactcatcccactgtctctcttggagctgccttttgatagcatgacggccccacaagcctgcgggttccttgacagcaggggctgtttgttgccccaggcctgacatggttcttggcaggtgctcattatatatttgtgaagttactgaatagggcagtgaaaaaaggacaagaggcatacagagaagggcacagatttccgggataacattctgtttagcaagtggagttcccgtggcctgggcattgacacagctgtcttttggtgtgtgtggagaagtataggcatgtgcaggcagcccaggcagagaaggagccacagctccctccagttggagtgggagctgctgtcattctatttgtgtgtgcatgcatgtgtatgtgtgtctcagagacggacttgcacagagtgtttggcttttcagagagacctggacagacagacaggagacttcatgatttactatcctaagatgtcttgagaggtatattaaaactcttctttttttttttttacatgagacaggcggtctcactatgttgtccaggctggattcgaacttctgggctaaagcaatcctcccacttcagcctcccaagtagctggagttcaggcacatgccattgcacccagctaaagctcttttttggttgcaagtgaatagaaactcaacacaagcaagcttagggaaaatcagatatttattggctggctcataggatgcatttgggggtagccggaaccagggattccaacaataccagactctagcatctgcttctctctccacccattagcctcattctggcagcctggcttcctcaaggctggaaacacggctgccagtagcctgggtctcacatttgagagcttccacccaagaggcaccaaaggctttctttctcaagtcccaatgacaaaggtcccaggaaaagactctgattgagtctccttgtgtcagggacctgtccctggcctaggaccaagaacagtagataaagaagcagggtcatgtaagaaggaaataccttccaacaaaacctcattattggagtgggaaaaggagcaatttccagaggctcctgtcttttacgtatgttaattaccttgcaaaactccaataggtattactgttgtaatctttattatccttgggaattattaccttagaaaaccaaggcacagagagggttaagcaactgccatagatcacccaattaataaatggctagaacttttttttttgagatggagtcttgctctgtcacccaggctggagtgcaatggtgcgatctcagctcactgcaacctctgcctcccgggttcaagccattctcctgcctcagcctcccaagtagctgggattacaggcatgcgccaccacacccagctaactgttgtatttttagtagtgatggggtttccccatgttggctaggctggtcttgaactcctgacctcaggtgatccacccaccttggcctcccaaagtgctgggattacaggcgtgagccatcgcgcctggccaaatggctagagttgataaatagctagctaataaatggttagcagagatggagttcggatctaaattcattcaattgatcttcccctgtatcttcctgttgtgttatagtgcctattcaccacgggagggaaaaaagcaaggtgcagagattcgaggaagggacaaagataattctcctgggaacagccaagggctgggctgaggagcctgtgggaagtgattgattcagtgtcaccaggggaatcaggaataagaaaccccaccacccatcaatctcatggcagagatctgaaaagggacatttcgtgctgacttctccatccttcttccatcttaacttacttaaagtaaaatttgatgaagccaaggaaagcaaataaaagaacagtgaggtcccattttaacctattaaaaatttaagcaggactataatagtcgtgctggcaggggtggggaaatggcttgcttctaaatggctggtgacaagctaaagtggtccaacctgtgaaaaacaatttatttggtcatgagggttaagagctacaaaagctttctttatttttgacccagtaatcttactttttagaaacaactcctggagtcacaaaataaaatgcaattagtgtcatgtgcaagagatacatctaaaacagtgtttctcagaaagatcaaaagtaaaaggataggaaaaaatagaaagcaaaaataaacgccgtacatgcaaatacatgcaacaagaaaacagacgttactgccgggcatggtggctcacacctgtaatcccagcactttgggaggccgaggcgggcagatcacctgaggttgggaattcaagaccagcctgaccaacatggagaaaccccgtctctactaaaaatacaaaattagctgggcgtggtggcgcacgcctataatcccagctactcgggagactgaggcaggagaattacttgaacccgggaggtggagggtggaggttgcagtgagccaagatcgcaccattacactccagcctgggcaacaagagcaaaactgtctcaaaaaaaaaaaaaagaaaaaaaagaaaagaaaaagaaaacagaggttacaatgttaatatcagacatggttgaattcaccaaaaaaaaagaaaaatcagaaaacaagacacagaagaacaccttgtaatgataaaggctgaaagctacgatgaagatgtcatgcatttttatgcataaaatatagcaacagaatttataaagcaaaaaatgggaactacatggagaaacagaaatataataatagaaggaaattttaattcatttctcttagcccacgactcatcagtaaaccatacagtaaataaggatatagatgacttgatttgttaatttataaggtagattgaattaaaatatattaaacttcaaagtcgggcttggtggctctggcctgtaaccccagcactttgggaggctgaggtgggtggaatggttgagcccaggagtttgataccagcctgggaaacatggtgaaaccctgctctacaaaagtgtacaaaaattagctgggcatggtggcaccactgtgccatgacccccccagggggtctacagaggcagcagcaactccatatcctttggtgtgtttttcctcctgcacctggcagatggcacccttcatgcctgataactttatcaactaattcattaatccatgacagacatgtcaacaattacaaaaatagctttagagaaacatgcaaaaatgcagtggggacccaggaagaggagtatctaagcctcactggcttggagcaggactttgagtgagtaggaaaaagacttggggctgaagaaagaaaacgcagttatagagtagagcttgagtcccctgcagcttcttgtaaggctgaaccactgtttcccacaaggccatgcccagtggctggaacacagcaactatgaagctcctctagagggttctctgcaaatccttctctctgcctcagccttcccagccttaaatcattggtcagagctttttccctaaggagcactgagatttgccagagtcctaaagtgagcagtaatggagcagaaattaggagccgaatgaattatagtcctagcgtttctattcttaactcctaggcttttatggagctcttagggttgagctgcattttgaaagcccacacatggaatacatggtgggtacaagtgactcaccattagaaaaaattaagttagggccccaagtcatggctgacactagaataaattccagatggcttaaagatttgaatgtaaaacatgaaatcataaaaatagtaaaataagaaaataggaaatttataattttggaaaggagggagaatacagatcattttaagtttaacaccaaggcaggtaagaaggaaaagattgatagtagtgcaaaaaaagtcctgcaccagaagactatttcaaaagtgcaaaaatagaaatagagttaagaaagaactctaccctaatgtcagagttgtttgatacaaagaaaagagggccttgggctactccttggggtgcttaattgagcaactgtatctagagtatttgtgccaactgtccccttacttctgacacttgtactaatcagccagctgcagtggagattttctccgcaccaaaccagtgaatgccccaggtagcaactatccccactggagtaagaaactgggtgtgctgaaagacatgatggattctcttcttcctgacatacgtgccccatgtatacgtccaatcaacacattcttcttcccacaaaattactttcttttttttttccttttcctttttctgtttagagacagtatctcactatgttgtccaggttgatctcaaactcctgagctcaagtgatcctcctgtctcagcttccttagtagctgggattatgggcacgccactggcccagcagctcccacaaaattatgacattcaggctccggaaacagaacagacaagaacaagaatgcactagattcatacagtgactcatacctgtaatcccagcattattgtaatacctcctacctgtaattccagcactttgggaggctaagatgggagggtcacttacttgagcctgggacgtcaaggctgcagtgagccatgattatgtcactgcactccagcctgggtgacagagtgagaccctgtctcaaaaaaaaaaaaaaatgcacaatttaaaaatgatcaaacagattgggcacggtggctcacgcctgtaatcccagtactttgggaggccgaggtgggcggatcacgaggtcaggagattcagaccatcctggctaacacagtgaaacccgtctctactaaaaaaaaaaaaaaaaaaaaatacaaaaaattagctggggccgggcgtggtggctcctccctgtaatcccagcactctgggaggccgaggcaggcggatcacgaggacaggatatcgagaccgtcctggctaacacggagaaaccccgtctctattaaaactacaaaaaattagctgggcgtggtggcgggtgcctgtagtcccagctactcgggaggctgaggcaggagaatcacttgaacccgggaggcggagcttgcagtgagccaaaatcatgccactgcactccagcctgggcgacagagctagactccgtatcaaaaaaaaaaaaaaaaaaaaaaaaaaatagccgggcttggtggcatgcgccagtagtcccagctactcgggagactgaggcaggagaaatgcttgaacccgggaggcggaggttgcggtgagccaagatcgcacaactgcactccagcctggcaatgaagcgttactccgtctcaaaaagaaaaacaaaaacaaaaaacacaaatatctagagttactaaacagttgggtaaaattaacactatgaaacagagccatcaaaatccatctgtaggccaggtgcagtagctcacatttataatcccagtactttgggaggccaaggtgggaggatcgcttgagcccaggagtttgcaaccagcctaggcaacatagggagaccccatttttacaaaattttgtttttattagctaggtgtggtggcacacacctgtagtctcagctattcaggaggctgaagtagaagggtcacttgagctcaggagtttgagactgcagtgagccacagtctcaccactgcactccagtctgggcgacagagtgagaccctgtctcaaaaataaaaaattaaaaatccactgtgggaaaccagaatatgccatccccaaaacatgccactctgatgtaaggattattttgagttgaaggcactagagaagaagatttacaaagacaaaggtgtcttcctaccctctctgtcaggaaagacaaaagttaaccaccagagacaactttagagcttaacagcctggagatggcaccaaaggaatctacgtagcaagctctactaaatagcctgtaactgacacttatttgccgtcccacaatttgcagcccttagaagttcaatgcccttttcccttgtcttgccacttctctaaaaatttactgttctttgttgaagatgctatatgaactggaattccaagccacctctttgaggcctgttcattccctgggtatttcagatgtatatacaaaatatacatgctaatacacttgtttgtttttctctcattaatctgtcttttcttataggggttcattccaactaagaatttatgagagttgaggaaaaaattaattttagttccttacactgccatctgaaaaacaaacacctaagaatgagaattaatgagtactagcagagcaagtctttagattaagcataattaatatctcaacaagatacgtgaaaagatatttcatttgctaaaaggaattaggccaggcatggtagctcatgcctgtaatcctagcactttgggaggccaaggtaggaggattgcttgagtctgggagtttgagaccggcctgggcaacatagcaagattccatctctacaaaaaatttaaaaattatctgggtgtggtggtgtgtgcctgtagttccagctagtcaggaggctgaggtggaaggatcacttgagcccaggagttcgaggttgcagtgagctctgatcttgccactgcacttcagcctaggccacagagcgagatcctatctcaaaataaattaaaaaatggaatgaactaaagatcgatttagaattcagtttcccaaataaaaatttaatgggcttaataacaaaatagatacagctgaagagtgaataatagagttgaaagatcaagcagctaagaaattcaggagaataaaaaacggccaggtgttggctcacgcctgtaatccctgcactttgggagtttgaggcgggcagatcacctgaggccggaagttcgagaccggcctggccaacatggcaaaaccgtctctactaaaaattaaaattagccaggcatggtggtgcatgcctgtaaccccagctacttgggaggctgaggcatgagaattacttgaacccaggaggtggaggttgcagtgagccaagattgcaccactacactctagcctgtctcaaaaaaaaaaaaaaaaattctcataaaatgcagttagaaagaacagaggtgagaagtataaaagaaaaattaggaagtatggaggatgaatccagaagttctatcatactatttaacaggaattccagcataaggaaacagaggaaatggaggaggaaaaataaagaaataaataatggaatattttctggaggtgaaaaaacacaaaagctttcacattgaaatgacccactgtagaccaagaagaataaacaaaacaaaacaaaaaagacttacacccagattaactatgatcaaatttcagaataccaaacataaaggaaataccaagcaactttgttttattccctcacatttgtaagtgaatttttctaggaagaggattcacaacaattagtcaattctcaagtaagtaaccaaaaggaaagtttaagaaccactgccctctatgaaggcagcttctccaagcagggaatctggaaagaagcttaacccctaagtgtagaccttcccccaaaggttgcgaagtttgctccacacatctagttccatttactctttttttttttcacacctgaagaaggaaagtttggccaagctcaaaaccataatgtccttagttcagacaacaaattattacactttcttctttctgggaaaaacatgtgcaaagattttccctcggaaatgtgcctgtttttaaaagtctctaaaactcaagagtgctagcatttgctactctgaagatctagccaggaaaatgggggcaaagggagggccatgaaagcccactgtgtccttttagtgttggggacgtgaagacacaggcctgatcagtgtacaaggccaggactgggaggctggaaacttgggttagagccctggctccactacttccaactgtgtcatccaggccaatccctttttactgtttccttgtcagtgaaataggaacatacttgttctgtctctcagaatagttctggggctaagatggtaaaacaatgaagacactctctgagacctcaagttctaaaccaagggtcacttaggcaagtgccttccagagccagataggtaatgcaactttgtgaattggccacattagaaaatggtgggaacccaggattgatttatgatatggtttggctgtttccccacccaaatctcgtctggaattttaatccccatagttcctatatgtggtgggagggaggtgattggataatgggagcagtttcccccatgctattctcatgatagtgagttctcatgagatctaatggttttctaagcatctggcatttcccctgcttgcacttctctctcctgccaccatgtaaagaaggcccttgcttccccttcaccttccgccacgattgtaagtttcctgaggcctcctcagccatgtggaactgtgagtcaattatacctctttcctttataaattactcagtctcaggtatttgtttatagcagtgtgagaacggactactgcaattcattgttgggcatgctgaatctaaggtgcatacagggaaatatagttctaaactacgttctaggaaccttagttccaggaaatattaatatcccaggaaaaaaggtgggggaccgttgagggtcgttcagtttccctagaaaacaaagcctggggcaatggttatatgctgatgtttttaatgaaggcacaaatccagagcctcaagagtgatataaaagggagggctgggaaatgatgcaagatgcttggaggagccagcggctcctggcagcagctggctggccacagaactccagagttggctgcagtggcaacagttaaggaaatgcaaaaggctaggatccaggacttaggcaggctaagagaacctatgaaaacacgtagaatgtgtccaacataaatgtcaaacaaaattaagaaacactaggtactacatgccgcctcttagaaatccgcaatgcatattagcacatttaacagttctagaagtacctcagcaaggaaaccagtttcattttatttgatccagcatttcccaagcttatttgaccacagaacctttctttcacgcactgctcatctgtagaactcagttctggtcagctatgaatactggaatttggggcttaggaaagaggatagattatagatatgaatttgagattaatagtgattaaagccaggagaataaaggagatcatcctggaagagtttctacaatgatcctaagcttgagtcctggcatacatcaatatttaagggacaaacataggaagaagatccctgaagagagaaagggaagaaaccattgtagaattaggagaatcaggaaccatcactaggtagtaatgacagttaattttaggtgtcaacttgactggattaaaaaattcctagaggctgggcgccgtggctcacgcctgtaatcccagcactttgggaggctgaggcgagtggatcacgaggtcaggagactgagatcatcctggctaatgtggtgaaaccccgtctctactaaaaatacaaaaaaaattagccaggcacggtggcgggagcctgtagtcccagctgctcaggaggctgaggcaggagaatggtgtgaacccgggaggcggagcttgcagtgagccgagatcgcgccaccgcactccagcctgggcgacagactgagactctgtctcaaaaaaaaaaaaaaaaaaaaaaattcctagaaatctggtaaagcattattttgggatgtgtaagtgtgtgattctgagtgaattctgtggagaagatccacccttaaggtggggggacagcatccaatctgctgagaatccagagagaacaaaaacagagaaaaggtgaatgtgttcatctatctgctggaactggggtacactcttcctctcctctccttggacaacaactctgggctccccagccttttgattccaggacttaacaccagaggcccctgggttctcaggcctttggccttagactgggaattatgccttcagcttgcctggttctgaggcctttggatttggactcagccacaccaacagcttccctggttctccagctcgcagacagcttgtggcaggacttctcagcctccgtaatcacatgagacaatcccccgaatgatgctcctctcatatgtcaatgtaaactaaaaatacaaccctaaaccccccagcccactgaacagatcccctcttgtccaacgggaccccagaaaaaccttaaaaatggagttcccagtcatgacaggacaggtcagacaagcctcgttataccccctctcttttgcaatgtagacagaacaactgatcagcattaatattaaaattgagaccataaggctgacagaatggactgtttgtaggaataagagaccgtacaggtcaccctgacccagtgtatcatgtcttgctcttgcagcccgactctggcatagcatcccatgatggttagcagatttcttaactaatgtatgttaaaattaaacctaaacattccttcatgctgactccaagattttagacaaagccttactcctttacccaattgcaaattaaagaatctctcaatctacttatgacctgcaagcccccacttcaagatgtcccacccttttgggccaaaccaaagtataatctccatgtattgatttatgactttgcctgtaacttctgcttccccaaaatgtataaaacagagttgcattgtgactgccttgggagcacgtactcgaggctctgggtttgtattttccccaggctgcagtcactcatactggttcaaaataaacctctttaaaacatagtatatattacagagtttttttttttccattgacagtttctctctatagatacagacacagatacagtagatattgatatatattgattctgtctctctggagaacactgactaatacaatagttaaagtagaaaggaatttatgaccaggtataggtgagcagaggacaccccaggcttgagttactaagaaatccatcttcccgatcaggcattaccctagagcttgttagagatgtaaaatcttatatgtcatggcagatctactgaatcaaaatctgcgttttatctagatttttcaggccattcatatgaacattaaagtttgaaaagttctgtcttacaacattactagcagggctggaggggtagacttaaaatggagcttccagaaataattgtaaaccctaagaatcatcacggttctgccatcactgatcatgaaagaacctgccaccactcctgccacaggaagctactgggccagaaaccagtactgattggggactacaaaatcaatctgccacaatccacatcagcaaaatgaatgccctacctgcatcctctctctccagttaacttagtttcaggttcaagttacatgcaagtttatagaatgataattcctaagctcatttggattgccagctgcaatggagtgtaggaagtgtgacatcccagctgtaatgtactggaaggagatgggaagggatgttatgtgaaccagtccgtagaatccaccattggtggtgtcatggaagctctgacatgagcttctttatatccctccgtatcttttctccccctcattcatggtaatccaatttttagctaaataaggactacatttcccagcctctctgcagatagatatgaccatgtgactgagtttgggtcaataatataaaagtggaaatgtcccagcactttgggaggccaaggcgggcagatcatgaggtcaggagatcaagaccatcctggctaacacagtgaaaccccgtctctactaaaaatacaaaaaattagccaggcatggtggcacatgtttgtaatcccagctactccggaggctgaggcaggagaatggcgtgaacctgaaaggcagaggttgcagtgagctgagatcataccactgcactccagccttggcaacagagtgagactacgactcagaaaaaaaaacaaaaagtggaaatgtcacatagcagcttctaggaatctttgagagaaagtaggatcatgtcctttacattcatcttttttcctccctccattgtgctgtttggagcatgagatggtaccgtcttagactaggaggttgagggctacaccctaggagttggcagagctttgagttaggaagaacctgaggccaggtgcaatggctcacgcctgtaatcccaacattttgggagatggaggcgggtggattgcttgagtccaagagttcaagaccagactaggcaacacggcaaaaccccatctctactagaaaaaaaaaaaaaattagaaaggcatgctggcacatgcctatagtcccagctactcaggaggctgaggcgggatcgcttgagcccaagaggacaaggctgcagtgagccgtgatcacaccactgcataccagcctgagcaacagagctagactttgtctccaaaaaaaaaaagagtataatcaacaggcaatagctgatagaaaaagtaaggcctgagaagtggcccctggatttggccctagactgttgatgacattagcaagagcagtttcagtagaaggggcagggcagaagctagactagagactgctgggagaatgagaatcgagaaagtagagggagcaagtactgtcaaccactttgagcagcatgacatggtgatcaggagacagtgaaggctgtgggctccatggagggttttcctggcttttctctacttttaggaccagggcagacagagcaagggtggcctgggatatccaatgtcattcagtgttgcagcccatctggtggctgtggccttcatagccctggaaatgctgatgctgtctcagaaacaaggggatagtgggaacctggaataaaggaggctggaggatgatttaggctcagccagagtagatgctgttaagtccttcccgttgggctgctccacactggggtgcctctgggcatccttcagcgagaggctgcccctagtgtcccctccctccccgcctctggtgctgccggctgcatcccaggcctggaaccaacatgccgaacagcctcagcacatctgcatagctgacgtcaaagcagaccacagtttgtcctctggggaggaaagggaaccacagtatgtgtgttggtttctcttctatctgaaagctctttcgcccttttctgcactcaggcccctggctagctttcctgatgtgcctctgggattcttccccttggcacctcctcaaccccgccctgcagtcccaggtttatccgtttcttgtcaccttgtgctcagctgggaacccctccctgccttttcacatcccttacatcactccctgaacacactagtcacttacgtcctctccttcttcaactttctttcctctcaaatgataaaaccaccttcccaatcaaagatttattgtgcagggaagttttcccagctccccacggtagtgagattagccaaaggcgaatcacatgggggaaactggagaaggaaatggcccagatttacaccagagctgtggggagcagaaccagcagccaatcacagaggatcctccctgagtggctgaccctttgcggggacataaagtgtccatttatctcctatcttgggaagaagtgagggtcctcacgagggcctggcacttgccagtctgccaattgctgggacgaatctcaggttttattagcccctcaatggtctcatgtatccaaggagaaagtgagggtcccatgtctgagcccaagcaggggttgctctcaccttggcagctccccatctccaggatgtgctcttgctactctggaatatggcagcctctgcaagtgatactgggcttacaacacagaaagtgtctcaaaaaacttataagcatccctcagaaacctctcctgctccccactcctggggccccatcaaaacccagcttccagtgttttaaatcaaaatatagcagccacagaaagccttcaggattgataagagttgagccaagcagattcaaatagcagtaggtctggtaccctacaatggtcttgccctcctctgaccaatatgtcctggatgaggaggaagaattcagcaaaaggagcaagcttccctcaaggtgcttaggaaaaaatacacactctggacactgaaaagcttggggctgatcctatccctgccactgctgactttgggttcttttttttgagacaagatctcaccacgttgcccaggtgggtgtcatgaactcctgggctcaagtgatcctcctgcgtcagcctcctgtgtggctgggactatcggcgtgagcccactgtacctgactcctatgggtatatttttaacttctttgagtttccactttctcaattgtaaaacaaggcttatatttccttttacctaaaattgtaaaaaattaaatgaaattatgcatgcacagttcttgacttttattaagttactaacctgcttgaaggtaaagcttcagaataacttcttgtttcccattttcagaaattctctcctctctgctttcggcttacctttctcttctcttatcattttcttccccagcacctggaaggtctcctaggtccctgctattcaaaggttcagggcaagcagtatcacttaggacctttttagaaatgcagaatctcagggcccaccacagaccctctctgaatctgaatcggcattttaacaagattcccaagtttttctctgtgcatactaaactttgagacgtgcttgtactagatcacccctttcttctttaatttatgacatcaaatagcactggtttcaataattcacaccactaacaggagtttccccccagcaaattgcatactacttactaaaatctccttgattatgatactggagtaacaataagtcataatattaatgaaaattatagcacagtgtaacatgtgtttaatgctttggtatttacaacatgcttttatacccacataatctcatctgattctagaatatggaatagttatcaatcagtgaattgatgaatgaatgaatgacttggggctatttggtggagagaaactggattataagaggattttgaggttatatcagtgaagaattttgctcagctgctactaagagagatccaagtcaacagtggtctaaataagacagggtcttagttttctcctaggaaaggccaggcaggtatggggactctatctacaaggtctccagattagaattattttgtcttctgctctgctatctgtggcacatgactttactccttaagatcacctcacggataaaaaatgactgctagggcctcacccatcaagtccatgtcccagggaggtaaaggaagaatgatggggggaaagatgaagtggtacttgctagctaagttagcctcctttatacagctttctcaaaacgccacccaatcacttccccttacttctcattagccatccctatctgcaaggaaaatgtagtcttagctaagactaggcacattgctgcccccaatataggagtaaggaaggtgggatagtggctataaggaagaaaactagcattcttcctatggcatgaatgacaggagcatgaatgaaagggagagattgatatacaaatcatgttcagtgtgccaaggcctttctggaagtgtttcgtatttctccttatgtaatggctcaacaaggaaaagagtcaggacaggatggagtggtctctgctgggctgcttctggggaaaaagaaaatgtctttcactgatgtattagctgagggcccaaagttgggtaatgtgagaaaccaggactctcagctggcccaactcagctgaagtattgctctctcttcaaaagatgctggcttaatgatggagttatcatcactcatgctcttcttcctatatgggatgctcccctcactctacatctgaattcccagctccttctacgcaactcccactcagtcctcagttcttagctcataggttcttttttcttttttttctcttgctctgtcgcccgggctggagtgcagtggcgcaatctcggctcactgcaagctctgcctcccgggttcatgccattctcctgcctcagcctcccaagtagctgggactacaggcgcccaccacgatgcctggctaattttttgtatttttagtagaaatggggtttcaccatgttagccagcatggtctcgatctcctgacctcatgatctgcccgcctcggcctcccaaagtgctgggattacaggcatgagccacctcacctggccaaagctcatatgttctcataaccttgttacatgttctcataaacctggaatttggtcaggtgtggtggcttacgcctgtaatcctagcactttgagaggctgaggcaggaggattgcttgagcccaggagttcaagatcagcttgggaaacatagtggtatcctgtctctacaaaaaaaattaaaaaattagctgggtgtggtggtacacacctgtaatcctagctacttgagaggctgaggcgggaggattgcttgagcccaggggatcgaatttgcagtgatccatgtttgtgtcactgtattccagcctaggtgacagtgcgagaccttgtctcaaaaaacaaaaacaaaaaaacccttgaaatttacttgtttgagatctgttcctgccccagtcttttattctacctccaagtagaaggtccctgaggggagataccatgtctatcctattcatcagtgaatttcaagcattttgtactgtacccagaacacagtagttgctccacaaatattttctgaatgaataaatatatcttataataaagttcatactatttcttagcgatctttggattgtaattaacaaaaatctacctaaactagtttaatcaagaaggggaacttatttataatgatactggaacatctcatagagacaagggactagattatagcctagcctcaggaatggagtagaactagaaactcaaatgccactgggaatctttctgtttgtcattctctctcataaaaccagattcttctgcttgttactcctatatagtaaggaaaatatggctgccaagagcacctaactgttatatgttgttgggccaatcagctggaggggagttaatatagctctctgttctctctttcttcaatattccagcatggctcaggtgcctgaccctggaccaatcaagtgacaaagggtcagggtcatattgtagaaacatggcagctcccactacaaccttgtggtttgggtatgggagagttgtttcctggaaaagaggttttaggaagacaaaaaaaatgggtgtccattggagcgagcatcactcatccctgccccagcactggctccttgaccatagctctagcatttccttagattgatgcctggatccctagcacctccaatgggtcttgagggcccttgccagaggcctctgatagtttctaatccgattctttgtttactcccctgaaccattttcccccaataatgccagtatttagagataccatgggtgcttgagacttcacagggaggaagaggcagcctggcctcctcaagatccaagagatcttgctgggctttactgcctgcagaaggtgacagtggagtcaggagagctgttggacaaggacagacctcaggtgggggcagctctcttcatgatttccttcaactagcaccctactcctcttacatctggtcatcatgcagctgtgagggatgggcctccataaccatctgacaaatgaggaaactgaggtccttaaagggggcaggacatgagcatggtcatttaacagatgtctcagttcattatgtattgctataacagaacatctcaggctgggtagtttataaagaaatttatttctcacagttcaggaggctgggaagtccaatatcaaggtgttggcatctggtgagggccttcatgctgcatcatcccctcatgaaaggtggaaaggcaagaggggtgaaagcaagagtgcaaaagtgtgctgaactcacttttcttacagacccaatctctcaagaactaatccactcctgagataatgacattaattcattcattagggcagagcctccacaacctaatcacctcttattcagccccatctccaacactgttgcattgggtattaagtttccaacacataaacttgggggacaccttcaaaccatagcaatagataaatagcaaagaaaacacttgaacttaagcttcccttctttatgctccagctatagggactggatgagtttaacatctcttctgcagagacaatgctgtgttcaacagatatagactacgtttcccaggatcccttgcatgtaggtatgttgtgtgactgagttctgccaatggaaggaggtggaagagatgcataccactttcacatttggccatgaaatattctacacacttaagctgggtgcagtggctcatgcctgtaatcccagcactttgggaggccaaggcgggtggatcacctgaggtcaggagttcgagaccagccatggccaacatggtgaaaccctgtctctactaaaaacacaaaaaattagctgggcgtgatgacagacgcttataatcccagctattccggaggttgaggcagaagaatcgcttgaactggggaggtggaggttgaagtgagccaagatcgtgccactgtactctagcccgggtgacagagcgagactccatcttaaaaaaaaaaaaaaattctacacactatctcctccacctgtgaggctggaagcaaaagggtctgagaatggtgaaacctcctaatggaagaaggccaaatctctgatttcacccaggagagagttccctatcaagatctgcattggattttgctgaagcaagtaatcaatctttactcttaagccactaagattttgaggctataagttcttatacatagcctagcatacccagactagcacatctctgatggagcccctcttctccacaaagagttagacttgatctcccacagcactgtatctgccccagccctcaccaccttctcccctgacaaagacccaaagtacagttttgcaattagaaacacagaccttaggtctcctcagaactgagtctgaactccaggtccacctcagacagacctaagcaggtttcttgacctctttaagactgtttctgcatctgtagagatggtacccatgtcaaaatgtggttgtaaggattaaacgagatattatataatcaatggttcacaataagatgatgccactctctgaggacaggggattggaagtttgtagggccatttttagttgtaatgatgattgtggaacccttctggctagggatgctagaggtactgtgacagggcactcccacacaatgataaattgttgcttgttccccacacctttcatatggttcatcattcatttgtctgacattacaattacatgagcctagaacctaactcttacatataatcacaaaatattgttgtgtggctttaattgacttttaatttattgattcttactttttaattgcaatgaggtctctctgtgtttccccggctggtcttgcactcctgggctcaagcaatcttcctgtctcagcctcctgattatctagaattacaggtgcatgctgccacacccagctgtgtggttttaagatatattaaatagtccaggaatatccaagggtgtggacaaggatggggaagacagaagggatatggcagaaacccaggtctggcaggagcagagctatcaccaccactatgcccagggagtgaggggtgggagattactagaacctggaagaagagtgtatgttgcagagtgggcggagtgttgcagaaagtgttcatttcctagggctgccataacaaattactgcaaacttggtgacttaaaacagaaaaaagattctcaaatttccagaggccaaaagtttaaaatcaaagcaaggtcacattcctttcaaaggccccagggaagaatcctgctcttccagcttccaagggctccttggcttgtggctgcataactccaatctgtgcctccatcctcatgcagccatctcttcttctctgatttctcttctgtctcttataaagatacttgtgattagattcagggcccacccagatcatacagcacgatcttatcttgagatcctgaattacatcagcaaagatcctttctccaaataaggtcatgttcacaggttctgggagtcaaaacgtgggcatatctttttgggggcccccattcaatccaccatggccactgtattagtctgttctcacattgctataaagaaatacctaagactgggtaatttataaagaaaagaggtttaattgactcacagttctgcaggctgtacaggaagcatgacgctagcatttgcttggcttctgaggaggcctcaggaaacttacaattttgtagagatgaggtgtaactatattgcccaggctggtctcaaattcctggactcaagtgatcctctgtttccacctctgggtggagctatgagtcacctacacctgtaattctcaatgttatgtgatctaaagcccctttcttataataaatattttgcgacaccacctttagcctacataggtaatataaccaaagtacatcatggcttcataaaattaggccataatatgtcacaattaatgtaaaggtgaattaaaataaatgtttaacacaaggatgtatatttcaacatgtaaatgcttggacagacccctgctagaagatataataagtagtcataagcttgtaccttacacagaatcttcgtgactgtgcaacagttacaagtgcagactgatacagtgtgttacataagcaggcacgtcacatggccagagcaggagcaagagagagaggggaaaggtgacacacacttttaaaccaccaaatctcatgagaactcactatttttagaacaataccaagaggatggtgttaaagcatgcatgagaaatccatccccatgatccaatcacctcccaccaggccccaccttcaacattggggattacaattcgacatgagatttgggtggggacacagatccaaaccatatcagccatcttgagagcagcagtgatatatagcagcagtttgaggtatatagccaaggaggtagccagagaaataaatgtcccaatcttcctttcttccctcggtccatctcctaccagggctctcataaaccagagggcgtgaacatggttggtgggtcaggctcccagggctggcagcagagtagaaagggaaggagcacgtatctggagggacaaacaaaactgatagtagcccaccatgtaaatcaagggaagattggactcttatttagaactctagtaagagagttctcttgcagtaaatcatagttgaatgggaatgggactggtggtatttgagccagtcatgtaacagacctgtatcagttggcacttgtaactgttgcacattcacagggattctgtgtaaggtacaagcatatgactactatatcttctaggaggggtctgtccaagcatttacatgttgaagtatacaaccttgtgctatacatttttcttttcttttcttttcttttttttttttttgagatggcgtcttgctctgtcacccaggctggagtgcagtggcatgatctcggctgactgcaactttcgccttccaggttcaaacgattctcctgcctcagcctcccaagtagctgggattacaggcatgcaccaccatgcccagctaatttttatattttcagtagagacagggtttcaccatgttggccgactggtcacgaactcctgacctcaagtgatccgcctgcctcagcctcccaaagtgctgggattataggcgtgagcaaccatgcctggcctatatgtttcttttatttcacctcaccttcactgtgacatttatggcctaattttatgaaatcatgatgtagtttggttatattatctacgtatgctaaaggtggtgttgtaaagtatttattataagaaaggggcactggatcacataacactgagaactacaggtgtaggtgactcatagctccacctagagcaagcactaagtgttcactgcatagtatctatttttattaagggtgttatcacccttcttcacttccaggcacaatcaggtttagatcttggagatcagtcgtgttgtgagtcaccagagaggagcaggcacagcttggagcctgttcccctggggagggtggcactgagtgatgcaagcctgggtcccaagaaaccctggccctgatgctgctgccccctctctgggagcaggaagtctccaggggaaaggactatttctctagagccctggaaatcccagattaaccctcctactaggtagatctacagtgttccctctgagcataccagcatctcaagtttcccactaaagcagggggctgggccaggcttggctccagagctgcgaacagcctggacagagctgacatcagcagttaggccaggttggggaagggtagggttagcccccagcagctgggctgtctcacccataggggaggagagaagaagagggagcagcagaagaagggaggaggaaaagcaggaaaaggaaagtgagcccagggaagtttgctcaggacaggcttttgctgtagggtggaggaatttctctagcggtagtgtaccactacacttcagcctgggagcaggattcctccagctgtaaagtggagtaatccgatgcatgttatctccccgcttaacaactgacgtccaaaacccctgcctatgtcttcatctttatttcatctcagaccatttcccgccatgcatggaccttcccatagaatcacttatagatccctccaaaggccatgctaatccatgactacatgcctttgggtatacagttctctgtttgaattgcctttccatgatttatctagctggaaatttccttaaaatatcaccttctccatgaagtattccccaattctgataaaattattcttgcctctgtgttcaaatctaggtgtctaagatacattagaatgaccatttattaatctagtaagtattctcaaactttagtgtgcatcagaatgacctgggagtcttgttaaaacacagattactgggatccaaccccagatttctgatttcagttctgacctgtagtggggtcaagaatgttcacttctggctgggcgcagtggctcacacctgtaaatcccagcactttgggaggctgaggcgggtggatcacttgaggtcaggagttcgagaccagtctggccaacatagtgaaaccccacctctactaaaaatgcaaaaattagccggatgtggtggcgggtgcctgtaagcccagctactcaggaggctgaggcaggagaatcgcttgaacccaggaggcagaggttgcagtgagccgagatagcgccactgcactctagcctgggcaacagagtgagactccatctcaaaaaataaaaaagaatgttcacttctaacaagttcccatgtattgttgatcctgctggtccaaggatcacactttgagaaccactgatttaccacaagaaattctcaaccctcagtatggtcagtgcttacttattaatttattcagtgaatgtctactgagggcctgctatgtgccagacatggaccaggtgttgagtgttcaatggtaagcaaagcccacattgaacttgcccacataggacttgcctctatggagcttccagtcaactatggaagacatattaagcaaataaaaataccattaagtatataataacaggccaggagtggtggctcatgcctgtaatcccagcactttgggaggtagagacagaggcttgcttgagcccaggagtttgagaccagcctgggcaatatagtgacacctcgtctctacaaaaaatttaaaaattagccaagcatggtagcacacacttggagtccttgctacttaggaggctgaggtgggaggatagcttgagctcaggaggcagaggtgtactgagacagcacttacactccagcctgggtgacagagtaagactctatctcaaaaaagaagtacataatactttgggaggccgaggcgggcggatcacgaggtcaggagttcgaaaccagcctgaccaacatggtgaaaccccgtctctactagaaatacaaaaaaattagctgggtgtggtggcatgcacttgtaatcccagctgctcaggaggttgaggcaggagaatcacttgaacccaggaggcggaggttacagtgagctgagatagcgccattgcactccagcatgggcgacagagcaagactctgtctcaaaaaaaaaaaaaaagtacataataacaaactgtgataattgatctgaaagaaaagaatattacaagaaagaataatatcaagaacctatttcagattatgtggtcaggtaagacctttttgggaaggggacgtttatacaggcagacatccagtactgtaaacaaacttctataaggtgtgtttattgcactgtattgttacctaggtttaagttgtccagctaaccaccagactgtgtacttcttgaaatgtagaatcttgtcaatatttgtgccctcagcatgctgcacagagtagggccttggtagctagtgaaagaatgaatggaaagatggagggatcatgggaagaatgagcaaataaataaaggaaacatcaggtggctgtatgagtgcatacttgcatgaatggatgatggataggtaacggagggatgggtgactgtctccagcagcaacactgacaaccaggattcctggtggtaccagtgagacaagagtagaaactgataggaacttagctgattcctttactatatttccaaaccatgtccatcatttaaggtgaccaccaatggcctctcctccccaaaaagccccttgattaccattgctaagccctactccacacgtgaatgaattgctgtcacctcctgtactcccacacatgccacaccacacttacgtcgacaaacgtaattgccttgcgcttgccatctactgatcacctggggtacaggtttctcagggcaagccatgctctctgtgtcagtcttagaagggataaagggatagagagaggaagaaaagaaagtttctttcctacatctgagccaaagaaggtacagagctcagtgggcagtgaggagattcttgctctgataattcatcacatgacttcaaaaaagcactttaaatgacacattttttctagatatgtgtcttaggcctcctaagaggagtttatttagagacccagtttgagtcacaataaagagttaaaaaaaacacccagggtccctctgggatctttttaaaaatgaacagagaaaagaaaattatacacagaccactctcttccctttaaacaatctctgcctgaaaatgaatgctcacctggctttgcattcctcacctgcggatgaacgctcatctgcctttgcattccccactggaggatgaacgctcacctggctttgcatgctttaagactcccatacacttgtttccagtctcatcaaagctcttagctacccaagcccagttctatgtcaaaggagcttgaattcagatgagaatttccaaagggcttgaagatgggaacagagcccctctctattcaaaagagggcaagataaagaatctgggacatgacagtccccagagattgaaataaaatacttcttaattgtgaacggcctgaatagacaattcctaaaagagggcaaggaattaacaaatatgggcatgaatatctaaccctaaaagtaatgaaagaaatgcaaataaagaaagattgtatatgtctccatgtatatatgtatacacacatacacacattttacactgtaagactctatgtgtgtcaggatgtcctgaaatggtttctcatgtgactgtaattggtaataggcttctgaaatccttgggcagtaggtctcaagtgtctctgaaatgttcttacttttccccaaaaaatataggaggaaaggatatgatatcaatttatccctaattctgatcatccatcctaagggaacatttgaaatacaaaaaacaaaatagcaaaaagaatactaatcatgaacactaatcacaaagatgttcatctctgtgttgtatgtaatagccaaaggctggaaatagccttaaagtccagcaatcagaaaatggctattggttagacatttatagaatactcttttttttttttttgagacagagtctcactctgtcaccaaggctgaagtgcaatggcacaatcacggatcattgcagccttgacctcccaaactcaagggacccttctgcctcagccttcccagtagctgggactaagggtatataccatcacagataattttttattttttgtagagataagattttcctctgtggcccaggctggtcttgaactcctgggctcaagcaattctcccacctcagcctcccaaagtgctgagattataggcatgagccaccatgcctggccttagaatattctttatcaatgcccacttatgggttctgcagggttcttccctggggaatgtgctagcaggctgttgtatagggtgcagtctccagatccttcaggaaagtgccttggttgagtctctcaagtccaaaacctggttctcagcttctctgggtcagaaactggattttcttagtgtagtagagaagagtggtcccttggggacagacttactctcactaataccatccaaggctgctgtagccatcaaataccaatttattagagcacagtggatgacatccttttgcaaacagcatagtatgtatatccactgcccaatatctattctccagctggtactagggtagacaggaagaaaaatcagaaggtttcttggtgagcagcgtgtttgaataaaaggaaatggacaggcttgaggagtactttttcaaatcatgatgagacctggggaaatgtccctgattgataggagagacaagttctctgtgactaaattgcttgtttctcctgacaaagtgtctctctcctctggagtgtgtaggcggctagctgaccagtttactttcctgcacctgcttttccatgttcactgcttctctttttattaatcaattccattcctagcaaaggtaactgagcaattgagagggggcactggcaggtccagctggcccagtcatagtcccttctctggggatatggacttgggattgtgctacttatcaatctattgcctctcagtgccaaactcaaacttcattccctgctctgcaaaaatgtagctggacagtcttaatatttttcctttgtcagctgacaaaggttaaactttgttagtaaagggcactagagagacattataggagaaagaaatttttcttttttcgttattctggtgtgctctgcttagcggatcccctgcatgtttcagcatgcaacacctgggttctatagataaacctctccagtatccagcgtctgcagtgcaagcaacttctttagcatcaggttcccgcaaagacagatggcttctccagggtctggctcctaccatgcatggtggccagcatcaaccaaaggccagcagcagcttcccctggcactccctactacaggtagttttataggagtgactctgacagacacctcccaagaatcccagagggtagatttccagcaagttccatcaacacagcgccacatggacttctttacaatccagtgaaccacagccatacctgctccaacaatgtctggatctcagcccttggggtggggattggggattggtttctgtcttggatgggatatctcagccctagaggtagtaactgctccttctagttgttattcccatactctttaaaattctctttacttcctactggccaatccttcactactccaatccccgttacagatagttaataattcttttttgagacagtctcgctctgtcaccccactagagtgcagagcgatcttggctcactgcaacctccgccctcccgggttcaagtaattctcatgtttcagcctcccgaatagctgggactacaggcgtgtgccaccacgcctggctaattttttgtatttttagtagagatggggtttcaccatgttgcccaggctggtctcgaaatcgtgagctcgggcaatcagaccgcctcggcctcccaaagtgctaggtttacaggtgtgagccaccatgctgggccttctagtgtgtttctataattcacaaccaaaggatccttatctaatacaatctgactctgggagatactgcgcctcctctcactgtgtattcatttcattggaacctttagagtttgaaagacgtccccttttgagacaatattatttataaaactgaaaatgagaaataacttaaaagctcaatcatagatatgcaatgagaatagtactgcattttgaaatgtactaatgttcttgtttcttttgtcttttccccttcagcacaaatctcatgggctggttattttccacctgcttcttcagatccatggtccaccattttccactctgctttgtgcactgggaggccacctttctgcggaatatacttacctctctgccttccatttcagttctgcaaatgggaggtactggaaagaacgtgagggcaggaggagagatatgccagggtatttattgccctagctccccctctgccagaccacaggtaagaaacgactgcatttctccacctaaattcctttcgagctgtccctcacccatcgctgcagtctgtattgttgctcctttgggcctcagggtagcgatgctctcccacatttctagtccctgagtgttttgtcatttcttattcactaccttagccttgctggcactttcataaacaatgtcttcattaaacccttcaatgaccacactgagtaacccatctgttttctgccgagaccctggctaatatagcatccatggggaaaaagggagggcagggattagaatttactacagaaaaaatacgaagagaaatactgaggcttctgacatacaaaattggattacatagaaaaacaaaagcctttgccaggcgtggtggctcaagcctgtaatcccagcactttgggaggctgaggcgggcagatcacaaggtcaggagttcgagaccagcctgaccaacatggtgaaaccccgtctctactaaaaatacaaaaacttagcagggtgtggtggcaggcactgtagtcccagctcctcaggaagctgaagcaggagaatcgcttaaaccctggaggcagaggttgcagtaagccgagatcgtgccactgcactccagcctgggcgatagagtgagactccatctaaaaaaatacaaataaaaataaaaaagaaaaacaaaagccttaaatacaggctatttaggttattgcttcagatttttctttagttaggcccgttgtcatttttccctattaaccagtgggtgggacattgtgaagaagactacatcagttagggagaaagaatatagaaatcacagtttctctgcacattcttagtcgaagtgtgatataaatctgtcaccactctcagggatgtgactaactaatttagaggattataggatggaatatttaattatgattacagcaaacgttaatgagtaaaagcttataacgtactgctaagtgaaaaagtagggcatgaaacgtatggtcattatgatctgtcaactatgttaaatatgtacacaaatatgcgtaggaaaaaaacttgtaagaaattcaccaaaatgtataaagagatgcctttagatggtggaattaggggcaggatttttttccttatatttttctgtattttctaatttttctgtaatgaacatgaattactttcgtaattataatttttcttttcttccattttttttaatgagagagggtcttgttctgttgcccaggctggagtgcagtggtgtgataacagctcactgcagcctcgacctcccagactcaaacaatcctcccaacttagcctcccaagtagttgggaccacaggtgcatgccaatacatgtggctaattttttaaaatatattttgtagagatgggtctccctatattgcccaggctggtggcaaactcttgggctcaagcgatccgcacacttcagcctcccaaagtgattacaagtgtgagccactatgcccagcctctttttcctttccggttttttttttttttttggcaggtcaattgttacacactccttagcagattcagactttcagacttacatggaacaccaacctgcttattttgttttttatttttgctttatttttttttctttttgaggcagggtctcactctgtcaccctggctggagtgcagtggtgagatctcggctcactgccacctccacctcccgggttcaagcaattctcctgcctcagtctcctgagtagctggcattacaggtgcacaccaccacgcccagctaatttttgtatttttagtagagacggggtttcaccacattggtcaggcttgtctcaaactcctggcctcaagtgatccatccacctcagcctccaaaagtgctgggattacaggcctgagccaccacacctagccttatgttgttttttaagaaaacacacacattatgttatgctcacgttatcagaaacaaatgagactgaccctggcaagtcccaaccaaggaatctgtctccagatatgccttggcctggttgactcttggagttaacccttcagaaagcaggaggcagagacccttctgatgagggctgcctctaggagtgggactgcttcagtggatccagctgaattgtcctgagcaactgttgtagagatatggggagtacttagtcttccagctgaggccaggttgggccactgtgcagtgggctgctggaagacaagttgagtccaaactagcccagttcttgaggagcaaccacgtgactctatcaccgtgatatgcacaggttgtgactggtgtcctcagactggaaaacacagtagtgccagctcaatcaggataggagagagacgtatacgttgacatttgtcttcctatccggatgagtgtggtcctgcctttgggcctttccttgggccctcccctctatgtgaaatgccatctctactagcgagattcctgtctgatttatttgtttaggtagaatagcaagaagtctacatcctgatgatcctgggcattgggagctcacctcaccttctctggactctggagggcacacacatatggtccctgctgggggatgcttcgcacacagaccgtcttccagaggcaggggcagggaaactgctgtcaggtgggtgttgggatctctttatatttagttttgttgtgctgtggttattgatgttgcggttttcagtttccttccctcgtagttactccccacctgggctagccactctctacccatcacaggcccaagtctgtgagaaggggcttctcttaggtcctcaccaaggccccttcccaaggtcccttcccaaggcccaacctgcccacagtctcaccgaggccagcagggcccaggtctgggcccaggtccagtcccaggcaagggtattgtgtgtgcttcctgataggtcaggccgccctgaaccctccaggcacactggccctaaatgtgtctgcttcctgaagggtcaggctgccctgaaccctccctgcgcttcctcttgtgaccagtgttgaagatcaagaggaagaggaagaggccaaaaattcttcacacagagccctgggctccgagcccctgtggcctgtcacttacctggtccacagcagaggtggtgtctctagatgagggtaatgggaagcatccttccctcatgccctgctcccttcctccgagccatacccattacactgagccagtcacggcagacatctaggcagaagggaccacaggggtggcctcgttgcctgtccttgctccctccacactgcatatctgcagtctaacctgctgaatcacagtccttgttaggtgagggccaggacaggagagaagacacttcacttgttgccactaccagtctttctataccctatctttgtattctgtctgcctggcctagtatggagcccactaggtcagcctttgaccaataccccacacagaagtatattttggttctgtttacattcttgtcagaaagcccgctattttaagtcagcgcctctcaaacgtgaatgcgcataaggatcacccagggatcttgccacagcctaagtcctgatttgggagttctaggtcaggacattctgcatttctaacaagctcctgatactgcaaagatggaagggacccaggcttatttctaggctcagatgaggtcttgcttgttctgtgaagattatcagagtgctgatgtcagaattaatcacttcatccatcatttcctgaacacctggctcagccgttgtcccaggtgccagcacagtctgcccacatctgctccctgactagtctgggggctactgggacacgtagtctttgtagccgtactccctagcatggaggatgctcagcagtttgtttgagcaaattaatgaacaaattaatggcatttgaaggtgatttgcaaaaggtataggttattaatatgtacatatatattttgagatggagtgtcactgtgtcacccaggctgtagtacagtggcacaatctcagctcactgcaacctccgcctcccaggttcaagcaattcttctgcctcagcctcctgagtagctgggactacaggcacgcaccaccatgcctggctaatttttttgtatttttagtagagacgggatttccccatgttggccaggctggaaggttgttaatatttaagacatttcctaaaccgtgttccctgggacaccaattctgacaccaattcagagggatgttaacagatatttgttaaatgtggtgggggaagtgggaagcttttgtaatcacttaatccaagaaatgctggatgaaaaatagactcctgaaaagcttctcacagcctttaataaactagtggtcagtgccagtgtcccagagagagatccagtgagcagcatttcgctcacttcgttgaccatagagaatacctcttgagaagcaccttgcggggctaggatgccgaggaacagaggtgaggggcacagtgagcactctagtgttcactcgagtcttggagataattaagttacaaaggtctagagaattaatagacacttgatgaggggagagggatgtcagaactgaaaagcagaggaggatgtttctttcacagactgagtcgtcccactttggagttttgttttgttttgttttgggggttttttgtttgtttgtttttgagattttgttttgtttggggggtggtggttgttcgtttgtttgtttttaagatggagtctcgctctgtcacccaggctggagtgcaatgacacgatctcggctcactgcaacctccgcctcccgggttcaagcaattctcctgcctcagcctcccaagtagcccgccaccacgcccggctaatttgtgtttttagtagagacggggtttcaccgtgttggccaggctggtctcaaactctcaacctctggtgatctgcctgcctcggcttcccaaagtgctgggattacaggtatgagccaccacgccccacttctttggagttcttatcacactgctgtggggctctctctgctcttctgggttcctctgggaggggagcacaggagaaattctgactctgtcttcctcctctgacctctgcagtggctgagagggggaggttaggaaacctagagagaagcgaacatggaagcctgttgatgctcagtctgctaaaagacaaaggactccagaaagtatctggagataaagtgtctccaggaggagctttattccagctagaaagcaggggaggatgtttttttaaagggccatgtaatacaagtctatagccgagattgggattgaaatgaactgattaaaagaaaggaaacatctagaaaaagaccccagtgaatcccagacttcatttatcttaaaacagtcattctcagctggagtgaattttggtctcccattggacatttgacaaggtctggggacatttttggttgtcacaactgaaaagaggtgctactggcatctagtgggtagtagccagagatgctgccaaacctcctacaaggcacagggcagccccttacaacaaagaattattaggtcccaaatgtcagtagtgtcaccattgagaaactttgccttaaaagttgtttttaaatatcagctttaatttacaatttacaatggtgcacaaattcagttgctataccacaaaaaaattgagagaaatttattcagtataaaaaaatccagattaacaatttggtcacctcctttgagaatgaaaaaaaaaaaaaaaaggacatccaaatcttagtcagcaatactattttgtaaatttaaaacacatctcaaacaacacttgctattttgcaaagagagaagtaaaaggattcacagcaaatattccctttaatttaaaagtttaggacattgcttaaatatacttaataacttttagcatgaagattttgaaggaaattttttatgatgcatctttttatttgtaaaaattgtaaaaatttatggggtacatgtgaaatctcgttacatatatatataatgcatagtgatcaagtcaaggtatttaggctgtccatcacccaagtacagtacatttttgtttaactatagtcaccctactctgctatcaagcaatgaatgtattccttctatctaactgtttgtacactttaacccacttctcttcatccttccccatctcttccattcattcttctcagtctctgttctccgtatttcctctctttacctcaatgtaatcacattttttttggctcccacatatgtgagaacatgctacgtttgtctttttgggactggcttatttcacccaagataatgaccaattctggaggaaatgtattaagtagaaggggataaaatgctacaaataaataaatattatgagtagggatggggaggatcccactactggctatataattaaagagattctcacacaactccataaagagacatgtaagaggatttttttttttttttgagacaaagtttcgctcttgttgcccaggctgaagtgcaatggtgcgatctcggctcaccgcaacctccacctcgtgggttcaagcgattctcctgcctcaacctcccaagtagctgagattataggtatgcaccaccatgcccggctaattttgtgtttttagtagagacagggtttctccatgttggtcaggctggtctcgaactcccgacctcaggtgattcacccgcctcggccttccaaagtctggggggggtggattataggcgtgaactactgtgcctggccataagaggatattttatcaccaagttatttgtgatggctggagagctggatgcaatgaggcattcatcattggggaaatgaatgtaagtaaaatgtgacataagcacactacagaatattctaccacagtaacaagcaatgaattagatacacacaaaaggtcaagaaatctttaaaacatggttctgtccagttgcagtggctcaagcctgtaatcccaacactttgggaggctgagacagaagggttgcttgagcccaggagtatgaaaccagcctgagcaagatggtgagaccctgtctctacaaaaaacaaataaacaagagcaaaaaacgccaaaactccacaatgctgaatgggggaaaaaagaagaaaggaacagaaggaggcctccagcacaatattattttttgaaatgaaaaatacccacaaaacaatgccacatgcttttgagaacacttgcaaatagaatgatttatgagtcttagtcactgcataaactttacagttgaactcttggaaattacgcatcagtgccacctggtggtagcacttcaaatttgtggcataattcagttttgtttttaacaagataacatttacatacaatgaaatgcacagatcttcatttgatgatttttcgacaactgtataccccagtgtaatccctactctaaataatatatacggtatttccactgccccagaaggttccctcctactctccccatgccctaccctgaaagcaacaactgatccgcctctgtcaccacaattagcttcccctgttgtagaacttacatatgtggaattatacagaattatacagtgcatactcttttgtgtttgccttctttcaggaatcataatgttttagcgattcagtcatgttgtagcacgtatcaatagttaattcacttttattgccaggtggtattctattgcatagctgtattccagttggtctatctgtgcaccaactgactgacatttggatcatttccacttattgcctaatacaaataaagcttctatgaatatttacgaataaggctttgtgtagacatatgctttttatttactgtggatggaattgcaaggtcatagcatggatagatgtgtaatttttttaattgcgaaaaacaattctccaaataagttgtatcattttacacatccaccaacaatgtatttgtatcagcaataaaaagatgaacaacccagcttatctaaataggcaaaaagtcgtgaatcaacattcggagatatataagtagctatatagtacaggaaaaagtgcccaccattattagttttcaggaaaatgcaagctaaaaccacaatgagatatcactttacactcactagaatgttaaaatgttgagaatgtggagaaattggaggcaattggaaatcacacacacacacacacacacacacacacacacacacaccccagctctctcaggtcaccagctcaattccttcacaaaagaaggattcagcttgtgacttgcacatttctgcataggctactgttggtcaagcctggaaagttaaaaaggcggaaagacaaatctgctgctgtgcattggtggcgtggagccacaggagtgccagaggcgtatactggggcaggctcttatacctgttttttactgcagttcttcattcagtagggaaagctttcataggggtctattagtagaggttggccctgacccttctaaggagaataagagtgtcctgaagtcaaaatgaatgaaagccaggtgaagagatgggcaggtttccatgggccccgcattgcctggagctgcccagaacatggggctggctgtagcttcaccacccaacttctctcttccctcttcctctttctgtttctcctcacctctctcttcctccttttcataacggcatcatgtattaagttttgttatgagccaggcgtttaatttttttttttttggagacagagtcttactctgtcaccgaggctagagcgcggtgacgcaatctcagctcactgcaacctccccttccggagttcaagcgattctcctgcctcagcctcctgagtagctgggattacaggcacccgccaccatgccaggctaatgtttttttgtatttttagtagagacgaggtttcaccatgttggctaggctggtttcgaactcctgacctcaagtgatatgcccgccttggcctcccaaagtgctaagattacaggtgtgagccaccgcacccagccctaatatatactttttaatacaacacttcaaggtaggcgttattattgttgttgttgtcatttttgagacagggtctcactctgtaggccaggcagaagtgcagtggtgctaactgcagcctccacctccaggctcaatcgatcctcccacctcagccacccaaatacctgggactagaggcgtgtgctaccatgcctggctaattttacaattttttgtcaagacgagatctcgctatattgcccaggctgatcacaaactcctgggatcgagcaatcctctcacttcagcctcccaaaaatgctgggattataggcatgagccacggcaccctcaccccatgagggaatgtgggctctccggttaaggaatttgcttgaggtcacagaacttgtggattcacaccccatggctgcagtcacaaattaccacaaacgcagaggcttcaaacaacatcaatgcattctgttccactcgggggtcagagtcagaaatggggcacaggcttgctctccctctgggggccctacgggagaaaacgtcccttgcccttgccagcttcttaaggctgcctctaaccctgggatccaggcctgcatcaccccccactctgctttcatcatcacagctccttctttgactctccctcctccctcttatgagaactttatggcccaagctcacccaggtaacccaggataacctccccatttcaggatccttcctttgatcacagatgcagaatcccttttgtcatgtgaggtaacatattcacaggtttgggggataaggaggtaggtatttggggggatgggagcatcggtctgcctatcacagtgagtgagtggccaaatgagggttcaaacccggttctgtcgtattcctgaatctgggatctttctccaaaccacactgccccttccttcagtccttcctgtccttggagctgtcctgggttcccagcaagcacagattctcagaaagggacagcagaagaccctaaggctggacatatcaggatatcacatatcctggtgagagtccaaagacttcttttcaaatctgggagggaagaggagagacggcaggagactccatgcccataccccattcaccataaagggagggggaggttggccttgagggccagacaggagaggttctgcaaagggagcagtgtaccctctgaacaatgccgaggacagcacaggtactatgtgaatgttggtgaggagggtgcaggttgctggggtcggtggtgggatgagtagcagtattttggaccccgtgtctaaattcagcctggtcatagatactgccagtggctgtgtctgggaagatgccaagctggggtcacatgggtcctgcctgctgaacctataagtgccgtggggcatgtgtggcagctcctcccaccttctgcctggaccccctggaatgactgccttttggagagggtctatattcagggacctctagaccttagctgggcccagatgcaaggaggttccacctgtggtccacactcgactattttggcaacttcctgccaaggctggaccacagaattttccacgaaactcacttcaaattgtgcggctctttcagctcctgctatttcagttactgggccaggatgggcttctgggtgtatgtatttaaaaccagaatctatggtgggcagaggaatctggtaagagtctgagatttaaaatcagatattgttttgaatgccggctctgccacttacaatgctggaaacttcgaacttgtcatttaatctttctgagccttaattttctcgtctgtaaaatagatagaattataaggccaggttaagaggctaagagggggaactccttgtgcggatctaaggacccctcctcgaggctgggaagaaagaggtgggcaggagaccctgggcaggggaccatgcccagatcacacccaccacagggagagggcagcagagatcttcgggcagcttgagggtcaggtggagacaatcaccagggaggggcagacaagccctgaggcctcacctgtcaacgcactgactcacctcaaatatttactgggcgcctttgagcatgagaactagacctctcccttgcctgccttggaccagtgcccatgggcatgttgaaagcacctgcctggaagagagtctgccttaagagggtgggtaccaaccagggccaccttggatatggaaaagaaacatcatgaaaaggaaagaatttccagggctcctggaaccgactgaagactttagccttttgggctctgaggctgtgccatttgccaggctccaaaatcgctaatcattttatcctgttcctttggcaacaatagggtacatgtgacctcagcccggcccatcacagatgcccaatttccaggccacattgattggttcaagagatgagcacatgacttacccaacccaatcagagtctcctcttgggtttttatacactgaaggaggctgtggggagaggagaaaagtcccttctgttcctttagttcacaaagttgggaaaagcggtctgcagccatacctccccatccctaatagcaaacagtaagcctgtctataagtgggagagcatgatgacagcccccccaaagaaaagtatgagagtgggagattgtgaacaaaactctggttctccccagcacaccccaggatcctttgggcaggttgcatggcctctgaactttgctgctggataccttacctgcccccactccagttaagtgcacactacagggcccatggaatctaaggggaatggcaccccctggagatgaacagaacacattccacacaaccacatgaagtagccctgattacaggtgagcaactgaggctcagaggtgcaatgacacacccaaggtcacacagacaaggtgtccagactccagagcccaggttctgatggcatggctgcctcctggcccacccctggcacagcccagaagggaggcagcactcaggactccaacatgagtctgggagctgttactctggacaacggcacccctgtgtccaggagccatcaggaggcccttgttgggccagctttatgaagccctgggctcttgtgagcgaattcatcgtacaagtgaaagatcagcatgtggccatggtgaaaccctgtctctacttaaaatacaaaaattagctgggtgtggtggtgcgcgtctataatcccagctactcgggaggctgaggtgggagaatcccttgaacccgggaggcggaggttgcagtgagctgagatcgtgccactgcactccagcctgtgcaacagagcaaaactctgtctcaaaacaaaacaaaacaaagtaagcatgtggggaaggtttagtaacatctgtggcttttgtctgaccagcaacattcctcctttcggtaatagaatcccaggttttctttggagacctacttaccttcattggatacaaataagggactgtccataaaaatgccttcccttccctggtcagaaagtagacatgggctgggcacagtgctcacatctataatgccagcactttgggaggatcacttgagcccaggagctcgagaacagcctgggcgacataagaagaccctgtctctacaaaataaaaataaaaaattagctgggcatggtgatgcatacctgtggttccagctacttgggaggctgaggagagaagatcgcttaagccaggaaggtcaaggctgcagtgagccgtgatctcaccactgcactccagcctgggcaacagagcaagaccttgtctctaaaacaaaaaccaaaaaaacggaatgtggacacataactctaggttttttgagcccagttcttttggggcatagttttttcagcttgtcacctagttttttgtgcagctgtggtagcaggcactgtcagtgtcccacccacactgtttaccactccccattcttgtgcatacctgcggcctccctgtgcaacccttgcaatcctttgcccggaggctttctctaggagcccagagacatgaaaggagctagccgatagtgccagggagttaatggtctctcttccagcagccctcaatcagcgactgttgggagttgctggatatataccccaattccttcacctctcagtggggataactctgccatgtgtgccacacagtgtcccagccatccctggttggattgaggcccagtttccccagtggtaacctcagcgatgcatacattattagttcccttccctgccttccttattcccactctcctgcaggtgtttcgtgggattgcctcccagaaaatgatttggaatctaatgtgcttttctcatggtctgcccctgagtccaacctaagacaataccacatccttctggaaaattattattctgctgaggtttgccaaaatctacttctgttgcttgcaacccaaggaccctatcaaaattcatagtggtctggagttgtgacatgttgcaccaggctgtgataatctgatttttctgaaggccatcagagctctggaacggaagggggtatcaagagactttgttctaagctcttttgtatgtatgctcagaggacttgagccactggttatgtccatgaatggaaatgtttggatggcacaaggtcccagaacaccaggtctcttgagcagccccactcctcgatgggtctgtatgataatcccttatggttggaggtgatcaagccaagagtccatgcaccaggagagaagataggcactgaaactgtttcctgtgagttcagcagatggtcttggggtagcttatggagacaaagcaccacactcaggtcttagaggagatactaagttcttaggtccccagccaggttggctaagagctagtagaaaatgtggtccttgaaatagagtgccacctctgttcccacctatatggacacagcataggatgtcactggctggacccagtggacccactagagtccagcttgtcctcagagcttcctcaagccctcagtccagcagaccaagcatctgaagctggcatccttactgtcctgagacttcatccagtgcaggatggattcaaatagtcaacacacacatgccaggccctgggcagagcactggggatatgaagtgacttaaatgtccccctgttcctctctttaaggaaatatgagagatagtcacataggcaagataaggtcatgaaacattacagctgctgctgggatagatgtctgtgcaaacatggtccccaaactggagtgggctgagggtctgagaggagagcccaaggggaggtaatagaggggcacgccaatcaggaagaacagcataagaaaaggcttggaggcgtaaaagcctgcaggtggttctatcggatggggtgaaggctcaagtggccagaggtgaagttagagaggccaacagaggaccagtcgtggcggaacttttatgtcatacaaaccaaggagcttggttttcatgcttgagtcattgtgattgagtaactttagttgaattgactatctgtaattgaataatattaggcagagggatgatgtggtcatttttgcattcagaaagatggctctggaagcagaatggattggaggaggtgagactggaggcagggaaacagcatgagtaatgaaggtgagagatcgcagaggctgaactaggggaaatatagaggaggtgatggatatgagaggtggtgaggaggtgaaatcagtaagacctggttcctggaatgtagaggtgaaggagaagctcaggatggtccccagattagcctaaggcagtggggtgatggtggtgctgtccacccaggtgggggaactgggaggtagggcagctctgggtggacagaagatggaaagttgacttttggacatattgagaagggggtccataggataatggggtggaaggaatatctctatttctatcacagctctcaccacagcattttatagattcctgctcaagagtccattccacctctccaccactggtgaactgcaagctccttgagtccaagtctcactcatctctggagtcccagggactggcatagtgattggtgccccacaacaggtgctcaataagtgtccattgaatggtagagtggatgcccccatggagggatgacttcagctcatttcatcactgagcattccttggagtcaaatcccaaaaaagtagatgaaacctctccttaaagtagtgtcctcccattgcctgccccctacagctctggaccaagtggaatgggcaggtgggctctagacctgggacatagagttgggtggctgaggggcccaggacaggctgtggagctggctcagtccagaccaggtctccctggaggggatgcccacacctgggtagctcacacaggtttccaggcaggtgggggcactttgggctggaggaagggtggagcaggatgtgagctggaggccagggaaggtggtcccagggcaaactggccatgctggccatgccatctggcagacccaagctctgctggagctcagctcccccaccttaagctaaacaaggcctctgtccccaccacccatcagcagaacccatgactcagacctgatggatccagcattgccgtcatcaaggagtggctgtttacctcaaggagctgggcaccaggccaatctaagcagatggcatgaaggctgctgggtgaggctggggagtgttggcccagccaaggcacaggacccaggttttcactctgacctggggcagaagatgcaggaattgcccagctttcctgcctgagccctgttttaggtcatctgtgtcctgattgtattgattccaggacctgtgcaggtgcccagggcatttaggtcttggcctctcctctgcctccaggaatccccacttaaaccctttccttggtatcacagcagctacacacatctcatctcacattctcctctccagggccctcacaggtgccctgggagtcaggctgctggtggtacaaattggtgaacccaacatgggagatggaagaacatgtgcaggcccaaagaggggaagggatgcacctaagctcacctaagaaactggtagctgggctgggagctgagtgtacaacgaggccctcacctcccgccactgacttccttgttctttccattctggctctactggactccttggtgttgtagctgccaaccctgttcccaagtcaaggcttttgcacttgcagttcctctgcttggcaggctcttcccctgccacctctgcaggactcgtttcttctctgctcatgtgctactattcaaagagaagcctctcctttgtcactctcctcttggccacttgatttctcttccacatcacatgtcatgtgtttattgttgtctttctttgttgtctatcaccccactagaacgtaagctccttaagacagggactttctccatcttatttatagctgaccccctggtgactcagaacagtgcacagaatatggtagatacttcataagtatttgttgaatgaacacacaaacccagattgcctcactcctggtccggagctctctcctgtacctctctatgtctcagagaagccagaggaggaaagagtgcaggaggggttggcttaggctggagggtggcagccttactcctttgccagagacacaacaggcactgtgacccaggccacacctcctggggcctgtgtgtatctgggggctctcttgggcactcacggcatcccaggggcatggagggatcagcacttacctcctcttttcccaaagcaggcaccatctctgcccttgggcccactgtgttcttcccgttcttggatctgtcacgcaacatttttttgagacagggtctcgctctgtcacccaggctggagtatagtggtgtgatcacagcttactgcagcttctacctcccaggctcaagcaatctttctgccttagcctccagaatagctggtactacaaggcacgtgccacactgcctggctaatttttaaaaaatttgtagagatggggtctcactacattgcccaggctggtctcaaactcctggcctcaagccatcctcctgccttagcctcccaaagtgctgggattacaggcatgagccaccatgcctagcctcaacacttattgagcacctactgtgtcccacgctcaggactgggcaccagggcaatagagataattgaaacattgtcctttttcccagacagcttgcagcttagtcagcagatggataagcaagggccaccaaagtgcagggggaagacacggatggaggagacagaaggcacaatgcgagtggggcattcagggtgggtgacaacagtcatgaccttgttggtgaaaggcagttaggaaggtttcagaagagggaatgtttaagctaggtttcacaggatgggagtagggggatagagaagggagacccagcattgccagcagacagaataaattgtgcaaggggttcagttgaactgaagaagtgcaggtccagggtggggcaaggtgaaggtgaagctggaaagatgggttgggatcagatgttgaaggggtgtggtcaccaggctaaggagtttgggcttcttcctgttggcagtggacgccattacagtgttttgggcaagatgacctggtcagctttgctctttaggacgcttgtccgggacgctgcgtgcagagtgatttggagtggcaggtggagagccagggatatgagacaggacaccattgaggtggccaggttggagacaacagtggccaggactagggtagagtggggggtgtggaggggcagggatggattcaagagctatgtaggaagcagaacctagaccctccatgggaaggcaaacaaggctgaggggtcagtgcctgggattccactgccggaggttgctgggatgtgggtcaggggagcagagatcaaggcttatttagcccccactgaccattccagactcctgtcatggccctccccggctccctggccccactttgcccacatggcttctctgttcttcagatgtgagaagcttcttcttgcctcagggctctcacacattctgtttcctctacctgcagcactgttccacttggctacagcctgccctgcccactcagcccttggcgtctctgatctcagatggataggtcactcttggatcctctcacagaacagagcatgtgtggttcatgggactcactccagcagtgatgatacaatgctgctgcccgttcagtactgtgcctctacttaaccaaagctcctggaggacaggaactgtatctgactcactctctgccatatccaagcactcagcatggagcatggcacttagccgcttgttaaacttttactgaatacatgaatggtgaattaatggtgaggttttcttggatgcactgacatccttaatgggctgttcaatagcagtcggatataggagctaggttcacactttgatgggatgacagattacgaagtttgttactatgagtgaatctagaaggtatttgtctgaagaggagaccttggggtgggctgggatggtaagtgagctcagtactccacaggctgcccttgactttactctgtactttgaaggatgcaaaattcaagcgtcctggctccttgcagcaactagaatgttcagtagccatttctgccacgtggatagaaatctaaggtccaaaacaaggaagggatcaaatccctttgctcccctctgtcccttcctcactgtaacctgggacactgacagacagacctgtcagtgatcagatgagaaatggagagaggcccaggagcttcacatgtgcaagggtaggaggcaggcagatggcagacctgctcagcctaaaggtgcttgtgcaagtacaggaggttcatgcaagtacaggaggccagagacaaagctataagccccaaggactctcagggaggcagacctcttgtgtgaggaaggactgtctttgttcgaagccatccaacaacgaaactggtaggtagtgagctccccatcaccatgaatgacctcccagtggggctgctgtaggaaagccctagtggaagaagggagatgaaacccagatgaccattattttttattttattattttatttatttatgtatctatttatttattttgagaccgtctggctccatcacccaggctggagtgcagtggcgcaatctcggctcacttcaacctccgcctccctagttcaagtaattctcctccctcagcctcccaagtaactgagattacaggcacacgccaccacacccagctaatttgtgtgtgtgtgtgtgtgtgtgtgtgtgtgtgtgtgtatttttagtagagatggggtttcaccatgtcagccagcctggtctcgaactcctgacctcaggtgatccatgcagcttggcctcccaaagtgctaggattacaggcgtgagccaccacaccaagcctatttttatttatttatttatttatttatttatttaggcagtttctcgctctgtcaccaggctggaatgcagtggcacaaccttggctcactgcaccctccacctcccaggttcaagcaattctcctgcctcagcctcctgagtagctgggattacaggtatgcgccaccacgcctggctaattttttgtatttttggtagagatgggtgtcaccatgttgaccagggctggtctcgaactcctgacctcaagtgaatgcacccgcctcagcctcctcccaaagtgctgggattacaggtgtgagccatggtgcctggccccaagatgacctttaaagtccaattccccttttataagatggcgtttttgctttaggacaggaagtcatcattaaatattttctctacctgcctaagcaatggaaagatagctgccacctgcctcagaggcatccctgggactgtgcagtttcctaaggaggaacggaaggatcttgaagctgagtcaaggatcactgggggcctcaagctagtcttggccacaggtctggggcttctatgggtctgtagaggtgactggatggctggtgtccccaaagggactgttctttttttaattaaaaaaaaaatttttttttagagttggggtcttgctatattgcccaggctggtctctaatttctgggctcaagcaatcctcctgcctcagcctcccaagtgttaggattacaggcatgagccaccgcacctggctggggctgtcctcaaacaagaatccttcgccttgtcattggaatattcttgcaacttatctgcaggcttgaaatctttcgaaataaagtttttctttaaaaaaaaaaaacacagattctgatttaaatatttcagagcgaagctcagcatctgtatttgtaaattctcccccagggaaatccaatctgcagacagagctgaaaaacactgatctaaatgaattagagaaacgtgtatgtaaataaaatgtattttatatatcagaaattctttgagagcaaatatccaaatgacttattaatgtatactatgtaagtatgggggagttttagaaactgatttttctttaaaagaatcttgtctttatttaacctatgaagatacagatgaggccgcgtgcagtgactcatgcctataatcccagcactttgggaggccgaggcaggcagatcacgaggtcaggagttcgagatcagcctggccaacatagtgaaaccccgtctctactaaaaatacaaaaagttagctgggcaggtggcaggtgcctgtaatcctagctactcaggaggctgaggcaggagaatcgcttgaacccaggaggcaggggttgcagccagccgagatcgcgccaggcacaccagcccgggcaacagtgtgagactctgtctcaaaaaaaaaaaaagcaaatgaacacataatacctgcaaagcaagaaggcatcttccttttaatgttttattttgcctttgttttgcctgttagttgtgcccactttgcggtacaaaaaaataagtgaaataaaagtaagtaaaaatgatcatttctgcttacgtttacagctcatttcatattctgcaaaatgttttcccgtctgctatcaccgccgccatcctcacagcagcctgggagaaaggcagagccaaaagtctcatctccacttcgtgcatgggtgatctgaggcccagttaagaaaagtggctctaccgaggtcccagagttggttgctggaggcactggcaaaggaatccaggctccagcccccttctctgcctcctgccatcttccagttgcttttttcctttctctctttctctatctctttccccttctctctgccttgaactctctctctttctacttcaactttcctctccttgctccaaccctcagattggagtcagctttgcaagttgtccaaactttttgtcactctggaaacctgccagccccatggccacagccccatctcatcaaaagctcagcatctgcacctagagcaagccctttccggatgtcagcgtgcaaagattaactctggtctctccatctggccctagataagataagattaggagagcggcactataaataggcccccatccttcctcaggcgcaggccccagccagctcaggctacactatcccaggatcagcatggccgtccgccagtgggtaatcgccctggccttggctgccctccttgttgtggacaggggtgagtgggcagaacctggattctctgtggctttgtgttggtaggtgagcttggggtgagagcagaagcagggcctggagcaccctgtgaggcctcagctttttccatgtaccttcattctgcatatgcaccctccactgtgctggggaaagttctgggctgggagaaaagaaacttgggttcaaatcctgactggcgcagaattaccaaagtcccctaccctcttggggcctcagtttctccagctgtaaaagagggcattgttccagttcaaagctgcactgagcaactattgggctggaggctgtggggacagaagggagcaggtaggtcccagctctcaggagagactgacaagtatgctgggtgcagggtggtggatgctaagagagacctggccgaggtcttctgagctcccgatctctctgaaaggctgtggtttgggacttgggcagccatgtgagcacgacagagccctttcccaggactggacacatatacttggggcagggccctctcaggatctgggccatccctgcaatctcacagctaccatgtcaggcactgttctgagcccttaagacagattagtgacccaaacagaaaaagcacggtcctgatggagcataaatccaatggggtagaggaaaaggggaaaggcaataaacaagatggttacaatgtatgttaaacggtatgttagaagctgataaaagttaaggaaaaaatacttggcagggtgatgggcactggaagggggttgcaatttcaaatcaggggaggtatctctgagagtccgatgtttgagcaaagcttgaaggagatgagggactaagccatgtggatatctgggagaagattccaggcagagggaacagctcaggtgcaaaggacctgaggcaggggcatgcctggagtgactgaggtactgtaagaccagtgtggcaggaggggacattgtacggagtgataggagaggagatgagagaggcaaattggaactgtaccgggaaagaccttgttggccaacataagaacttggcttttcctctgactaaaatgggaggcactgaaagctttgagcagagagttatgtctttcaagggttgctctggttggtacattgagaataaactgaacagggaagcggggagaccagttaggacccgcctggacaaaagccataagttataaggcaacgcctggcaggatccagggccactgacctcatggccagtcccacacccatttccccagctggaaacagacctgggcacagggggaaagggaaacgggtctggggacctgttcaggagcagcctgcttacgcccagcctggcacctacacctacctactccttgagcagttgggaacactgaaaagcctgctctgaagaagtttggtttttgtttgtttgtttttgtttttgttttttgcacatttcagactactgcctgggctgagtgaggagggggcattttgggtcaaggtcaagggcagcctgggggtaaatgtagcttttccccacatcccccagaaagaaactctgacatcttagagttctgaacaccccctcctcccaatacactttaatttttttttttatttaaacaaaaatttttttttcaagacagagtcttgctttgttgcccaggctggagtgcagtggcacgatcttggctcactgcaacctctgcctcctaggttgaagcaattatcctgcctcagcctcctgagtagctgggattacaggcacatgccaccacacccaactaatttttgtatttttagtagagacggagtttcaccatgttggccaggctggtctcgaacttccaaccccaagatttgcccgcctcggcttcccaaggtgctgggattacaccaatgcactttagtattcaattcctgaacacccacagtgtaggacattgaaccaagtgctgcgcaaaggcagacataaaggaaccccaaggagctcaggtgcatagggaggcggggtgacccagtgagtgggacagtacatggtggtgtgaaagaagcctccatccagatctgctcaggaaactgttggggacgtcaaggacagcttcactggggggcagcatcaagccttgaaaggagggtatgattcggcgggaggagaacggagacgaagacatttcagggaggggacatggcatgagccaaagcagggcccaatctaggacccgtgagcagagaggaatagctggggcatggagaggtgtactgggaagtcagcccaagaagcaagtttagggtcagcttacgcagtaccctaaacataagactaagcagctcaggtccatagggaggcttagtgatcaggacagggaaccacggaagggctttatattttttaaatgcttttcttttccctaacagttaaatatcaagaaatgcacaaatcttatcactcgatgaatcttgacaatgtatacactcgtgtaacccaaacccccatcaagatacaggacctcttgagacaaggacttagggaagaaaaataaatacagaacatttccatagccccagaaattcccctatgtcagtcaatccctgcccccatcccagtgctctgacactttttttttttttttaagagacaaagtctcactctgttgcccaggctggagtgcagtggtgcaatcatagctcactgcagcttcaacctcctggattcaaacgatcctcctatctcagcctcacaagtagctgggactacaggtgcgtgccaccacactcagctaatttaaaaatttttttaaatttatttttatttatttatttatttatttttgagacggagttttgctctgtcacccaggttggagtccagtggcacaatcttggctcactgcaatctctgcctactgggttcaagtgattctcctgccacagcctcctaaatagctgggattataggtgtgcaccaccacgcccagcaaattttgtatttttagtagatatggggtttcaccatgttggtcaggctggtctcgaactcctgacttcaggtgatccacctgcctcagcttcccaaagcgctgggattacaggtgtgtgctactgcaacctgccctcattgttaaattttttgtagagatgaggtcttgctatgttgcccaggctggtctcaaactcctggcttcaagtgatcctcctgccccagcttcccaatgtgatttttttccatcatagattagttggcctgttctaggatttcacataaatggaatcatagggtatataatcttttgtgtgtggtttcttatgctcagcaaactatttttgagattcagccacgttattgcatgtatcagttgcttgttttaattgttcagtagtgccccattgtatttatttatccattctcctgttgaaggacatttggatcactttcagtttgggcaatttgacatggaagggttttaagcagttcagtgacaggtctaggtttgcattttgataccccaatgccaggcttaaacagcacattggggtgacttagtctaagtttctgtttccctctctctgtggaaataccctgtaatagcatctccaggaaaatataaaactacattgccttgcacacctccagtgatgggaaactcactacttctggagaaagcctctttcactgtggcatagctcccactgagagaaaattctgcttcatatggaacccaaacctgcttccctgcagcctcctcacagagatgggctctgctttgtgaggttgaaaagagtccatctctccctcagccccaggatagcccttcagagacttcagggagcatcctgcccttctctaatttacataaacgcccttccttccacctgtgccattagacatagctccagttccctcatccacccatcatgcttgtcagtcacatcacagtttgctcatgtcctttaagcagttcagccagaccttgaggggtacaccagtgtatgtagaaagagtcaggctctggactgcaacagacgtgtgggaaaatcctacctctgccttaacaaactgcattgcgtcacctctttgagcctctttcgtagttcgttaaactgacctatgccccaggaaacagattctgagctatacatgcaatttactggggagcgttcatgggagtaacatccatgaaggatgagggaagttgacttccatgcagcacaacagaggcttcagatgatcctacaggcagctttgggcgaggggatcaggccctttgtaaccacatcaacccgacatgggatatgggctgttcctgggtagtggatgcagccctgggcaaggcagcttcattctctgagggtaattcctaggaagagacttgcagtgagtggtcaatatttctggcagcaggggaaatgagtgcctcagacttgcgcgagggctcttgatggcagaacacagcatccactactatctcctttcttccctctgttacacagcagtaagataggggtggagaggagttaaaatcatgtgttctcaatgcccggcacataataactgctgaattgctattttataattattatatgggacacaacaattccagtgggatctaactaacaaggaataggctggactgtcaccttcctaatttttgaatttctgtctctgtttatggaacccaagatcacatcagctttctggcagccccattgtctggtggctcatcacctttccttgaggaattccaggttgggtagttgctggaccaagctccctgaagcagaagcagtcctcagacccctagacctggggtctagagccggcataatctaattcttgcttctttgtgtttcagaagtgccagtggcagcaggaaagctccctttctcaagaatggtaaggcagctgcgtgttgttctcaccttctctctgctgagaggagtcctctcgtccatgctgagaaaccagttattcttctccacgatcctgctcagacaccttcaatggctccaaggtggccaaggtggcctcctggcctgcacattccccacattagcccccaaggctgagtaggcccagccccctcacccaagtcccaagattggcctcaaagcccttatgatgtcccccacctggtgtccaaggccccttccatcagtgagatctccccacccaggcttagcaggacagggtgtgctctctgctctgtatagtgcagacaggcaggccacagagttcaggccaaagaggggaccctggcacactgaaagcacctgtggagtgtgccagcctcccaccaccacattccatctgattgtctaaacaccaagttgtccccgaatcctgattccaccttggcccttggcctaatgcccccagtgacccagaaggcagtggtactggcatccttgagactcttgagattgccccttcatgtagtggaatgaggaggctcggagccaccttcccatccacagcctcagcatcgtccccgtcagtccatcagaatccagccccgcttattcagtgccaaagagccaaatagtttacatacattatttcaattagccctatgtgagagaaacgccactattataatttttacagatgaggaaactgagactcagagagtggaaatacctcaattaaggttatacagctaatcagtggcaaaattcaggtttctagggttcgggccttcacggttgcaccgcacaacctttctcagcctatccctgtctcaggcactaatgccagtcctgactgagttctcaccttgacctcaggcctgtcctaaaaccctttcagacagcctcaattaagccccaagctctgccccatttcttcagccttcgcacactttgcagcctttctgacatgggcctgatagatcatgcaggccagggagagttcaggagcccccagggagagaggggcctcctgggaatgatgggtggttccgtatcctggggtcttcaatgggaccagcagaagttctgattagtgcctctgaagagggtgtgaacaagtccccaggagcttgagggcacaaactcactccacacacatagacataaacacaggcatacgcttgaatgcctgcacaccgggggctccagagacacaggtacacatatgtacacatccagccataggcacacacgtggtcatgcacacgcacatacaagcaaacacaccaaggggctctgagtggttggtttcatcttcactggacccacactgggggccttcttgactctgatacctcactggggccccactggttccgagcagaacccctgtatccctccccactgcctctgaatccctgagtcctctccctcccttctcttccacagcccatctgtgaacacatggtagagtctccaacctgttcccagatgtccaacctggtctgcggcactgatgggctcacatatacgaatgaatgccagctctgcttggcccggatgtaagtctgccccacaacccctgcttgcttgggtgggccccatctctggtgcacagtctgaaaggagcaagacttgacctgcttcttccttcatacacgcttgacctgagaagagtcctccaacatatgcccctaatagaatgagtgccagattaactcaaagaaggcacatggttccaagcagaaatctagaagctggtggtggatagggagtaggggcagaaaccattttccttgttctgccttgattgactaggtgacctcatctgttttttcattcgtctagccagcaattatttattgagcatttactatgtgctaggcactggggctagaacagagcctaagttagacagcatcactggccttctggaacatacaattggtgtaagggggaagccaggctgatagtcagccaattgcagcacagaattttttttttttttttttgagacagactctcactgtcactcaggctggagtgcagtggcacgatcttggctcattgcaacctccgcctcctgggttcaagtattctcctgcctcagcctcccgaatagctgggattacaggcgcccaccaccacacctggctaatttttttttttttttgtattttaagtagacatggggtttcaccatgttggccaggctggtctcgaactcccgatctcaagtgatccacccgcctcagcctcccaaagtgctaggattacaggcatgagccaccgtgcccggccttcagcacagaattctaagggatcagtggggcacacaggaataagtagaaattagctaggaaaaaggagcaagggaagataattccaagtagatgaatttgaaaaggtctacaaggaaaagtttacatttgaggaaatataagaagttggacatgttggagtataaggtttaagggagaatcagggagaggcaagaagtgagtccagaaagatgagcagggctagaacatgacctccctacatcagatcacctattggctcttagtttcttcatcaataaaacccatcttctatgatcctgagaactaaatgagaccatggaagtgaagaaagtcctcggaagctgcaaagctctggatagatgtgaaagtttgtatttgaggaaatataaggaacatcaggatgttgtcctagcttagagaaagatcatgctaatcaaagactcatggttaggaggtacattgggagtggaattgacaggcttggtatgtgactgtatgtaaaggctgaggggaaggaggcagcatactggtttctgatttgtgggcttgggtggccagtggtttcatgggctgagatgggtggtttgggggtctgtaccagttctgtggggggcagtgatgtttgtggacagttgagcccctaggacatcccactggatatggacaactgcatgaacaggtaggacataggtccgagctggagacagatttggcagccatcagcgtgcgctggtggtggaaaccccaggaagctaaaatcccccaggggaagggtgtacaaaaaaggaaaagctgtagaaggatgtgcccatggacccttgggatctgccctgtatccatacactgcatatgtgggcgacgctcagcaggatgtctggatggactgtgccaggtccctgaatggtacactacagctcctgagaaggtagcctcatgcctgtcttctttgatcctagaaaaaccaaacaggacatccagatcatgaaagatggcaaatgctgatcccacaggagcacctcaagccatgaagtgtcagctggagaacagtggtgggcatggagaggatatgacatgaaataaaagatccagcccaactgagtgaagtggtcagtgtctctggggacactggttgcagaggggataggaggtggatcttgcattgtcgcctctactctgaatttgatgtccagcttctctccgtccctctggtgctcctcaaccctgtcacatgtcccctcagaggtcccagttatcttctgcctgcctgagaggccagtccctgaccccaggatgctgcctagtactcctgtctgccccagcctggactatcattcaggccaagaacctaggtgaggtctgtatcctctgccactgctggggtgcacggcccagcctcagaaagcctctgtgaaatcaggaacagtagctcatacctataatcccagcactttgggaggctgagggtggcaggattgcttcaggccagcctgggcaacatagcaagactgtctttacaattttttttttttttaattagccaggcttggtggcatgcacctgtagtcccagctattcaggaggctgaggtgggaggggattgcttgagcccaggaagtcgaggctgcagtgacccatgatcgcatcactgcactccagcctgagtgacaaagtgaaaccctgcctcaaaaaagaaaaaaaaaagctttgtgagagtcatcctgtgccccccatggcttcctcctgggttgtgccagcactccaaggcatgtacacacagacacgtggcacagcaatggctgatattcaggcagtgtacacagtacagctgaactgcttgttgtaacattgaactaggtttttcacaatcgaaaacaggtgatgccccaagccctttgagtgcccccccataccctagccacccagattgtcccctggaaacacctgggtctctcggtttccacagtctggggttaattcctggcactgtgggatgatttcgagatgctgctctgctcttttggtcaacatctgctctgactggttgtcaaatattctgacattagacacagccccaggcacgtcctgcacacatgcactcacacaatgtcccacagggacacacagtgttcagaattgtcaccatagacagagactccctcctgtggtatatgttgaatacctcctcttttggccaaagcccctaggcagagcctcttgataatggtggcaggagaaaggggtatggagagaggcctgggcaggtgaaagcagtttcacacagactctgattcctgctgcagagtgggcagaaagggcaggaaatgctctgtagaagacacatgtctgagagaatgggcacaggaaggcaggaagctactttctcttggaccactggaatgggaacactgagcaggaattgttgctgatagatttgcaggtggcaggcctaggaggccatctatgaataaggccttctactgggactgattcatacctgtttcatacctgcatatgaatgatgtaggattaagtttggctgtgagaggcagaaaacccaaaataacagtgacttatagccagaacttcatttctcctacacatagacctatgtagtatgacaactccatgctcctctattttgttactctgccatccgcatcacagtttctacctcaggtccaagacagctactccaaccacagccatcacatctgcattctaggccacagagagaaagggcacgccacttgcctctgaagacatttcccttaagacatacacactctgtataaaccacattagctaaaatgtagtctcatggccttctgagcagggagactgagaaatacagtctatctggttggccatgcattaaactaaaaattagttcactttttgtaggaggagaaagtggatattggtgacatctaaaagtttctgccctaagtgggacacccctcttatacccaagtggcatagcccagccaagcatctcatcagtgacccttccttcccaggcttctactcatcatctgaggaatcagagattaagcctgaacaatgtgccaggcaccacctggaaggaatacctaatttaccacttacagatgtggactctgtggccccctctctgggaactaccccaaaacctaagtgttggcccctaaagaccttatgtgtggcatgagaccctgctgccctggccattgctgattagccaaaagattcttccccaggatctttcaaattagaaacaagcaaacagaggcagttcccctctggcactgaagctgtaggatgagcaacacaggggttgtcagcagtcacatgtcctgctttgtggaagaaggaggaatgagaggatgatgcaggcatgcagaggcagagtgattacaggcagtgtttgagttcctgaagcccggctgcctttgaccttcccaaaattacatgggataacttgatatcatgaccataaagtttctattttgcccagtctctttggaattaggcttctgattctttttctttctttcctttttttccttccttcctttttcttctttctttcttccttttttctttcttctttctttttgagatggagttttgctcttgttgcccaggctggagtgcaatggcgcaatctcggctcaccgcaacctccgcctcccaggttcaagcgattctcctgcctcagcctcctgagtagttgggattacaggcatgcgccactatgcctggctaattttgtatttttagtagagatgggatttctccatgttggtcaggctggtcttgaactctcaacctcaggtgatccacctgcctcagcctcccaaagtgctggaattactggcgtgagccactgtgcccagcttggcttctggtacttttgacaaaggtcctgactactatatgaaggagtctcagaagaggtaacctttaagttgtgccttgaaggataagtagaaaccattaactaaatagacaatgtcgaggccgggcatggtggcccacgcctgtaatccaatcactttgggaggccaagacagacagattgcttaagctcaggagttcgagaccagcctggccaacatggcaagaccctgtctctaccaaaaacacaaaaaattagccgggcatggtggcacgcacctgtggtcccagctactcgggaggctgaggtgggaggatcgcttgagcccaggaggtggaggttgcagtgagcagagatcaagccactgcactctagcctgggcaagagagcaagaacccatctcaaaaaaaaacaaaaacaaaaaacaatgtgggagaatccttccagccctgaggccgaagaattcgtttgtgggagcacacattcccatctgttctccctgtggtaagacttaccatgtcccaggcaagtgggcacctgagaaggggtgctctctccccttctcacgggagaagaaggggtgctctctccccttctcacgggagaagaaggggtgctctctccccttctcacgggagaagaaggggtgctctctccccttctcacgggagaagaaggggtgctctctccccttctcacgggagaagaaggggtgctctctccccttctcacgggagaagaaggggtgctctctccccttctcacgggagaagaaggggtgctctctccccttctcacgggagaagaaggggtgctctctccccttctcacgggagaagaaggggtgctctctccccttctcacgggagaagaaggggtgctctctccccttctcacgggagaagagtttcacaggcagaaaccccttgggtgagcagatctgcgtgggtggggcctgtgcaatcacctatcacatctgcccagcagtccatgcattagggcctcttttctcaacccttaagacaataaaggctgttaaggctgtaaattccaatgctgacggagattctgaggccaaatgcagctatagaagtttcactattgatgtgtgcattcaacattcatttgttctccaaatatttattgaggtcttactatatacaagactatataacaagttatgcttgttatatatgttatatatgttatgttatatatatatatgttatatatgtaatataactatattacaagttatgcttgaaataatgctgttaccaagataaagaagctccttcacccaaggaaccctggtgttaaaggcaaagattaaccaaataatcccacaagtaaactatcatggactatgtaaatgctgtgaaagaaatgtatgggaagtcgagagaggatcccacctgggggctggacagggtctcaacacagtaggtgagggttctccatgcaagagacatgtgagttgaattctgaaggatgaacaaaagtcacctatacaagggtagggttggaggaaggaaggtgaggagctgttcaagcagaggtagtagcaggagcaaagacccccaggcaggagagggtgcagtgcatctgaggacctgaaagaagagtggctgacagcagacagccaacaaatgagggggttgagatgagatgggagaaggcatggggtaaagacttttgcctaaagagaaagtgagccattggagggttctaagcaggggactgacatggcaagatttgcacttcatgatcactcgggctgctctaaagaaaatgaactagagcagagaggaagtgggagctagagggagaggcagaggacaagaggaaaaaaatcagagaatgggcctgtgcaaccctgtgttggttgagaggcagtacagtagaggggaaaagcactggctctgaaaccaaaccacccagctttgtgtcttggctttgccgcttactctacaaccttgcgctaatgacctaagttctcttggtttcctcatctctaaaataaggatatctgtctacctctcaagttatgtaagaattaaatgactaatatatatgaatagtttagaatggtgttcggcagtttggtgcacagtaacttctcattaaatgttgtggcccacgccacacagctatcacacaaaaatagatcaatagtgaaccactctgattaaagttggggtgcggtgggctgggacccgagccttgtccacaagtctacctctactaccttgtctgaggtcttaacctgcccagtcctgaattcctgggacttcaacgactctctctctgccaaatgatgtgagtctttaggtagagttatagcgcaaagggctactatcaatgttattaagcataaattatgactagagccacagaatgatttcctcattaatccaaaaaaaaaaaaaaaagcaaaccactcttctactttatgatgagcacataaacagtttttttttctttttatttatctacttttacttacttaaattttagagatggggtcttgctatgttgcccagactagactcaaactcctgggctcaagtgatcctctagcctcagcctcccaagtagctgggactacaggaaggagctactgcacctgactcaattttttttttttctgagatggagtctcactctgtgacccaggctggagtgcaggggcgtaatctcggctcacagcaacctctacctcccaggttcaaatgattcttgtgcctcagcctccccagtagctgggattataggcacatgccactacgccaagctaattttttttttttttttttttaaagcagaatggggttttgctatgttgcctgggctggtctcaaactcctggcctcaagtgatccgcccgcctcagcctcccaaagtgctgggattataggcatgagctgctgcgccaggccttaattttttaaaaacaatgatggggtgggggtgggggacagtccacaaaatggatagaacagctgtgaaggaaacatagaactcagaaggatatggttaacaaaaatgcctttgaaggaagcacatgtcactcctgagaagtttatggttggcttcaccacctgcctgctttactcattctggtgccttctctttgcccttcctaatccatggctctggcctggtttcaagcacagactcagtcaacactgggttctaaccttctgaagacttgcttggggacaaggaagccttgcatcaaccacaggctccatccaaggaacggccccctggtatctcatggcctgtggctagtcagggtcactgggaggtgaggacaaagtctagaacccaacaacccagccagatgctctggaattaggtcacaatgagggataagtggtctacttatgtgccaaacaccttgttctaggccattcccaatattcctgactaggtgcaacctcctggtgattctggttttacagctatgggactacacgatcacaagagcaaagaagccctcatgtatctgaagactgagggggcctataaacctgaaactggcccaaggcaaattagagctctcaccagcccaaagaaagcacccagaggtccaaacagctgggaaaatttgggcagaggtggccctctccagaaaaggtggattgctggacagtacaaccacagagacagaaggagaaaacagataggagctttactcaaaatcacaaagacactatttttcattgagaaccagtgtgagagtaggaaaattggcaaatggccagttgcccccagcagccctgaagaaatcaggtaaattccgctccagagacggcagagctggtggcgccattcttcagggcagcacagcctttttctgctacacctcactcggccagggcaaagtttgtagactgcagccgctcagtctcctggcagatgttctgctccactgtgtcacactcggctaggaatgcctagaaaatacacacggggcagtaagggcccatccaggggtagccgaccactgcccacacaaggctccttgcttacccattctggggaacccatggctgagactcaaaacagattgtgcatgaatggagatgggccactggcctgggttccaaggtaaggggagggagggagcataggaccagcattctgaccatgctctaggccagcaatcccctaaaaggtggtaaaggcagggagctttgcctcagggccactgcacagcaactgcacaatcgcaggaagcactgtgtgcatgaatactgcctcctggaattgtgtaatgtgtcagccctacctgctctccagtgagttccctccctaaatagtttaaattcaaatataattacagggacacaggtggctcttctctgacgtttggggttcctgctgataaatataaccaaaacaagcccataccacacaccacgctcctacactacctgattttgaacagataaacacacatacctacacattaacatattacaccttgtcgtgcactattacacaactcacctgaaccttttttaccaagcctttccttttcaatctactgtctttgaaattttctggcaggatctatggaagagtaagttgataatacaagttagtaaatagtaaacatgtaacaaataatcctcagtgaaaatgacatgagagcacataagaaacacccacagtacacaaaacaggtcacaggtcaccaatgtaaatgtgatatccattttcaggaaccctttccctgggtctgtatcctgtatggcctttccatggctcttgtccctataaaagctccctgtgttctcaatgtctgggccataggaactgatctttaacacagactttgttcttttattgtttcctatgtatggatactctgccctggccacaccatgggctcattgtgacaggaaaagtgcctgctgctgcttctttacacccaccctggccaacagaagtacacagtgcagttcaccttcaagaatgaagcatcaggctagagatatcattactatcatctgcaaaagagttaatgattttcaatggcctcacatgacctgggtctggctgaatcatctataagtaatgagccctgcagaattatcagtcacatattcatcagagaaagttaaatcctctgtttcctggaccatgagatcgtggactccttgggtcccagcttcatgacgattacagatgctactggcaaacataagtgtaaatgataaaagtcctatgctggagggctgtgagtgcctagaaagcaggaactgtcttatcatcatgcattcacccaggacctagcaacatgactggcacacaatagtagatgcttaatattctcaagtgatgggtttgctcaggcaataggagagtaaattactgaaagagtgaatgtgactgaaataaagtcaaagaaaactagttcttctcagctgaatatttacttaccagtgtgtcaatctcctccaagatcttcataaactgctctattgtggcttttactctcctatcaagtttgcagagagcttcagcttgcaaatccttgggcagaaaaccctgcggggaaataatgcattattgcaagggttctctgaggctgacggaagactccatgccacaatactaatgatgcaatcacactgagcccaccatagccctggcaggccaggccacatctcagatccacaactttaactcttggaaaaattaaaaaggctggccgtgggccagtccaagaattctatcaggttgcagtctgctctacctcgcatgacccactgtggctgcaaatgcctcctgaggcttggctccagtgaagcccccagtcacaagaagaggcagatgttaaaagcacaggtttagagtcttcaaagcctacgcctgaaaactgactgccatttactaacttgtgatcttgagcaaattatttagcctattcatgcctcagtaccctcattttaaaaatgaagattatgatgcccacaccctagatggttactgtgaggtaaagggaatatatgtacatgtgtcactaacttgtggcacagacgcatgctaaagaatggcagcagtgcttatttttatcaaattgtctaatggttcactcacacagcttggcctaatgaccagttagctggtgacaagagttggatagcagggatctctgaggatgtttatcacagccacgagctacagacacagatttcacaacacgtagcaagagctttaaacatcacccagcaattccaactcaaagaatttattctaccaaaaaaaccaggaatggtcaaaaaagatttacgtccaaggacagtcaaagaagcattacacataatggtaaaaataatattaaatgaacaatacagagttggctaggtaaataatacatttatacaagatgaaatgcatgcgagctttgaaaaataccatcacaggaaaatgtttaattttttatccaataaaagaatagtttataaagtgtaaataacattatatcaaatttttttaagatgaaaaatatatttcaggctttggtaatcgtcatctctgagttggtgccccatgggtaatttttattttccatattagtgcctatacatgtacttaaaacttttgtacagtcagcatgtattctgtaattaaaacacaaacatataggccgggcgcagtggctcatgcctgtaatcccagcactttgggaggccgaggcgggcagatcacttgaggtcaggagtttgagaccagtctggccaacatggtgaaaccccatctctattaaaaatacaaaaaaatcagacagatgtggtggcaggcggcacctgtaatcccagctactcgggaggctgaggcaggagaatcacttgaacctggcaggcagaggctacagggagccactgagattgcaccactgcactccagcctgggtgacagagcgagactccatatcaaaaaaaaaaaaaaaaaaaaaaaagccaaaacacaaacacaccccaattaatgctataaaatgagagggaaaaataaataaaagtggtcttgagctagtcctaatccttactgggttttagtaccccatctctaatataaggaattgaataggatgactcccccaaccccactatcatgttcaacttggaccttctatgaaccaacaaaatgttatttgccttgccaaacacattacaacagcccagagagaagctacttgttctatttcagacaatacatgatcctagcaaggcaggtgctctcctgtgagcataaatggatgctggctggggtttgacaataactatgacaataaatgcttataaagcacttagtatgtgtcaagctcaatctacattatttaattctcccaacaatcctaatagggaaatgtcaccattattccatttttacagatgaggaacttgagacaaagataaacttgttcacagtaagagaaagggtgaatccaggatctgaacccagggagtctgactgcagaacatgtccccataaccacaagttatatccaggaagctctgatagaaggcagaaagttaaggtccatgaagagagttacctgctggattccagtaagctctttattcaactcttccagctggtcagctatcttctccacagacttctccaaatgtttcaacttctttagttcaacctcttcctgtggactgttctaaaatgtttaagaagaaaataaagccaatagtcaaaaagaacaggctgggcatggtggctcatgcctgtaatcccagcactttgggaggccgagatgggcagatcatttgaggtcaggagttcaagaccagcctggccaacatggtgaaacactgtctctactaaaaaaacaaaaaaattagccaggcatgctggcgtgcacctgtagtcctagctactcgggaggctgaggcaggagtatagcttgaacctgggaggtggaggtttgtagtgagctgagatcgtgcacctgtactccagccagggtgacagagcgagactgtctcaaaaaaaaaaaagaaaaaagaaaaagcaatcaacaagaacagcagcctctgtcaggaaaaatacctgaccacacctgcatgaagccactcacctagaaataacagttttaactctgttgcttcttggaaatcaagtcaaagggttatacatcaagttttccatctacaaagactccagactagagagaaggtgttaggtaaacattctggtgagggccctgacagcttgggtgcagagaatggagacaatccaagtgccagattcagtctcagccctatactgatcaacaaccaagactgaagcctggagggtaatcacatttcagtaaacacttgtgaggagtccagaatggcaagaaaggtggaattctaccattcctttaaatggaattcctaaatggcagcctccaattgagcgctcctgtttaatgtgatgctggttaacaacgatgaatacttttattgaacacttcctacatgccacacactatcctaagcaccttacctattttttaagccttaccacaactccatcagggaagtactgctgttttacagatgatgaaactgaggcttaatgtagtaaagtaacatgagatcacacagtccaaaagaggtagattagacttaagttcagacttttttcttttttgagatagggtctcactacggttcccaggttggagtgcagtggctgtttacaggcatgatcataactcactgcagcctcaaacccctggactcaagtgatcctcctgtctcagactcccaacttgctgggacaataggcatgtgccatggtgccttccttgagttcacacttcgctccatacgctctgtgtcagctccaagtaaaagtcctatagtttcttcaaacttgactctttggttctgcctgttgcccatcaccattctccctgaccctgaagcaagaaatttagaatatttccctcttctctcaggtaaacaattgatagataggtctagcagctttctgcttagttatgctatcccaaattattcacttctctttgtggcaagtcctgagttccagtctcctggcagttccaagtctggattagattttttttgccttcactttgtttatctgccctctctctactcagccacctaactcacaataagggaacttcatatgctcataattctgctgtgtcacaatgcagggctggccacagccctctctcatcaccttaagggttgctgacctcatctgtctttttttcccctcagttctttagtctgaaccttcctttccagtcgaaggttttcccttgtgggagattttagttaaaaggttggttaaagggagagaggctcctgaactggaacagagtgattattcttaatatctacaagtttattttaacaaaagactcttgcaaattctactccaagtgaatgagacctgtcccaggcaccattttaaccagaccaagattccaccaccaaaacaaaaaacatattattaaggcagcacaaccgctcctaattcctagagcaaaagttctaaccaacaggagcaggagggtatgagaacaacaaaactggtaatcctgtaaaaccaataaagattgtatttgtttagagaggtgttttatcaatgcagaatctgggtccccagtttggtcttctaaacagaaacatgtataaaagacttcagtcatttgattctgaggatttctgatggaaaaagcaatttacctttttcccaattaacatgacccggcaaccatcttgtattccaagtgctgacaacggtgtttccatttccttcagagattttcctaaaaagaggagaaaggtaggccaagttgtaataattgtacaacactgaaaataaatttcagcaggatacaggaaatagacaagtgtgttcactaatgagaactggtatctttttagagggtgtcatgacccagtaatttcatttccagatatttatcctaaacaaataattggacatgcgactccacagtaactactatacgataatattcagtgcaaccttttcataatagtgagaaactggaaagagccaaatattcaggaatcagggaccaacgaaccacactacagaagactttaaagtcttcagtaggcattaaggtctacagtagccattaaagctcattttttgcaggaaaccccaataccacaatgaatgctgatgacacagtgttattatgaggggttttatccaggggaacattttctttttcatgcattcctctattttgaaacatgaatttctattgtctttataattcagaaataaaatatttttaaaaattaaagacaatatgttacactatgaaatataaataaaaatgcctcctattactaaattctttataatgactgacacccaatggggtaagtctttccccagtggataccagaatgatagattctcaggggggtgggaagacagagggcaggggccaggagggtgtgggtcctggcagaaatgagcatcatgcatccactgagcccgccacatccaggcctcaggtaagtttgctcaaaacctcctttgagtcagaacaatgggaggcactggaaacacagcagtatctccaccctcacggaggctgttattttaacagagaaatcagatgttaagcaactaagaaaatgattatttaatagtaatttcatagaagtgatgcaaaaatagcagggagtaccatggtaacatataatgggaagatgatctaacctagcgagggaagactgcccatgagcttcatcgaaaatggtgagatttctgccatcatcataagacttcaaatctgacacctgtccaggtgtttgagagtgtccaatacctagcaggtcctcaataaatatctgttgaagaactgaatgaataaacaaataaataaaaattgtcccagtttgaaaacagagtgactattaggaaaagttcagcagttttaaaactgtcctttggccataaggaaaagccggaaaagaaatgcttacccttggccaggtgcagtggctcacacctgtaatcccagcactttgggaggccgaggcgggtggatcacctgagatcaggagttcgagaccagcctggccaacatggtgaaaccctgtctctactaaaaatacaaaaattagccgggcatggtggtatgcacctgtaatcccagctacttgagaggctgaggcaggagaatcacttgaatccgggaggcggaggttgcagtgagcctagatcgtgccattgcactccagcctgggcgacaagagtgaaacttcgtctcaaaaaaaaaaaaagaaaaagaaagaaagaaaaagaaatgcttacccttaaatatgagtttctgaaaagactgtggaacccctatgacctcttcaacaacctgggccaggtcttggacaactggttcactgctgccctgctgggaggtaacatgaaggtcgtgcttctcattgcctggggagaaagaaaagcatttgacgaatatgattctttcacatacaccaatataggatgacactttatcacatttatttacccagccttcaaggcccagctcatatgccacctactccacagagcctgcccccatgccacccagctttcctctggtgacctcctcaagtatctctgtttcctctattataataactaacaatatgaatgatatctgctaacattttaagcatttcatgcataatctaatttaatcctcagataaaccccacgaagtagatctacctattacttcttatttcacagatgagcaaactgtgacttcaggcaagttaaggactgcctatggagactcaactgttggaatcagaagttgatatcagatctagctgattcccaagcccacctttttcatcacaagccatctgcttcctgtggcttgactgccctgtaccctgtattgtattggtctcgtctcgcttgctgtaatgggcaagtgactgttttcctccaagtctctcccactgaacacacttgagtgcatccatgatttgtgctaagtaaacagacaaatgcatacgaacagcagagcctttctttctgaagaagagacgccaattcttttccagggatgcggacagcaaggagggagcctgtgtacagtacattacaccaaggtttggttcccccaacagctccgtgaggtcagcaggagccagggttaccaaatctacttcacagaggagaaaccggattcttagaagaagccgtccatcccaaggtcactcaaaaccgcaggatctagaatccaggtctccagattcccagacccttgggcctcccctagctggttctagagaaacctcatggactcagctctccggtgtactgacttcatttggtggtgtgtcaactccaacagtaggcagacccaaagggtgcccagagtacaacgcttggacccacggccaactcaagcggcgcacacggagaaggcactcagcacacgaggagcaccccggcatgcacgaagttctgacttatcacacacggagcagtcgtagaccacatggcccaatatatgcctgacacaaagggcacaataactgcgcgggcacacaaacacaaccaggcccacgacgtaaagcacggagaagctcaaacacccaggatcgcacaaatgaccagagacaaaatacaccggccacatggaaaagtgtacagacacaagcccgggacaaaagacagttccacggacacaaccaataacccacgcttccggacgccaggacaagcgcaaggtcacacgcttctggaggacacgtgactaaacccacagaccccgccgggctttcgggacctgcatggagcccacctggcgcccgacactcactgtgggtgacagtcacggtgagcccagctgccgccatttcctccctggtcacctcctcgctccgggtcgactcctcgtcccgggtcacctcctggctccgattcatctcttcgccctgggtcgcctcctcactctgggtcgcctcttcactccaggtcgcttcctcactcagggtcaactcctcgctccgggtcaactcctcgctccgggtcgagcggcgccgggttttcttcttcatccgcggcctgcgagcgccggcggcggcgcccctggtgggtcggtcatgcccgctggcagtactccgggcaggtggacgcccagagggaggcggaccacgctgggccgggggctccgactggcgcggctcccggcctggccgaagggcgcgcagccgggaacccagccgctcccggtcgcctcgcggtctccgcgcccccccgcgctgagccaggcccgcacttgttgaccgcccagcgatggaagctgagcgcggcgtctcacaaccccgcccgactacttcccagccccgccccggcctgccggccccgccctcgccctatgccgcgttagttgcctccaggccccacccactcaactgaggccccgccttgctacagtaaaacccctcccactccttctaccaacaccccgccccctgcaggctctctccgagagcaccaagtccttttgctctccatccccggaagacccggctgaaaatccggaaaaagaatcgggaaacgccaggaggcatattgcgcttgcgcacggaggggccggaagtcgaggcgggagtgactctgcttccgtttctggttttgctctagtgtttgggtttcttcgcggctgctcaagatgaaccgactcttcgggaaagcgaaacccaaggctccgccgcccagcctgactgactgcattggcacggtgggcatttgatcatgcataagtaggctcaggacctctgacacacccgaccccgcccacccccagccccgggcccatattcttccacttcatttcgggtcctgggccccttacacgtcgtccctctctatctcaccttctccccttcatccctgttacccaagtcattcctaacgccacaaaccagggaacccctaaccccatcactgccttgccctgccagcacccaacccgttttgatgcccattgcccgtccactcgctctcgccttgatcctctcacctcacccagccctaggcccatacacccttcccacctcatcctgcctgatcccttacccttcttccatctgtcatccccagtccacatcaggactcagcttgatatcctaggtcaacatatctgtgccttcgtcctggatctcagtaacacaaaactcagaaccctagcccctcagattaagccaccatccccgatttagggaatggcattagatctacaatcagctggtttcacttggcactggcccatttcatgtgcctcttggaggaactctcagcctggctagtctctgattctagggaaattccaactcaactcagtgattctcaaattattttctgccccaacccacttgaaggctacctggtatatcagaatcggggcagtgtggcggggggtaagagaataatttataaagcccagggtttctggttgggaatacccttctttgtgaaccactgtttttcacccttccccttaagctcctcttttcttcctctgtattccttcctctctacctgccccttctggaataagtgtattgcagtaactaccagtgcatttgatattttcccctaaggtggacagtagagcagaatccattgacaagaagatttctcgattggatgctgagctagtgaagtataaggatcagatcaagaagatgagagagggtcctgcaaaggtaaggtgggcagcaactgctgcacaaggtgctggcagagcctagttttagcacctatagaaatagggcctagttcggctgggcgcagtggctcatgcatgtaatcccagcactttgggaggctgaggcgggtggatcacgaggtcaggcatttgagactagcctggccaacatagcgaaaccctgtctctactgaaaatacaaaaacttagctgggcatggtggcaggcgcctgtaatcccagctactcaggaggctgaggcaggagaatcgcttgaacctgggaggcggaggttgcagtgagcagagaccacaccatagcactctagcccaagtgacagtgtgagactccgtctcaaaaaataagtgaaataggacctagtgcaggggctgtgagcatccctacagaagagatgcttacagtctggtaaggagaaaacatgtgagggtgtatcctttagggaggagagtttgcaatcaaatatggaagggaggctggggattgatctggtggaaagagatgctggtcacacgtctaaaagcatgtacatgagaattagcatattatactgagaaggtggtaatctggagaggaagactaggctgtgctcaagatcaatgacttgctaagctggtcaggttaggttggtatattagactgcttaaggagtggcctgctgggaaaaactgaactaggcatctgggaccagtgttctaatacactgtcactgccttctagttgtgaccttgataaagtcacttattttccactcctgttaggtagaaacataaaatactgtgtttaagcacatggactgtggatatagaactaccttgttttttccagatccataacttattaaccatgtgagcctgggtatcactgaacctctctttccccatctgtaaaacagagataatacccaccttacagtatgaggattaaatgaggtaattgatgtgacctgtgtaccactatgtctaggataaagtagtactcagtaaatatgagttatgatcatctgtgaagtaataatacctgtttttccttcctcactggagaagacaaataaaatgatctacagaattctatagaaaaggaaggcttttcccagccatcttagtggatggtgtggaatgaagagcaaccagaggtaggaaagcccatttagatttgagacaatgaaagcccaaaccatggtggtaggaaaccaaagaatcagtttgaaagtgagttctgaaatcagctaacaggatgactgtgcatgaagaaacaacagaaagaggaaagataaggttgataaaaaggttttcaacctagagaggtgagagattggtgggccattgttacttatttcaaaggtgagataaggttcaggagtttggaattgttgaggttaagttgatgggctgtacaagtgaagaatctccctaaggcaactggatatacagactcagcacttttggggctagaggcagagataatatgcattaggaaaagagaaagtagttgaggactctgggatgtgggatgcaaagacagataggagcaaaggcttaaagactggaccttagagatacctgtttttgggaggggaagtacagaatccaggagccattatgcctactactttgaagaagagaggaagtaggcatgtgagtttgaggctatgggaaatttcttttaccgtatatgtgttttccaccttatttttattaaatctgtttttctctccagaatatggtcaagcagaaagccttgcgagttttaaagcaaaagaggatgtaagttacacacacaatttctacctctagcaggtttaactaaaagagaaatggtcttccattccttcaggttttcatactattttctaagcactcttgatttaattacaaattttcattgacgtgtaattaaatacagttagctgggttgttatctgttgtaacaacttccatctaaatagaactttttgccatgatggagatgctctatatctgtgtgttcaatacagtagctattagcaacatgtggctattgagcacttgaaatgtggctagtgtgactaaggaaatgaagtttaaattttattcaatttaaataatttaagtagccttatatggttagtgactactgttttggactgaccagatctgtagggtttggttttcctattatttattttagagtgtaccttttttgtttttgtttgtgaagttaggaatcctaaatgtttgttccctcccaccagaataaatttaaagatccttaatttgttttaggtgactatgtcccaattttgagcagaagctaactagtatctttggtgcctacctctgtagactgttcagctgatgagatcctctgcagggttatagaggtcaggtataattagctatcgaggagccagaaagattgtcagtgtctctcttcctatattaaaatgactttttataagataccagatgccatcttcctccttttagattagatcaaattggaaaaagaaattgtaatgcctagactggtgagggtgtggtgaaatgatttaccttcttaattggtggcattgctagttttaagtaaccttttttgttataaaaagaatataggttcattgtagaaacttggaaaatacataaatatgaacagaagaaaataaaatttacctagattcttactactagaaataaccacctttaaaatgctaatttcttccagtttctttcctctgcttctgcatacgtggtatgtgtgcatataactttttagaagaaatgaaattgtagtgtgtatatgtaggttttccttttccacttaatgttatatcatgagcatctccctgttcttttaaatattctttggaaactttacactttttaatgagattataatattctaccatttgcttgcaccatgaacggaccattctttttctagttggatagttagattgtttccaatattgtataaagaacatagtgacataagtctttgaggtaatattataatttgatataaaactgtattttaaaaacattttgaacaccacacattaggtcagatggattacctaattatgggtgcaaaattaataaaacacctggggctgggcacagtggctcacacctataatcccagcactttgggaggccaagacagaagctcacttgaggtcaggagttggagataagcctggccaacatggtgaaaccccatctccactaaaaatacaaaaattagctgggcgtgtttgcatgcgcttgtaatcccacctacttgggaggctgaggcaggagaatcgcttgaacccaggaggcagaggttacagtgagctgagatggcaccactatactccagcctgggcaacagagcaagactggctctaaacaaataaataagtaaataaataaacaaaataaaatatgcctgtcttcaaggagttcaaaattctggaaaaccatttagctatatgtatgaagagccttaaaaatagttttaccctttgctctaagaatttcacttctgtatatttatcatagaaaataattataaagccttattaagatatgtagcaggccgggtgcggtggctcatgcctgtaatcccagcactttgggaggccgaggtgggcggatcatctgaggttgggagttcgagaccagcctgaccaacatggaagaacccgtctctactaaaaatacaaaattaaccaagcgtggtggcgcatgcctgtgatcccagctactccggaggctgaggcaggagaatctcttgaacccaggaaggtggaggctgcagtgagccgagatcgtaccattgcactccagcctgggcaacaaaagtgaaactctgtctcaaaaaaaaagatatgcagcaacacagaaaaaagcaaatgctataatgttaagtggaaaatagtgttataactaaaatacagtcatgtgctgcataacaatgtttttgtcaatgaatgacagaacagactgcattataccactctggcccctataaggttataatactgtatttttactgtaccttttctataggatgtttagatacacaaataccattgtgttacaattggctacaatattcagtacagtaacatgctgtacaggtttgtagcctaggagcaagcagtaggctatatcatatagcttaggtgaatagtgggctataccacctaggtttgtgtaaatacattgtctgatgtttgcacaatgatgaaagtgcctaacaacatatttctcagaacatatccccattgttaagcgatgcatgactgtacatgcaaaggaaaaagactggagggacacatcaaatgatatttgtgttagagtgattaaattgtttttgccaatttttctgcgtgatacctaatttttaagttttttgttccgttgttttttttttaaatactcttatttagtgtggggatactttgttcttgaggatttctatctggttcatatatttgccattctcaattgactctaaaaaggtatgagcagcagcgggacaatcttgcccaacagtcattcaacatggaacaagccaattataccatccagtctttgaaggacaccaagaccacggtactcccaaaacaccttttcctgttatttcatgtatttattcttattctcttttccgatggctttttaaagacagtttaaccagccaggcacagtggctcacgcctgtaatcccaacactttgggaggctgaggtgggtggatcacctgatgtcaggagtttgagaccagcctgaccaacatggtgaaaccctgcctctactaaaaatacaaaaattagctgggtgtggtggcgtgcacctgtaatcccagctacctgggagtctgaggcaggagaatcacttgaacccaggaggcggaggttgcagtgagccattgcactccagcctgggcagcaagagtgcaactctgtctcaaataaataaataaataaataaagacaatttaaccaacatgacttactaaaacattgtgttttcttcttccttttcttaggttgatgctatgaaactgggagtaaaggaaatgaagaaggcatacaagcaagtgaagatcgaccagattgaggtgagacatatgctagtttctgcaagaatgtgcactagtttctgagagaatccaaacgagtgtgcatgtgataggaagagcacaggagaggaactgaatcttggggctgccatttactagtagagtaacttcgagaaagggtaccaaatgtctcagtttcctcagtgcaaggatcctaataccacatacagttacagacagtccccgatttaagacggttcaacttaacgatttttcagtttgatgatggtgcgaaaactatatgcattcagtagaaaccatactttgagtatccacgtaaccattctgtttttcagtttccatacaatatttaataaattacatgagatactcaacactttattatgaaataggctgttagatgattttgcccaactgtaggctaatgtaagtgttctgagcacaattaaggtaggctaggctaagtgatggttcagtaagttaggtgtattgaatgcactttctacttaagatattttgaacttaagatgggtttatcaggatgtaaccctatcataagtcaaggaacttctatattatgaggatgaaataaatgagctagtatctctacacacacaatgcctggcctatgataagcatccagtagttacttttaactaattcgatgatatttagtctgtttcttcgatggtagtggtgttgttgcctattcccaggattgtcatgagtgttaaatgaaggtatgtaggtaaagtgtatgtaaaatgtttaacccaactcctggcgtggtagacttggttcccttttctagtaattctctttagatttttaataataatgtcattagttccttaaagttagcatttcttattggaattgggttttgaccagggagatgagccctaagagcttggcagctctcagctgtcagatgaacagcccaggtggcaagaagagatagcagagggagtgagtggtgactggtcagaggagagaggcttcctttctgcatataaaatggcgctcttgacctttacccccctgactagaatgtccatttccttgaatgcagggacttgattttgttcactactgtgtccccagtgcccataacaatgccctgccatggttggtgctcagaaagtatttgctggttgatgaatcagaggctataaagggagataaagcaaaaaaaaaaaaaaaaagagagaaagcagtacagcctgattcaagcagtgtttgttaaaataccaggcattttattgcctctgcaaagatattctctcataaagctgatctttagtaagagtgaaggcaggctgggcatggtggctcactcctgtaatcccagcactttgggaggccgaggcgggtggatcatgaggtcaggagatcaagaccatcctggctaacacggtgaaaccctgtctctaccaaaaatacaaaaaattagccgagcatggtggtgtgtgcctgtagtcccagctgttcgggaggctgaggcaggagaatggcaacccgagagcagagcttgcagtgagccaagattgcgccactgcactccagcctgggcgacagagcaagactccgtctcaaaaaaaaataaaagagtgaaggcattcctcccctctcttattttttcaagcatccctcttaggttgcctttgtctgtctctaatcctccacaaatgtttgcatacatggaattaaactttgtgatactctctaagagcttcactgatgaaagtgttctgtatatgcttgtctttttttgttgttgttgttgagacagagtctcgttctgtcaccaaggctggagtgcagtgtgatctcggctcactgcaacctccgcctcctgggttcaagcaattctcctgcctcagccttccagatagctgggattacaggtgcctgccaccacacccagctaatttttgtatttttttagtagagatggggtttcgccatgttggccaggctagtctcaaactcctgacctcaagtgatccgcccacctcggcctcccaaagtgctgggattacaggtatgagccaccactcccagccatttttttttttgtataatatcatttgccattaaaatataatgaaatgcaatggtattttctgcttttagggttccttgtgttttaattaaagctatttaataggaacaaaagagaaactttggtcttggtgaatgctttgtatgtctcttcgtctttcacctgtggttgtctgtctgtctccctgcctaattatccttttcctgtcctccaatagattgccagcatgacaggtggagagcccctttaactcttttggtgtgtatgtgtctttggttagatcgaattttttggtcagatttattttcctaaaatgctttacttagaaaatattttcattgttttatagctttaactttttattttgctgttgtgtgtgtgtaggtctgtttttcttctgctttttcagttgctgcatatcactttgtcaatgttctttttagcttagtgctttttttttttatattgcttttgtttgtttatacaatagagaaccagttaatggtttgtgggataaattttttctgtgtctatcctggagtcttgctaggaatcctattcatagatgatccgggaagatgtgtcttgatgtgtaatactattgtataagcttgacttgattagctttctctatgttattttcattgtctttaattattactcagccagtgcttctctgtgtagcagagtgttaaatatgcatataatttggcagtttggtacttggaaatacagaaaatcaaagtttaaaaaaaaaatttcccctccattttactacccttttcacctttcacctttatgggggccaggaaggaattttcttttttcttttttttttgctgttgcctaggctggattatagtgactcagtctcagctcaccgcaacctctgcctcccaggctcaagccatccttctacttcagtctcctgagtagctgagactacaagcatgcaccatgcccagctaatttttgtatttttttgtggagatgaggttttgccatgttccccaggttggtcccaaactcctgagctcaagtgatccgccctcttttgcctcccagagtgcttggattacaggcataagctactgcacccagcagaattttcaaatgtcttgcattgctttagaaattctgaaggataaatggtgctgatttggtccttttgctttatcaacactagttctgttcctgtctgtgtggaattttagtatatgaagagtgtattgttgttccgcacataattaacacagtaaaatatatatagtattaggtgcttagtgttttacatatattattgcaataaatccttacaataaccccagtgagatatggctattttatttatttatttatttttgaaacagagtctcgctctgtcgcccaggctagagtgcggtggcgcgatctcggctcactgcaacctctgcctcctgggttcaaacgattttcctgcctcagcctcccgggtagctgggattacaggcgcatgccaccatgcctggctaattttttgtattttagtagagatggggtttcaccatgttgcccagactggttgcgaactcctgagttcaggcaatccacccactttggcctcctgaagtgctaggattacaggcatgagccaccgcgcctggccagatatggctattaataattccattttacagatgaggaaaataaggcttagagacattacttctcattgagtaatggcaaaattgaacttgggtatatctgactccagagtctcactcctaaccattataccagctgccctttgttatgctataccacttcttagattggtttcatattacagtttacccttgaacagcaaatgcagtttgaactgcacgagtcacttatatgcagatatttttcaaccaaacgaggatcgaaaatatagtgtttgcaggatgcgaaaccacccatatggaggaccaactggggacttgggtgtgggcagattttggtatagacagacatcctggaaccaatcccttgcgtgtaccaagggacaactgcatttttagccttgtagtaatctcccagttaagcacaggtagattattcacacagggtttatgcccttggtccatttttttcaccagccttgtcttggctgtgacacctatcctgattccctttctgattctccatccagggtgggcccatgtacaactcactttttgtaccacttcagttgtttctactcttgcctcctttctctacacagtgtaatctgtctttcgctgacttgagaagaataatttgcttgtctcagtaacctccctgtcttcattaactagaaaatgattgacagtttagatcaagataattgcttgatttaatgtttcaagtaaaactttctgtaatagtagacagctgacaatcatctattctcacataggactttgggcttccatgaggcactttaaaatcaaatccagccgggcacagtagctcatgcctataatcccagcactttgggaggctgaggtgggcagatcacctgaggtcaggagtttgagaccagcctaaccaacatggcaaaaccccacctctactgaaaatacaaaaattagctaggcgtggtggtgcacacttgtaatgtcagctatttggaggctgaggcaggagaatcacttgaacccgggaagtgaaggttgcagtgagctgagattgcaccattgcactccagcctgggtgacaaagcgagactccatctcaataaataaataaataaagtaaaaaataaaatgagagatcatcaattctattctttaagttcacattttgccaccaaaaataggcaagggattatgtgggtcagtaacattcataattattgttagaggaggtctttgggcttatggtttttaattctttaagcattctctcatacttttaattagaagggatgttttaagagttacttgaacctgtcctttagaggagtgtctgctcagttgttaacattaaaaaattgctagccaaagactgggataggggaggtgaactaacagttgttgagaactgtttatgtgcttggcattttatatacattatctttttaaaaattgctcatgtctagattcaaaggagaatgtaggggaaaagggtagttaaaagaaaatggtaaatgagagaaaatcctctcatatatatttccgtaggatttacaagaccagctagaggatatgatggaagatgcaaatgaaatccaagaagcactgagtcgcagttatggcaccccagaactggatgaagatgatttagaagcaggtaagttatgagaaaagtaatgtatatttagttttggagtccaaaagcaacagctgcctgggaccttttctcaaatgctagtgaaaatttctatcaggatttcctgaaggttagtttatggtactgtccctgggcaaagagcttgtgaggcagccacatcagattgcatactccaccaacaacagtgggatggatcaactctgaaggaagtccaggtacaggctgacctggtgcttggtatctgtaagtgtcctccacgtggcctttccttgctgtattccttttgattttgttctcactattttcctagttggagtcctctccctcagaacagcaaaaccaattaagaaacaataattagggccaggtgccctaatcccagcactttggaaggccaaggtaggcggatccactcaagcccaggagttcgagacctggctgagcaatatggcgtcaccccgtctctataaaaaatacaaaaattacccaggcatggtggtgtgcgcctgcggtcctagctactcgggaggctgaggtggaaggatcacttgatcccaggaggtagaggttccagtgagccgagattgccccactgcagcctgggcaacagagtgagaccttctctcaaaaaaaaaaaaaaaaaaaaaaaagaatagttggcaaatacttagtgtgcatctactctatgccaggtactctactaggtggtgggaatttagcactgaataaaaatgcagcccctacattcatgaaccttctctagcagtggaagacataaatggtttgcttcaagtaattaattactagagcacagactatagggaagaagtatggggtagcatgggagcacatactaagggactctaacctagttagtagtgggagagaggcatgggacctgaagggtgagtaggggatagcatgaaaaaatgagaagggttgtcgaatggcctcagggagagcagtctggaagttattgcgatagccatttaagagatgatggtggccgagactagctagggtgatggtagcagaaacagacagaagtggacagattgaagacatcttagaaaattgagtggacaagacttaatgattgacaggatgtggaagaagtgggaggtgtcaagggtggctgtcagtttctagcatgagtaactgggtagatgacagaaccattccacactggatttctattgtgtgattcccctgttacattactactgctgctttcccgctctctccatggtctatttttgcctagaacctttcattttttttccacttatttctttattttttaatttcccatcttcaattgcccctgataagtctctacctgctattgtcattcctcttggccacttccaactcattttaccacagacttatttttggagtctgatttcacgtaatggtcacacagcatacaacaatctcatgccctcttcactgccttctttcaagtccatcgataaatgagagaaattattagctgccagttttcttggttacattttttttaaatgttgactgtttcaatctcagagttggatgcactaggtgatgagcttctggctgatgaagacagttcttatttggatgaggcagcatctgcacctgcaattccagaaggtgttcccactgatacaaaaaacaaggtgaaagctttttctgtttatatttcaatgcaaaatagcaaaggctttatgcttgaccataagtctgggaatctaaaaggtagtcttaacattagaacaaagaaagacagtcctggtcattattttgtgaacccttgaaggtccggtttttctgcattggatgatgaactgactgcataaacactgtcactgaggctcaggaatatttttatagaatgacaatttgtgtaacatacatgatcacccttgttgtgagctggcactgggtaccattgatgggtcttagacatttcctgtaaaagcgtaagcaacacatgcatgagacttgctaggcagcagtgaaaaagtctcactcttcatacacaccagttaattactggctggatttttaattttattttcctttctttttcttttttttttttcctgtacacacaggagtttagaatgggtggattttctaaactatggattaataatttaagcataaaacttaatgtagaaagattctaatttaaggcaaaagaatcagaacacctgacactaagtatgactaattacttagctattgtaagcttttcttttccttgcatctgtaaaatgcagataattacaagtatctcacgtaattgttgtgcaagcaaattagatcttgtatgtaaaggactgtgcaaacttaaagctctgtccaaatctacatgattgtctttttttttgagacagagactcattctgtcactcaggctggagtgcagtggcgtgatctcagctcactgcaacctccgcccccctggttcaagcaatcctcgtgcctcagccaccccaggtagctgcgattacaggtgcgcgccaacatgcctggctaatttttgtatttttagtagagacggggtttcaccatgttggccagactggtctcaaactcctggtctcaggtgatctgcctgcctcagccttccaaagtgctgggattacaggcatgagccactaataatgacaaccaggctgggcaaggtgtgactttgagcaaaatagcagaaatttatgtcttctttttgaacctcatcagtttttcctacctgtaaaatgtgagagcaaagggcagggagcaggtaatttcttaggtccattattactggtttctgtgagtatgcatcttcctctattgtatccttcccttctctgttgagcctgggatagtcttgcctttctgaactgcccactcctccccgacctctctggcaacttcaaggtcccaggtccatgggttgctttttctcagcaacccatgaaataatttttattaatactaccatagtccaccttgttaattttctagtaacaagtccctgtagcggccaggcgcggtggctcaagcctgtaatcccaacactttgggaggctggggcaggcggatcacgaggtcaagagatcgagaccatcctggccaacatggtgaaaccccgtctctactaaaaatataaaaaattagctgggcgtggtggcaggctcctgtaatcccagctacttgggaggctgaggcaggagaatcacttgaagccgggaggcggagcttgcagtgagccgaggtcgtgccattgtaccactccagcctgggcaaaaagagcaaaactcaatctcaaaaaaaaaaaaaaaaaaaaagtccctgaagcatctatgttatttccactttgagaaggtcacagattcctgagttatatatgctgtggatatatgggggttttgttgttgttgttgttttatctttttgagatggagtcccgctgtgtcacccaggctggagtgcagtggcacaatctcagctcactgcaacctccacccccggattcaagcaatccacccacctcagcctcccaagtagctgagattacaggcatgcttcaccacacctggctaatttttttgtttttaatagagatgggatttcactatgttggtcaggctggcctcgaactcctgacctcaaatgatccacctgcttcagcctcccaaagtgctgggattacaggcctgagccaccgcgcccggcctgttgttgtttttaaagtaaaggaataaaagaatggctactccataggcagagcagccctggtgttttcattgatagtgatgtcgctgcctatgattatagtaaagcatgatatggaagtgactgcctatccacgggcactgctccttcaaggatttgggaggctaagaaaggtattggtccagagtgaaaatgcaaatctggaggcaaggacccactcctcaacctttcctttttgactctcccagcctccttttcccctttccaggtttactcttagatttctctttctccctctttcactctctttcccctgtggaggagcccccttttggccctttctagttctcttcttgattcatcacttcctcctttacctttcatgaaaaagcttgttctcatcttatgactgcgattttggttttgattgattaaatacttggaaatgagttttaactattaaatgtttgtaatcctttttttttttatcaaatagaaaaatagtggcactaaacattgcttcctttttacaggatggagttctggtggatgaatttggattgccacagatccctgcttcatagatttgcatcattcaagcatatcttgtaaaacaaacacatattatgggactaggaaatatttatctttccaaatttgccataacagatttaggtttctttcctttctttgaaggaaagtttaattacattgctcttttattttttccattaagagactcattgcttgggaaatgctttcttcgtactaaaatttgattcctttttttcttatgaaaaacgaactcagtttaaaagtatttttagctcgtatgacttgttttcattcattaataataatttgaaataaaactaaggaaatggaatcttaaaagtctatgacagtgtaactctacagtctcaaaatgacctgataaattgataagacaaagatgagattattggggctgttcatattatgattcagaatcattttctattgtggtattataggttggttaaagtgatggcctttttgatgggttttgttgtgtcttgtgaacaagtcgttactgtgtccattattggaatggaattatcactactgtatcatgagtgggtattttgattctatggttccctcagtattacatcttgacttgtaatcaattatgaatatttcttgatatttaatgtataggacatttatttatactcaataaatatttttcaaaaggatataattttaataatatcacttcagcttaaaacctctactgcggaaaccaaatttaatagaattttaatgtcatttcagcctataactccactacagaaaccaaattaaccagtagcattgtgaggaaagagcaaggaacaatctgggcttgggccctgggtctaccatttactaactactgagtagtctattcaacctctctaaccttctgtttccttattagtaaaatcatgcttaactcacagagcttttgtgaggaataattgaggtaatggtcataagtaccttgttaactgcaaggggctattcttatatgagggattgttaacaataaaaaagaaactgcttcattcttttcttggaaggtgcctggagtactacagcaagttcaaactcctgcccaatttcagggtctttaatgatcctgtcctcccttcctcattcaacttgttgccaacagcatggcccctccagcctagctgggtgcctcacagtgctatgtgcacctgactctcatgtgtctgcagatcaaaccaataaacatttaggaacaccagctttgtagaagtctctgtaccagcccaggggttaccaagttcctctcttcaggagttcttgtctagttacaagtggagatgagataacgtatgtaaccctctcctatctccaacctcaccttctcaagaagccttccagagggagcaaacattatagtattcatcattaccttcttgaaacctttcttggcttttctgtgagttctgtgttttcttctaatctggcccacttactctcttatatggatacctctttcttagccccttgaatatttcttccattagagttccaatctgtattctacttgagaaatctcacacccatgatatcaactattacctacacactaatgactcaaaatgactgtcactagcctagacttcttatccttattttcaattctgggcatttccacttaaatgccccatcgttacctagaatctaacatatccaaattaagctcattatcttggggttcactgtcagcaaacatttctcgttgatttctcgtcttgcttagtgttaccagtgattcatatattgcccattttagtgggtgatatttagccctttagctagaccacattagtgcattggatatgagtgagcaatcattctacctaaatctctactctcttgggttttgtgatagtactctccggttctcctgttcctctaactattccctctaaggcttctttctgaaatcctcaactctctaactgtaatgttactgctcctctggattctagcttttaccccccagacttctttctctgtttacttacatttagtgatctcagctattctcatggctttaactgctaacttccaaatctatacttctatccctgaacttgcccctgagtttcagaatcttatttatatccagctgtttgcctaacaaatatttggatgttccagaagcccacaagcacctcacattcaaatagctgaaacagcctatcacctttcctcagacctgaatctcctgcttctgttttccctgtctcatgatgggagatgtgagacagggaaaccattgtctcatgatgggaggctgtgaggctaatggaattattattctcctatcatttaaaacagaaagcgcttgagttgtccttgatgcctacattttgcctacacagtcaattatccttaaaccctaatccctgtttctcaaatctaactcctcctctccttctctcaactctcgctggcctagatgtctctcacatagtcttttggaatgtcttctcttctcgcatagtttcacttccttgagtacactgatcacatatagctactcttacctttctaaaatataaatctgacttgaattctttaatgtcctctaatacttccaccggggcataaaaagctgccaatgacctggcctctgcctatctgtaatggtttattgcctagtcttttcagaaagcatttcctttctttcaagggaactgctcccccatttcaactgtgcgattattaggaacatgccaattttagagtagtactgtccttacccttccaagctatggaagtgtgtatgtggtcacgctgtgtctatcagagtccataactcacattttctaaatagaaagtaggggaagtgctactctttgtcagtatgagagattgaagccagaggggagccaagatgagagacagactgaaagatgtccatggcactcagctctgaattctgatccttgacattccaagtctctacaactcttcgttctgtgaggtatttgaggattctgcaaataaacttaacccccttttctgcttaaagtagttggcattgggttcctgtcacttgccagtaagagacagaataattgctctgcagcttgtgtcatgtcacacttttcaattttgtgatctagtaattgttctgcatctggtccccccacatccaccatatagccatgattccttgcctctgttcatggtttctcctacctgaagcttccttatgtctttgtcattctgctaattcttcctgtattggggaaaggccaaagggcatgccctggtctgcatcaataccagtgaattaaaggaaagtggaaggagtgagtcctgtattagaaagccctaggtaccataaagcctgtgatcatcactcctatagctaccaccagacaacctcactggtcaatatttcacctgttaactactaggaaagagcagaattgagtgcagggggtcctaggttttaatctgtcagttctgagagtttagcaggaatggggaaggagattgatatgattctgtatagaaaaagtttggcacttctatcatccatatcccttagctttccttttgtgttttcttatagttatgtcaccaagagagttattaaaaatattgatgtctgggtcctacccccatagattctgatataatagatctggatacagtgtgggcatttggatttttaaaagctcccccaagtacttaagtgtatccagagttaactgctgctctgtggtgcctgatcagtctgaacctattttcatggttaagcattctggactgttaccatcaatttctgcagtgaaggagtaggcaatgattgccctaaggtaaagttgttcgtccacggaataaattgggaagtactccctcctcctgtattttttggaagagtttgtgaaggattagtgttcattcttccttgaacatttggtagaatcatgtgggtttgggtgtttctttatgggaagtttttaaaattactgattcagtctctacttgttataggtgtattcagatgttctatttattcttgagtactctgtgtcttcctaggaatttttccacttcatctaagtaatctaatttggttggcatgcagttgttcatagtagtcccttttgatcctttttatttctgtaatgtgggtagtaatgcctatgttttcatccatcattttagtaatttcagtttttctccttttttcttgattattctctctaaacatttttatcactttggttcaatgaactgttgatttttttccgttctttttctatttcaataatttctggtcttttattatttcttttccttctacatgctttggtttagtttgtttgctcttctttttcttttttcctttttttttttttttttttttttgagacagggcctcactctactgcccaggctggagtgcagtggtacaatcatagctcactgcaatctcagcctcccagattcaagcagtcctccccagcctccctagtagctggaactacagacatgtgctatcaagcccagctaatttttttttcaatttttagtagggatggggtatcactatgttgcccaggctagtctgaaactcctagcctcaagcgatcctctcgccttggcctcccaaagtgctgggattacaggtgtgaaccacccccaccccagccctgttattctttttccaatttcttaaggtggaagtttaggctattgatttgcaatttttcttcttttttattaataaactttatttttttagagttttgggttcacaacaaattgagtggaaaacacagagagctcccatataacacacaaccttcccgctatcagcttccctcaccacggtggtatgttgcaatcagtgaatctacactgacacattattatcacacgaagtctatagtttacattagggttcactcttgatgtacattctatggggttttttgttgttttttgcttgagatggggtctcactgtgttacccaggctggagtgcagtggcatgatctcagctcaccacaacctccgcctcccgggctcaagtgatcccacctcagcttcctgagtagctgggacctcaggcgcatgctaccatgcccaactaatttttgtatttttagtagagatggggtttcaccacgttacccaggctggtcttgaactcctgggctcaggcgatccatccgccttggcctcccaaagtgctgggattacaggcatgagccgccatgctagtgattctatgggttttaacaaatataatgacatgtatccccctttgtagtatcatgcagaatagttcactgccctagcaatagttcactaccctagcagtcctctgtactctgcctattcatccttctctcccctttaactcctgtcaaccactgatctttttactgtctctataattttgccttttccagactgttacatagttggaatcaaatagtaaatggtctttccagattgccttctttcacttagcaatatgcatttaagttttctccatgtcttttcatggcttgatagttcatatggatttgggattttttgtcttgtttggtgtttttgagacaggatctcgctctgtcacccaggctggagtgctgtggtgcaatcttggctcactgcagcctccgcctcctgggctcaagtgatcctcccacttcagcctcctgtgtaactgggactacaggtatgcaccaccaagcttgactaatttttgtatttttggtagagactgggtttcgccatgttgcccaggctggtctcgaactcctggactcaagcgatccacctgctttggcctcccaaagtgctgagattacaggcatgagccaccatgcctggtctttgggtattttttgtttgtttgttttttgatagtatctcgctatgttgcccaggttgggcttgaaatcacctgggctcagacaatcctcttgcctcagcctcccaagtatctgagactacaggtaaacaccaacatgctggcttcatttgttttgggcactgaataatattccattatctggagttctttttcaaatataagtgtttacagctatatatttccatctttcaccacctgcagctttcaccacctgccataagctttagtatgttgcatgaaatagtttgtataggaaaggcaagataaatgcttgcttactttcatttattcacaagttttgaaaataatgagtagattctgtagagtgccaattatgaatttgctttcagttctacatttattgtttttgcttgctctgtgaaatggatttcggccttttatttattctttgccagctggcagatattaaaccttgtcagcagagggcactggagagatactgcaggaggaaaagggttttggctcctgtttctgatttcagtggggcaggcttctgtagtctgggcaacttcttcaatggcttctgcaatgcactggcttcttcagtgcctggctatcgcactatatagtgaccagttgtcagaaacttctcctagcactccccgcagatggtttgtagtagagtacctctggtgagacacctccccaagaatggcttcaaccagcactccgtaagaaaaatgtctggcaacttccatgccatccagtgagccacaggtcttttctctaacgaggtctgcaggccagctctggtctcggctcttctttgacactcttacctcagccctagctgctctttatatatggtaatcctgttttggaattatcttgcttctttactagccaatccattattattccaaccccctattatacttaataaatctttaaataaaactttccttattaaaaaaatgtaattcctgttcaaaaagtggggttcttctctcctgattggacccagactgatacacctggtaatttttaaaggtgactataaagtttgatgagctgtcaaaattaaggatttatgttcaacaaaggacaaaattaatatttaatggaatagaagacaatttaaatgtctaaaactgacgagtgacacctgtaatatacaagaaaccatcaggaagaaaaatgggcagtggatatggataagcagttttaaaaggaggaaactcaaaagaccatcattaaatgtttggcccggcacggtggctcacgcctgtaatcccaacactttgggaggcctaggtgggtggatcacctgaggtcaggagttcaagaccagctggccaacaggatgaaaccccgtctctactaaaaatacaaaaattagccgggcgtggtggtgggtgcctgtaatcccagctacttgggaggctgaggcgcaagaatcgcttgaacccgggaggcagtttgcagtgagccgagatggtgccacttcactccagcctaggcgacagagtgataagattccttttatttttcaaaccaatggggctgtgtctgttgtccccctcggtccccaggggtgggggggccttggaaggcagggtggtgttggggggctggggggcaggctgagtgtgtgtgtgtgtgtgtgtgtgggtgtgggtgtgtgtggagtgtgggtgtaggactccagtcccagctgctgcctaggctcctgtgggtccgaccgggttccccctcccctgtccaccttccccaacagggctatagtttcagggtgtcccaggccttggctggttggctgggcccagctcctgggggctgggcagggcagggcagggcagggccgggtccacttccattgttagcagttgtttgcagaattttctctgttaccattcctctctttttgttctcgcccagagtgggtggttttttgttgttgttttagattttcatgtgaaggcagagagttttttttcttttttaactccccatccccctatgcggggtgtcatttcaccatccacatccttgtttgcgtttctggccctcgtcctccctgcctctcctctgcctccccaacccccgcctacctactgctcccaggggtctctccaggggcagggggatttcaggagatggggtgggggccagcccctactggacccttgtaatctgatttgaagaccatccccctgatgggaccagcagccccgctggcccactgggggtccctcttaacatctgcttgttgtgggggtcagtgccacggtctgctggggtcttggcactgtcttcctggccggggcctggcaccttagcccccagccggcccgagtgggggatatcgacacccccagctaaagcacaagcaccttagtcatccctcctctccccctgcctcctggcctgccaccccaccccagcgtttaccccaaagcacaatgccctggtcacttggcaagtggctgggcctgacggaggccaaggggcagaccggggctccagccagacccccgaaaggaagcaggtgctcccccacttccaggacttagttggggcggggggcccagctcctgggcctagggtcttctcacccccacccccttgtcctgggtaggcccctgcctgcccctctctgccttttcctcgggtgtccctcctcgagcccctgcggcactggcttgggtggcagagcccacttgtttcagggaccccaggaggtggtgccccctggctcctgggactgtgtgtgggtctggggggtgggggggtggggagaagcgtcgggcagggggtgcaggggaggaaactcctcaccaggaaagccaaagacagggttgtgccttacctcaggagccacccgttcccccttgccctgccgttcaccctccacctttccccccgggcggcctgctgctttttccttctcttcctcccctgccctgccctgagctgcatggttcccctaccctgggaagccaggaaggaatctgaatggagaatcaccaaccaccaaagaaaaaaagactgcggggccctcccctgccaactccccttccctggccgcccactcacccacacctctttcacgcaggacaggctgcccaccctgtccacgtgaagtgccaacgccctccccaccctgggccgagcccccacccctccctgggcccccaagtgagattgcacatttaactactgtaaggagaggagcggcgttggcaaatgtgaaccatgagaatatcggtgatactgatgagaataaacgcctttgtaaaaaaaaaaaaaaaaaaaaaagtctggagccaggcgtggtggctcgcctgtaagccaagcactttaggaggccaaagcggcaggatcgcttgaggccaggagttggagagactagcctgggcaacatggcgaaacccgtctctactaaaaatagctgcgcatggtggctccgcctgtagttccagctaccggaaggctgaggcgggaggattagagactgaagctatagtgagccatgatcagaccactgcactcaagcctgggtaaggcagcaagaccctatatcaaaaaataaaaaaaggaaaaccacaatgattacgcaagtcgccgccctccctcctgcgattgttgctatttccatccagctactagtctcctcctcccgcccgacacctggcgcgtctatctgacgtcacgaacgcgccacacagattcgggctgcgcaacctctgtggccgtctacacggcgcgcagatgcgaatattctcgcggcgccggaagtccggggcacgtgacctggtgacagtgctgacttggctgtacagctcgatctaggttctgcggcacgggatggcggaggcgcctcctgtctcaggtattgtcccggcccgagcgggactgggcccctttcagggagcggaaattgggtcagtgacgaagttctagggcctcagccactcatatcgcgagagtagcacatgctagggcgtaggatagtggctcggaagggccaagccccgcgcatcgtgcgtacgaagatctgtgtcttcttggactagatggtgaagcccagtagctgggtttcggaggagagaggacttgtcccggcgctgcgagtcgatgtgggtgccctgccttcccacaggctgtttctggggcagcggcgcactgaccttcgacaggcgggcgtcggccaggtcacagccagtgacggtggcgggctcttgacgtgtagggtgtggtgtgctcataccgcctggagtggtggcgtgggcgcgagccgaattccagtagtttagagtctcagcctgctgcgaaccccgtgtgactcagtctcagtctcctcatctgtcagttgggagtagataagttaattcctgtgatggctcccgccctgtactgtacctattctgtaattgttcactcactccccctcctggagttgcctcagtgtgtagagacagcctcatttgttcgttgatataacatccatttcctcagggtgttccatagatcagtgttttccaaatgtgttggacagcaaccaaaagaaacattttgcatcgcgaccttaaatattgtacacttacataaatataaaagcgaaccagaagtttctggaagcagtgaggttggttggtttgttttacaatcagcaatatattctgttttctgtttcgtttaaaaatatgtcacagcccactgccttcatttgattttatggcccactctggaaaacagggcagcagtttgcagaatggagtttggaaaccattggtttgaatctcagctctgtccctgaccagccgttggggcaccaagaagaccatatatgtatttgtatactgggtggcaggtaaaatgtatttattactatggttcttagtttaaaaagttagggccgggcgtggtggctcacgcctgtaatcctagcactttgggaggccgaggtggacggatcacgaggtcaggagatcgagaccatcctggctaacacggtgaaaccccgtctctactaaaaatacaaaaaattagctgggcatggtggcacgcgcctgtagtcccagctactccggaggctgaggcaagagaattgcttgaaccctggaggcggaagttgcagtgagccaagatcgtgccactgcactccagcctgggcgacagagtgtgacttcgtctcaaaaaaaaaagttggaaaacacactgcattggtgtaccctagtcttgatgtggatattaagtcttccttggggttggaaaactttttgggctgggtattttgttattctcctcacctagtccttcaccagattctctaaactggatctattgatcgtctcatccacaggctcgtttctgactcatttctgtacccttcagtgtttgaagaagaattcggtggggcctagttgtgagtcttcgtgttgaactttggtgttgtgcccaagttattacctccaacccagaaagtatctaatgaggcaaaatcttctagtccaaagacctccttactccttttcatgtgctttagtttgattttgctttagttcccattccatgttcgtattttagcatcatctttagcccacaccctcatcatcaaagtctttaaacagaagcccagtgcagaggatacttttctgccggtgagcagactctgcaatgccagccttgtctctggactttgtaatctgccagttggatttccctttagtctgcctttcccacctgttggacacctactgtgctgctgtgttatcttggatttagggtaccacttgtattctagccgtggtgactagacatcctgtttactaacttccagctacttgaaatagtgaaataaaaatggtgcctctgatctttgccatggccagtttcctgatcaatgtgtcctgtttcccttcctcatgtctcttatgggtttttttcctgagggctttgcctgctgcctcatgtctagttgaacatatcctgtatatgagtacatgcagccttctctggattctctagttgcatcaactcattactgcttaacgagaaacactcttttcctatcctttactaggcttctctagacatctttactgatcttatttctgcccctctttccagtctcgctttttcaagcaagcgagaactacacaatacccactggtccaatttaaccattccaacctttaaattatcttatgtttccagaatacctctgccaccctctgcatttgtctaatccttttgtgattttgtgaggccctccatcccatcccctagaattctgcctatgtgaaagctttcaggacaaatcctgaattgggtgagaggttactctatgacctttatgatcattccatttttcactgtatgtttctatggtacccactgcccaagctctgttagtgtaagagcgcagtctctaatacacaaactgagttggaaccccgagtcttccttggaattcctctgtggccttgggcaagttcctactctctgtgcttcagttttctcatcaggaatgtaaggattaaatgagttaatacatgtaaagtgcttaggatagtgcctggcacataatacctaataaatgttaggccttattattaaacctgaaaccctcaggctctatactgcacccatcaatgctcaagcctgtgtgtttcagatcctctgtagtcctaacagcaatgatagagtaccattttaaccattttgtgtgtgttattaacttgctttactcttcactgcaactctttgatatagaggttgttactatcttcattacatgtaaggaaaatggggctaagtaactttcctgaagttaaaataagtgataagtgacttaaacccatgtcttccaggtcttaccaatttatagtatattctgtatgctacacatagttctgactttgctactaattttatgtccttaggcaaaccattttgtctttgtgcttcagggactgaattgactgtaccaagaagcatcttctgggggaacatgagtgggttgaaggggagtatgcttaattttttccactttgggattgtagaccagattatagaggttatgtatggaaaacccaaaatatattcctaggggaaagagatgaaaactaatacacttattaagtactatctatgaaatcatatttaaatttctcagtaaccgttgaaataagtattgtcatcctttaccatagacaaggaaactaaggctaaaagcaggcacgtgatatccctaagttcatacaataagttggacaggtggactttaacccattttggcttagtccaaagcctgtttacttgatattacacaatgctactttactgttttgaaagaagaccacatggaacctgatgattgatacccctgaactgttagctggccttaaatttttgtaataaaatgaatagatgtatacatagtactttatggcccaggtgagcatttttactcgacaacacttagctgtcattggctattggtgtttggtttttggacatggaataatgattgattagtcctccacaagcaccttgaacccatcaccttcactggaaacatagttcttacttaacagcatgttttatacaaagttctaaggaaagtaatttttagatttggcttggagtctatgagtttcatggatgaagtttaatctctttactggcatgtctattttttatgtcctaggtacttttaaattcaatacagatgctgctgaattcattcctcaggagaaaaaaaattctggtctaaattgtgggactcaaaggagactagactctaataggattggtagaagaaattacagttcaccacctccctgtcacctttccaggcaggtcccttatgatgaaatctctgctgttcatcagcatagttatcatccgtcaggaagcaaacctaagagtcagcagacgtctttccagtcctctccttgtaataaatcgcccaagagccatggccttcagaatcaaccttggcagaaattgaggaatgagaagcaccatatcagagtcaagaaagcacagagtcttgctgagcagacctcagatacagctggattagagagctcgaccagatcagagagtgggacagacctcagagagcatagtccttctgagagtgagaaggaagttgtgggtgcagatcccaggggagcaaaacccaaaaaagcaacacagtttgtatacagctatggtagaggaccaaaagtcaaggggaaactcaaatgtgaatggagtaaccgaacaactccaaaaccggaggatgctggacccgaaagtaccaaacctgtgggggttttccaccctgactcttcagaggcatcctctagaaaaggagtattggatgggtatggagccagacgaaatgagcagagaagatacccacagaaaaggcctccctgggaagtggagggggccaggccacgaccaggcagaaatccaccaaaacaggagggccaccgacatacaaacgcaggacacagaaacaacatgggccccattccaaaggatgacctcaatgaaagaccagcaaaatctacctgtgacagtgagaacttggcagtcatcaacaagtcttccaggagggttgaccaagagaaatgcactgtacggaggcaggatcctcaagtagtatctcctttctcccgaggcaaacagaaccatgtgctaaagaatgtggaaacgcacacaggtaaacctacctagataggaaatattttgttgtctttttaatttaaatttttaaataagtcatatattcacataatttagaaagcagaaagtatggaaagttacactgtaaaaagtctcaatctttattcactgtctgcctaagttctaccaccactcgctgctccctgccccaataggtaaccacttagttttatgcatatcacaagcaaatacaaataagaattctttttcttttccaaatgaggaattttgtaagggttttcaaaaatgcaaatacgggtggtgtagatgtctggttacaagattttttttgagttgtgaaaacaagtggtgggtggtaacatctctgctgcctcttttggtttcatcctgcatcatctaatctgcctcatctggtctgcttagttgcagcagttcctaactggtcttatcatctcttaatttctctctttcagttcacctcttaaaccagcatcagagagcaatctttataaaacacatattttatttatttgtttttttgagaggagtctcactgttgcccaggctagagtgcagtggtgcgatcccagctcactgcaactcctcctgggttcagatgattctcctgcatcagcctcccgagtagctgggattacaggcgcccgccaccatgcttggctgatttttgtatttttagtagaaatggggtttcaccatgttggccaggctagtctcaaacttctgacctcgggtgatccgcctcggcttcccaaagtgctgagattacaggcgtgagccactgcgccctgcctaaaacacacattaaactgtgtcactcctctgcttaattccgtttactgcttctgccttactcaacagtcccatcttctgctgcctcaatatctaccacattttattccctggattctacacttttttgtctttgcatggtgttgcatgtggctccctctctttagaatttctgtcactcagttcgctgacgaagtcttactcatttttcaaaagctactttaggccaggcatggtggctcacacctgtaattcctgcacttggggaggctgaggtgagaggatcacttgaacacaggtgttcaagaccagcctgggcaacataaggagaccctgtcactacaaaagaattaaaataaaaaaattagccaggcatgttagcacatgcctgtagtcccagacactcaggaagctgaagtgagaggatcacttgagcccaggagatcgaggctgcagtgagctattgtactccagcctggataacagagcaagaccctgttttgcggggggaaaaaagttactttagtcacatgtccagggaaccttttctcacctttatagatagcgttaatctcttacagccctcacgcttatgtctttctcttaaatttgcatgcttctattacagaacttacactggaaaccataatttatttatgcttcattgtcctccactagtctgtaagctccttaaaaacagacactgtatatttcttttctttttttgtgaccctgctgccccacacagctcttgaaacatagtaggtactcagttctgaccattaaaaagttcatccttatattgaactgaaagcttctttcctttccttcctatcctttggttcaagttttatcctccggagcagcatagtaactagtctgtcttctcacagctccccctctccttactgcaaatcagctttttgcagtattcgaagacatctatcattttgccctaagtgtatatttcatcaagctgaatagttttattctgctagctcttcctcctggaccttcactatcttaatccctctccagtttaatgtgagatacagcccaacccttgaagccaccatctacccagggcctgtttttacaccagcctatagttctagtttcttgctttatcaggattattcttggaacctcaatgtatatgtgaagcaaagcaatgttataccagagttgttactgaatccttaaggctggttaataattacctcttgctttatagtgaattatcacaatgtagtggcttatgataacacacatttactatgccactgtttctgtgggtcagatgaatgggtcctggttagctgggttctctgctcagtgtctccaaatttggctaggcatgtgatctcatctgaggctcagggttctctttcagtcactggttgttggtaggattcagttccttacagatgtaggactgaggttcctgttttcttgctggctgttggccaggggtgtctctctcagctcctagaggccacctgtgtttccctgccacatgactctgtacacaacatgatagtttgcttctttgaggcctgcgggaaagcagctgctgccacttcagatctctctgacttctgtttgattttcaactcttttaaaatggcttacttgattaagtcaggcccacccatactcaaggggaggagattatatagggtatgcataccagggaggtgggaatctggaagaccatcttagaattctatttaacaaatctcttggggccttaacattctcacattattcatatcatttttgagaacacttcattcatatttgttgcataaatactatataccaagcactgttctaggtacagggaatgctgatggaatttacattctggtagggaagacaggcagaaagcacttagatatttaatatgtcaggtggtgataaggactaaaaagaaatattaagaaggttaagaagacagagtgacaagagtgctattttacataggttgacctctttgataaggagacatttgaacagagacaagaatgaagtacagaaatgcaccatgtggctagcttgagaaagagcattctaggcagagggaggagcaaatttagatgtggggaggggtattataggcaatgaagataggggcaggaaaggtggtcagagaaatagcaagggctggatcatgtgagtcccttggatttggttctgagtaagatgagaggctgctggaaggtcctgggaagagggatgtcatgaacttacattctaaaataatcacttagggtctggatgtggtggctcacatctgtaatcccagcactttggaaggccaaggcagaaggattgcttaagcccaggagttcaagacctgcctggacaacttaatgagaccccatctctgcaaaaggcaaaaaaataaaaattagctggacgtggtggcacatgcctatagtcccagctactcaagaggttgaactaggaggatcgcttgagcccagtgggtcaaggctgcagtaagtagtggttgtgccactgcactctagcctgggtgacagaataagaacctgtctcaaaaaaaaaaatattattaagctgctgtgtggagaataggctctaagaaggcaacaggacaagttaggaggctattgcagttgttcaggtaggagatgatggagacttagactggagtaatagtgtggaaaaggtaacaattggatagattttggatgtatttggaaggaagattttatgcctgagcaacttaaaagaatggaattggcatttactgaagtgtcaaagcctagtagagaaaaaggtgtttgtctgtaaaatgtttcagtttggaataatttcagatttatagaaaagttgcaaagatagttcaaagaattcccatatatctttcacccaacttcctctaatgttaacgtcttacataaccagactgcctttgttaaaactaagaaattagcactggtataatcatattaactaaactacagatgttattcagatttcaccagtttttctgccaatgtcctttttctgtttgaggacccaatccaggataccacgttgcatttagtcatgtctcctgagtctcctaccatctctgacagtttcttcatctttcctttttggaaaagatgtttctgctcttgttttatttacttcttattcagggaagatttttgtttaatttggttaaatttctgtaatcccagtactttgggaaaccgagtcaagaggatcacctgagcccaggagttcaagaccatcctgggcaacagaggtagaccccatctctacaaaaactaacaaaaaaatcagccaggtatagtggcacacgcttgtggtcccagctactcaggatgctgaggtgggaggatcgcttgggcccaggagtttgaagatgcagtgagccacgatcatgccactgcactcgagcctaaactttggtgacgcctgtaactttcacagaaagaggttgtggaacagactaaatatcactcatttattcctttatccatgaatttaacaaatatttaatggagcacctagtatatgccagacactggaaatactacactcagcaaggtagacaaaactctcccttctcctgagctttcagtctcagggtgttctctatttcttttgacattaaactgaacaatcagaaagtaaatcttaggagagccaatattatggaatattacagtgtgcgcttttgagtcagatagtttgacaagtttgaattttgacttttaaatttctagttgtgtgaccttggataaatgatctaactacatgaagccagtttcttcatctgtaaaatggtacctatgttatagcattttttttttttttttttttttttttgagacggagtctcactctggagtgcagtggtgcaatctcggctcactgcaacctccgcccccgggttcaagagattctcctgcctcatcctccttggattactactgggattacagccacactccaccacgcccagctaatttttgtattcttagtagagatggggtttcaccatgttggccaggatggtcttgatctcccgacctcatgatctgcccgccttggcctcccaaagtgctggtattacaggtgtaagccaccgtgtccaacctgttacagcctttttgagaggactaaataataatatgtaatgtgcttgcaatgttgtatttaaggttaattttattcttttaacttatttagacctgaaagcaaataacaataatattatgaaataaatgcagtgctaaaagtatgtactcaaaaaagcatatacacacactcacactcagttttgagagtatctggctgtattgaaatctagaaagactttgctgcaattgtgtttgaggaaaaaaatctggaagtgggtgaaggtattcaggaatagatctgggaggattattctgatactacacactggtctgtgtcactggactttgagctcctggagccagggactgtaacaccaccatggggcttatggtaggcaccaagaatatctttgttaagtgaatgactaaagactttgagggcaacggctagagccatctcaccactcatgggttgttggaacctgcccagacttgggcttcttatagctgacactacagcttcacgagcctctttctaacctaaatccatggatctgatagatttagaggatcctggaaaatagaaaatgcaaagcaagatcctgtattgcccagtggatcctcaggctatgttacaaggggcatttggctactctgctgttttcctgggaatgtttccttaattgtgggaatccccacctgagtgtctccttcctaaatcctcttcctcagcaaattcctgcccctttttggcctcagtctgaatagccagctgccttacccagaatcagatatcccttaaaatctctgtgtttggattcttctcttgagtgacttgctgatccttggttgattaaagtgaggaatggttttttgtgtttgagttaatcttttttgttattttgttttttaaacaggttctctaattgaacaactaacaacagaaaaatacgagtgcatggtgtgctgtgaattggttcgtgtcacggccccagtgtggagttgtcagagctgttaccatgtgtttcatttgaactgcataaagaaatgggcaaggtctccagcatctcaagcaggtcaattaattctctcttctgagtagttattctcccctatttgatacgtttaagtattattaagcccagctttaaaaatacagtttaatttctcttaactactttttctgcagggagagtatgttaccttgatcatgtgtttcatatgaccagaattaagttatagatcttaaataaaccagctaaacaacaatattaaaatatattttaagatacgacaaaatcagtcactcttattgaaaatgatggcttttacttattattttttctttgacctactgattttatttcctgtggatacataaacagaagtgtgattgcaggatcatatggtaattctatttttaatttatcttcttctcatttttggccaggcatgatggctcacgcctgtaatcccagcgctttgggaggccaaggcaggcggatcatctgaagtcagaagttcaagattagcctggccaacatggcaaaactccatctctactaaagatataaaaattagccaggcgtggtggcgggcacctgtaatcccagctactcgggaggctgaggcacaagaattgcttgaatccaggaggtggagattgcagtgatctgagattgcaccactgccctccagcctgggtgacagagcaagaccctgtctcaaacaaacaaaaaaacatttttttttcatttttaaatttttactatgcatacgtaatagtttacatgtttatggggtacacatgatattttgatacaagcgtacaatgtgtaatgatcaaatcagggtaattggcatatggggattccaacacctcaaatatttatcatttctttgtgttaggagcatcccatttctactcttctagttattttgaaatatataataaattgttgttagccatagtgctactaaacactagatcttattccttctatctaactgtattttttttttttttttttttttgagacagagtcttactctgttacccaggctggagtccagtggtgtgatcatgtctcactgcagccttgaattcctggactcaaatgatcctcctgcctcagactcccaagcagctgagactacaggcacatgccaccacatccagctaattttttttttttttgagacggtctgctgtgttgcccagtcttgtcttgaactcccaggctcaagcaattctgcatcagcctcctaaaatgctgggattagacacatgagccaccatgcctagctagtggtttttttttgtttgtttttgttttttttttgagagggagtctcactctgttgcccaggctggagtgcagtggcacgatctcggctcactgcagcctccacctcccaggttcaagtgattcttctgcctcagcctcctgagtagctgggattacaggcgcgcaccaccacgcccagctaatttttgcatttttagtagagatgatgtttcatcatgttagccagggtggtctcaatctcctgaccttgtgatccacccacctctgcttcacaaagcgctgggattataggcatgagccaccacacctggcctttttttttttttttttttaatgaaccccatatttagtggaaaatgctgtattcaagctaagcagtcagtattgtgaatttgttccttaaatgtctgatatgcttaacattgaaattattaccactacttcaatattgtgtcttcctatagatttaaatttttttaattacatgtagcttttggaagaaaatttatttggcctactcccatttttcctgacagatggccagagtggttggaggtgccctgcctgtcagaatgtttctgcacatgttcctaatacctacacttgtttctgtggtaagtttgtttatatacactggagtctcttttactacatacattgtacctcagttcaggaaaggtggtctgcggggcatgttttagaagttactaatgagacttcaaagctctaggagtctataagactgtaattatgtggtccatcacacagctagagccacagcctttgtgctcctggcaagctgttctggagatggccaaccaggctcatgctgcttctgggctgtagtgcttgtctccttggtcttgagaccaggcctgaccatgtagcagagataggtgtggacgtgggcttcatctcacccccagcagttacagctttgatagtccagatttgagcagtatgagtaaataatagtgtttattttaatcctggaaataagtcattggtatttataatcagattttttataaaccagcattataaactctatcctggcatcttccctctttatggaatacttctttctgtttttgaatatctcagttcccccaagtattaggggaaaacttcttgtaacccagatgctcattcttgctgctagcccatttctgcatgttttttttcctttcctgccttttaatgactaacttccctctagttgttgatttttcagattttgtttctttactgtctgtctccctccctgaagcattgcatttttgcttctgtcttgttgcctcactgaaaccgtattcagaaattaccaatgggccgggcttagtggctcacgcctgtaatcccagcactttgggaggccaaggtaggtggatcacctgagatcaggagttcgacaccagcctggccaacatggtgaaaccccgtctctactaaaataagttagctgggcatagtgttgcatgtctgtaatcccagctacttgggaggctgaggcaggagaatcgcttgaacctgggaggcagaggttgcaatgatccaagatcatgccattgcactccagcctgggcgacagagtgagactccatctcaaaaaaataaataaataaaataaaaacaaagaaatcaccaatgactcctttccagccatatctagggctgattttataagctcataatctttttggtagagtgatagcccttgacacctttgaccattcccttcttgaaataagtagctcttcctgtttgtttctgcatgctctccttatttttctaaccaatttgctcatatttctcctttcccattacttagctagcagctttcacaaagagtcaagtcatttaccatcaactctgaatcttctagatgcaataccttggtgaactctttgacttccccttcttttctttcaattcttaaccacagtatcatttaagatctgaccccaaacaccctcttacaaaggaagctttcctttgttattctctgtctcactttggcctctgttttatttggaattttccggtcttacatgttttattgacagaatctcagccttaatagatactaaattggtattagatgagggaataaatattcttgaatatactaccagaaaggcagcatgaaactggaagtaagagatcagtggaaatttgggcaaataggacaataccaatacttaataccttattttgaaggattacataaagtaccacaatggaattaaaaatcttgttaaagcctctactggcaaattagatgagagactctaaggcagtataagaatgtggagtgaaggtcaagatgatctgaaagtggtaaaatgatgtgagaatgcacataaaggccttatttgcagatgactttgccccacactgttcttccaggggaccattaatttaacatgtttttattgagaacttattaatgttcaaggcactgtgaagaaacagaggcgaataaaacggttaacttaccagagcttacagtctaagagttaaaacacaattagcctgatactctgctagaagtacaaagtactatgggagatctttggggtagttacgacttacagctggatgattaagagaagccttcttggaggaggtagaattgaactggcattgtaaactaggtaaaatctttgtaggcagaaagatatgttgaagggaatagcataggcagttcaaaatcaacagggtttagggtatattgggagaagagtgattcatccacttacagagcccaggatctatgatggtaggggagtgggagatgactggaaaggaagggctgaccctttgataccagtctcagatgttgggacttcatttggaaggctgtgggaagccactgagggcatcaacatgattctttatggagattagtttggtagcagtgagtagagtattttggagcctaaataatttgggacttataatccagatgaagagtagtacaagcctctaaggagtgtgatagaaaaatatggtgttaggttgattcctgacagtagtaggaatgggagtcacccaaagtttcatgcttttggaaatggtgataccaaggaaaagggcaggtcaaaagaagaaggtctggtggggacagtgactacagtttagaaatgttgagctggaggagtgagcagaacatacagtgaaatatgtccaacaggcaggtagcaatatttgaggaaagaccaggacttaaggatgagaatcacagctgagaggagtagttaagaccctagcggatgaaagggtacagagtgagaaaagggtgtaatgcagaacacttgcaggggaaagaaaagcaaaaaaccccaaaacatcatttggagtcagggacaaaaggtagagctcttgagagatgttagaggaaaaccagggcactgtattggagcaaaaaagcacagaggcagggaggcttttgtgatagtctggagatgaggttttggccagttagagaggcaggaacaggagagcgatgaggtgagagccactttgtaggaaaaattgacacaacttggtgattaagtagaaagaggtgtcagagatgactgtagtttttgagcgtgtgtgactctgacagagttgacgtcactgacagaaataggaaaccctgaaaagggaggagttatagagggaagatgtgaactttgactgtggataaagccagtttgaggtgactgtgaaaccccaagcaagaatgttcagcagacatttggacatatgggtctgaaactgaagattcagggcaagagagaaaatgtggatttggggatcaatggcctttaggtggattgcacctctcaacatgaataaaatttctgaaagagatagtatagagagaaaagcagaggccatggactggggatggctgcaatttagtgtgcaaattgcccaagtgaggatgaattcctcaagggcaaggaggaatcctgtgccttcgttttactcttccctgtctctgctgagtccatggaagatgtgccatgaagatttgcagtgacattgattataaaagtataaggtcttttatgccgactttatagttctggaataggtgagttcctgctactcgggatttatgtcctttccatttcttactgcctcccccctttccccacggtgctcttctcttattccctctctctgatccttccagcagcaattcgcatatcagttcagaagtccagttatagacgacttgtcttataggtatttatcttaaattaaacgtttccattagtcaagatagtattttcgtaagtaaaagtgactttttatttatctttcccaggtaatccaagatttaagatttatcatactcagtgaaactttttatgaatagcattatatttatctttttattttaagatatgggataatacatttgttgaaataataaaaaccacactaaagttgcatgctgcctagctatactttactgtttcattaaagttgagaatgtggttgaagtttgtaccattgactctctgatctgatatgttctaggcaaggtaaagaatcctgagtggagcagaaatgaaattccacatagctgtggtgaggtttgtagaaagaaacagcctggccaggactgcccacattcctgtaacctgtaagttggaatgctaattccgttgggattgctggtggacatgctttgctggtggctctaagtaaacatacctggttagcatgtaatggtttgggatgaagggtgatatgggacctcagtaaatggtctcaaatcaccctgtgccaggcactctacatcagttaacttgttgaatccttaccacagcccagtaatagatatttaccatctctgctttacagatgaggctcagaaaggccaagcctcttgcccagcatcacagtggcagggcgtggatggtggagctagggtttccaaagccagtgctgcttccattacattacactgcttgcttctaagaagaaatgtgactcatatgttttatcccgcattgatatccaggtccaagagaatgtatgggagaaccttctgtctggggaaagacaattgtttagggtcccggtcggacagtatttccaagatgtcaagatgtcaatctttttctttctttctttctttttttttttttttttttttgagacagggtctcgctttgtcacccaggctggagtgtgagtgtggtggtgtgatcacagctcactgcaaccgccgcctcttgtgctcaagccatcctcccacctcatcctcctgagtagctgggactacaggcgtgtgccaccacgcctggctaatttttgtatgttttggtagaaatggggttttgccgtgttgcccaggttggtctcgaactcctgggctcaagcaatctgctctcctcagcctcccaacatgccaggattactggtgtgagccaccacacccagccataggatgtcagtcttttccctacaataaatagccagctgtagattatatccataagccagacacggtggctcatgcctataatcccaacacgttgggaagccaaggcaggaggattgcttgaggccaggagttctagaccagactaggcaacaaaatgagaccccgtctctacaaaaaaatttaaaattagccagctgtggtggcacacacctgtagtcccagctacttgggaggctgagcaaggaggatcatttgagtccaggagttcacggctgcagtgagctgtgattgcactattgcactccagcctgggcaacaaagcaagaccatgtctctaaaaataataaataaataaataagtagactgtatgcagtcagcttctaaataccaaaaaatgcacagtaatagaaaaacagttgatcagttacaaataaatttctacaggccttaacctcagacaaaggtttaaatcttaggttcaagttacttaaatagttatgtaaccttggacaagttattaatttatctaagcctgcatctgtaaaataataatgatagtaataataacacttatagggttctatgaaaattaaatgaattagtgcatctatgcggctcgatatagagtctttctggcaagtgatcaaaaaatgacaattcttacttttactacccaaatctaagagtaaaccagacatcagagtgttatcttggtatttctactgcttggaggagggataatattggaccagggccttgtgatcaaggcatggtggtggcgctggggaaatgtcagtgggggtagagctgttttaaactgggctagacagcatggcctgtgatctgctgggcagtcagatacctcattccctttgactgctcgcataggtccttccttaggaaggagttaagctattcttgccattagttgtcattttcagtaaattcagtaataagaagttaatcctggctgggcgcggtggctcatgcctgtaatcccagcactttgggaggccaaggcgggtggatcacgaggccaggagatcgagaccatcctggctaagacggtgcaaccctgtctctactaaaaatataaaaaattagccgggtgtggtggtgggcacctgtagtcccacctactggagaggctgatgcaggagaatggcgtgaacccgggaggcggaggttgcagtgagccgagatcatgccactgcactccagcctgggctacagagcaagactccgtctcagagaaaaaaaaaaaaaacttaatcctctgcatggactatttttccaaacccttcatgactaccagagattaaaactgttgcagatcaagtgatcagcaccatgtctgaaagaaaagaacaccttaaaacctgctcctgctcttttgtggctctggagctttcacacttgacttgggaactttcttttactttcaggaccatagaagcccattccccagtagcacttttctggtctccaagaaagctttgctttctctcatttacacttgttaggactcaaaagtgacagagacagggtctcgctctgttgcccaggcttgagtgcagtggtgctatcgtagctcactgcacccttgaactcctgggctcaagcgatcctcccacctcagcctcccaaagtgctgagagtacaggcatgagccaccatgcctggtgtgaacatcaatatttttaaaagctctccaggcacttccaatatatagccagtgttgtggacctctggtctaaaagttaagaaaacctgagattgaggagattgagtccaggcttctgagatatttgacataacctagaatcacccacacctgacaagcaatgaaaattgtttcacccgaaaggattgaggtatatataaaatataactgttgaataatgatactcatctttaaagaaacatgcttaaacttatgtctcctatgggtattgtctatcaaaatgagtcatcttagaagactagacacttgttcctggattgttttcaatgtttaaactttatttaagaattatcagagcttgtttaggagtttcatagaaactaaacattccagccagaccactttataagcacactaatgttttacagcaaattctgttacccatctgattaattagtcttggctctgattggcttttgattcccaaagggttgtaatttgccacctagaatatacccctcctactccaaaaacagttgtcgtagaagttcccaaaatgttttaagtagtggtatttctgtaccactgtgtaatttgccaaagtgtctgctttgaagagggcagtatatatttgaatatacaaattccgtattgtaacttttttctattggtctctataatatagctcctaaaatagcatttttcagagggctaattctgacctatagcatatcactcagcccagttctttccatgacccccttccctttcattctctccatgttactcactagcatgcctcccctcatgtcagccttcttttcactgttccattgtttgcccagtgcctgattattacttcactagctgatagtatgtctgtacttcttacggaccaggtagatttgagttctattactttgcttagactctgatcttctacaggaccctattagccattctgccttttacctgagtagcaaactatttttatccccacacactgctgtaagtgggccaagactgtatttgaaaatgtcatctttgactctcagacccaaatataaccagtattttgacttgggatttacttctgtggttaaatagtctgtggtgataatgatgtcgattttttgcacataaaagtacagttgatatctttgttcaaatagtttaatcaactttaaacaaatacaaagacatgtcatagtagatgtatttgttgccatattcacaataagacccagctgggacagctttgttcgggtttggatacatggctgtggtttattcagtgaaacctttctctttcagtctctgccatccaggaccctgcccaccctgccctgcctttatgacaaaaacatgtgaatgtggacgaaccaggtaaagttaaaattacaccctaaagaagacctcagttttcacatgcatgattgacttgtgaatttctgaaataaaagaatagtaggtagatacaaataaatggtaggcatgaatagtactttttttttttcaggagtgaaagtttattaaaaagctttagaacaggaaggaaaggacagaaggaaagtacaacttggaagagagccaagtgggcaacttgagagaccaaatgtgccatggatagtacttttctgtaactagtagttccctgtgctgcccatgaccctattttgtaatcttataagtgattaagaagttatatgcacaatgagattgtgagactacccattatttcgggtaaaataccaaagtgacaaggatttttttttttttgagacggagtctcggtctgtcacccatgctggagtgcagtggtgcgatctcggctcactgcaacctctgctgcctgggttcaagcaattctcctgcctcagcctcccaagtagctgggattacaggcgcctgccaccgcacctggctagtttttgtatttttagtagagatgggatttcaccatcttggccaggctggtcttgaactattgacttcgtgatccacccgcctcggcctcccaaagtgttgggattacaggcatgagctaccgcgctcggtcggcaaggattttttttttaacctctctaagtgggtgacagaaccaggagttgaacccaggcctaaggaggctgggaccagtttcctgtgcctagcacagtatctggcatctaagagtcttttaatgaatattgttgaatgaaagaataggtgactccagagcccacccttgttccattataatacaaggtctcctacatcattagtacaaggattactgatagctgtggagtgtctctgaggcccagtaagatcttaaaatgatttttgaaccacaggatgagatgaatcatgcagattttcggtgaggtgcgtttgtttagcctttactgaacttatgtggacagccatgtggcctgagattacatgtaagtgttttgactcagaaaggtcagatcctggttctgtcacttactggttgttgattctgggcaagttgcttggtctcactgaacctcatttttcttataaagtagaaataatagtgtctacttcaaggggttactgttagccatggtgctaggcagaatggcagcataataggctagtgttagccattatgtcaagtactgcaagctgatcatttatgtacataacagtgacttttaaaaacaaaatatggagttgagatgagagtcagggatgaaataaaactcttcttgcaggagagtagactccaagtgcttaaccattaccctagaaagagacttgaagacaattgtctaaaagtactttttgcggctgggcgcagtggcccacgcctgtaatcccagcatttcgggaggccgaggtgggtggatcacttgaggttaagagttcgagaccaggtgggccaacatggtgaaaccccgtctctactaaaaatacaaaaattggctgggtgtggtgacacgtgcctgtagccccagctactggggaggttgaggtaggagaatcgcttgaaaccaggaggtggaggttgcagtgagccgagatggctccactgcactccagcctgggcaacagagcaagactctgtctcaaataaacaacaacaaaaaaggactttcttatatccttctctcagcaaaatcaggatgtttattagaacaaaactagaattagcttatttccctaccctgaagcaaagtcacatatagtatgttctaagtgctgggtctcaggataatgccattgtgctgttagtctgagtgtgtcagatctgggtacatgatagctgtcctcccgtctgtaaagtactgtggaagctccaggcagagctaggaccagaacccagatcttctaactcctcaccccagcattctttctccttacgcatgctgcttcatggaactcagagatgaaatcacataaagcaaatactcaggaatagccttcagttcctcaccactcagaaaataggaaagaaagacaggatggaaaagaaaaagaaaaaggaggagaaagaagaaagagtgggccgggcgtggtggctcaagcctgtaatcccaacactttgggagcctgaggcaggaggatcgcttaagcctaggagtttaagattagtctgggcaatatagtgagaccctgtctctatttaaaaaaaaaaacaaaaacaaaaacagaagaagaaaaagagtggagaaagggagagtaattgagaaaataagaattggaggagggagacataggaaaaagtgagggaaatgaagttagagaaaggcttagtgggttttgaggggagagttaggggccgcagtgttagtttggttgtccaacaggaacttttacactgatgctgtctttacatctattgtctttacaggcacacagttcgctgtggtcaggctgtctcagtccactgttctaacccatgtgagaatattttgaactgtggtcagcaccagtgtgctgagctgtgccatgggggtcagtgccagccttgccagatcattttgaaccagggtaagtggtgggcacaccagctagcaatgcttgtgttcttttctggaaccttattaatgattgtcttgataaactttgattggtgtcagacttttagtcacaaagaccttgagtagagagaactggagatacgatgcttagacggtttttattattttacctgcataccagtataggtcattgtcctatataattttttttttctttttgagataagtctcactctgccgcccaggctggagtgcagtggcgtgatcctagctcactgcaacctccacctcccaagttcaagcaattctcctgtctcagcctcccgagtagctgggattacaggtgcctgctatcacgccttgctaatttttgtgtttttagtagagatagggtttcacaatgttggccaggctggtcttgaactcctgacctcaagtgataatgcctgcctgggcctcccaaagtgctgggattacaggcgtgagccacagtgcctggcctatctaatttaaatagtagattttaaaatgctgtttaaaagtaactgcttgaaaaggaccagattattatggacctagaaagaccaaaataatctttttaaaaatgaactggccgggcatagtggctcatgcctgtaatcccagcactttgagagggtgaggccggtggatcactcgaggtcagcagattgagaccagcctggccagcatggtgaaaccctgtctctactaaaaatacaaaaattaactgggcgtggtggtgggcgcctgtaatcccagctattcgggaggctgaatcaagagaatcacttgaacccgggaggcggaggttgcagtgagcagagatggtgccactgcactctagcctggatgacagaatgaggctcagtctaaaataataataataaaatgaacatatgtgaaatctaagaacatataaaactaatttttcataataaaaattagaaaatggttgcctagtggtggaaattgggggaagggacacaaattttctgggttgatagaaatgtttgatatcttgttttgggtggtggtcacacagatgtatacaattaccaaaagatatccgaaaccaatcaaaactgaatatgtaaaatatttgtgtttattatatgctagctgtacatcaatgggaaaaaaagtagaaagtatctacatgaatagaaaaaaattttttaattgtgaatataagtttatgtttttgatgttttcagtttttctcttcctctccattactgcaatctagaaatggaacagaagaatctaattttatagttggggcgtgttggcgggcgccggtaatcccaggtacttggaggctgaggcaggagaatcgcttgaacctgggaggcggaggttgcagtgagctaagatcgtgccattgcactccagcctgggcaacaagagcggaactctgtctcaaaaaaaaaaaaaaaaggaatctagttttattttctcttagtgcaatgcaattatcccctttttgctctccagagtgaatattgtcagttacccagtcgctgattaaacagcctgaaagctcactgtatttttaggtaggctgtttagtcatgatacaactctaatcgtcccagttttttcttttattgagccaaaatctgcttccctgaaatatactctctccttcgtctgcctttctctacattttatgttcctcctgggttgttcaaaatcagctgtcatatattctttccccagcgtttcctttcaggcctaacagctgtgattgcttcatttcttccctgtgaaacatgctcagagaccacacatcctcttaaaagtggctagattggcctgggcacggtagctcatgcactctgggaggccagggcaggtggatcacttgagcctaggagtttgagaccagcctgggcaacatggcgaaaaccagtctctaacaacaacaaaaaaaaaaaattagccagacatggtggcatgtatctgtagtcctagctacttgggaggctgaggtggaaggatggcttgagcccaggaggcggaggttgcagtgagctgagatcatgctaccgcactccagcctaggtgacagtacccacctctgtctcaaaaaaaaaaaagtggccagattgttcacaacaatgccagtctttttgtgggatccacgaaaaccagtattgttcgaaactcggtgttctttgagtacattcttgagatttttcactgagacggaggactgattaaatgtgtcctgattattttccagactaaaatttctggtctgttctctgtggaatagaacttcaaggcttccatcacctattgtgaatcctgaccctgcctgtgggtgctccctccagttttatcccaggctgaaaatgggataatatgttccagcccctgtttttaatagtctcttcaagagaatgaagagttgcctgtgcccagtttgattatccattatgtcatatggatctgtaattaacaggaagtgcagaaaagctctctatcctggtacttaccaagccttttttttttttttggatctcgttctgtcatccaggccagagtgcagattctcctgcctcagcctcccaagtagctggcactacagatgcacaccaccatgcctggcttcagctgtttttagctcttgattcatattgggcttttactcagctaaatcacccaagtcttttttgtacaaatttctgtggatcccagtctcttcctccttgtttctgtttagttgatttttcaaacccagttttgaagactttttgtttttccacattagttatctagcagaatattttggccatgtaaatagtttatcttcttgaattataatcttctaggatccctttcagccttatctagagattaataagcattctttttgggtctttattcatatgttgataaaatactaaatgggttaaggctggcaacagggtcctttggttccttaatattatttaaccagctgtgactctacctaattcttctgtcacctgctcatatttctgtctctcgtgcctaggagagctttttagtatttactcagattttttcatcaggaactcaatttttttattgttacctgttctgacccttgattcttttgctcacagctttctattcattacctctgtaaaaagcctttgttctgtttgagcagaaacttagcaaagaaaagcctactagcaaaagcttccagtttccagggtttctttaccagttcattgattctacaaatatttattgtgttttctgaatctttattaatttatcaaatcagtctttattaaatgaacaaatgagttttagaacgggggaaaaaattgcatataggccgggtgtagtggctcacacctgtaatcccagcactttaggaggccaggatgggctgatcacttgagcccaggagtttgagaccagcttgggcaacatggcaaaaccccatctctacaaaaaatacaaaagctagccaggtgtagtggcacgcacctgtactcccagctacttgaggggctgaagtgagaacattgcttgagcccgggagtttgaggctgcagtgagctgtgttcacatgactgcactccagcctgggtgacaaagtgaggccctgtctccaaaaaaaaaaaaaaaagaaagaaagaaaagaaaagaaattgcacatgcacttactggaagatgaaatgtgtattttaaaaataaagagtccttgaatcttaaattcagctaattaaaaaaaaaaaatcaaggcaggcacagtggctcacacctgtaatcccagcactttgggaggtcgaggccgcagtaagctgtgttcacaccactgtactccagctgggcaacaaagtgagatcctgtctttaaaaaaaaaaaaatctagagtcttaattatggccgggcgtggtggctcacgcctgtagtcccagccctttgggaagctgaggcaggtggatcacctgagctcaggagttcaagaccagcctggccaacgtggtgaaactccatctctcctaaaaatacagaaattagctgggcgtggtggcgggcccctataatcccagctacttgggaggctgaggcaagagaattgcatgaaccggggaggtggaggttgcagtgagccaagatcatgccattgcactccagcctgggcaagagtgagactctgtctcaaaaaaaaaaaaaaaaaaaaaaaaaaaatcttcattatagtgaaaccttttggttctgtttaatgtacgattttattttatgagtattatttttaataccttattagaaggtttctattttatttttattgtatatgtgattttaaaaatgtgatgtttttataatactgcatttattctgatcattagatcttatactctcatgccaatttttaaatttctttttggcaacggggacctttttacaagtgttttatgtaaaacctgacataaagtatgaaacctgtgcttcttgggttgaagtgaggatgggaaatccagatgtcaactcctccaccactactaccagcttagcttgtctatctcctgtaacatcaccagaggacccgcaggagcctcacagtgaatggtgttcagccacggccttatggaccagatagtgttctcttaatttagaggttgcttcactctgatgctgttcttggaatgtgctgcagaggcactatgagatattaatagtttaacaaggcttttttaatttcttcctatggtaaagctcttaggcgggtcttagagctgctgtatgaactatactcatttctgcataggtctgatcagtactctatttggcctcccagattacaggcatgagcgactgtgccaggcccgcattttgtattttcttatagattatttgtgacattttaagaacccatacatgttactaacgttttgtttttgaaattttctcttcaagtatgctattgcggcagcacctcccgagatgtgttatgtggaaccgatgtaggaaagtctgatggatttggggatttcagctgtttaaagatatgtggcaagtaaggttttacgttttcttcagttgaactaaagctgcactttatgcaacaattatgtaatagtgtgttttcttaacagggacttgaaatgcggtaaccatacatgttcgcaagtgtgccaccctcagccctgccagcaatgcccacggctcccccagctggtgcgctgttgcccctgtggccaaactcctctcagccaattgctagaacttggaagtagtagtcggaaaacatgcatggaccctgtgccttcatgtggaaaagtgtgcggcaagcctctgccttgtggttccttaggtaactagtaagcgtaaagttggctttaaaaatattattgtaaatggttggcagcagtgagtgtttaagcaatgtagaagtaagtgctagttacaatatcagaggtttctaaatattatgatcatatttatgtaggtacgttttctttcctcctcaacatatacttgtgaaaacccatacatttgcccaaatgatctctctgattcaggtattttattgttaactctggacaactgtggtgagttactgttccataggggttatgatttctcttaggagcctgtactgtaatgaacactatatgtatttataccaatccagggttcagcaagtgttgaaaacccttttcacataataggaacatgctaaaataattgtgggtgagacagagtctggtttggagacagagtctcgctctgtcgccccagctcgagtgcagtggtaggatctcagctcactgcagcctctgactcctgggctcaaatgattcttgtgtctcagcctcccaagtagctgggactacaggcgcacaccaccacgcccggctaatttttgtatttttaatagagacggggtttcaccatgttgaccaggctggtctcgaactcctggcaccaagtgatccacccgccttgggttcccaaagtgctgggattacaggtgtaagccactgtacctggccaaagaactaaaattgtaagtacaatagaacctcagccatttagatcattcaaggaatgtcagcctctgtagctaagtttcccatctagctgaggatacgaggatagcacctattgaacatcattttggatgaatatttttcttttcttttcttttcttttttttttttttgagacagagtctcgctctgttgcccaggctagagtgcagtggcgtgattttggctcactgcaacctctacctcctgggttcaagcaattctcctgccttggcctcccgagtagctgggattacaggcacctgcaatcatgcccagctaatttttttttgtatttttgtagagacggggtttcaccatgttggccaagctggtcttgaactcctgaccttgggtgatctgcccgccttggcctcccaaagtgctgggattataggtgtgagccaccatgcccggctggatgaatatttttctaaaatttacatttcatgtttaaacagagtttactgaaggtgttgtaatttttctctcattgacccagagtcatcatttttatgaactccagttactgtattacactgaatgcagtggtgcccttggcctgctgaggtttctcagactgatgccccataccaatgagcagtttgaattgttgtatctgcttgttgaagctttttgttgtttatattcttatcagtgcttttagtatgcttgcctgtctacttttagtaattccccctttcttctgatttgtggcttctgattacttgaatatagaaaccagaaaaagctcattggaattagatacaaagtaatactatactgagcctatctgactcagtcttttgggaatgtatgtctgcagttttgcaatgacttggcaacttctctcctgagtgggtgttgaaaggccatgcatttagaaaaaaatggaaagtaggcaactgagattgaataggaaaattatttctaaaactaaccatgtatcttgtgaggtaaagctagaatctttaggtttggtttccatttcatcaaaaggagagagttcacatttctttcaagtgccagcgtgaatcagtgggaacaccctacttaatcctttttctcaatctgaccttaaaattgtgtatagaggagaagtgctgtcttcttgtattttaatatacattccagctgcattaggaaagccagtcatctgttggttctctgcttgccatgaaaatgtgtttatgatatggagatcaaatgactagtaaatcaaatcccctttcggaaagcacatgagtcagttttataagaatttcacatataatgaccagaaatcctaccctggcactcatgtatcctgttggtgatgagagaagaaggaaatgtgaaatgggtaatgcaaagggacttgagcaagagaagggtagtaactggcagtaacagaccttgggatgggacaagaccaggttaagggataagagggtacctgctatacctcagcaggtatcatggaaaacctttaaggaaataggctgagttgactgagaagctcagagacaagcgtgtggctagcgataacaatgactgtcaggtttgttcagacctagcttatctatagaaagctcgcttaggtcttttgtatctcactcagtaggaaatttccatcccagagacacagcttcagtataagagactggatagagttctactttaaagatggtagcatgaagagctcccatagatctgcttcccagtaaagcaaacaaagctagggaaaactataaaaaagcaaccatcaaggctgggcatggtggctcatacctataatctcagcactttgggaggccaaggtgggagaactgcttgagtccaggactttgagaccagcctgggcaacatggcaagaccctgtatgtaccaaaaaacattttttatttacctgggtatggcggcacgtgcctgtggtcccagctacttgggaggctgaggcaaaaggatcatttgaccctgggatgttgaggctgcagtgagccatgaatgcagcactgcactccagctaggctgacagagtgagaccctgtctcaaaaaaaaaaaaaaaaatcaaccatttaaagtttctggaggctgggtgcagtggttcacatctgtaatcccccacactttgggatgctgaggtgggcagatcacttgaggtcaggagttcaggactagcctggccaacatgatgaaaccccgtctctactaaaaatacaaaaattagccaggcatggtggcacatgcctgcaatcccagctactcgggaggctgaggcaggggaattgcttgaacctggggggcagtagttgcagtgaactcagatcatgccactgcactccagcctaggtgacagagtgagactccatctcgaaaaaaaaaaaaaaaagtctctagaaattgccctaagagcatacctcaaatgaagacatatttattcaacaaaatcttctaaaactctggtaaacaacagcaagagtctgtggcattgagccctagctagttccttcctcctcccctcagctcagcttgacagatctccactcaggataagtgtggacaagaagatggggcttcttctcccctcagctcccagtcaggtttaccatatctcactgggaaggccacattgtcaacatttctctacccctccaactccaagttgaagaggctgaaattctggtgagtgcagctgagcagttagggctccctttctccaccaagctcccacttacagaatggaggcttcatcccatttgcagcagaatactggagccctaatcgtcctcaccccagctcactcgtagggcagaggttccactgagagaagcaagccaagaaggcaagaggctactatcccacccagcacccagagtagtgcctcagagacctttcccagggcgagagacagttcataacaaaagagagctccgaggtactctccaaaggaactgactttatttgaaacagtgtggggaagtacaggcctaaggacactttagaaaatgataacataccttaaagaacagtaactaaactgtaggccatctagttcatcagagagaatcagggaaaggtagctaagaggagccctcttcaggtcagaacaaatctcaaagacttacagcaaagactattccttcccaaatttaattggatcagactgctgagcaattgatgccctggaacattgtcaaaaacaatagaactgcaattaatggatccttgagactgagcgtaatccaaataaggcacacagtttaacagagagatcgggaatcaagacaaagagagccctgcttgaaacgactgtcattccagggtcagtttgtacccctaaggttgtgccatccaaagagtgacaccagcggctacatactgtagggaaaatagacttcactgaaatagtctagccaagtcacaaaacaaataaataagcaaccacaacaaaaacaagctgtggagaggggaagcagtatccagagttgctatatagctaaaatgtctagtttccaagaaaaagtatgaaatgtgcaaagaaacagggaaaaaaacaggcaacagaaactgccttgtgagagtgaccagatgtcagatttcacaaagactgtaggataatcataataaatatgttcaaagaactgggccaggcatggtggctcacgcctgtaatcccagcactttgggaggctgaggcaggaggatcacgaggtcaggagttcaagaccagcctggccgacatggtgaaaccccatctctactaaaaatacaaaaattagctgggcatgttggtatgcgcctgtggtcccagctgctccggcggctgaggcaggagaatcccttgaacccaggaggcagaggttgcagtgagccgcgattgcgccactgcactacagcctgggcaacagagcaagacttcatctcaaaaaaaaaaacaaacaaaaaaaaacaaataaataaatatcttcaaagaattgaagggaaaccatacttaaagaggtaaagaaagatgtgaagatgatgtcttatcaaatagagaatattgataaagagatagaaactagttttaaaagaggcccaaatggaaattctgaagtttaaaagtaggataaccgaaatgcaaaattcattaggctgggtaccgtggcttatgcctgaatctcagtgctttgagagatggaggcaggagaattgcttaagcccaggagttcaagaccagcctgagcacgtagtgagaccctatctctacaaaaaattttaaaaacttaggccaggcacagtggctcatgcctgtaatcccagcactttgggaggctgaggcaggcagatcacttgggatcaggagtttgagatcagcctggccaacatggtgaaatctcgtctctactaaaaatataaaaattagctgggtgtggcggcacacgcctgtaatcctggctatttggaaggctaaggcaggagaatcgcttgaacccagtaggcggaggttgcagtgagccgagatcgcaccactgtactccagcctggacgagggagtaagactccatctcaaaaaaaataataataattaaatttagctgggcatggtggcacacacctgtgatcccagctactcaggaggctgaggtgggaagattgcttgagtccaagaggttgaggttgcagcaagccatgatcatgccactgcgcttcaggtgggcaagaaagcaagaccctttctcaaaggaagaagaaaacttcattaaaggggctcaatagtagatttgagctggcagaagaaacgatcagtgaacatgaaaatagattgaaagagatttggtcaggcacagtggctcatgcctgtaatcccagcattttgggaggctgaggcaggcgaatcacgaggtcaggagatcgagaccatcctggctaacatggtgaaaccccgtctctactatatacaaaaaaaaaattagccaggtgtggtggcgggcacctgtagtcccagctactcgggaggctgaggcaggagaatggtgtgaacctgggaggcggaggttgcagtgagctgagattgtgccactgcactccagcctgggcaacagagtgagattccatctcaaaaaaaaaaaaaaagaaagagattatataacccaacggacagagagaaaatataatgaagagaaatgaacaaagcctcagaaatgtgggacacctttaactgtatcagtgtacatgtaattggaatatgaggaggagagtagaaagaagtggaaaaatatttaatgaaataatagataaaaactttcaaatgtattgaaaaacactacacatccaggaaactcagtaaactccaggtaggaaagagatccacatctagacatataataaaaatgctaaaagttaatgataaggagaaagtcttgaaagcagcaagagaaaaatgacttatcacatacaagggaacctctgtaagcttaacagtggacttctcatcagaaacaatggagaacacatcacaaccagaaggcagtaggatgacatattcaaagtgctgaaagaaaactggcaactggccgggcgcggtggctcacgcctgtaatcccagcactttgagaggccgaggcgggtggatcacgaggtcaggatattgagaccatcctggctaacacggtgaaaccctgtctctactaaaaaatacaaaaaattagccgggcatggtggcgggcacctgtagtcccagctactcgggatgctgaggcaggagaatggcatgaacccgggaggcgtagcttgcagtgagccgagattgcgccactgcactccagcctgggcaacagagagagactctgtctcaaaaaaagaaaaagaaaaaaagaaaactgtcaaccaagaatcttacatctcatgaaactaactttagaaaatgaagataaaaacaaaatttattgctagcaggcagacttgccttacagtaagtactaaaagaaattcttcaggctataagcaagtaaacccaaatagaatttcaaatccacatgaaaagacaaagagcactagtaaagatgattatgtaatcataaaaggcagtataaatgcatatttcttcttctcaactgatttaaaaaacaactgtataaaataatatgtataaaattatattttaggcctataacctgtagaagtatatttgataattatagcataaaggagatagatgggatcaaagttgtgttagaataagaaaatgataccagatcacaactcaaacctacaggaacaaatgagggaagccataagtggtaaattttgtataagaggggggctaggcgcagtgactcacacctgtaatcccagctctttgggaggccaaggtgggcagatcacttgatgtcaggagtttgagaccagcctgaccaacatggtgaaactccgtttctactaaaaatacaaaaattagtgtggtgtggtggcatatgcctgtgatcccagctactcaggaggctgaggcacaaaaattgtttgaattcaggaggcagaggctgcagtgagccaagatcatgccactgcacttcagcctgggcaacagagcaagcctctgtctttaaaaaaaaaaaaaaaaaaaaaaaagctgggcactgtagctctcacctgtaatcccagctactcaggaggctgaggtggaaggatcacttgaggctaggagttcaaggccagcctgggcaacgtagtgagatttaatccctcaaagaaatttgtaaaattacccagacatggtggtatgtgcctgtagtcccacctactcaagaggctaaagtgggggatcacttgaggccaagagttcaagactgcagtcagctatgatcatgccactgcattccagcctgagtgacaagagtgggaccctgtctccaaaaattaataaagctataaatatatatatttgttatctttttcagcttctttaatagatataacattatataaagttctaacaaagtagtattgggtttataacatatagatgtgatatgtataacaataactgcacaaaaggggagaagaatagagctgtgtaagggtaaaccttctgtatcttactggagttagtataaatctgaagtagattctgataagatgtatatggtaagccctagagggaccattaagaaaataactcaaaacatttagtgaaaaatataattaagggaattacactataaaaaatattgacaaaatgcaaatgaaaataggaaaggagtattagaataacaaaaaagacatgagacttacagaaaactaaaaaagacgaacataaatccagctataacagtaacattaaatgtgaatggattgagcaaaagcagatatttttgagttttgatttatttattttttatagaggtggaatctcactctatttcctgggctgatcccgaactcctaggctcaagcagtcctcccaccttggcttctcaaagtgctgggattacaggcatgagccactgcacccagccaaaagcagaaattttttagactggatttaaaaaacaagatccaactatatgctctcttgagatggagtcttgctctgttgcccaggctggagtgcagtggcatgatcttggctcactgcaacctccgcctcccaggttcaagcgattctcctgcctcagcctcctgagtcgctgggattacaggtgggcgccaccacgcctggctaatttttttgtatttttagtagagacagggtttcaccatgttggtcaggctggtctcaaactcctgacctcatgatctgcccacctcggtctcccaaagtgctgggattacaggcgtgagccaccgcaccaggccatggagacaatctttatagtcaaagatacaatgaggctgaaagttaaagaatagaaaaagtacaccatgtaaacagtagccataagagaccccaggtgatccccatagggtcctggaaacaggacttgtcctaaacctagtttagcagcatggatgcaggcaccaccagacattcacagagctctagtcagtcagactgtggatcatggcttctgattatttataatccccagatgactttcagagtcgacagcattccactaaagtcatccatggctacagttttagggagattcaagtctacactggagatgtggggcctgaggaaaaagaagatttattctgtgtttttgttatttgttttgaaacagggtcttgctctgtcacctagactggagttcagtggtgcgatcacagttcactgtagcctcaacgtcccatgctcaggagattttcccacctcagactcctgagtagctgggactgtaggcctgcatcaccactcctggctaatttcttgtttttgtgctttttttttttttggtagacacagggtttcaccatgttcccaggtgatctcgagctcctggggtcaagcgatcctcccacctcagcctctcaaagtgctggaattataggcatgagccaccacacttggcctttttttgacttaggcaaatcgtcgtatactttaaagcatattccagtgtctaagctgggccctgaagttgtcagaaaaggcccagtctgccagatgaagggaagatagggaagaagcattgactgcatacttccctcaactctgattctggagttgcagggcatggaggggaagaccagtgtggctagcaaatttgggagtatgaaaatgagtagttgcagttttcatttccagctcttttcgtttttattaaagatttcattcatacctgtgaaaagctctgccatgaaggagactgtggaccatgctctcgcacatcagttatttcctgcagatgctctttcagaacaaaggtaaatcctaaacaatgctagagttgttgccatcaatgttttctttaaaatggtgattatgggaggggaggaatcaaaataacctcagtagattaggtatgggaagtggttgtggcactcaaggtccagaggcctatagtgggataaggcaaatatacagatcactctaccaaatacaggtgtgatagtctgaaaaggggaacagtagcactgttgcaaggagtcagccaactaagaagttagaggaaacacagtccatatgaccacccacttgtggcaccaacttttgataccaattgaaagttcagtggtccctaagaccacctgcgaggcttgataatttgataaaaggactcaccgaacttgctggtggttacactcatggttagagctttactacaaggaggttacagttttattacaaggaaaaggatacagattaaatcagccaagggaagaagtatgtaggacagagtccaaaaaaataccaaaggtggaacttcatttgtcctttccctgtggagtcaggaaagtattactctctccgcttcagtgtgtgccagcatacatggaatattgccaaccaggaaagttcacccagacctgtgtgttcagtttttattggtgctctattgtgcaatcatagttgactgcccatgtggctaatctcagtctccagtctctcccgaggtgtaccgataccatgtgacccaaaacccctgccctaaaactatccagtgtggccagcctgctcctaaatcacgtaattggactatccagtgactcaagactccaggcaaacaatgacacttatatcaggcatggcattccactaggcttagagattacctctcagaagccaagcacaaaggccagactctctttaagtaaggtttaattcttcactgtacatctgttttgtcagtttctactttctggtgaaagcctggatggtttttatttttctttttttttttttaattttatttatttattttgagacagagtctcactccatcacccaggatggagtgcagaggcgcagtcttggctcactgcagcctccacctcccagattcaagtgattcttatgccttagcctctggagtagctggaattacaggtgcatgccatcacacccggctaatttttgtatttttagtagagacgggattttgccatgttggccaggctggtctcaaactcctgacctcaagtgatcctcctgcctcagcctcccaaagtgctgggattacaggtgtgcaccaccactcctggctaatttttgtatttttagtagaggtggggtttcaccatgttggccaggctggtcttgaactcctgacctcaggtaatctacccgcctcagcctcccaaaatgctgggattacagacgtgagccactgtgcccagcctaccttggatagttttcatcagactttatgttataaaaagtcttcgggtgattcagcttggggaacacactgagtgttgatttatcctgctctttgacctacttagtcattttagtgtatatcaacatttgtcccagtagagtacaagccagggtggagacagaattgtgaaccgttggttctgttaaacacaatgcagggtctggcagcatctgacttgcgaataattctgaggatatagtccataaatgggaagctagtttaataggaaaacttcagaaaaaagggaaaagtagtataatttacatgttacaaaagttgtgtaatcatatatgggttttttcctgaaagaaattacaatatacataggataacagaggcatttttgaatgtcaggtatgggaccacttttgtactttgtaaatactgtattaaagactgagatgctgtgatttggcaatcataaatttagtaatgcccagagatgctctttgtgatctgtgtgactgaaaattgtaagcagggttgggacatgtaagctggaagtggctgctgtcagttttcttcattctcccacaatccctctttctatctctacgttttcttgcttctcattgactctttgtcctcactccctctaatagtggactccatggcagtgagtgtattcttgaaaagctatgtgtaagttgaatttttgcaagtagaagtccttaaattgcaggaggagctcactgtcaatacaaactctgttaaacctgtttgacaaagtaaaaaaaaaactcttcaaaaagctgataattggctgggtgtggtggctcacgcctgtaatcccagcactttgggaggctgaggtgggcggatcatgaggtcaggagattgagaccatggtgaaaccccgtctctactaaaaatacaaaaaattagccaggcacggtggtgggcgcctgtagtcccagctactcgggaggctgaggcaggagaatggtgtgaacccaggaagtggagcttgcagtgaaccgagattgcaccactgcgctccagccagggcaacagagcaagactgtctcaaaaaaaaaataaaaaaaataagctgataattatcacctcattgtttaactagatttttcatgaatatggatttttcatgacatggttttggtaatggaatgggcttttccacagaagtgagttttctagataaataaaacatttcttaaaacttcaaaggttgttttcatttcatcactttggtgggattctgataaatgtatgctgtgtctatgtcttcataaagcatgctatatttaagtctttatggtaattcatgtgcaggaatttatgggagttctgcctttcctgacaattgtagataaccactcctgcatatcatttcttccatataatccagtgttcactgatgggagcattaactcagtttcatgagtcacttttgctttatatctgtagagagcatatagggaactttttcatatcatcaatcccagacacctcattttttatctgaaatgtatattttccagccaagaaccttttattgcttagacttcttcacatctgttatcaacttcagtagctgctttttttttttttttcaggataatttttacgaagaggggacttttaaagtcatttttctcatttctgagtacatggcaacctgtaaatgacatcaaagccaaaatcagatgtagaagccgggcagctagccagactcattctaccccaagtgactgacttccttcccacacaccatcatcactacacacgatttttaggatcatgccttagcaaaattacgtgatagaccttttagaccactcacatgtagtggaaaccaaactttagaggccaaaccaaagatcctgctttatttcactttgctgtagttttgtgatattatcaggtgtgctctgaagtgtgtagagccgtttgtccctgcattaaatggtacagattgtcatctgttttcaattcttatatctgctttttatggctttttctgtctgtacccttgtttggtgatgacttctctttcctttgcatgcctttagcagccctctttctatttagattttgtaattattagtctactgtgaatttggagaccagaccacaaaaattgttagaattgtattttcatgaaaagtctgtaagcctggagtcctcttgtgagtaaagctcattcatatagggattaggctcgctccagacatggcaagtgaagttggtgaataagtgactatcagagaagtatgggatatttgggatattcttgttacctatggcattatattatagttgtattattttagttattcctaaagtagttaccatttctttttctttttccataggagcttccatgtaccagtctcaaaagtgaaggtatgactggggtggggcatgagggaatttctggggtgaaagtgtcgtcactctgaatcttgttagggagttgggttatgtatttgtcaaaattcagtgaaggcatacttaagatttgtggtataactttcacctcaaaaggaaaaaaatataaattgaattctaattgatgaaatgctgaaaaatataagctaagtgcactcatgtctacagcttgctttgaaatgcattaaaaaagaaaattagtgggtaggtagaagaatggatatgtatatgaaaaaatatgttaatggtagaatctagatatgggcatatggatgttcactgtaaaatactttgaactttttttctttttccttttgagacggagtctcgctctgtttcgcaggccagagtgcagtggcgcgatctcggctcactgcaacctccacctcccaggttcaagtgattcccctgcctcagcctcccaagtagctgggattacaggtgtccaccactacacctggctgatttttgtatttttggtagagacggggtttcactgtgttggccaggctggtctctaactcctgacctcaagtgatccacccgcctcggcctcccaaagtgttgggattacaggcatgagtcaccacaccggcctcgattcctgtttttataaccgacacatactgttgttgaagccattttaaaacctttttggaaaagtgatggaagataaggatatgcaaaataaaaggtcttactgtagtcagaaagaaagctgtattggttaggaagcttctggatgcaggtaacaaaacccaagaaaaagtgacttttacgataagggtgtttactgccacacctgataggatatctggaggcagaacaagtccgagattggttaattttagctcagtgattttgaagacttcaatttggcttctctgtggttttcttgattttctcctcgtgggtatgttagctgctgcagcttcacacattgggtctctgcccaacaacatctaaacaaaatccatgaagagagtgttgttgttctcttcctatgtaagagcaaggaaaacagtcctgaaaggttctcagtacactgtgtccaattcttctgcctaaacctgtaactagcaaagtgaatggaattaccatggtgggtaaaggtacacaacatccacccctggaactgaggagcacactggctcccagtttctgaacaaaattaaggctgtctttgcctgaaagagaagagtggccgtttgggaggtacccagcaatatctgcctcaaaaccgtatttaaacttttggttcagtgtgccatctgtatcaaggaaaaaaagtttggttattaaaaacataatttgggtccaagcctggtggctcatgcctgtaatcccagcactttgggaggccaaggtgggcggatcacctgaggtcaggagttcaaggccagcctagccaacatggtgaaaccccatctctactaaaaatacaaaaattagccaagtacagtggcgcacccctgtaatcccagctactcaggaggctgaggcaggagaatcacttgaactcaggagacagaggttgcagtgaactgagatcacaccattgctctccagcctgggcgacagagtgagactccgtatcaaaaaagaaacaagaaaaacataatttgggccagatgcagtggctcacatctgtaatccttatgctttgggaggccagggctgggggatcacttaaagccaggagttcaagaccagcctgggcaacatagtgaggcactgtctttgcaaaagaatttttaaagttagccaggcatagtggcatgtgcccatagtcctagatactcgggaggctgaggcagaggattgcttgagtccaggagtttgaggttgcagtgagctgtgattgtgccattgcactctatcctggtgacagagcgagaccctatctctaaaacaataaaacaaaataataaaaacataatttgaaaaaatacaaaattaatacacttatgaagtttaaaaaaaaatatgaagtgaaagatgaaaatttgccctctaatagtagtttgttagttagggtttcagatctttttccctattcatacagatgtataaacatgccagcatagttttgtttttccctagatttaggcttatactaaagatactgtctgcagcttattttccctcactaatatctcaaagacgtatttccatgtcagtatgcataactcttgttcttgcagagtattccatatgtggatctgccttgtcatagttcaccatgacccttttggtggtcatttaggttgtctccagtttttccccattattaataagcaggaaccgtcctgtcccactttttataactttatgatgcaaaatttcaaccatacgtgaaagtggagaaactggtataatgaatccccacgtacctatgacctgtcatcatcagttgtcaacattttacctctcgttttcatccatccctccttccctacattttatttatgctgaagtactttgaaaacaaatctcaaatatcatttcacccataaatacttcagtggttagcccactttttttttagttgaaattcacataacataattaaccattttaaatgtacagttcagtggcacttagttctttcacaatctagttccaaaatattttctctgtcttacattttttcttcttctctattttatctttctttttcttttttttttttttttttttgagacggagttttgctcttgttgcccaggctggagtgcagtggcgcaatctcagcttactgcaacctccacctcctgggctcaagcaattctcctgtcttagcctcctgagtagctggaattacaggcacccaccaccatgcctggctaatttttttgtatttttagtagagacggggtttcaccatgttgcccaggctggtctcgaactcctggcctcatgtaatccgcctgcctcagcctcccaaagtgctgggattacagtcatgagccaccgtgcccaacctttttttaaattttattttaaaaatatgttgagacagggtctcactttgttgaccaggctggtcttgaatgcttggtctcaagtgatcctcccatgttggcctcccaaagtgctggggaaaaacattttcgtcaccctgaaaggaagccctgtattaattaagcatttactccccactcagtcctcccccaggtaaccactgatctgctttctatctgtatggatttactattttcgaatacttcatctaaatggagtcacaatatatattcttttgtgccctgcttctttcacttagcatgttttctaagtttatcatactgtagtatatatcagcacttcattcctttttatgattgaataataattcattttatgaatatacattttatccattcactggttgatggatattagaattgtttctactttttggctattgtgaatagtgctgttatgaacatttgtatacaagtttttgttccaatacctattttcatttctttggggtatatacctaggagtagaattgctggatccaatggtaatcttgtgtttaatttttttgaaaaactgccattctgttttccacagtggctacaccattttatattcctaccatcagtgtatgagggtttcattttctccacatccttgccaatacttgttattttctgggtttttttggtttttgtttttttgagatggagtcccactctgttgcccaggctggagtgctgtggcgctatctcagctcactgcaaactccacctcccaggttcgagtgattcacctgcctcagcctcccgagtagctgggattacaggtgcccgccaccgcgcccggctaatttttgtatttttagtagagatggggttttaccatgttggtcaggctggtctcgaactcctgacctcgtgatccgcctgcctcagcctctcaaagtgctgggattacaggcgtgagccaccgcaccgaccatttttggggctttttaaatcatagccatcctagtgaagtgatatatcactaccacatgatgtgatgtctctgatatctcaatgttaggttttaaaatctatttattgtttaagacagggtctctgtcaccttgactggagtgcagtggcagaccacagctcactgcagccttgatctcctgggctccagtggtcctcccacacaagcctcccaaatagctgggaccacaggcatgtgccaccatgccctttgcttaattaacttttaattaagttttaaaaacttaatttttaaaagtttttccagggctgggcgcagtagctcacgcctgtaatcccagcactttgggaggccaaggcaggcggatcacttgaggtcaggagttcaagactagcctggccaacaaggtgaaaccccgtctctactaaaaatacaaaaaattagccggcatggtggcaggcacctgtaatcccagctactcgggaggctgaggcaagagaatcgcttgaacccaggaggcggaggttgcagtgagcaaatttttgtagagacagggtctcattatgttggccaggctggtctcaaattcctgggctcgagcaatcctcctgccctagccacacttaaattttcgatagaaacacactcagccagccttccatatccatgggttccatatccatggattcaaccaaccacagattgaaaatattcaaagaaacaaattacatctgtactgaacatgtacaaaattttttctcatcattttctaatagcatttacattatatttggtgttataagtaatctagagaagatttgaagtataagggagggtgtgcataggttatatgcaaatattataccattttgtataagagacttcaatatctgtggattttgatatccaagggaggtcctggaatcagtcccccatggactccaaaagtttgtacacccatctactaagatgagcatggcttctcctccacaccttaaacactaccgttgctattttttttattttttgagttttaaaggtgaaaattgatattttaatatgcattttcagctgggcagagtggcttacacctgtaatcccaacatttggaaggccaagatgggaggctcatttgagtgcaggaattcgaggttacagtgagctatgttaatgctactgcactccagcctgggtgacagaaagagaccctgtctctttaaaacaaaacaaaacaaaacaaaacaaaaactgatggccgggcatggtggttcacacctgtaatcccagcactttgggaggtcaaagcaggtgaatcacctgaggtcaggtgttcaagaccagcctggccaacatggcgaaaccctgtctctactaaaaatacaaaaattagccgggcgtggtggcgcacacctgtaatcccagctactcgggaggctgaggcaggagaatcgcttgaacctgggaggtggaggttgcagtgagccaagattgcgccattgcactccagcctgggcagcagagtgagaccctgtctcagaaaaaaaaaaagaaagcaaaaaggccaggcgtgttggctcacacctgtaatctcagcactttgggaggccatgggaggtggatcacctgagatcaggagttaaagaccagtttggacaacatggtgaaaccctgcctctactaaaaatacaaaaattagctgggtgtggtggcaggcacctgtaagcccagctacttgggaggctgaggcatgagaatcacttgaacctgagaggtggatgttgcagtgagccgagatcacaccactgcactccagcctgggcgacagagaaagactccatctcaaaaaacaaaacaaaacaaaaaaaactgcatttacattattacaattgtattattactattgtattctttgagcctatagttactcaaatatttgttgtatgaatgttcatatcctttgtctggttttttttttctttttaatttgccacagcagatgctacatttatgtgtgacaagcggtgtaacaagaaacggttgtgtggacggcataaatgtaatgagatatgctgtgtggtaagtggacttattaggcataatcagattccattcatccaggtgctgggcttctggaagcctgagccatgtggagaatgcagcccggatttaaaagtcactgggacaggcccctaagcagcagtcagagagctctcatagtccccataacctctctgcaaagagacagactgggcctttttagcctcacccaggttaagaagtcagccagtggcatctggtagcaacacagaggaagagaaagagataagagaaggtctcacaccccagagcccaagacccctagatgagcacacagtcttcggcagaagattgtgtgttgtcccaacacaaactggcctggacttagcaacttgggcttcaggtttcatgtactgcttaggtcaggtcagtaggaaaaattattaggacattttttaaaaagattttttaaaataaaatatttatttaaaatatttgcttttatggaactaattaaatcactagctggctatttgtactctgttatctcatatactcttttatatataaaaaatataacgtatgctatatatgacataacatgtatatataaatgtgtatgtatgtattagtccattttcacactgtcagtaaagacatacccaagactagggaagttacaaaagaaagaggattaatggatctacagttccaagtcggtggggaggcctcacaatcatggtggaaggcaaggaagagcaagtcacttctcacatggatagcagcaggcagagaaagagagtttgtccaggaaatggccttagaaagccatcagatctcatgagacttattcactatcacgagaacagcacaagaaagacctgcccccacgattcaattacctcccaccaggtccctcccacaacatgtgggaagtcaagatgagatttgggtggggacacagccaaactatatcattctgcccctggcccctcccaaatttcatgtcctcacatttcaaaaccaatcatgcctttccaactgtcccccaaagtcttaactcatttcagcattaacgcaaaagtctacagtccaaagtctcatccaagacaaggcaagtcgctttgcctatgagcctgtaaattcaaaagcaaattagttacttcctaggtccaatgggagtacaggcattgggtatatacagccattccaaatgggagaaattggccaaaacaaaggggctacaggccccatgcaagtccgaaattcagtggggcagtcaaatcttaaagctacaaaatgctctcctttgactccatgtctcacatctaggtaacactgatgcaggaagtgggttcccatggtcttggacagctccgcccatgtggctttgcagtgtgcagcccccctcccagctgctttcacaggctgtcattgagtgtctgtggcttttccaggcacacagtgcaagctgtcagtggatctcccattctggggtctggaggacagtggccttcttctcacagctccactaggtggtgccctagtagggactccgtgtgggggctgcaaccccacatttcccttctgtactgccctagcagaggttctccatgagagccccacccctgcagcaaacttctgcctggacatccaggcatttccatacatcttttgaaacctaggcagacgtttccaacctcagttattgatttctgtgcacccgcaggctcagcaccacatggaagctgccaaggtttggtgcctgcactctgaagccttggcccaagctctgtgttggcccctttcagctacagctggagtggctgggatgcagggcaccaagtcccgaggctgcatgcagcagggggaccctggggccagcccacaaaaccattttttcctcctgagcctccaggcctgtcatggaaggggctgccatgaagacctctgatgtgctctggagacattttccccattgtcttggggttttacatttggctccttgtcacttatgcaaatttctgcagccagcttgattttcttctcagaaaataggattttcttttctctcacattgtcaggctgcaaattttccaaacttttatgctctgtttcccttttaaaactgagtgcctttaacagcacccaagtcacctcttgaatgcttcgctacttagaaatttcttccaccagatacccttaatcatctttctcaagttcaaagttccacagatctctagggcaggggcaaaatgttgccactctctttgataaacaacaagagtcacctttgctccagttcccaacaaattcctcatctctatctgagaccacctcagcctggacattattgtccatatcattatcagcattttgggcaaagccattcagcaagtctctaggaagttccaaactttcccacattctcctgtcctcttctgagccctccagactgttccaacatctgcctgttacccagttccaaagtcacttccacattttcgggtatcttttcagcagtgccccactctgctggtaccagtttactgtattagtctgttttcacactgctgatagagacatatccaagactgggcaagttacaaaagaaagagttttaatggacttacagttccaagtggctggggaggcctcacaatcatggtgggaggcaaggaggagcaagtcacattttaacatggatggcagcaggcagagggagagagcttgtgcagggaaactcggccttataaagccattagatctcatgagacttattcactatcatgagaacagcacgggaaagacctcccccaccatgatttagttaactcctaccaggtccttcctacaacatgtgggaattcaagataagatttgggtggagacacagccaaactgtatcagtgtatatatatatacataaacaaggtaacacagtaccaatagcaaggtagtacgtgtgtatgtatgtatatagcatacataattattttttaaatttatatatttaagtgaagagtgatgaattgtgcaagtattataaactagtgttagaaggcttaaagacttcctcttattataaaaaaatttgcagccaggcattgtggctcacacctgtaattccactttttgaggccgaggtgggtggatcttgcttgatccaaggaattcaaggccagccttggcaacatggtaaaaccccatctctgccaaaaatacaaaaattagccagtttcataacccggtctctaaataaatagatttaaatgtaaaaataaggctggatgcggtggctcatgcctgtaatcccagcactttgggaggcaaaggcaggcagatcacttgaggtcaggagttccagaccagcctggccaacatggtgaaccctgtctctactagaaatacaaaacttacctggacattgttgtgggcacctgtaatcccagctactcaggaggctgaggtaggagaattgcttgaacccaggaggtggaggttgcagtgagccaagatcgcaccaccacactccagcctgggcaacagagtgagaccctgtctctgtctctctctctcacacacacacacacacacacacgatgtaaaaataaaatatatttttttaaaatttcaaactggctcatgcctgtaaccccccagcactttgggaggccaaggtgggcggatcatgaggtcaggagattgagaccatcctggctaacacggtgaaacctcgtctctactaaaaatacaaaaaaattagccaggcatggtggtggatgcctgtagtcccagctactcaggaggctgaggcaggagaacggtgtgaacctgggaggcggaacttgcagtgagccaagattgctccactgcactccagcctgggcgacagagcgagactccatctcaaaaaatatatatgtatgtatcaaatatatgcagaagcagagagactactagtatagagagtcccatatacacaacatccagtttcagtattgatcacctcatgacgaattttgttttatcttcatccccacctactctcccttctgtggctattttgaaggtatttccagatatcattttatccataaatgtgtagagctttgtttttattaatcttgttgttatttatggaaaatataaaatgaagaccattttatgaacaaatataaatctcttttcccaggataaggagcacaagtgtcctttgatttgtgggaggaaactccgttgtggccttcataggtgtgaagaaccttgtcatcgtggaaactgccagacatgctggcaagccagtgagtgtctttactgtatagtttattagaagagttttttagaaattcagacataatatactttgagagattgatttacttagaattgtatggattcttgaactaagccttcgtatttccaatatgttgagactttttttaaagttacttctaatgctgtgttgtagtccctgaatgtgcaaaacttgggatatgaacagtgatcctgagatggggcctagttcgttaatagattccttctctgctacatgcctcatatgtgttattgacctaggttctgtcctcaacaatcttctttctctatattattagcagcagtttgcaaactttttggttgtagggctcatttacattaccaaaaactatcctaaagagtcatttttatgtgaattgtatttatctttatctaccatattagaaattaaaactgagaaatttaaaaaataattgattagtatatttaagaataataatatacctcattgcatgtaatcacaaaaatttttttaaataacttttcaaaaaagtagaatagcggatacttggtttaatagaaggtagctggattcttgtatctacttctgcatccagtctgtcgtgatatagttgaggcatatgaaaaaaatccagccttacacagatagccttacacaggagaagggaagagtattttaaagatgttttcaaataattattgatattctttgaaattacaccaaaattcaacctcattttagaaaggacttgactcggtgtttttattctctgtcacaaaaatttattggactttcttgtactttgaatggatctttttacccgtgcatgattttataatagcccacattgatcatttggaaaataattcttcactgagttatgtgatctttgaaatgttgataaatttcctattataatattaaaaactcagtcattaatataatctccagtctagaaatatgttgggaaaagtattgggaagttgtcagggtcatagtaataaatgaaacttcatatctgttcatgcctttttcaccagcttagctttaataaaataaaagtttaataaaataaaaacctcttttgaaaaaagtagcacccccataaattctcctctaaaaatacaagcaaaaatgtgtgtgtttgtgtgtgttagtatgtacttgcacatcccaaactcagaaaggattcttttgttttacctgctgctccaccaggttttgatgaattaacctgccattgtggtgcatcagtgatttaccctccagttccctgtggtactaggccccctgaatgtacccaaacctgcgctagagtccatgagtgtgaccatccaggtgagtaccaacttgtcttcacacttcagcctgctcacaccatgtcatttaggatcctgctgtgttactgtcttcactgctctagagtcatgctgtgatggctgccccttgctcccggctcaggggctggttctctgaaggtgggtctgtgatctgggccacagcttggaatcacagtgccctccattggtttactctagggatgtcaaacacacctaaaaacgttggaagactccccagctgatcttatctctcaagaacttttctttctttgtggtctccactttggtgcatgttttgaaatttagcatctttttacaaaattaaaagtgacttttttgttgttatagaagcaatatatatttatcgtattaaaattaagaaaatagaggccagggccaggcgcagtggctcatgcctgtaatcccagcactttgggagagcaaggaggggcagatcatgaggtcaaaagattgagaccatcctgcccaacatggtgaaaccccgtctctactaaaaatacaaaaattagctgggcatggtggtgcacgcctgtagtcccagctactcgggaggctgaggcaggagaatcacttgaacccgggaggcagaggttgcagtaagctgagatcgcaccactgcactccagcctggcgacagaccaagactctgtctcaaaaaagaaaatagaggccaggcacagtggctcatgcctgtaatcctagcactttgggaggctgagatgggcgggtcacttgaggtcaggagttcgagaccactctggccaacatggtgaaaccatgtctctactaaaaatacaaaagttagccaggcattgtggcgggcacctgtaatctcagctactcaggaggctgaggcaggagaattgtttgaatccgggaggcagaggttgcagtgagccaagattgtgccactgcacttcagcctgggcaacagagtgagactccatctcaaaaaaagaaaagaaaaagaaaaagaaaaaaaaggccgggtgcagtgactcacacctgtaatcccagcactttgggaagctgaggcaggtggatcacctgaggtcaggaggttgagaccagtctggccaacatggtaaaaccctgtctctactaaaaatacaaaacttagcctggcgtggtggtggacgcctgtaatcccagctacttgggaggctgaggcaagagaatcacttgaacccgggaggcagaggttgcagtgagccgagactgtgccattgcactccagcctgggtgacagagtgagactctgtctcaaaaaaaaaagagagataaagtcaaaagtttgaaattaaataatctattatatgtcacctccaaagaattataccttatatgtatttctcagggtcttttgccatgtgcaaatatatatgtttgcattttttccccaatgtaaaagtgggatcctactgaacttaatgcttttaactagctttttttcccactcttattattatatttttgatctgtccccttgtaagtatttttttacaatataaacttttaatttcaattgagtgtcctgttacatggatgggccataacttattcagtcagtcttgtgttgctggacattttagtgttttcagttttcctctgataaactgctcagataccaggccaacaaccatttgacatcactcaatttccgtatctgtcaagtctagttgctggcttttctctagcaccataccgggcccatcatttcattttaccaaataccagaggcaaacctgaagtaattcaggggaccagatttgatacccacagttagtctggcagtatgattcagacttaaaactagaaaaccaactcttgattttttaagttaatggagtaaaacagaacttaacaaattcttcattaagtggaatgttccctccttccttggggatcttaggatagccctcccagcgtagtttgcaagcccctcctgtggcattcataccagcatgaagtacatgcccaggccagtccccaccgattgcctcctttacacttaacctgcagatgaattccaaatgctgctgggcaaggtccatagtaagaacttcaccatttgtgaattgtgttgttttagcctattttgttccccattcatttccattttcttaagtgtttattgtatttctaacatggtgtcagacatagagggaacttcagaggaagagaaaaataccctgtgaccttgaggttcttaacattctccgagaggaggaggacagtagttcaatacacatgatacaaccacccttcacatgaagatgggctaaataatgtggcagcaacccatctgcataggaactgagacaccaggaagtgtgagggagcccagacgagagtgtggtagccaaggaaaggttcattgtaggaggtgagttttgatgaacctccccttataggcagtaatgaaattggaaggagtcagcagaagcattttagatggaattaatagcaaagatatctgagcagaagtgagcagttgcggttaaagtagggccaaaagaatgacgtagtagaattggatggaccatatggctgtgctgcaagagatgagatgggaaagctgcctcatctgcttctgttttggcatgtctcttcctccttggttgggtttctttttctcactcatgcttgtccttcaacactttaacataaagcaaggtactttttactttcctgtgaccgtttttcaaaagtactcccagtttctgaatttaaaagtttcatgccgtatgccacttatatgatgtataatggtttacatggctttatttagaaagtattcctaaagttacctttctctttctgcagtatatcattcttgtcatagtgaggagaagtgtcccccttgcactttcctaactcagaagtggtgcatgggcaagcatgaggtaagttttctctctcaagtgctcattgttccaggcagaggttcatgattttattacttaagaattgttagtctcatcgtctgtcaaagtaaatacactcagaagtagaagctttccattgcttaaaaattttttcttaagatataatttgcatacaacagaatttaccctttttattgtacagatccatgagttttagcaaaagcatacataccatcaaaccactaccacaatcaagatatagaacagttcagtcacccccaaatatccttcatgcccctgtatactcaatgtcccctacttccaacttctgaaaaccaatgttgtctgttccaatcattttactttaaaataccaaatttttttttaataacctccttattcctgcaagaatggcaataatcaaaaaataatagatgttggcgtggatgtggtgaaaagggaacacttttacactgctggtgggaatgtaaactagtacaaccactgtggaaaactgtggagattccttaaagaactaaaagtagatttaccgtttgatccagcagtcccactactgggcgtctacccagaagaaaagaagtcattatatgaaaaagatacctgcacacgcatgtttatagcagcacaattcacaattgcaaaaatgtggaaccagcccaactgcccatcagtcaacaagtggataaagaaattgtggtgtatctatacgtaccatggaatactactcagccaggaacgaaataatggcattcacagcaacctggatggatttggagaccattattctaagtgaagtaactcaggaatggaaaaccaaacatcgtatgttctcaattataagagggagctaagctatgaggacgcaaaggcatgagaatgatacaatggactttggggactctggggaaaggacgggaggcgggtgagggataaaaaactacacactgggtccgagcacggtggctcatgcctataatcccagcactttgggaggccaaggcaggtagattatgaggtcgggagttcgaaaccagcctggccaacaaggtgagaccccccccatctctactaaaataattagccgggcctggtggcgcatccctgtaatcccagctactttacttgggaggctgaggcaggagaattgcttgaactcgggaggcggatgttgcagtgagccaatatcgcaccactgcactccagcctgggcaacagagcaagactccgtctcgaaaaaaaaaataaattttaaaaactacacattgggtacaatgtacactcctcgggtgatgggtgcaccaaaatctcaaaaatcactactaaggaacttatccatgtaaccaaacaccacctgttccccaagaactattgaaataagaaaaaagaaaaaaaaaaaatcactgattgcaggtcaccctaacagatataataatgaaaaagtctgagatgttgcgagaattaccaaaatgtgatgcagacacgaaatgagcatgtgctgttggaaaagtggaacagatagacttgctggagacagggttgccacaaagtttcaatttgtaaaaaatgtgatatctatgaaatgcaataaagtgaagtccaataagaaatgcatatttattgtacagttgagaagatttaattctgctactgagaaagaaatactctaccattctggcatataaaccaccagacgtggtacacatttttccttgctgtggttaagatgatactgtttgctacattccaactgtcctataccaaaaaaaaaaagatattgttttgtaacctgctttttttgcatcatgacgtattggccaacatttcatgaaactcttgacatctataacaacatgctatattcttttatcttcatggacgtatattcctccactgatttcctgtgggtggttctcaagtccttggtatttattcttttctatatgtctcaccttttccagtttatccattctaaaacatcaatgtgttatcttcgtactgatggcttattaagacttcattcaacagatatcgagtatgagtacctactatgtgctaggtaacaggctaggtttgggtgctttggaagtgaacgagactaacccttgcccttatgaagccttcactttgggttaggaggcaggcatgaaaacagacaatagcagtaatgcgggaaatacagagggctaaggaggatggaagggctctccaggtgttctggaaaaattaacatcctaaaggatagtgagaagaaagtaatgtggagaggatgacagggcagagcatgggcaaaaattatcccctttgccctggtagtagaatgggtaagtgtttaatgattgagaactacattctactaaaatatggattccagtgcgatgggaaatatgtatgtcctagatgttggaagtctcttcagggggagaagttgtgtgtcactgcagtagaagtatatccctcatttcgagggttcaagactagcctttggtcctacgagagtaaaatttcagcagctttttcctatggtgaggaagcgtggaaacaggccatttttcaagaaaaaaaaaaagaattgggggttctatcccctgttgtctcttaattttttaaaggacaggactgcgtgaagctgtggagaccatgagttgggagacatgaggagagttaagtatttaattacagaaaacagcctcctagcctgggcaacctagtgggatcctgtctctacaaataatacaaaaattagctgggtttagtggcatgcctgtactcccagctacttggaaggctaaggcaggaggatcacttgaactcaggagttcaaggctgcagtgagacacgattgtgcaactgccctccagcctaggcaacagagcaagattctgcctcaaaaaaaacaaaacaggccaggcgtggtttctcatgcctgtaatcccaacactttgataggctgaggcaagtggatcacctgaggtcagcagttggagaccagcctggccaacatagtgaaaccctgtctctactaaaaatacaaaaattagctgggcatggtggcacacacctgtagtcccagctacttgggaggctgaggtaggagaatcgcttgaacccaggaggtggaggttgcagtgagctgagatggcgccaccgcactccagcctgggcgacagagcgagactccatctcaaaaaaaaaaaaaaaaaaggcaaaataaaacgaaaaaatggccctgccatcagtctcagaaccctgggctaaggttgccctccaccccgcatctataagaattagtctattgactctgctttagcagttcagaaaggagggaaaagatcatctgcccctgccagttagtcatagcattttcaagcactccctagttacctagttacatttgtttgttgtcactttggaaagtttatgttccagatcacatttttggcttctgctgcaaatccttttgagtcataacagggattattaaataaagttaaggtttgttttcttcatctcaaactaacctttcagactttgaaaatcaaactgatttcttttcagataaatagagcttttttaaaaatacagcttttaagctggatgcagtggcatgtacctgtagtcccagctaatcagaagactaaggcaagaggctcacttgagcccagaagttcaagtccagcttaggcaacatagtgagaccctgtctctaaaaattaaagtaataataatccttattttaaaaactgagctgagtgtggtggttcatgcctgtaatcccagcactttgggaggccaaggcaagtggatcacttgaagtcaggagttcaagaccagccatctggccaacatggcgaaaccccaactaaaaatacaaaaattagctggtcgtggtggtacacacctgtaaccccagctactcgggaggctgaggctggagaatcacttgaaccctggaggtggaggttgcagtgagccccgagattggcgccactgtactccagcctgggcaacagagtgagacttcgtctcaaaataaataaataaatacaaactgttattgccagatgcagtggttcacacctgtaatttcggcactttgggaggcctaggcgggtggatcgcttccactcaagagttcgagaccagcctgggcaacatggtgaaaccccatctcttaaaaaaaaattcaaaaattagctgggcgtggtggcatgcacctgcaatcccagctacttgggagactgagatgggaggatcacctgagccccaggaaagtcataatcacactgttgcactccagcctgggcaacagtgaaaccctatatccgaaaacaaaacaaaaccaaaccctgccataagcttagaaatgtttaaagagaaagttaaaactcaccccaaatcccacatggagatgagaatctggctacttctgtctctcctagtttcggagcaacatcccctgtcacctggttgatatctcttgcggattaccctgcagtgccacgctaccatgtgggatgcacaaatgtcagagactctgtcacaaaggggagtgtcttgtggatgagccctgcaagcagccctgcaccacccccagagctgactgtggtcacccgtgtatggcaccctgccataccagctcaccctgccctgtgactgcttgtaaagctaaggtgggtatttctggccacagatgcagcattgactgtagttctgaggctactagtgaatccagaactgtctacagtggcccctgggcatgcatcttaattaagggtcattggttgcaaataaccacaagttagagaaaggtagagtaagtcatacaagtttctgcctgcccaacttggtatggccttttgattcagcaggtacccactgccaccggaccacagtctgtgtctcccttgggtgagattctcaatagtcactgattgtttactccatttatttaataaatgtataaatgtcttttgtgcaagacatagtatgaggtgctagggataaattagtgaacaagagacacatggttcctcacaatctgataggacagatacttgattattacttagataactaattatggctgtggtgtcatgagggagtagtttaagccttgtggagggggctatgagagcaggtaaatgggaggttaagcctggtctaaaggatcaagtgtggccaccttgaggatgtggagttggcttggagttggctaggccacagttgggcctagggcaagtgtctgtctctgatggtacaaacttcatcctaggcctgccccttcagccaggattaagaacagaggtggtttccaaaagggggcattgtggacggggcaattctttcctagcatgtcaacaactgtgtcagtttgcatgtgtggttagcttcttccagcttggagagtggccacccactgactctctagtctctgctatggtttaagagaggatttaagagtgaaaagtgctttattcacatagttccagtgtgctaaaagtcgttccatgttcatctgacttcaggtagagctacagtgtgaatgtggacgaagaaaagagatggtgatttgctctgaagcatctagtacttatcaaaggttagtgttacttaaatgttaacaactgatggcctaggtgaaacagatacatgtgttttgttttgtttttaaagctagtcaagtgaagcagtgggagtggagaagaaacgaagtctgtaactgttgtaatcagttgtaaacaccactgcacagatacatgtgtttatcatagtatccttgcaacttttctaaaagctggaaaggtttttttgtttgttttgttttgttttattgagaggggtctcgccctgtttcccaggctggtctcccaccttggcctcccaaagtgctgggatcacaggcgtgagccactacacctggctggaaagtttcttacatacatttttaaaaatctggtttctctagttcaaagaaacagtgctgctttatataccttttcttccctaactttagtgtgtaaaataactttgaaatttctccgcttcctccttcctctttctttttttctctcttttggtcgtattacattgtgagataagaagggaagatgtcctgaagttaggtgaattgctttcacatcctaccatttgtcattgacacagccagggctaagctctgtgctcctctggtgtgagggtttctaattgttctgtgaggtatctctgcagcctcctgaagtcttgggacctgtgtagccgtacagggatctgagtgctgagatggaggtgttagagaatgaatggttatatatatatatatctggttagatggggagaggtgccatggatataggactttaagaggatgcacacatcagattggctgtgtttgaatacctactaagtgccaagtgttgctctaggggatactgagggattgagtcacctcatcgcttcccatgtagctgctttgaatataattgaagagatatgacataaatatgtaggtagttcatagtagccgggcttccaaggccacaccagttttcatctgatagatttgcttttttttttttttttttttttgaaatggagtttcgctcctgttgcccaggctagagtgcaatggtgcaatctcggctcactgcaacctgcacctcccaggttcaagtgattctcctgcttcagcctcctgagtagcggggatcacaggcacctgctaccatgcctggctaattttttgtatttttagtagagacggggtttcaccatattggccaggctggtcatgaactcctgacctcaggtgatccacctgccttggtttcccaaagtgctgggcttacaggcgtgagccaccacacctggcctagatttgcttttaaagaggtcttctgtatcccaagtataaggaggttcttgtgaaactgcaatgcctctttttccctttcttttttatatttcagaatagctgcaatctccatggcctctaagataacagacatgcagcttggaggttcagtggagatcagcaagttaattaccaaaaaggaagttcatcaagccaggtaatttttaaaatgcatatatgtgccttctttcttcaattagacttcaattagagggcagagattattcatttatctcaatccttcatagtagagccttgcatacacaataagtattcaatagacaatttgatgttgagacatctgctccatccccaatgaatcctactcaggagatggctaagactaaaggagacttttccaggcctcacagtaaccgaaggaagcagagacctataggtgtttagcttaacccatatgagaatagagaacccagagaggtggccatctctggagagggagattgggctgttaagaggggcacctgtggagcatttggggctgagcagccagggaacactctgaggccactggaggactcctagaccccataacagagaggccatcatcccacctgtccttcagagggacctcatccagccattcctggattggggtccctggggaaatggtatttctagggcaaggttactaatggaaactgaagagcaggtggcctcacaggctgcttcctggcctgagggattgttttttggcaagagtcagctgtgcttccaggttgactgagacttccttttcttgctggatgggagctgtacagtctgtattctgactttaattttttttcatttgcttatcaaggctggagtgtgatgaggagtgttcagccttggaaaggaaaaagtaagtagttgcagctgcttttttaatctccttgcccttgagctctgtgaaattaatgggagggagcaacccttcaaacgtcattcactcagcactgcgctgcgtcttttaccgttatcaaagagcaagagaaatgccgttaccaagaattgaattgtcttaaggataaaccactcaggtgatttcagcatattgagaaacatgagctgtgtggttttgggcatgatataaacatcacataacacagcatacttattcagggactggccaacttcctgactcagagataagaggtttaaaacaatgtttagttaacttttcgttgaagtttagcatacatattgaagattggaagtgtgcagatcagtgaatcgtcactaaatgattacagttgtgtaatcatttgtgtcactaaatgaatacagttgagtatggatacaggtgaaaagataattaccagaaccgtctcttgtactctacataaaggtgaaacctctatcctaatttctctttagattagtttttgaactttatgtaagtgatgaaatcatgtagtttgtattatttttgtctggcttctttcgttatatttttgtgacattcactcctgttgttgcatgtagcaatgctttattcatttttattcctgcatgattttttttgtattactattcatttacccattatactgttaatggatatctttgtattaactgttagactattacaaataaaactgttaagaattcttttttttttttttttttttgagatggagtttttctcttgtcgcctaggctggagtgcaatggcatgatcttggctcactgccacctctgcctcccgggttcaagcgattctcttgccttagcctccagagtagttggcattacaggtgtgtaccaccatgcccagctgatttttgtatttttagtagaaatggggtttcaccatgttggccaggctggtctcgaactcctgacctcaggtgatccacctgcctcgacctcccaaagtgttgggattacaagcttgagccaccacgcccagcccagaacattcttaaacttgcttgctctatatttctgtacatttctgttggatataagccagaagtagaattgctgattaatagggtttatgtgtgttcagcattagtagattctgcccatgtccaaagtgattgtaccaaattacactcccaccagctaaggataattcccattgctgtacatttttgtcagcacttgaaattgtcactttttaattttagccattttgtagatgtgtataacaagatgtcattgagcttttaatttctattttcctgatgacttaagagattgagcacctttcttgtagttactggccattggatagcctcatttttgaagtgcctgtacaagtcctttgcttatttttttgtgctctttttgtattgattagtaggaattctttatgtattctgaatatgagtcctttgttggctctatgtatacattgtgagtactttgttgcactctgtaccttcattttttactctcttgatgcctttttttaatcccagaagctaaagaactcttgttgtcttttgataaacagaaatttttaatgttaatattatccagtttatttgagtttcttaataagcacttttcatgtcctatttagaaaaatttgtctatcctgaggcaatgacaatattctgttattatctagaaactgtgttattttacctttcacattttaaatctacagttgacctgtactgatttttttgagtatggataaggagagtttacaattcagcttttttccacgtgaatatccatttgacgagtaccaagattgtccttttcccagcactctgcagtgccacctctgtcatacatcacatataagcctgggcaacttggcaaaacctcatctgtacaaaaaataaaataaaattagccaggtgtggtggtgcacacctgtagtcccagctacttgggaggcttgaggtgggaagattgcttgaacctgcgaggttgaggctacagtgagccatgatcaccagtctggactatacttttggtgacagagtgaaatgctgtctcaaaaaaaaaaaaaaaaaataagccgggcatggtggctcaccatggccgtaatggtggtgcctataatcccagcactttgggaggttgaggtgggcagatcacaaggtcagcagatcgagaccatcctggtaaaaccccatctctactaaaaatacaaaaaattagccgggcatggtggcgggcacttgtagtcccagctactcgggaagctgaggcaggagaatggcatgaacccaggaggcggagcttgcagtgagccgagatggtgccactgcactctagcctgggcgacagtgggagactccgcatcaaaaaataataataaataaataaagtatatcaaatatatatatatatgtgagtctgtttctgagctcatcctgttcaactgcactagtatcacactgtcttaattactgtacctttataacaagtcttaatatctggtagtatatatcctcaaccatgacttttcttcaatattgtctttgattattctttattcttagccctttacatttccacttaatgtctttttcatttatgtatttatttattgagataggatcttgctctgtcacccatgctggaatgtagtggcacaatcatagttcactgtacccttgaactcctgggctcaagggatcctcgtgcctcagcctccaaaatagataggactacaggcacacaccactacgcctggctaagattttcttttttttttttttttcttttgtaaagacagggttttactatgttgaccagggtggtctcaaacttctggctcaagcgaacctcctgccttggccccacaaagtgctgggattataagcatgagttactgcacccagcccatttccacttatatttcacaattggcttgttattataatatatacccaagaaacctgctgggattttgattgagttggtatttaacttgtaggtcaatttggaatctttacaatgttaaattttctagtccaagagaaggtgtattcttgcatttcatgtcttctttgatttctctcaatgatactttatggttttctatatataaattttgtattctttcagtagatttgtttcttgctttttgatgctgctatagatgggtttatttttcttgtattacttgtaattttttttttgagacagagtctcgttctgtttcccaggctggagtgcaatggtgtgatctcggctcactgcaagctccacctcccgggttcacgccattctcctgcctcagcgtcccaagtagctgggactgcaggtgcccaccactacacccggctaattttttgtatttttagtagagatggtgtttcaccatgttagccaggacagtctcaatctcctgaccttatgatctgcccgcctcagcctcccagagtgctgggattacaggcatgagccactgcgcctggccaacttttaattttttttaaattattattattatttaatgtgacaagtgttttgtttattttgtttttgaccaggttgacatcctcaaaaaaaaatgcaaattacaaggacttcattttaaagcaaatgctcattttagaaatgtgttacagaagatatttatgtgcttcagcaggcataaaaatatatcacagataaggcaaaaaaattctgtgaatggcttgatttttttttttttttttttttttttttttttttgatacagagtctcactctgtctcccaggctggagtgcaatggcacaattacagctcactgcagcctctacctcctgggttcaagtgatcctcccacctcacctcccaagtagctggaactgcaagtgcatgccaccacacccagctaatttttacatttttttgtaccacacccagctaatttttttgttttttttttggtagagatggcatctcgctatgttggccaggctggtctcacattcctgggctcaagcaatcctcctgcctcagccttccaaagtgctgggtttacaggcgtgagccaccacacccggcctaaattggtattttctaattgcttgttgctggtatttagaaatacaattgataattattgacttatttagcaacctcgctaaattcacttatttctgatattgtagattattttggattttgtatatacacagtcatgtcttctaataatagtaattttatttattgtcaattcctgttatttttttcctttcttttttcttttatcttttttccttctttccaattcttaacttttatttcttcttcttacctcattgtattggttagggccttcagtatattgttgaatggagggtggtaataatagatattccttggccgggcgcggtggctcacgcctgtaatcccagcactttgggagactgaggcgggcggatcacttgaggtcaagagttcgagaccagcctggtcaacatggtgaaaccctgtctctactaaaaatacaaaaattagccgggcatggtggcagacgcctgtagtcccagctactcaggaggctaaggcaagagaattgcttgaacctgggaggcagagggtgcagtgagccgagatggcgccaccacactctagcctagacgatacagcaagactcagtctcaccaaaaaaaaaaaatagatgttcctgactaatcctccatctcatggggaaaactttaagtatttcaccattaaatatgatgtctgcagtaagttatttgaggatactctatcagatcaagaggcatttattcaacaactgacaaactttctgattctagcaaagattgattaaattgaatagccctgcaaattgttaataattggagaatttaggtgaaggttatatagaagtttatggtaatattctcataacttgtctttgaaatttgtttaagataaaaagttagacaaatgcagacaaagtatagccctattttaccttgaagtttgactttcagcaattttaatagtacctctttacatattaagtgtgtagaaggtaatatgatgactagtagtgctgtccaaattttccttggtttgacccttataataactttctagtgagtgccgttcaaaacccttgccctttaggaaccgtcagtcagtgttctcagctgcagaatgtaaattaggagtcctaggtattcagaaatgctatagtgaatacacagaaggtctccaaacatggaaatgtacttttggtggttgaaagacatattgtatactagttagagccagagctctggagtcagattgtctggatttgaatcctggcttcacaaatcacttagctatgagaccttgggcaagtcacatattgtctgtaagccttaggtttcttaaaaatctagaaatgatgacaataacagtatttaccttccagagttgttgtgaggattaatacattaaaaatgatactcataaagctcttggcacaagagcttggcacatagtaggtactcagtaaatgttattgattaaaactagctatttttgaaagccttttgaatttctcctcaatcttggtgatgacataatgacccttactggatagagtctttcataaatacacacaaacctaagagaaaaaaatgcaaatttaaagaaaagtccatctaaagttatatctatatatacacacacatatatacacgcatacacctgtgtgtatatatatgtatgtgtgtatatctctattgtagaaataaaaacctagcaggccaaattcagcccacagacaggttttattggtgtttaaatttgaattagtggccaactaaccaaaacatcaaaagatcttcccctagaaattctcttgaaaatttgaaaagtaagtgtcttttgaaaaattggaaatctagcagtgtgaaccagattcttgtgggcactaagcttgtaagtgactcttggtgcagtgtaaatgaaaattgtactaagtgctaagctgaaatctagctttaaaaaaataaaataacttgaatgttggtgagatgccatgagattcagacactgatggctagggcactaagtggcatttctggagaccacttactccacattgatcaagagtcttatgtccactccatgtaccccacaactggaaacattttcaaagctttttgcacagagatattaattgtgtcgtatataatattgagaaactgaggaactgttaaagaaacctaaatgggaaatgattaaaatatgggaacataattagaagactatgagccatgaagacagttaagtgtgaaaacaaaataataatatgagaaatgctaacaagataatgctgagaggcaaagaaacaaggtttttttaatttttaaaatttttttattaaataaaaatggtatatatttatggtaatacagcatgatgtgtatgtatacattgtggaatggctaaatcaagctaattagcatatgcattacctcacattcttatttttgggggggtgagacaattttgaatataataatggcggtacttaaaattatagagaaaggctgggcgcagtggctcacacccgtaatcccagcactttgggaggtcgaggcgggtggatcacctgaggtcaggagttcaagaccagcctggccaacatggtgaaaccccatctctactaaagatacaaaaattagctgggcatggttgcgggcgcctgtaatcccagctactcgggaggctgaggcaggagaatcgcttgaatccaggaggtggaggttgcagtgaaccgagatcatgctattgtactccagcctgggcgacaagagcagcctgggcgacaagagcaagactccatctccaaaaatatatatatatacacatagagagaaacgttatagtgaaaaaaggggcccgttacagcggctcatccccataatcccagcatttgggtggctgaggccagcggatcacttgagctcaggagttcaagaccagcctgggcgacatagcaaaaccctgtctctacaaaaaatacaaaaattagccgggcatggtggcacacttgtagtgccagctactggagaggttgaggtaggaggatggcttaagcccaggaggtggaagttacagtgagctgagatcatgccactgcactccagcctgggcaacaagagccagacccagcctcaaaaaaaaaaaaaaaacaattagaaaaaagggaacacttacacattcttggtgggattgtaaattagtacagccactatggaaaacagtatggaatttcctcacattaaaaatagaactaccatatgatccagcaatcctattacttggtatctctacagaggaaataaaatctgtagagatacctgtactctcatatttgttgcagcactatttacaatagccaagatatgaaatcaactgaagtggccaacatggctgcatggataaagaaaatggggtatatatacagaatgaaatactattcggccataaaaaaaatgaaaccctgtcatttgcaacaacatggatggacctggaggacatcatgttaagtgaaataagccagacacagaaagacagacaccacacgatctcactcatatgtagaatatttaaaaaataatacagaagcagagagtagaccagtgttgtctgactgagaagagggacagggtggaaaagggaggttgaggagaggttggtcagtggatataaagttacaaatagatggtagtaataagttcctgtggttttttttttttttttttttttttttttgagaaggagttttgctcttgttgcccaggctgtagtgcaatggcgctatctcagctcactgcaagctctgcctcccgggttcaagcgattctcctgccccagcctcctgagtagctgggattacaggcatgcacaaccacacctgactaatttttgtgtttttagtagagacgaggtttctccatgttggtcaggctggtctcgagctcccagcttcaggtgatccgcccgcctcggcctcccaaagtgctgggattacaggcgtgagccaccgtacccagcctaagttctcgtgttctatggcacactggggtgatgatggttaacggtaaggtgtagtattttacaaaatagctagaaaagaggcttctgtgtattctcaccacagtgaaataataagggcatcaggtgatggatatgcctaatacactgatttggtcattatacaacatagtatatatgtaccgagacatcaacatcaaactgcttcataaatatgaagcaatgacaatgggtcaataaaaataaaataataaagaaatgtattattattattattattattattattattattatttttagacagagtctcactgtgttgcccaggctggagtgtagtggcacaatctcggttcactgcaacctctttctcctgagttcaagtgattctcatgcctcagcctcctagcagctaggattacaggcacgtgctaccacacccggctaatttttgtatttttagtagagacagggtttcaccatattggccaggctggtctcgaactcctggcctcaagtgatccatctaccttggcctcccagagtcctaggattactggtgtgagccaccgcacccagccaagaaatgtataaaaatgaagtgtatatgttaatggaattctttacttttcagatttctatattaattttaacatttgtatgtctattttatgtaccttatctttaaacaaagcctcagagaaagtcatcccccattgaccattctcagtgatcccacacccccaaactcctcttccccaaataatctaagtccccagtgttcagcctatgacttgctcagatccttatagatctgtttattttcttttatgaagacaataccacctcatgtcccaagttgttgttattctctccttaataatccagtttaccaaaatagagataaataatgtgtaaagaatttaggatatagtaggcactcggggttactgcaagatagtttccctcccactccttttatttgcatacctctctctctctttcaggagattagcagaggcatttcatatcagtgaggattctgatcctttcaatatacgttcttcagggtcaaaattcagtgatagtttgaaagaagatgccaggtatgtaacttgttacctgctttcttaattgtggcttgtcagggtgtttggtcttttgagatgtcataactaatatgtactcctcctgtgattaagccagttcaagtttgtttgtttatctattgtaagagattatgtgctgtttaataaatatccttctcttggtttctcgaaactgtccccttaaagaactgaacttggggtagggttgagataagagtttgggtggggtggtggtaagagtttgggcctcccaagggctggactagactaaattggaggatctctgggcttcattccacttctgtccaccccagtctcacattcacatgcgttctcagttggagctataacagctcttatttttctcctggagtccctggcctttcagtggctacttctcctttcatcttctcatttcttatatttttctcttttgttcttccgtcagtcatccttctgttttctgacaattcctgatctctgcagttttactgccagcattgtctattgtctacgctttacagggagaggatgggtgaaaggggttctcagaagggcagggacagacaaaattaactggtgatttctcatttcaggaaggacttaaagtttgtcagtgacgttgagaaggaaatggaaaccctcgtggaggccgtgaataaggttgaagtcgaaacatcccactggacatttctctaaggccagcttgatgaaaaaaaaaaagcaatcaagtcctggaaacactttcaacctagagtagttgtaggaaaaagtcacaacttctttgaggatccttatctttctcaaaacacagccattataacatctgtggaagcctgtcctggttcaggacagttgactgcagaaaagatctacagtcggctgggcacagtgtctcatgcctgtaatgccagcactttgggaggccaaggcaggcagatcacttgaggtcaggagttctagatcagcttggccaacatgacgaaaccctgtctctactaaaaatataaaaattagctgggtgtggtggcgggcacctgttattccagctacttgcaaggcttaggcagga

SEQ ID NO: 32 - DNA, 165539 bp, Homo sapiens
acataaatcagattagcaataaagataaacagagttgctttaacctaatcacagaagcatggatgaatgagtttccagaattgctttacgaagtgtttgtcaagctcaatgcaaccagttggtgggtcaaggtgcaaagagatggggaggccctgggagaatagcactgaagcctcagacatgtccaggccccctgtgcagttcattccagagctctaggctgtggataattttctactgcatctggccaggtgcagtggctcacgcctgtaatcccagcactttgggaggctgagacaggcagatcacctgaggtcaggagttcgaggccagcctggccaatatggtgaaaccctttctttactaaaaatacaaaaattagccaggtgtggtggcgcatgcctataatcccagctattcaggaggctgaggcagaagaaacgcttgaagcggggaggcagaggttgcagtgatccgagattgtgccactgcactccagcctaggcgacagagtgagactccatctcaaaagaaaaaattttctactgcatctggtgctccaggaacagcaatgtctcctctgtctatcaccaagagtgaagttaaagccagaccagtgagggaggaggacagttctgcaaaggatgcccacggtcttcttatgaccctggaagccattcccaaggaattgtgtgactcattccatttgttaggaagttctcctgtccctggaccccaaggggctcaaagtcaagggcagcgttatggcaggcaaactaagagtttaaagaaaaaaaccaggagggaacaccaatccccaagtcctcatggtcccatgtggaagaacttgtacttgggtagactcctggtgactctgcagcctggcttctcccttggaaaagagtaatgacttctcttgctcctcctggtatcctgggttgggatcctctattacaggttctgcctgcctgcaagcagtacacatctggtcccctctcaggaggctgaccctgaacagggccaggggctgtccagctctgtctgaccggctgacaagtttcattctggagtgaattacagcaagtccccctagccgcagatctaaacccacattctcttttttcctttttttttttttttttgagatggagtctcgctctgtcacccaggctggagtgtagtggcacaatattagctcactgtaaccggtgcctccctggttcaagtgattctcccacctctgcctcccaagtagctgggactacaggtgcgtgccaccacacctggctaatttttgtatttttagtagagaccgggtttcaccatgttggccagactggtcttaaactcctgacctcaggggatccacccacctcggcctcccaaagtgctgggattacaggtgtgagccaccacacctggcctaaagccacattctctaacctggcttttatcagtaataaagatccatctcttctaacctctacatctgtatctcaatgggtttcaagtttaatatcttagctccttaaaatcccaacataaatgagacagagaggtagtagcagggtacgtcacagcccagggccacacacagggcccgcctgtaacccagagagggagagggtgagtgatgagaagaagcctttcatttgcaagaatgccattcatttggtctcataccttaagggtataaagtatttccattaaactggcatattcagcagggttatctttctggaggtaattatattcttgccatgggttcttggcagagttcttcttgtctgtcaagatgctctcctgaaaaccagccaggctccgggggctgcaggaatcagatagatacttcccagctgtggacaaaatcctgtaatgaaaggaatgaccattatgccctgagctatttgcatggaactttcttcttggagcagtcagattgctccttactaaattcaaagataatcctcatgagacagactgaattaaggtccagtttataaggcaacgaaaggctgcccttcatcattgaggagtgagctggacctcaggtgcacaataaaaaaaacccagtgtttttattcctgctgaacattcacagtgccagaacatgctatctccctaatatgaccgacagcctacataggggcagctctcagtttagtctggaacactgtgcaccttctatggagacttttcttgctatatgagcatcagggtgtagaacagtcaaatgccagcatggaccaccagcaccaccatcagagagaccgctgggcaggatagcagctggctggctcctagagaacagtgacagcagctcgctgcacgcctctttacccatgggcccacctgtcctacatgccgagcttgcatggtatttgtgtttggtggcactgggaggtttatttttgtggtttaggtgctacagagagatctattgaggctggcactttccaaactctttgagaaagacaaacgcctagaggaggtttcatatgataatccaccccttgtactgctggggaagtggaatcttgacctccaccctgttttccttagcccaactttaccacccatcctacccatctaaatatgtacagaattacatgaacatgtgtaacacattatgacacatcccaaatgtggctaattccctgccttctcttttactgtaatttcttatgaaaacattgctttggacatagcagtttttaggatgcactcactatttcaaaaacagatccttgagttgttcaagaaatgcctgtacttgcaaataaatccctgtgatacgatcttcctcagaagccactgctgacataagcagctacctgcctctgccattaagttcaagttcgttcttcctgttgcttgagccaaccagtaactttggttgggtctcttatctgtcaaactgtggcctgtctctgccattgccttacttccagtcttcactagttcttgtctggatcacagcaggcttccaactaactggcttccccttcctctagtcctcgaagttctacttaatctgtcctcctaagggttagcagaatgatcttcccagaaggcaaatctgattttggctttttcccaaagatagtgcttcacaggggcattagaaaggcttggtagaggagaggccttaaggaccccaggaggtttcagccctctgcgccatcagccaatggcagagctcccaaagggctcttgcttctgttctgcatttaacacatgctgtctcatttccctccaactggacggtgaggacaaaacacggactgttcttcatttgtgaattactagcactagcacagtgcctggtacgtggcaggggctccacaactgttgaaggatgggtgaccctggctttagtgaccaggtcttcgggggacagttcaatgagacagtcaggttctggaaatctagcataaatttacaagttcccatggctgagaagtgggcaataacttgtcacagttgagggaaccaatggaattgtaatcctccctcctctgtgcacactgcgttctcttggcacagcaatgagcatactggcacatgctggatgctcccattaatttctaagctctttgagggcgaggattgagtttaattaactgatatccccaagacctagctcagagcccaggaaagctgtggcacagtgggaagggaggtaggggtgagtaaagtgggagacagaggtgagtggggcgagagataggggcgagtggggcgggaggcagggggcgagtgtggcgggaggcagggggcgagtgtggcgggaggcagggggcgagtgtggcgggaggcagggggcgagtgtggcgggaggcagggggcgagtgtggcgggaggcagggggcgagtggggcgggaggcagggggcgagtggggcgggaggtagggggcgagtggggcgggaggtaggggcgagtggggcgggaggtaggggacgagtggggcgggaggtaggggacgagtggggcgggaggtaggggtgagtggggcgggaggcagggggtgagcagggcagaagggagaggcgagtggcggggggaggtggggcaggaggtaggggcgagttgctaaggaaggtctgtgctctttgttggcagtttcttctcacgattctttgtttcccgtcatttctgagaccaccaactgtctttagtccaagattttttgtgatggttctcattatggggaaaggctcacagcaggatagagtgggagcagctgctgctgttcctaactcactcctgaatgcccagcacagaaattgcgtgactttcgggagtgaataaaaccaaagtgccacaggcatacagtagagtgtgtgtaaataatataaatgaagtaaatggtaattcctaggacacagattttccttaatctcttaatgaaatcaagtattacattctgaagggtaaggagagactggttaggagcacgaatggggacacaatagataaaagatgggcctctctgggctgcattttgcagcccagagaggctgaaagcctggctgagcttcaagtcaagaacagcctgggtgtatccaagggagctcctgaaagagatgatgtcatcctggaagcactaagcctggaaagggacagtcaccatctgtgttcctggctggaaggctgcacagtgtgcatgcgtgtgtgtgtgtgtgtgtgtgtgtgcgtgcatgtgtgtgtgtgtgtgtgtgtatgtggcaggcacctgtaaagcttatcttatctccccatcaatctcaccagcagcacctagactcctaccaaggaccactccccaccaacaggcgggtggcagaggcaacaggtcagaacgcgctgggccgctccagtgacaagattgacattggccacccagctcttatgatcacttctctgcagaaagggatcattttgtgatttacgggctgagtaaagcaaggccgagttgaaatctcatctgagagatttctctcatcctgggcagcttgggccagatatagggagattgctgtggctcctctgtattttcctagcacccattacttacttttggaacagtggtgctttcatttcactttgtaccaccactaaaaatttcatcacccagagattactttagggcaataaagaatcacctaagaaggaggttaagggattgctgctggtccctcaaacaactgtatgaaacagacttcttccccttaactcctaaggaataaaggcatcagccataccaagggaatcaagagatttcatttaaagggataaagaaagaaatgtgggaagccagagccccttgaagggaaaaactgtctgaggaaggccacctcagggcaacataaaagccctggcaggtatgagaagagaggaagggagtaggacaagcttttccagggcagaccccagagattcccctttgatacacagcccttcagcagcacggaatttgactgcaggacccagaaggcaggctgcctaagttcaccccgatcctgaaggctggcccaagggacttcaccaccacttgtcacaccgtttctatatggaaatttatttttagtcccaacaactaatttataaacaagcagtcggaaccaagcccattcctaatttggagacaagatgcactgtttcctcatttaggctgaaaccaccatatcaaaccaaaattacgtgacccctgccaagtaggacaaagccttgccctttttaggtgctcaataaacgtttaatgatgacaataatgacacgctgtatctaggtacagacagtcctccagccctgtggccttcacatctggcatatgctgtccttgctgtactgtgtactagaccaagctcgtgctgatcaggaaccccagggtgtagaggacaatgactcctctctcctacctgttggctagctgctgctcgaagtccccacaatgccgcaaaagctctccacaggtggctattatcctaaacaaaacaaaaagcacttcaagttcaagtatctggaatgccagcctttacaggacaaacattgtcttattcataaaaatcctaactatttgctcctttgggtagttctggttctgggaaagccgttaaacatctgctggcctgaaatgtttcattcattagtcattaatgtaaaaagaaaatgctggtcccttccaataacctccattgtcactggcatctctgctacgaaagcacaattctatccatggccccctcaaataattttacatttccaaaatactcagctttgtccttgagaaaaacagggtagagatattttatatctaaaatttattatttatttatttatttatttttgcaactaagtctcgctctgtcacccaggctggagtgcaatggcgtcatcttggctcactgcaacctctgcctcccaggttcaagtgactctcctgcctcagcctcccaagtagctgggattacaggcgcacgccaccacgcctggctaatttttgttatttttagtagagacggggtttcactatattggccaggctggtctcaaactcccgaccttaagtgatccgcctgccttggcctcccaaaatgctgggattataggagtgagccaccacatcctgcctgtatctaaaattaaaaacaaaaaaaatgtatcacttaatatttgctagatgcctgctagtttccagacacagaaaatgttttggtactagaagtatctttccctgatcatatgaaaggcagatgaagattaatccatttgtttctcagagataagcccaaatgaccatcatatccgtattgaatgatcctttaattttcaagtaattttatgccaagcctcaaactcccagctgctgggtccttcaacaccaaactcataatgtcaggacaaatccaaggattaaaaacatcttaagtctagttaacttttaaccttctctaaaagtgcgcatcatcaccaggctatctaggcattccatcataagaaaagtttatgagaaggtaaaatattccacttcccttacgtgcaacagaacaaacttgtgcataatattttccagaataccaaaccaccacgggtgataagggatacagttagcatctagaacattacattttttttaaattttattttaagttccgggatacatgtgtaggacgtgcaggtttgttaataggtaaacgtgtgtcatcgtggtttgctgcacctatcaacccatagaacattaaatttcatcaaaacaatccagaacagagcctgtgaggtgaggtaataatctaaaatggtcctgagtggtcctggatctacccaacggccttgggtgggtctgggtctgctctggcatgggccaccgcattaagaaccacatgtgtcacgggcaagggtcaggtaagacatgaaagtgggtgaagtgcgccaagtgaacggccatttctctcttgggaaaatatatccaggaagaatggttttaagaaaaagaaacttccagattgcttttttttttttttttgagatgaggtcttgctctgtcacccaggctggagtgcaatggtgcagtcttggctcactgcaacctccacctcccaggttcaagcaattctcctgcctcagcctcccaagtagctgggattacaggcacgtgccaccatgcccagctaattgttgtatttttagtagagacagggtttcaccatgttggccaggctggtcttgaactcctgacctcagatgatccacctacctcgacctcccaaagtgctgggattacaggtgtgagccactgtgcccagcctgcttttcatctgttgtatggtgcttctcttctctgccaagtggtctgagagcctaatcgtatcactattagcccacttgggagaggagagaagcactgcacaacagggaacccgtgcccagtttctcagggacccctgctgccagccccagtggctatgacaatgcaggcccagtgttgcctgagcatctcattttttaggtgacattagaaatccggatcatgttaaatctagtttttaaatattggcaacaaatccacttgttaaaaactgcaatgatcaaacatgtccataggtcaaatctggccataggccaacagtccatgctctccagctggacatgtcaaggaccaaatcttctcaggcaactgctgatcgaacctccatcaagcctcagggactggggcaaaatagggtgtctacctagtggcccacaggccacacaggctattccagaatctggccctcaacaacgacttgagaaggtcacctcaattcctttcactgaaccttttttgttttgagacagggttttgccctgtcacccaggctggagtgcagcagcaggatctcggctcacttcaacctccacctcccaggttcaagcaattcccctgcctcagcctcctgggtagctgggattacaggcatacaccaccacacccagctaatttttgtatttttagtagagacggggtttcaccatgttggccaggttggtcttgaactactgacctcaagtgatctgcccgcctcagcctcccaaagtgctgggatgaaaagcatgagccaccaagcccagccctttcactgaactcttaaatggccctttccaggccaaatagcgttgcctggaaccatttagtaccatgtaccatggttctcagatccagaaacaggatccgatcacctatgcattttctaatacataagccctaagttattttaggtctataaaaactatacgctaaggtgggggtaaaaaatctcacatcaaatataaaaaatttaagtcattaaaggagatgaggcatttgtaaagaacttttaaaaatatcttaagagctggaggggtctttttgttggttggtttgggttgggttttattggtttgtgtttagagtctggagtatttgctttttaaaaaggcagtgaaagaaaaaaaacgaaccccttccaaacacatttgtcatttttatatactatatcatgcatgtttatgctggctacattaggaacaagcttgaattacaacccccggtttacctaatggagttctgaaaagccgtccaatcttcctggaagagggagttgggaggaatgtggtccagtttgcacttctttcgtatggactggagagtgctggtgaaatcagacacatacctgccgggaaagggaagaaaatggtagggaggtcaccactgattccccaactctaaagagacctggaattctacagctctggacaaattgctaatggccttgagagcatctttagaggctcccaccgacgagtgaaactgcttgtaaacctctgaacacaaaaagttcttctctatgtggcaagactgtcttcaccacctggttgagcagtttctaaaagagatgcccaagaggagaaggaaggaataatcgtgaagttgactccagggagcaaccaggtgagagatgatgctgataaatcccccctcatccagataagtacatttctgtgaaagcaggtttgaagaactgtttaaacatcacggtcccatggtaataactgactgtgacctgggataacgtaaggaaggtcatgacatccaaggtacctctgcatcattctcatcctctaaatttagattaaatacccgtggcaaaaagattaaagtttcacggctggcaagtgtctgactttaatgggacagacgcatgaaagtggattcaaagccaggagatcctccctcacaggctgcgttgtttgctctcactgtacacacatacttttccctcacagcatctaaaacactgtaattaaacagcttgtttagacagggcatggtggctcacacctgtaatcccagcaccttgggaggctgaggaaggaggatcacttgagctcaaggagttcgagacctgcctgggcaacagagtgagatcccatctctaaaaaaaacaaaaaaattaggcgggtgtggtagctcatgcctgtaatcacagcactttgggaggccgaggtaagaggaccacttgtgcatggaagttcaagaccacactgggtgacatggcaaaactttgtctctacaaagaatacaaaaattagcctggcgtggtggcgcatgcctgtagtcccagctactcaggaggctggggtggaaagatggcttgagcctaggaggtcaaggctgcagtgggccatgagcacgccactgcactccagcctgggtggcagagcaagaccctgtctccagataaagaaatagcttgtatgatgcttattgctgctgctagactttaagctctgggagaacagagtctgtgcctcatacttatatccccaggaactagcacagagctggacataaaggagggagtcatgtcctctgaaagctacgaaacctgtgcctcatacttatatccccaggaactagcacagagctggacataaaggagggagtcatgtcctctgaaagctacgaaacctgtgacatttgcatgcatcacaagaggccttgccgcttgcccctcccaaaacgaagctctaaatgaggaaagtgaaatgtgaggacccagggcacagccccaaaaggtcagtccatgcagtggagacacaggccactcaatgaaccaactggaagaaacggcttcaggtcactccactgactgcaaatgatcctgctgctccctttacagagagctcgatgctttcaggtggaaagctgcaaaacccagagtaccactgacaacaccttccccttgcaccaagagaggtgacagctttctagggttataagtcccaggaaggagaggggctggcctcaagcacaaactgacaggggaatgttaaggaacatgattgtgctttagccatgggaagttaaacaaccatgtcaccacctctgcaactatggcaaatatccatgtgctctgcagaaagagcaggtacacactgcaggagaaggagttttgtttagccactattctcaggtatggttataagcaaatgctttctctatttcattagctgtcaatccagaattctaaatggtttgtcatgaaatctcagaggaaaagtgtagctttcatcacatcatttttgttcccaaaccctccagctgtttctcacaatacacatttccaattgtcaaccatgtcagagtcaccgtgttaggggctttaatgatatgcttttggttaatattcacaacctccttggaaaggagatattgtcatcatcagtttactcagagaggaacactaccatctctaaggtccccactagtaagtgtccagagctcccatgcccatcacagtcttaatacccctccttcttgaaccaccggttggccactatactctatgcttcatcctagttcgagttaggccaacctgcacctgcctttcctgcgtaccctgttctccttgcccctgcctcccttaatacccttccccaaaccctcctcactactgaacaatgtgccatttgaaccctgctcaagttagcttcaacctgatttccctgattttataagcatcagctattttggtaacttcaaaatcttcccttttagagaagatggcctgggttttccagatatacttttgtacagtttgaatgcttaatatggaaatgtattattttgatttttttttattttttattttttgagacagagttttgttcttgttgcacaggctggagtgccatggcacagtcttggctcactgcaagctctgcctcttggattcagcaatttttatgtctcagcctcctgagcagctgggattacaggcatccaccatcatgcctacctgatttttgcatttttagtagagatgagcttcgccacgttgaccagggtggtttcgaactcctgacctcaagtgatccacctgcctcagccacccaaagtgctgggattacaagcgtgagccaccacacccagcctgatgtttctttttctgcaggaacacattcaggctcatccggccacaccagatgatgtgttcctatagaaatgcctacgtggaactgccctgggaggtgctggatgcccgatggcaatgccagggagctctgggtccaaggagcctccacagttcacagaggcatgctcagtatttctggaacaatcagagacagggcttcaccatgttggccaagctggtctcgaactcctgagtttaagcaatccacctgtcttggcctcccaaagtactgggattacaggcgtgattcaccgcaccaggccaaaggtcctttttcttgttcaaataaactttgttaaatttaacttgtctaaggtttctttttttttcttaacatactttaactgctgcacaagtttccctcatatgaatatgtcacatcttaagtaaccttccctaatgggtagacatttacgttgtttcaaatgttccaccattacaaacaatgccactatgaatatccttaacaacatcctcttgggttcaggtgcaagtgtttcccagggttcagagaacaaatacagaacacgtgcatttttatctgggacagacactgctccaatgtggcccgtctggtccccagttccccagccttacttggcaaagagggatttcagggctgacaacaggccgcaggtccccaggccattggtgaatctgacgcatctgtcaacggctgcagacgccagaccaaacagcttgttcacggagtggctcagctcctgcacacagtcaatcacttccccatgctcctggtcagcaaatacagacaaagctgcattaggctttagaacagacaatgctgagataggggaagacctccaagccttctcatctgtagtaaaatcacttaataacgatgtcagaaatatagtcccaacgtttgaatgcttctctagagcctgaatcaagggagaacagtctaagtcatcagtgggatcatggaaattcactcctggcagaaaagcatgatcgaatgtctgtctacttgatcctaatgtttttcattgctttcctctttttctgtgattattaagatggcatctcttcctctggctctcgagctacgattcaaattctccttatcagacgctccaaagaatgtagcaaaagggggctgggtgcagtggctcaagcctgtaatcccagtactttggatggcagacgtgggcagattgctccagcccaggagtttgagaccagcctggtcaacatggcgaaaccccatctctacaaaaaattagcctggcatggtgacatgcacctgtagtcccaactactgggaagctgaggtgggaggatcgcttgagcctgggagatcaaggttgaagtgagctgtgattgtgccactgcactccaacctgggcaccattggacttcaacctgtatgacagagcaagaccctctcaaaaaaataaaaataaaaaataaggcaaaaggaaaatgcttccttccttcaggtgcaagtatggcactgaagtgcaatagactttctaggtatatccctagaaaacaagaaaatggtaagaggcagtagatttgaactactataagatcaattctgaaatatcaatgtacctcatgctagacaaccttatgacttgaaaacaaaataatatttgaaatggaaatggcctcagttccacccctggtgcccacatagcatagtgaacctgcccctgcagcattgcccatgagtgctaagatcctgtgcccatttgcatgtcttccttaaacaaaagaccgccttagtaagaaattagtaaaccagggagataatcaacttatcccccaaaagatttaagcctctcattttgtttaaccttcattggggattttaaatagaaaactagggcccggcagggtggcacatgcctgtaattccagtactttggaagcccaaggtgggtgggttgcttgagcccaggagtttgagaccagcctgggcaacatggcaaaactgtctctacaaaaaatacacaaaaatgagccaggcatggtggtgcatgcctggagtcccagctactcaggaggctgaggcaggaggatcacttgagcccaggagatcaaggctgcagtgagttgtaatcaatcgcaccactacactccagcctgggcgacagatggagactctgtctcaatccatcaatcaatagaaaattggtagcaaatatatggtctcattttacattgggattacaagagcccacaagtgcttaaaggtcatatttcagcaccccggatcccaacccccagccctctcccagacgtggccaagaccctggctaacagaatgcttcctcagtggccccaggacactgcgactttaccagaggcacagcactcatctggatgaggaggttgctctcttccatgtcgccatacttcagctggtagggtttgtatggatcatacacagcatccaccagctccgtgacttttaccagattgtgttcatctttagggaatcagaaatgtaaaacgataatgaacaaagaatctgaaattaactgtgggaaagcaacaatcaagaggcgctctactagaactttccccatttgatctccagaggggactatattttgttaagcagcttttatcattcatggaagcttctcctacaatcagttcagcaaatatctggataaatttgggctttgcacattgtttgcctaaagcactattaaagacaccagccccctgaatcccatgacccaccacaaataagaatcccttcaaaagataaccctcattggccgggcgtggtggctcacgcctgtaatcccaacactttgggaggccgaggcgggcggatcaactgaggtcagaagtttgagaccagcttgaccaacatggagaaaccgaaaccttgtctctactaaaaatacaaaattagctgggcatggtggcacatgcctgtaatcccagctactcgggaggctgaggcaggagaatcacttgaacctgggaggtggaggttgtggtgagctgagatcacaccattgcattccagcctgggcaacaagagcgagactccatctcaaaaaaaaaaaaaaagataaccctcatcaaggtcaggttcaagaattgccacagaggctgggctcggtggctcacacttgtaatcccagcactttgggaagcggaggtgggcgtatcacctgaggtcaggagtttgagaccagcctacccattatggtgaaacccgatctctactaaaaatacaaaaattagccgggcgtagtggcgggcacctgtaattcctgctactcgggaggctgaggcaggagaattgcttgaacccaggaggtggaggttgtaatgagccaagatcatgccactgcactccagcctgggtgacagagtaagacttcatctcaaaaaaaaaaaaaaaaaaagaactgccacagagaaaaggcaatacaggaagaacaattcccatgccacatgttcctaggacttcctagaaacagaatacccccactggcaggtcgtggtggctcacacgtgtaatcccagcactttgggaggccgaggtgagcggatttcttgaggttaggagtttgagaccagccctggccaatactgtgaaaccccatctctactaaaaatacaaaaaaaatttagctgggcatggtagcatgcatctgtggtcccagctacctgggaggctgaggcaagagaattccttgaacccgggaagctgagattacaccactgcactccagcctgggtgacagagcgagagtccgtctcaaaacaaaaacaaaaaacaaaaggataccccatagcccaggcattccaaaaattcctacgttcaaccacataaaaatgtaaaacacgctgtatcagaatgtaaatgtgcatattctacaacacagtaattcaattcctgaaaatcatctcaaagaaatcaacaaatacacagagacagaaggatgttcatggaaacatggctcagaatcagaaagctttggacacagtctcaacaggggattagtaaatgtaatagcctacttactggtatcctcacatccttctggtcccctccttcagctagttttattattacttctacagcctcatcctccttccctcttcctctagctcccagccttctctcagttcctaaaagcttccttctgttcacatgctgatcctctgtctggaaggaccggcttcgtcccttcccctctttatctagttaactcctacttctccttcaatactcactcagctaaagtctgctgctcttgatttctggcaccaattttacaaggttttgtagagattaggtaaagtaatgtgggtctaacatggtaataatcaaatctgcacatgtatagaatccaaagtgttatttcttttttcttcttcttttcttttttcttcgagacaggatctcactcagttccccagactaaggtgcagtggtccaaccacaggtcaccattgccttggcctcccaggctcaagagatctccccaccccagcctcctgagtagctagtactacaggtgtatgctactatacctggctaattttttttttttttttttttttttgtagagatggggtatatgtttccagagctgatcttgaactcctagaatcaaatgactccctcaccttggcctcccaaagtgctgagattacaggtgcgagcccccatgcctggcccaaaatgctgtttctgaatggtgagttgagaatgatttctttttccttccttgttttttcctagatttttctataatgataaagtcaacctaaatttttaaaaatttactttatattgcataatcttttatattttgaattgtattaggtacatgtattaactattaaaataatagaaaaaatgttaagggtaaaattaaaagttaggcaatatatttacaacatatttgataagcaatggtaaaaattcctcactatataaggatctttcaggaatatgcaccaaatttgtaacagtggttaaagtgggattataggagagttattttgtgtcacagatttctatatcattaattcttataatacatattttgttgctttttataatatatttaataatatattattttaaataaattgctcttataaattaaccagaaataggttaaactcccaaacagaataacaggctaaagaataagcaattcaaaagagaaaagatactttttatcatgtaactttcaaacttgctaataaccaaagtgaaaaactaaaatggcatatcagtaattgtctaagaacctggcaatgacaggagaaaaaaagaatctagtgctggtgaggggatggcaacacaggcaccttcgttcactactgatagatacaaaaacaggtctaaagaacaaaatgtgtcaggaggctgaggaaggagaatggcatgaacccaggaggtggaggcttcagtgagccgaaattgtgccactgcactcccgcctgggcaacagagtgagactccatctcaaaaaaaaaaaaaaaaaaaagaacaaaatgtgacaagtatcttcaaagttttcatttctgagcaactgcaaatttaaacttatcctaaggaataatcggagctaggctcaaaaactaatgtataaaacagttcattatagttttatatatcatagtgattaaaaatggtagtaaattggccaggtgtggtagctcacacctgtaatcccagcactttgagaggccaaggcaggagaatcacttgagcctaggagtttgagatcagcctgagcaaaataggaagaccctgtctctacaaaaaatttttaaaaatgagtcagccttggtggcatgtgcccgtggtctcaactactcaggagactgagttcagagaatcacttgagcccagaaggttcaaggctacagtaagctgtgatagtgtcactgcactctaacctgggcgacagagcaagaccctgtctcaaaaaaacaaaaaaaaaataaagacaacaaaactatgtcttaggaaaacatttaatgacataagaaaatgcccattatattattttgagcatttcaaaaaatgaaaatataagactgtctacaaccaatattttaagatattttgtatatattatataacatatattattacatgtaaatatataaaagtatttaatatatttaatatgttatgtatttattacataatatttatatggtagatattaagtatattaatatttgtgaacaatgtatatttatatttgtattactggaagcaaataatgttgttggtggctctgactgatgagtttatggattgttcttgctctctttttatttttgtgtgtgtttccaaaaaatttttaagttaaaagaaaaactaaaactcttttggaaaacctcagggagaatcattagtaatctaggtcaggtgtggtggcttacacctgtaatctcagtactttgggaggccaagatgggtggattgcttgaggcaaggagtttgagaccagcctggccaacatggtgaaacctcgtctctactaaaaatacaaaaaaattagccaggtgtggtagtgtgtgcctgtaatcccaactactcagaaggctgaggcaggagaattgcttgaacctgggaggcagaggttgcagtgagccaagatcacgccactgcactccagcctgggcaacaaagcaagtctctgtctcaaaaaaaaaaaaaaaaaaaatgaaatctaaagtcccagccaggcatggtggctcacacctgctgtaatcccagcacttcaggaggctgaggcgggtcgatcacctgaggtcatgagttcgagaccagcctggccaacatggcgaaaccccatctctactaaaaaatacaaaaattagcctggtgtggtggcacacacctgtagtcccaactattcaggaggctgaggcaggagaattgtttgaacccaggaggtggaggttacagtgagccaagatcacaccgctgcactccagcctgggcgagagtgagactcgtcccatggctgactagcaaagcacttccagatctgtctcaagggtggttctcttccccactacatccatccccaggggaaggatgcagccattccttgctccaccttcgtcccactgtgctgcagcaactcgccttagcccagctctctcaactctccttagccacttccacaaaggcatcacggtcccttggaagcttccccatccactgggcctttcccataactaaggcctgacctgtgagcatgccaaaaacaccgatgagtcatcaggaatccgaacaataaacacactccctggaacgtacaaggcaattatacacagatgtaattaaagagaagaactattaaataaaccaagtcagtgacacacagccgccgaacagcagaacaaggccttcctgaagcaatttcctgatttgacagcaacatgcgtcacggggtctgtgttctttaaaaatttataaagcttttaacatagacgggaaagagcttggagagcatcacacaccaggcactgtttacccaaatgggagtaaggggtgctctgctctcagtcggccaccggggaaagcccattttctctacaaccacctgtagtcctaacacagctcccctgccctgggacacttgctgttgctccttcaaaaagcccctgtaggctgggcacagtggctcatgcctgtaatcccagcactttgggaggccgaggcgggcagatcacctgaggtcaggagttcgagaccagcctcaacatggagaaacccaatctctactaaaaatacaaaattagccaggcgtggtgctgcatgcctgtaattccagctacttgggaggctgaggcaggagaattgcttgaacctaggaggtggaggttgtggtgagccaagatcgtaccattgcactccagcctgggcaacaagagcgaaactccatctcaaaaaaaaaaaaaaaaaaaaagcccttgtagcctgtttgttctctaaaactgacttttgaggttgaaatgtctgaggcttcgtgatgacttcaaaggataagcacacttgcctcctggtgtaatctgccgccaactctttgccataacatctacctgcctcactgtgatgcctcttttatatcccaagccccacagaggtgtccatcacttccccagagcatgtaaggcacccaggcagcactggagccaggcaaagatattaaacaactatttccttgatggcaatgttttttcatggaaaagccctccacatctgctgagaaggaaaacaccgatcccttccatttctgtaaaatcagtcatctgaaaaggcaaacaaatccaggccccagaagcttcagaaagagcgagtaaagacaagctagagaactggcaggaaggaatgtttacgtaggtgggggagcagtgccatctccaagcccttggcgaagtgggcggtggcgtcgtagaactccagcagcctggtgagctcctgctcgggccctgccctctccacgccgttgctgaggcaggagggcagcgagggcatgagggcccccagggtctgaatcagcagcaccattaccacctcgtggggcttctggaaaacctgcagtgagagagaggtgtacctgccttagcacatggagccaaataggagcccaccttttttaaaaaacttttttgagatgccaggcacggtggcttatgcctataatcccagcaccttgggaggccaaggaaggtggatcacttgaagccaggagttcaagaccagcttggccaacacggcaagaccctgtctctactaaaaatacaaaaattagccgggtgtgatggcgcatgcctgtaatcccacctattcgggaagcagaggcaggagaatcacttgaacccgggaggtgcaggttgcagtgagccaagactgtgccactgcactctagcctgggtgacagagcgagactctgtctcaaaaaaataaaaattaaaattaaaaattaaaaacttttttgagacagggtctcactctgccacccaggctgaagtgcagtggcataatcatagctcactgcagcctttaactcccaggctcaagtgatcttcccaccttagcctcccaagtagctgatactacaggaacactaccacacctgattaattttttattttattttatttttttgtagagacggggtctcactatgttgcccaggctagtctcaaactcctagcctcaagtgatcctccttcctcaacttcccaaggtgttgggattacaggtgtgagccacatcaccttttaaagaagtataacttttaaagaagctatctcctgggtcatctcaaaaggatctcccctgatagatgaaaagtgatctagtttagagctataagcccaaagttttcctcatggcaaatgtgaacatgctcagaaagtaaactggcaagacttggaacttgcaacttgcctagaacaactggcaagttcatgtctatcagtggccccaagtgtctagttattttcaaatctaacgaacacattcatgtggcatttttttgatggtcaccaaaaattaactagagagaggactatgggccaggtgtggtggctcatgcctgtaatcccagcacttttggaggcctaggtaggtggatcacttgaggtcatgagttcgagaccagcctgaccaacatggtcaaaccccgtctctgctaaaaatacaaaaaaattagctgggcatggtggtgcacgactgtaatcccagctacttgggaggctgaggcaggaggattgcttgaacctggtaggcagagattgcagtgagctgagatgttgccactgcactccagcctaggtgacagagcaagactctgtctcaaaacaaaagaaacaaagaaaagagaagaactgtaaaccaacatgccttatgaatacacatgtaaacatcttcaagaaaacactagtaagctgagttcagcagcatattaaaaaacattgtacaccatgatcaagtaggattcacccaggaatgtgagaatggttaaactaaacaaaaatggatcaaggccgggcacagtggtggctcagccctgtaatcccagcacctgggaggccaaaacaggaggatcacttgaagttaggaatttgagaccaggctcaaaaaataaaaatattataaatctctaattttttaaaatgaatcaatgtaatacaccacattaacagaatgaagggaaaatacatgatcatctcaattaatgcagaaaatatatttgacaaaattccatacccttcatgagaaaaacactaaactaggaatagaaggaaacttcctccacataataaaggccatatatgaaaacccacagctaacgtgatacccattggtaagagatggtaagaacaggaacaagataaggatgcctgcttttgccactctattcaacaaagaaccagaagtcctagccagagcaattggacaaaaaaaaaaaaaaaaaaagaaagaaagaaagaaagaaagaaaaggcatccaaattgaaaacaagagttatctctgttcacagatgacattattttatgtgtagaaaatcttaatccacaaaatacttttagagttaataaattcaggacaagtgcagagtggctcatgcctctaatcccaacactttgggaggctaaggtgggaggatcgcttgagcctaggagtttgagaccagcctgggcaacaaagtaagatcctgtctctacaaaaaatgttcaaaaattagccaggtgtggtggtgtgcacccgtagtcccagctactggggaggctgaggtaggagaattacctgagcccaggaagtggaggctgcagtgagctgagattgcaccactgcactccagcctgggcgaaagagcaaaactctgttgcaaaaaagcaaacaaacaaacaaaaaaaaaccaggctaggcgcggcggctcacgcctgtaatcacagcagtttgggaggccaagatgtggtggtgggcacctgtaatcccagctactcgggaggctgaggcagagaattgcttgaacccaggaggtggaggttgcagtgagctgagatagcgccactgcactctagcctgggcaacagagagaaactctgtctcaaaagaaaaaaaaaaaacaaaaaacagctaaactgctgaggactctccaatttgtgtttcttccaaccacctactggatgtcaccattaggatgcgtcactctcacttggaatttaaaagcagtcagaattggaattcattgttttgccactgacctccccagacctgcttcctccaacttctgtgttcccgtcagtaacatctccattgaaccaggatgaaaactgccctctgactctctgttcttgtggtccattcatcagttaccaggtcctaacaactgtttattcttcttgaacttcaacatttccatcaccatcctctaccaaaggttcttacctgtctccagcatagcctcatcagttcaccctctagaccaccaccaaattcgttatttttaaatgttatttttaaaattcaaggcctagcacggtggctcacacctataatcccagcactttgggaggccgagtgggcagagcacttgaggccaggagttcgagaccagcctgtgcaacatggtgaaaccctgtctctactaaaaaatacaaaaattagccgggcatggcagcatgcacctgcagtcccagctactccagaggctgcagcatgagaatcacttgaactggggaggcggagtttgcagtgagcccagatcatgccattgtactccagcctgaccaacatagtgaaaccccatatctactaaaaatacaaaaaaaaaaattagctgggcatggtggcacatgcctgtaatcccagctactcaggaggctgaggcaggagaattgcttgaacccaggaggcggaggttgcagtgagccaagatcatgccactgcacttcagcctgggtgacagagcaagactctgtctcaaaaaataaaaaataaaaaataaaaaaaacctgctacaactcaataataaaaaggcaaataacctgtttttttttaatggacaaaagacctgaatagacatttcgcaaaggaagatgcacaaatggccaataagcacgtgaaaagttcctcaacatccttagtcatcagggaaatgcaaataaaaaccatgatgagatactactacacacccaccagcatggctgaaattaaagagaatgtcaacacctaattttggcaaggatgtggaacaaccagaactctcacacactatgtaggagtggaaaaagtacaaccactttgagcaatgtggttgtttcttttctttttttttttttttttgagatggagtctcactctgttgcccaggctggagtgcaatggtgcgatcttggctcactgcaacctccacctcccaggttcaagcgattctcctgcctcagcctcccgagtagctgggattacaggcatctgccaccatggccggctaattttttgtatttttggtagagacaggctttcaccatgttggccaggctgctctcgaactcctgacctcaggtgatccgcccacctcggcctcccaaagtgctgggattacaggcatgagccaccacacccagccatctttcttttttttgagacagggtctcactctgtcgcccagactggagtgcagtagagcaatcatggctcattgaagcctcaacttcccaggctcaggtgatcctcccacctcagcctcctgagttgctgagactacaggcatgtgccaccacgcccaactaatttttgtattttctgtagagacaagattttgccatattgcccaggtgggtctcaaacttctgggctcaagcaatcctcctgccttggcctcccaaagtgctgagattacaggtgtgagccaccacgcctggctcggcagtttcttacaaacctaaacatacacctacgatttgaccctgcaattccactcctaggtatttacccaagagatgggaacatgtgtctacaaaaaaaaaacctacagaacaatattcaaagcacctttattcataattgcccaacactggaaacataccaagtgtctaccaataagaagtgtcaacaggctgggtgcagtggctcacgcttgtaatcccagcacctttgggaggccgaggtgggcagatcacctgaggtcaggagttcgagaccagcctggccagcatgaagaaaccctatctctactaaaaatacaaaaattagctgggcatggtggtgtgtgcccgtaatcccagctactcatggggctgaggcaggacaaccacttgaacctgggaagcggaggttgcagtgagccaagatcgtgccactgtactccagcctcggcaacaacagcgaaactccgtctcaaaaaaaaaagtgtaaacaaacaggtatattcacaccatgtaacagtattcagcaacagaaaggaacaaactagtgatacaaacaacacgagcaaatctcaaaaacacgctgagtgaaagaagcctacaaaagatgaaatgctgtctgattccatctaggtgaaattctagaacacattaaactaacttatgatggaaaaaatcagggcagtggttgccttaagggtgctggtgcacagaccaactgggaaggagcatgagggaactttccagggcgatggtgatatggatgttctggatcctgaaaggggattaggctacccaggtatttgtagttgtcaaatgaatgggatggcatatttaagatcactatggctgggtgcagtggttcactcctgtaatcccagcactttgggaggcgtgcagcccaacagtgggaggatcacttgagcccaggagttcaagaccagcttgggcaacatggcaaaaccctgtctccacaaaaaatacaaaaattagttgggtgtggtggcacgcacctgtagtcccagtactcaggaggctgagaggggaggattacctgagcccagggaggtcaaggctgcagtgagccatgatcatgccaccgtactccagtggggaaaacagggcaagaccctgtttcagaaaaaaaaaaaaaaagattgtatttcacaattttacctaaaaaaaatgtaagtaaacattgaactctagttaataatatgtatggtctgaagtgaatgaagtttgcaacttactctgttttttttttttgagatggattctcgctctgttgcccaggttggagtgcagtggcacaatctcggctcacagcaacctccacctcccaggttcaagcgattctcctgcctcagcctcccaagtagctgggattacaggcgcctgccaccacggctagctaattttgtatttttagtagagatggggtttcaccatgttagccaggctggtctcgaactcctgacctcaggtgatgttcctgcctcggcctcccaaagtgctgggattacaggtgtgaaacaccacgcccagtcttgtaacttattttgaaatgagtaaaacaaataagatgattgactgggcactttggctcatgtctgtaatcctagcactttgggaggctgaggcgggaagatcacttgagcccaggagttcgacaccagcctgggcaacatagtgagaccccatctctgtttaatttaatatttttatataaaaaagaatacaaataaaaataattttaaaaaataagatggattaatgaacagacagagacagggatagacaggcagatctgcaataaagcaaatagagcaaaatgcacactgtacaacgtaggaggtggctacatgggtattcactgtacaattccctcaacatttttatatattggaaatttctcatatgaaaatgctaaggggaaaaatctgaaggagacacatgtgccctggctcctgtgtgctataccgaccttcaggaggggacagcccaactattatgcttccatcctgaaaagaaaatgggccacaggccaacagtataaatcagcagaaactcatgtctcccaaaatctaggatgaggcccaaagagaagtctgagaagtctaagttctttttcttagatgacgaaaggcattcgtatgtatggacatgaactgtttttatccttgtgatacaagaagtagtagaagaggcaagaacacatgaataatttttttcttggccgggcacagtggctcatgcctgtaatcccagcactttgggaggtcgaggtgggtggtcatttgaggtcaggagttcgagaccagcccagccaacatggtgaaaccccatctgtactaaaaacacaaaaattagctgggagtggtggcggatgcctgtaatcccagctactcaggaggctgaggcaggagaattgcttgaaccagagaggcggaggttgcagggagccaagattgtgtccctgcactccagcctgggtgacagagcaagactctgtctgaagaaaaaaaaaaaaaaaaaagaaatattcttcttaagaaaaataaaataaagtcaggcatggtggctcatgcctgtaatcccagcactttgggaggccaaagtgggaggattacttgaggccaggagttagagaccagcctgggcaacacagtgagatccttatctctacaaaaaaaattttttttaattagccaggcatggtggcacatacgtgtattcctagctacttgaaaggctcaggcaggaggacagcttgaacccaggaggccgaggctgcagtgagccatgatcatgccactgcactctagcctgcatgacagagcaagactctgtctcaaacaaaacaaaacaaaacaaaatcctaagaatgaattaggttagttcaaggaaaaagaacaaggatggagaaaagtgctttaaccaacaacttgaatgacatgacccggtataaggaattctctccaaccttagtcaaattcattccagcaaatgactgatgaacatctgaagagtgattcacaactatagtaaaaaataaaatatggggaacgtgacactaaaccactcgtagatgacctgcttctaggttggggtttcgtacatagcagagcagctccctcactgcaatctatttcaatagctctctatctgagtgctattgaaaatcagccctcaacacaagggtttggagaaaaaaaataaataaataagaaaaaaataaataaaataagccacactagaaacaggcccagtaagtcattactgcaaagtaagacaggctcttcccctgcttacaagaggttctactgtgcctcctgtctcaaggcaagagaacaacggtttaaaacctttatggctggaaatgcctagagacttgaggaaagtaaatgatggatagttgccacttgaaacaaagttcctctgtctctcctcactcctagtcagggggtacctttaaaattatctcttcccctacttcttggtgtatcatgagaacaagggagactcacttcaggtaggtaaattttacctgaagtaaagataaaaacattcctgttcattcgaacaccacctgacgaggggcctcctgcttttagatgggaagaaaatggccttcaggaattccacaggctcccttgctggacaacaggcggcattgtcacattaggtcctatttaagttatagataagagtggtaagaagagtttcagtggagacctaaagatttcactgacgtggatttctaagcttatcttttaaacttaaaccatttaactggttatcgttttttcttttgttgtttgtttgtttgagacagtcttgcttgctctgttgtccaagctgaagtgtagtggtgcgaccatagtcactgtggcctcaacctcctggacgtaagcaatcttcctgcctcggtctccttagtaattgtgccaccacacctggctaacttttgcattttttgtagagttggggtttcaccgtgttggccaggctggtctcgaactcctaggctcaaacgatccgcccacttcgaccttccaaagtgtggtgattacaagtgtgagccaccgcacccggcctaactggttattttttaaccccttgaatgacagcaacaaacggggaagttctttgagctgtgctctgcagttgagggtggccactcccgaggcagtcacccgttcccttgtcaccacagactctgttctccctagaacaaaaatgagctgttacctgtgtagcccactggatttgtgtgtgccaagcaccaagcaaggcatcatagagtccggtaagctgccggtccagggataggtcactttgacacagctcttgccaggctgctaaaagctgcacctgcagagacagaacaaagggaaccttattgggtacgtcaacataggttgcctgtgaacactgccctgccctgctacccagcgtaatcacggattgctcaatgggctcactgggcagcccagtgaggtccattcacttcaaagaaaggcaggaaaaaaaaaaaaacatttgcagttatctgcactgattcacagctttaatctgtcaccctgcggatgtgatcccctctccatttatcctgccctaaaaacatgtaatgtgcaaccacttggcacaccatcactcttctgaatagatgttggggcaagagcgggcagacatgtatgtttaagcttcatgtcctaacatcactgcttaaaagacacagagcactggacttgaaggaattaaggtcagttcaggaagctgtcaagttttttggcaatctaacttcagcaaacctagaaaacataaaattccaagccaggtggagtggcacgcgcctgtagtcccaactcctcacaaggctgagacgggaggatcacttgagcccaggagttcaaggctgtagtgcaccatgatcggatctgtgaatagtcaccgcactccaggctgggcaaaatagtgaaaccctatctctaaagaaaaaaagagaaattcttactgccttctgagggtgtaataaagcttaagacataaatctcccttaaaagacaaaaatgagaataaattaaaacaacgtttcaagtctataatgaatccagctgtaaacagaaaagagaatgaaaacggataactttttccaactggcaattaaacaaatccatatgctagaccaagagcaccccctactggctaactaagagaaaaacagccagagggcaaggagacaaatgttcttaccttctgaattatgaacctgcgattctgtgacccagagttatgagcattccacaactgcacaactgtcatcgcgcacagcttcttaccttgtgacacttgtagtagtaggccaggagctggggcatccggtcaatttcagtaaacaccttcacaaacactttggactgatctaaagaacatacaatgtatatatactgttaccagcctttctggtgtagacatgagaaaaaactcaccaggatgaaggtggatatatggaagctagtattcacaagttcctgcctagatactgaattaactcatgcatgaggatcataaatttgaaaaataagcatgacgtgaaaaccagatactgcaaggtattccccactgttcctcacagaattcatattttaacatgatactgagaggttatttatgtctttcaaaattcctacttcgattataccagatgggaactttaaaaaagcaaacacactgaactgctatatgtcaacatatctggtggtttgaggaataagtaaataatttgggctggtcgcggtagctcatgcctgtaatcccagcactttgggaggctaaggcaggcggatcacctgaggtcaggagttcgagaccagcctggccaacatggcaaaaccccatctctactaaaagaaaaacaaaaattagctgagcgtggtggtgcacacctgtaatcccagctccttgggaggctgagggaggagaattggttgaacccgggaggcagaggttgcagtgagccaagatcgcgccactgcactccagcctggccaacagagcaagactccctctaaaacaaagcaaaacaaaaaaacaaaacataaaatcaaataatttggtaactattagcattccacacataacaatggattctaagacccaagttatgggcttaatatcaagtagtttctgacatatttccctaagggcagaggaaatgactgggcaaagcacttgcttccaggctcaccgctggacagacaggaaggtgggtttcagtgcagtctctgaatagtgtgcacagcagcgccacctctggctcctgtccgcccccttctggccaaaatgtacatgccacagccttagaactatatcaaaagaagggaaaaaaaagccttgagctaacaggtctccaaacttcttatatttgctctgttccccttcacttctgggaagcccaataaactgctgagaaggaaatgttgtaacagcaaccgctgtgggacacccagctaagcgctggagacctgccagtggaacttgacttaatgggcagaaatccatgagttagaaaacgaatatttgcctttaaaatgcttattattttcataagaacacttaaataagtgaatcttcctgttacatttaaaattattccataggccaggtgtggtggctcacacctgtaatcccagcattttgggaggctgaggtgggaggactgtttgagcccaggagttcaaaaatgtcctaggcaacacaggacccctctacaaaaaatagaaaaaattagctgggcatgatgtgcacctgtaaaccccaggaggctgagctgggagtatcacttgagcctgggaggacaaggctgcagtgaactgtgatcacatcactgcacttcagcctgagtgacagagcaagattctagctcaaaaaacaaaattctataaattgggtttgaccagtgagaagcaaaaaaattaattaaaataattctataaaaagttgcttcagtgtatcagctgaattcattggttatataaaatgaactgggcatgtatacttggctatactcacattgtcattttaggagatggaaaaggggaacatgttggggatgaacaaatttatcagagaattccctttaaaaactgttagctaggccgggtgaggtggctcatgactataatcccagtactttgggaggctgaagtgggtggatcatctggggtcaggagctcgagaccagcctggccaatatggtgaaaccccgtctctactaaaaatataaaaaattaaccaggcgtggtggtgcatgcctgtaatcccagctactccagaagctgaggcgcttgaacccaagagctggaggttgctgtgagccgagatcacaccactgcagtccagcctgggcaacagagtgtagactctgtctcaaaaaaaataaaaagtaaaaactgttagataaagaactacctcagccttccaggaaacatggctgattataaacagcacattacctgtggggcgggggaacccttcctgatgcttgccaaaattaagattaatcaccaaaagaaaacattgttttatctgcgttgaagccaggaaaatatctgtactacatatttcagagaatcccaactagatatctaatcactttgggccacaatgggtggggaagctggtaaaagtctgggcgctaagggtggtgcagaacagtacaaagggccaaagactgggggccaagggggcttgggccaggcatgggagggagggctgtttccactgcggcccagcagaggaggcagcctatggagctcaaaagcgccattttcgccttctgaatccatgtcctgcctagagtcaagcctgattcaaatttgtgcacaaaagctgtcaaaaactgcttatctccaaaaccaaacccatgatgctgaaccaccaggcatcactcaaatccaacaccagctcccagaagccagctcactcagaaggaaacaaacaaaaaagcttaaatgcatggagccaccacctctccatccccactcccactcccccaaccccacagaactggatgtaaccccaaccagaaaagtgagctctgtagtagccacaaattcacaagagaatgtgaggaacaaagctcctagatggtaactttccaaccccccagctccagccttagaattctgtgaatgaagaaaagactcaaaataaagaattaacaaatgaggaagagagggaattacagggctggagatgagtactgaggccattctctctagctaactgaagagcacagcggagaatataaactttcaatcaagggctaaaggaaagcgctcttaaacaaggaggggcttccaaggaaattccactatttttcagtgaataccaggcccagaacaaaagcactatcacacacaaacatgaatcagcagaaacaaagaaaactccaccacggtacctatgcactcaataaattggactacaacaaaattaaaaacttggggccgggcacagtggctcacgcctgtaatcccagcacctggggaggctgaggcgggtggatcacgaggtcaagagattgagaccatcctggccaacacagtgaaactccatctctactaaaaatacaaaaattagctgggtgtggtggcacacgcctgtagtcccagctactcgggaagctgaggcaggagaatcgcttgaacccgggaggcagaggttgcagcgagccgagatcaagccactgcacttcagcctggagacagagcaagactccatctcaaaaaaaaaaaaaaaaaattaaaaacttgggcatcaaaagattttatcaataatagaatgaaaacacaatccatggaatgggagaaaatatttgcaagatatattcaataaaagaataatatccagaatatatgaagaatttctacaactcaccagcaaaaaaccaaataacccaatataaaattgggtaaagggccaggcaccctggctcacgcctgtaatctcaggactttgagaggctgaggagggaggattgtttgagtccaggagtctaagaccagcctgagcagcatagcaagaccctatctctacaaaaaacaaaaaattagctgggcgtggtagtgcacacctgtagtcccagctacttgggaggctgccgtgggaggatcacttgagcttgggaggtcaaggctgcggtgagccatgattgcaccactgcattccagcctgggtgacagtgcaagaccctgtctcaaaaaacaacaaaacaaaacaaaaatggggaaaggatttgaatagacatttttccaggaatatacaaatagtcaataagcaaatgaaaatacactcaatatcattaatcattagaggaatgaaaatcaaaaccataagataccatttcatactaattagtatggctataatccaaaaaaaaacaaaaaatgacaagggttggaaaggtgtggagaaattggaacccttgtgcattgctggtggtagtgtaaaatggtgcagccactatggagaacagtataacagctcctcaaaaaattaaacatcagattaccatatggccgggtgtggtggctcacacctgtaatcccagcacttcggaaggccaagacgggcggatcacttgaggccaggagttcgagaccagcctggccaacatggtgaaaccccatctctactaaacatacaaaaattagctaggtgtggtggtgcgcacctttaatcccagctactcgggaggctgaggcacaagaatcgcttcaatctgggtggcagaggtcacagtgagccgagatcatgccactgcactccagcctggacaacagagttaaactgtgtctccaaaaaaaaaaaaaaaaaaaaagataggcatatgatccagcaattccacttctgagtagatccctaaaggaattgaaagctggaactcaaacagacagatcatgccactgcactccagcctgggcaacagagttaaactgtgtctccaaaaaaaaaaaaaaaaaaaaaaagataagcatatgatccagcaattccacttctgagtagatccctaaaggaattgaaagctggaactcaaacagacacttgtacacccatgatcattctagcattcttcacaatagccaaaaggtagaaataacctaaatgtccatcaacagatgaatagatagagaaaatgtggtaatatatgagatggaatattattcagccttaagaaaggaaattttgacacatgctacaccatggatgagctttgaagatgttacgctaagccataaaaggaaaaatactatgtgaatccatttataggaggcatgtagagtagtcaaattcatagggacaaaagtagaatgatgattgctggcaggtgagggtaggaggaatggacagttgctgtttaatgcgtatgaaatttcagttcagaaagatgaaaaaagttctggagatggatggtggtgatgtttgcacagcaacgtgaatgtacttaatgccactgaaatgcacacttaaaaattattaaaatggtagattttgttacatgcattttgccacaattttttaaatttttttctaaaaaagaacacttccaaagattttccctaagaaagagaagaaaattttaggcaataattgcttcacactctcaaagaaattacatgtcctttctttaacaggacctaaggcttcaggaggctgaggtgtgaggatcactttaggccaggagttcaagaccaacctgagcaatatagcaagaccccatctatacaaaaaaaaaaaaaaaaaaataggctgggcacggtggctcacgcctgtaatacctgcactttgggaggccaaggcaggcagatcacctgaggtcaggagttcaagaccagcctggccaacatggcaaaaccccatctccactaaaaatacaaaaaattagccaggtgtggtagcgcatgtctgtaatcccagctagttgggaggtaaggcaggagaatcgcttgaacccaggaggcagacatcatgccactgcactccaccctgggtgacagaatgagactccatctcaaaaaaaaaaaaaagaatctaaggtattacaatgagatacaaagggaggttggcagagctaaggaaaaaaattaggaagtaaatcatgacataacaaaaattaaaaattaattagaagaacaaagaaaacaaaacctatttttttttttttgagacaaggtctcactctgtcactcctgggctcaagcgatccttctgccccaacctcctgagcagctgagactacaagcgtgcgctaccatgcctagctaattttttattttttgtagagacggggtcttgctgtgatacctcggcttgtctcaaacacctgggctcaggcgatcctcccaccttgacctcccaaagtgctgggattacaggcatgagccactgcacccggccgagaacagatactttatttttttaaataagtagagagtttatttgggtgaagtttgaggactgcaaaccagagtcatggattcacgctgccctgcatatatgctccggaacagatacttcagaaaaccccatcagtcaaatgaaaaacaagctttagaaaaaccacacatggcaggaggggactgagagggagcaggcaaacatccaaaagagaccagagaaaatatgatatatatggagagggaaaaaggagagctaatgaacagatagttgatgttctcaaagacagaaaagagaacaaataaaacagaaaaaaaaaatttttaaggaaggtgattttctataaatgaagatatgaattggtaggtgaaaagggctgacgctgggtcctggaaaagttaaaaattttcaaaactgaaaaagaacctagagaagttactaaactacaaggtaaaagaatcttataagccataatttggcaaactatgcgccagcaggccaaactgccatctgtttttgtaaataaagttttacttggccaggcatggtggctcgcgcctctaatcccaacactttgggaggccgaggtgggcagatcacttgagatcaggagttcaagaccagcctggacgacatggtgaaacctcatctctactgaaaatataaaaattagccaggtgtggtggcgcacgtctgtaatcccagctactcgggagactgagacaggagaatcgcttgagcctggggggcagaggctgcattgagctgaggtcacgccactgcacgccagcatggggaacacagcgagacttcgtcttaaaaaaacaaaaaaaatttactggcacacagcaaagcccatccatttacgagtgggcttttgtgccacaactgcagaggtatctgtgagagagaccacaaggccgccaaatactaatatttatgatctggccctttacaggaaatgtttgtcagtcctgttataactattcagggaaaagaaacaagctacatacaaaaaaaaaataataggaagaagcagcaggccaatctcatacttatcagaatatagagggaaatgcattcgcactagaagacagaattcacagaagtagcatttcaccttttgcctttacagaagtatatttggctgttttgtgagacattctgcgggaaaagaaaaataaatatagatggcagaagacaatgaagaattctgaaggagaaagtgtgtgacccaagaattccaaaagcagttattgctttctacacataaaagcaatagaaagacactcctggccgggcgcggtggctcatgtctgttaatcccagcactttgggaggccgaggcgaggggatcacctgaggtcaggagtttgagaccagcccggccaacatggtgaaagcccgtttctattcaaaatacaaaaattacctgggtgtggtggcacacgcctgtaatcccagctactcgggaggctgaggcaggagaatcacttgaacccaggaggtggaggttgcagtaagccaagattgcgccactacactccagcctcggtgacagagaaagactccgtctcaaaaaaaaaaaaaaaaaaaattacagagttccttctaatctatgtaattcaatcaccattaagacattctaaaaactgaagacttacaaggccttatctttatagagagatatacacagagatgagaagcagctagcactcacctacagcctgagaggtgaatgccgctacaatctgtggactggctagggcctccagcctgttcttcagtgcctccaagtgcacacacttttctgagtagtctggtgtatcaacaagcatcattaagctgttctgcatacctgttagcttggcagaaatcacagctatgtcctagaaaagaccagaatagagaatatttattttaaatgatccctactgcctcaattgggaatagataaaatacatgaaaaggcaactcatcaagtatgaaaatggggctgggcatcgtggtggttcatgcctgtaatcccagcactttcggagattgaggcaggaggatcccttgaagccaggagttcaagaccagcctggttaacatggcaagatccagtctctacaaacagtaaaaattagctgagtgtggtcatgcgcacctgtagtcccagctacccaggaagctaaggcaggaggatcacttgagcctggaaggtggagactgcagttagccaagatcacaccactgcactccagcctgggcaacagagaaagaccccgtctcaaaaaaaaaacaaaaaacctgtactcaaataaatgcaaattaaattaaaacaataaagtgtcattttcctcctaacaaattggaaaagtgtttgaaaaattataatagctattgttggtgagggtacaaagaaaaaagacaatctggtatcataaatttaaatttatactgtctttctggaaggcaatttagcaatatgtgctaagagttttaaaaatattcacatccaggctgggcacaatggcttatacctataaatctcagcattttcagaggctgaggcaggaggattgcatgaggccaggagttcaagaccagcctgaccaatatagcaagaccttgtctttacaaaacattttaagaaattggtcaggcagccgggaagggtggctcacgcccctgtaatcccagcactttgggaggccaaggctgaaggatcacctgaggtcaggagtttgcaaccagcctggccaacatggtgaaaccatctctactaaaaatacaaaaattagccaggcatggtggcgtccacctgtaatcccagctactcgggaggctgaggcaggagaatcgcttgaacccaggaggcagaggtttgcagtgagccgagatcatgccactggactccggcctgggcaacagagcaagactctgtctcaataaataaataaataaaagatagattgttgagtgaaaaaataaagtgaaaagcagtgttcacaatgagctttgtgaggaaaaaaaggggcagggaacataaatatgtatgtgcatatctggaaggatgggcataaagttgataacagggcttgtccgcacaagaaaaattagcccccggccgggcatggtgactcacgcctgtaatccctgcactttgggaggccgaggagggcagatcacctgaggtcagtagttcaagaccagcctggccaacatggtgaaatcccatctctactaaaaatacaaaaattagccgggtatggtagtgcgcgcctataatcccaggtactcgggaggctgagacaggataatcacttgaacccaggaagtggaggtatcatgccactgtactccagcctgggcttcagaatgagactccgtttcaaaagaaaaaaaaaaaaagaaaaattagaggactaaggtgggggtcagggttaggaaaaaaacttattttttgcagtttattcctgtgtaataaatttgttcccatgtgcatttgtaactttttaaaaaaactgactgataaatcattcattttgctttacaattgagtaagagttcttcataagacatcatcttacttcatccttacatcccaggtggaaaatgttactattttccacactttgcagcctcagaaggggtcaataacccaccaagtccccaaggtatataaggctcccctttccccatgttccaccctctcgtccatttacccccaaccttctctgcctgtgctggtttttcttttcttcttctttttttttttttttttgagacagggtcttgctctgtccctcagcatagtggtatgatcatagtttactgtagccttcaactcctgggctcaagagatcctcccacctcagcctcctgagtagctggaactacaaatgtgcagcaccacacctggctaattttttaatttttttgtagagacgggggtctcattattttgcccaggctggtctcaaactcctggcctcaagtgatcctcccacctcagcatcccaaagagctgggatttcaggtatgagccacagtgcctggtgcctgtacatctttatcaaggcttctcttgaactcattctgtgactaagaggcttcagtcacacagagggtgcaagctaaagaggctggaaacacaccgagcagcttcagatcttccccaccctgagtctgaaggtttctgaatgctgctattggctatcaactttgtatctcttttgctttctccaaacctcaagttcttgcttaaatacctttcataacatcccctaaacaagaaacctacctgagtcttaaatgtctcctcaatatcggcgctcaacgtgctccacttatctgcttcctgaagagattcggcagcaagttgcattctggacttcacttggtcaatttctaccaacacctgaaagaggcgtgaggggtgaaaaatgaaggggtaggtcctttttctccatctgccaccagggacttgaaatgtaagtatggtggcttgcttctgtctttagggagcttctgtctcccaaaacaccaatcatctggctaaatttattcagcagtgctgaagagatgaaccagctgaaagacccaagcaaaagcatagtttcggggagccaggcacagtggctcacgcctgtaatcccagcactttgggaggccaagatgggaggatcacttgagaccaggagttccagaccagcctgggcaacatggtgaaaccctgtctctactaaaaatacaaaaatcagccgggcatggtgttgcacgtctgtgatcccagctactcagaaggctgaggcacgagaatcgcttgaacctgggaggtggaggttgccatgagctgagatcacgccactgtactgcagcctgcactccagctacagagcgacactctgtctcaaaaaaaaaagagcatagctggagtgctgggcagaatcttgagtgatggttggcctcccaaaacaccgtgctgttctaaagcccttacgagagtgaccaccttcccaaagcaagaatcaccatttacaacaggagccaaaaggagccaaaatacctgcatggattgagatgtgtcctgttcaaattttttaatgtcctccttgacaagaatcatctgttctttcaggaaagatgcctcctgttttagggcttcaacatcacggagcactttgggcatgttctggagagcttggtgacttgtttctgtagttaaaaaaaaaaaaaaaaacaacaacaacagcgatagccacaaaaggtgaaagttggaccagccaccagtaaaatacaggaaacaaatcagacaacagaaaggaaatgcacgaccaaccaaacggtttttggagcctgcagaaaatatggggcaggagaggagatgggcagtgaggtggcccctgccgggatcacgtccccagactgatgggaaagggcctttgatatcacaaagaatcaacaatcaacctgtcccaacaccaacttgccaccaccagtgaaatcataactccacttgcaaggaggcatgccccaggagctttgcatacatcatattacttaatgtccacggcggtcattagcagccacctcctactgataagaaaactcagagaggttaaagtaacttgcccaagatcttacagagctaaaagtaagcctcagataggtctggccccaatgcctgctttccatggtcttttttttttttttttttttttttgatacagagtttcgctctgtcacccaggctggagtgcagtggcgcaatctcggctcactgcaacctctgcctcccaggttcaagtgattctcctgcctcagcctcctgagtagctggttttataggcgcccgccacccgcctggctaattttttgtattttcagtagagacggggtttcaccatgttggccaggctggtcttgaacccctgacctcaggtgatccacccgccttgggctcccaaagtgctgggaatacaggcatgagccaccaggcccggcctattttaaaattatttttgagacagggtctcactcggttgcccagactggagtgcagtggtgaaatcacagctcactgcaacctcaacctcctggtctcaggtgatcctcccacctcagcctctcaagtaggtgggactacaggcacacaccaccaggactgaataatttttatatattttgcagagacagtttcaccatgttgcccaggctggtctcaaactcctgggctcaagggacctgcctggctaggcctcccaaaatgctgggattacaagtgtgatccacaatgccaagcctaaaaatatcttaaatatacccattactcatcatcttcactgccatcaccccagttgaagccactatcatctcttttctggacctcagcaatagcctcctgaaccatgttactctgctgcttaaaaatcttacaatgccttatttttaaattaaattcacactctatttatttatttattgagacagagtctccctctgtcacccagactggagtgcagtggcacaatctcagctcactggaacctctgcctcctaggttcaagtgatctcctgcctcagcctcccaagtagctgggattacagttgtgcaccaccatgcccggctaatttttatatttttagtagagacggggttttgctgtgtaggtcaggctagtctcaaactcctggtctcaggtgatccacccacctcagcctcccaaagtgctgggattacaggcataagccaccgcacctggccttaaaatcaaactctttaatgtgacactgaaatccctgcatagcactctaacctgggtgacagagcaagaccctgtttcttaaaaataaagaaataaaataaaatccctggccaggcgtggtggctcatgcctgtaatcccagcactttgggaggctgaggcaggcagatcacgaggtcaagagatcaagaccagcctggccaacgtggtgaaaccctgtctctactaaaaatacaaaaattagctgggtgtggtggtgtgtgcctgtagccccagctactcgggaggctgaggcaggagaatcacttgaacctgggaggcggaggttgcagtgagttgagattacaccactgcactccagcctggcaacagagtgagactccatctcaaaaataaataaataaataaataaaaataaaaataaaatccctgcataacgtggcccctgtggacctctccaatccaacactgggtcttgttcaacagtgtatttttagaacctagaaaagagtttgtgcccaataaatatttgttgactgactaaatggagaaattggtcctccaatttggggtcctcaacatgtgcttgaacggctacaatcacccttcctcatcgcagacttgggcccttgtctcatcttgcataaaaataaatgaagctttaaacctatgaaggctacctactgcctaagggataaaagccaaactcccaaggctggccagaaaggtctttcgcaggctgatcccgatctatttatctgcctcatcttcagttacatttcccctacaaaagtgtgattctctaataataacactactaattatcttgtctcactctgtcccccacattggagtgctgtggtgcaatcctagctcactgctgcctcgaacttctaggctcaagcaatccttccgagtagctggactacaagcatgaaccaccatgctggctagttttttaattttttgtagagatagggtcttgctatgttgtctaggctggtctggaactgctggtctggaactcctggcctcgagcaatcctcccacttcagcttcccaaagcactgagatcacacccagactgtttattgatattattcatgcagctctgtttgaacttctcacctttccctggactacgccttcttatagccacactcctgtgcatatgttactctctctctctctttaataccaaggaagtagtgaaatataatggttaagggcctgggctctggagccaactgtctgggttcagtccaggctctccattcattaggaacatgatgccgagcaagttacttaacttctctcaacctcagtttctacaagtctacagtggacataataactgtgcctacctctaaggataactgtcaggtttaaattagataaccatgcccaaaagcaggtactattcacatttaggccaggacaattcttcactgtgcaggactgtaccaagcactgcaggacattaagcatcactgggtcctcccactgaatgtcttatgtctgaatgccactgaatgtcacccctttaatgcaacaactaaaaaagctcccacagccaggcgcagtggctcacgcctataatcccagcactttgggaggccgaggcgagtggatcacaaggtcaggagatcgagaccattctggctaacaaggtgaaaccccgtctctactaaaaatacaaaaaattagccaggcgtggtggcgggcgcctgtagtcccagctactcgggaggctgaggcaggagaatggtgtaaaccctggaggcagagcttgcagtgcgtcgagatcacgccactgccctccagcctgggcgacagagcgagactccatctcaaaaaaataaaattaaattaaaataaaataaaataaaataaaataaaataaaataaaataaaataaaaaataaataaaataaataaaaaagctcccacagtccaggcgcaatagctcatgcctgtaatcccagcactttgggaggccgaggcaggcagatcacctgaggttgggagctcgagaccagcctgaccatcatgtagaacccatctctactaaaaatacaaaattagccaggcatggtggcgcatgcctatacacccagctactcgggaggctgaggcaggagaattgcttgaacccgagaggcggaggttgcagtgagccgcgatcacgccattgcactccatcgcactccatcctgggcaacaagattgaaactccatctcaaaaaaaaaaaaaaaacctcccaccaatttccaaatagtccctgttcctgagggcaggaacaaggataaggggaggcaaggaaagcattgcaacccatgtttcagaatcacttagttaatacatatagagcaccaaaaagagtgtctgacatgtaccaaacctcatatatgtgctattatatcattattattattatttttgagacagagtctcactctgtcacccaggctggagtgtagtggtgggatctctgctcactgcaacttctgcctcctgggttcaagcgattctcctgcctcagcctcctgagtagctgggactacagcgcatgtcaccacacccacctctaattttgtatttttagtagagatggggtttcaccatgttgaccaggctggtctggaactcctgacctcaggtgattctctcgcctcagccttccaaaagtgctgagattacaggcatgagccactgcgcccagccaatttgctattatattattattaatgtcctttcctctttgccctacaaagttttccttcaaggtctaacacagggcaagtgctttatgattctcctaaacaagaagtaactgcaccctcctgacagttctcacaactccagattctattctgagtaaagccatccgtcattgtaatttactgtttctatcttccccaaaggcagcaagctcgagcaagataaacttttcctccccactgcccatttctggacacatgcatagtagatgctcaataattagtaaaagatgcaaggtacaataaagaataagggctgggcgcggtggctcacgcctgtaatcccagcactttaggaggcaaaggctggaggatcgcctgagctcaggagtttgagaccagcctggacaacatagtgagaccccatctctacaaaaaatcaaaaaattgtgccatctggcatggtggcacaagcctgtggtcccagttattcaggaggctggggcaggagaattcctcgagcccgagaggtgaagctgcagtgagcactgaccacaccactgcactgtagcctgggtgacaaagtgagaccctgtctcaaaaaaaaaaagaaagaaagaaaacaatctgcagtgaaatagagccccctccctaccttttcttaaacaatgggcacatctggccgggcacagtggctcatgcctgtaatcccagcactttgggaggccgaggtgggtggatcacctgaggtcaggagttcaagatcagcctggccaacatcatgaaaccccatctctactaaaaatacaaaaattagccaggggtggggcacgcacctgtaatcccagctactcaggaggtagaggcaggagaataacttgaactcagaagggggaggttgcagtgagctgagatggcgccactgcactccagccagggggaaagagcgagacttcgtctcaaaaaaaacaaaaaaacaaacaaaaatgggaacatctcttggactatccactcccagtggaagcagtctgtttggtctttccatctgagcctaggagagagacttgtgtgcagtacgtactgaatcaacacacagtgaatcaacacacggtgaataaaagtcaagttgaggagttacatgaaatggttgccagtgcatgttattttttataatttaacttatcctcaacaaatggtttaggccaggcgtggtggctcacaccagtaatcctagggctttgggaagccaagatgggaggatcacttgaggtcagaaatttgagatcaacctgggcaacatagtgcgaccttgtctctaaaaaaaaatttttttttttaattagccaggcatggtggcacatgcctatagttccagttacttgggaggctgaggcgagcggactgcttgaacccagagtttgaggctgcagtgaactatgatggtatcactgcattccagcttgggcagcagaatgaggaatgagaccctgtctcaaaaaaaaaaaaaaaaaaaaggtttaagtctccactgagaccagcctatcttcctcagctgaaataaaatccactaaaacaatgttttctagatctgtgtcattctcttatacctatactataatacgttttttccagatatatggatctgttggctattctttcatactctcaaaattcactttttttttctttttacagtttattgtttggtacaaaacaggctctttaactctttgaataaacacctcacagactcgtgctcctagattacaaaaagtcaaagccaattttctttgacactgggctcttgactctgagattcaagtcactataacagaaactggagttgttttatcttatattctggaaggtgcctcaacaaagacatgttaagaactggttaaaacttctagcatttaaaaagatccatcttgtcttccagtgcctatggataataataaaaagggaatcccagagatctgctattgaattatttagagaagagctactgcaataagatccactcttttaagttccaaaaggaaacttcaggccagatgtggtggctcacaggtataatcacagtactttgggaggccaagactggaaaacccattatgcccaggaatttgaatttgagaccagcctggcaacacagtgagatcccatctctacaattttttttttaaacagaatttgtggggcgcggtggctcgcgcctgtagtcctagcgactcgagaggcgagaggatcgcttgagtgcaggagttcgaggctgcagtgagctatgatcgagccactgtagagagaccctgtttcaaaagaaaaaacaaagagaaagaaagaaaagaaaaaggaaacttatagcccagccagaggaggaaaaacaacacccaaaattagcaagtgttcaagacagcccggcacccagctgagactcccgctgacgtgatcaggagttcggggcttgctcttttgccgagggtatttgctgtccatgcgtgccccgcccacctgagtgcctcacgcaagttcggtgacctctgcccagccgagagcaggggagggtcccgcggccagggccccgagcggctcaccctccacggcgtggttcacctcttggatgaacagctgcagcttcatcaccagggtggctgcgtggccatccgccttcccggacgccgcctccttggagccggccctgaaggccgcattgatccactccttcacgtcgaagtcgtctgccaggaacttggagaagtccatggcggaactgcctcaggcctggcgtccagaacttaagagttggctccgggcggcaacggggatgcagaagcgagcgagcctgcgagagcaccgaggctagcctccgaggcgaaccccagaaacgccaggacgggtaacttgcccctttgcgcttccccgctcagcgcactcagtttgcggctgggaatgaccctcgccgcccgccgttcttcttccggaagtcgttggccgttaccatagtgactgcaggcgtccggagcgctgagcagaggtgggtgtgggaaaacgccccggactgagagctcccggcaccgacaaatatcccatgtctgctaacatttgccgaggactaaactatatgcttactataaagccctgacatacattagcgcatttacgcggtggctcgcgcctgtaatcccagctctttaggaagctgacgcgggagaatcgcttgaggccaggagttctaggacagcctgggcaacagtggagcgcagtgggcagcaatggagtgcaattgaacgatctctgctcactacagcctcaaattcctgggcaattgaacgatctcagctcactgcagcctcaaatttctgggctccagcgatcctcccacctcagcctccagagtagctgggactacaggcgcgcgacaacacgcccggctatttctttctttttctttctttctttatttttttctgagacggagtcttgctctgtcgcccaggttggagcgaagtgacgcgatctcggctcactgcaacctccgcctcccaggttcaagcgagtgtcttgcctcagcctcccgagtagctgggattacaggcgcgtgccaccacgcccggctactttttgtattattagtagagatggggtttcaccacgctggccaggctggcctcaaactcccaacctcaggtgatccgcctgcctcggcctcccaaagtgttgggatcacaggcgtgagtcaccgcgcctggcctaactaattattttcttaatgatgtgttttgaggtgcagaccttttaaagtttgttaagttccttatcacctttttttatggatcatgcttttggtgttgcggctgagaaatctgtgcataacccataatcacaaacaatttctcagcctgggcaacataggaagaccccgtctctgcaaaaaaattaaaaattagctgagtgtggtggcgcacacctgtagtctcagctactcgagaggctggggtgagaggattgcctgagcccaggaggtcgaggctgcagtgagctgtgatcacgccactgcactccagcctgggtgacagagcgagaccctgtctcgaaaagaaaagaagaaaaggtaggggaaggtatgagggtattctttaggttctaagtttttatgttgtttcaagagtgggaccaacccaagggggaggacaagatgtcatccttggaaaccctacaggggacagttttccaggttggcctgccattggggtatgagtggctggctgccatctccaggcctgatagtcactcgtttttcattggcatctcccttggtttgtctcattcttctgggttgagtaggttttaactggggtaacccttctgctaggagtcccagttatttggggggaggggagaggagggaaggagagaggaggggagcaatgcagggaggggagacgaggggagcaatctgatagtgtaagtcctcttactttgctcttgttaaaaatttaggcaggacacagtggctcacgcctgtaatcccagcactttgggaggccgaggcaggcagatgatgaggtcaggagtttgagaccagcctgaccaacatggtcaaaccccatctctactaataataaaaaaattagctgggcatggtggcacgcgcctgtaatcccagccactcaggaggcagaggcaggagaatcgcttgaacctaggaggcagaggttgcagtgaaccgagatccgccactgcactccagcctgggcaacagaccgagactccatcccccccaaaaaaaaaaaaaatcctgctgggattttgacagggattatgttgaactgttgaattgttggattaattttaggagaattgccatcatgacaatattgactgttccaatccatagcatgaaacgcctcttcatttatttagatgggaatttttcagccttggcactactgagcccagataatttttagttatgggggctgtcctatgcattgtaagatatttcgcagcatccctggccgctacccattaggagcaacatcctctccaagttgtggcaaccaaaaatctgtccacacagtgccaagtgttccctagtaggaatcacccctggggatttagatctgatttagatcttctttaatttctctcagcaatattttgtagttttcattgtataatacaagtcttgcacttattttgttaaatttatttatttataagtatttccttttctaggtgcagtggctcatgcctgcaatcccagcactttgggaggccgaggcaggaggatcacaaggtcaggagttccatacaagactagcctgcccaacatggtgaaaccccgtctctactgaaaatacaaaaacagcctggcgtggttgtgtgcacctgtaatcccagctactcaggaggctgaggcaggagaactgcttgaacccgggaggcaaaggttgcagtgaacagagatcgggccactgttatccagcctgggtgacagagtgagactccatctcaaaaaataaataaataaaataagtatttccttttaatgctaacatgaatggaattttcttaattttcatagtttcttgttacagaaaaatgattttgtgtgtgtgtgtgtgatggagtcttgctttgtcacacaggctggagtacagcagggcaatctcagctcactgcaacctccgtctcccagattcaagcaattctcctgcctcagcctcccaagtagctgggattacaggcatgtgtcaccacacccagctaatttttgtagagacgaggttttgccatgttggccaggctggtcttgaacttctgacttcaggtgatccacctgcctcagcctcccaaagtgctgggattacaggcgtgagccaccacactcagcaacaattgatttttatagatttatcttgtaccatttgactgttaaatttgtcttctagtttgtgtgttggggtgttggttgggatttgtttacatacaggatcatgtcatctgtgaatagacactttttcctttgcaatttttttttgggggggcgggcgcggggggacggagttttgctttttttgcccaggctggagtgcaatggcgcaatctcggctcactgcaacctccgtctcccgggttcaagcgattcttctgcctcagccttccaagtaactgggattagaggtgcccaccaccacatgtggctaatttttcatatttttactaaagacggggtttcaccatgttggccaagctggtctcgaactcatgacctcaggtgatccacctgcctctgcctcccaaagtgctgggttacaggcgtgagccaccgcacccggccagaagtccctttctattcctagtttgttgagagtttttttaggatgttggattttgtatttttttttctctgcctattgagataatcatgtggttcttgtcacattctattcaaatgatatagtaattgattttaagatggcaaatgaatcttgggaccaggcacaaagtgctgtaatcctaacactttgggaggccaaggcgacggatagcttgaggtcaggagttcgcgaccagcctggcccaaatagggtgaaaccctgtctttactaaaaatacaaaaattagctgggcatgatggcacacacctgtaatcccagctactcgagaggctgaggcaggagaattgcttgaacccaggaggcggaggttgcagtaggtggagattgcgccattgcactccagcctgggcaacagagcaagactccacccaaaaaaaaaaaaaaaaaaattgtcggttttaggccaggtgcggtggctcacacctgtaatcacagcactttgggaggccgaatcacttgaggtcgggagttcgagaccagcctggccaacagggtgaaacctcgtctctactaaaaatacaaaaattagccgggcatggtggtgggtgcctgtaatcccagctacttgggaggctgaggcaggagaattgcttgaatccaggaggtggaggttgcagtgaggtgagattgcgccactgcgctgcagcctgggagacagagcaagactttgtctaaaaaaaaaaaaaaaagtctattgtatgtgatattaacatagccactccagctttcttatgattacacttgcatggctaatttttttaaatttttttttattttgtgttttttttgtagtcccagctgctagggaggctgaggcaggattgcttgagcctgggaagcggaggttggaggaagccgtgattgtaccactgcattccagccagggcaacagagcaagactccatctcaaaaataattgtccatttcatccaagttgtataatttgttggcataaaattgttcaaaggatcctcatatagtcttttctcatctgtagaattgtgacgtctgcctgttctttcctgactttggtaatttttttttcccttggtcagtctgctgaaatttgtgaattctgttgctcttttaaaagaatcagctgcaggccgggtgcggtggctcacgcctataatcccagcactttgggaggccaatacgggcagatcatctgaggtcaggagtttgagaccagcctggccaacatggtgaaaccccgtctctactaaaaacacaaaaattagccagccgtggtggttggcgcctgtaatcccagctactcaggaggctgaggcaggataattgcttgaacctgggaggcagagattgcagtgagccgaggtcaggccactgcactccagcctgggtgatagagcaagactgtgtctcaaaaaaaaaaaaaaaaaagaacctattttgactttgttaattttttttctattcaactttgactttaatttttttctatttttcattttctattattgatctctatgctaatcagtttccttctttgaatttagtttgctctttggtatattaaagtagaatcttaggttactgattttaaatactttattttctcatataggcatctaaaattactaatttttccctcatagtctaatggctaggaaaaaataaaaacaaaaaataaaattataaagcaagacactgtctctacaaaaagttaaaaaaaattatctagccatggtggtttgcaactgtagttccagctactcaaaagcctgaaaggccagagatcatttgagcccaggaatttgaggctgcagtgagctataacagtgccactgcactccagcctgggtgacagtgtgagaccgtctctaaaaaaaatttcctctgaggccggctgcggtggctcacacttgtaatcccaccactttgggaggccgaagtggttggatcacctgaggtcaggagttcacgaccagcctgaccaatatggtgaaaccctgtctctactaaaaatacaaaaactagccgggcgtggtggtgggcacgtgtagtcccagctactcaggaggctgagactggagaatcacttgaacccaggaggcggaggttgcagtgagccaagatcatgcacgccattgcactccagcctgagcaacagagcaagactctgtctcaaaaaaaaaaaaaaaaatttcctctgaagcattgctctagctgtaattcataaattttgatgttttcatttttgtttgattctaaatgtttttaaatttttcttgtgactcatttaacccatgggttatttagaagcatgttgtttaatttccaaataattgggtatttcttggatttcctgttgttgatttctaattcaattccatgtgattggaaaacatacttggtatgatttatattcttttttttttttttttgagacgaagtcccagtctgtctccaggctggagtgcagtgacacgatgttggctcactgcaacctccacctcccaggttcaagcgattctcctgcctcagccacccaagtagctgggactacaggcacctgccaccacacctggctttttttttttttgagacagagccttgctctgtggcccaggctggagtgcagtggcacaatatccactcactgcaagctccgcctcccgggttcacgccattctcctgcctcagcctcccgagtagctgagactacaggcacccgccaccacacccggctaatttttgtatttttagtagagacggggtttcaccgtgttagccaggatggtctcgatctcctgaccgcgtgatctgcctgccttggcctcccgaagtgctgggattacaggcgtgagccaccgcgcccagcctacccagctaatttttgaatttttggtagagacaggatttcaccatgttggccaggatggtctccatctcttgactttgtgatccagccgccttggcctccaaaagtgctgggattacaggcgtgagccaccgcacccggctggtttatattcttttattatttatagagatggcatcttgctttgctgttaaggttggtttcaaaatcccctgcagattcaagcaatcccctgtctcagcctcccaaagtgctgggattgcaggcctgagccaccgtgcccagcccttaaattcttttaaatttattgagacttgttttatggcctagcattggtctatcctgaagactgttccatgtgcacttgaaaatatatatctgcagttattgggtggagtgtcatatatattttagctacattaatagtgttgttcaactattttatatacttgctgattttctatgtagttgttctgtcattactgaaggtaaggtatttagatctccaattattattattttgagacagagttttgctctgtcgcccaggctggagtgcagtggtgcgatctcagctcactgcaaccttgcctcccgcgttcaagcgattcttctgcctcagcctcctgagtagctgggagtataggcatgtgccactatgcctggctaatttttgtattttttagtagagacggtgtttcaccatgttggtcaggctggtctcgaactcctgacctcgtgatccacccgccttggcctcccaaagtactgggattacatgtgtgagccactgcactcggccctattatttatttatttattttttttggagatggagtttgctcttgttggcagggctggagtgcaatggtgtgatcttggctcaccactacccccgcctcccaggttcaagtgattctcccgcctcagcctcccaagtagctgggattacaggcatgcaccaccacactcggctaattttgtatttttagtagagacagggtttctcaatgttggtcaggctggtcacaaactcctaacctcacgtgatccatccacctcagcctcccaaagtgctgggattacaggcatgagccaccatacctggcctccagttattattgaatcatccatttttacatttgattctatttaatttttgcattaggtattttggggctttgatgtgaggtgcatatacattttataattttatgtcttcctggtatattcaccttttatcattattaaatgttcttttctgtctctagtaatatttctgtcttaaagtctatttttatgccaggtgcggtggctcacacctgtaatcccagccctctgggaggccgaatcacttgaggtcaggagttcaagaccagtctggccaacatggtgaaaccgtctctactaaaaatacgaaaattagccaggcatggtggtgggcgcctgtaatcccagctactcgggaggctgaggcaggagaatcgcttgaatccaggaggtggaggttgcagtgaggtgagatcacaccactgcactgcagcctgggagacagaacaagactgtctcaaaaaaaagaaaaaaaagtattttgtgtgatattaacacagccactccagctttcttattactacttgcatggctaattttttatcctttacttccaactgatttgtgaacctaagtgtaccttttgcagacagcatagagttggaatttggtggtggtggtgttttcaatccagtatgacagtttccgcctttttggagacagggtctggctctgccacccaggctggagtgcagtggtgtgatcttgtctcaccactgcctcctctgcaacctctgcctcctgggctcaagccaacctcccacctcagcctcccaagtagctgagactacaggcacatgccaccattcccaggtaatttttttgtagagacaggggtctcactgtgttgcccagggtggtctcaaactcctgggctcaagcaatcctcccatctcagcttcccaaagtgctgggattacaggctcgagccaccacacagtttcctcacagccttttgagttaaggcaggtagtatttctatttccaaaagaggaaactaaagctgagatgaggccatgctgtagagaaacttgaatgctagggcaattgattttatttaatccaaaaagatatgcagtactaattaaatatgattagagatgcagtagggtcaggctaggcatggtggctcatgcctgtaatcccagcactttgggaggccaggagtccaagactagcctgggcaacacggtgaggccctcatctctacaaaaatctaaaacttagtcaggtgtggcagcacgcatctgtaatcctagctacttgggaggccaaattgggaggatccctagagcccaggagtttgaggctgcagtgagctatgaccatgccactgcactccagcatgtctcttaaaaaaaaagaaaaaaaatggtctgtaaagaaggcacaaggagaacaccacgtgacaatgaaggcaaaggctggagttatgcagctacaggctaaggaagtcaaagatggtggaagccagcaaccaccaagagggagggagcaccatggctccaatattagactcccaccccacagaactcagacaacacatctgttgacttaaaccacccagcttgcggcacgttgtcatagcagttctaaggaactaatacagagaaaaataaacatttcgactgttactttgggtttgtttattgcagctgatcctgatcttaacaaagggtatggtcagattttttttttttttttgagacggagtcttgctgtgttgcccaggctggagtgcagtggcacgatctcggctcactgcaaactccaccttctgggttcgagcgatttccagctaatttttgtacttttagtacatggccaggctggtcttgaactcctaatctcatgatccttcgccctggcctcccaaactgctaggattacaggtgtgagccaccacgcccagctggtatggtcagattttattaaaagtatcaaccttttctgctgcctataaaaatattcataagttatcagtattcttagaacaatttctgtggttttatgagagcaggagaggctgtgaaatgaacagtgatgaaatggaagtcaccactgttacaacagttaagaaaatctcagatgtgaaggtgatttgagaaatagcacctaaatttatagaatatcctatctgctattttgtacacctcatgacattctcaccaaaatgtgtgaagtagacttctaacatttttaccatttacggatataaaaactgaggcccagagaccactgacttgcccaacatgctacatagatggtaaaaaactagaaattaaacctgactccccagcccacacttggttcactctagcgcacctaaatttatagaatatcctatctgctattttgtacacctcatgacattctcaccaaaatgtgtgaagtagacttctaacatttttaccatttacggatataaaaactgaggcccagagaccactgacttgcccaacatgctacatagatggtaaaaaactagaaattaaacctgactccccagcccacacttggttcactctagcgcacagggctgccagaattgaggcgagagggttgccagggaaaagtccggcctgcttggctgcctgggaatggtgccagcgggagggagaggatacaaggaaactatgagggaactgctaccccagagttttaacatgcagcactttcaacacataagtgcttgatttgtaccatatgagctcagggaagagagcggggttatgtttctaagtaattcatattgataatggcattttctccaagctatctatggtgttacatgaaaagaacaaaacacagaacagtatactatattttcttgaacatgcctagaatccctctgaaaagacagaggatggtaactgggtgggaagaattttcacctttcataattttgaatcatgtcaatgtctttatcttaaaaaagacgacactgagcataaaaaaataaggttttattttcagctgattttagaaagctcagaaaaaatttaaagaaaatttatctataattccctgacccaaagattaccactgtcagatgtgcacacaaacatcttggtgcatcgcttggctttaaaacaaactggggtcaggacatggtggctcatgcctgtaatcccagcactttgggaggtcaaggcaggaggactgcttgagcccaggagaccagcctgggtaacacagagatccagtctttacgaaaaactgcaacattagctgggcgtggcagcatgcacctgtagtcccagctactccagaggctgaagccggaggatcgcctgaacacaggaattcaaggctgcattgagctacaatcacgccactgcactccagcctgggcaacagagcaaagccctgtctcaagaaaacaaacaaacccacttttatactcttgacgctgggtaagcatcttctataatgggtatatttaaaggatttgggattaatattgtagtaggcaagcactatttgtattctagaatattgcccttgctttctagctttaacattttctgtctcaatttacactatttgtactaggtaatattcacttttcttttggttgtcatttattgttttcaacactatcttcatgacctgtttgtgttcagagtggctcacagataaggaaacatttttgcccagtcttaagttcatggaagataataggaagagtaattaactgcagcaaaaggttaggacaaaacatggcattatcagggcttgaaaggactttattgtggctgtggtgaagcaggccctggtcttggcagatgataccagaagggcactgagtgccagcgtgcaacttgaatttgatcccataaagtcaggcatcaggaagccattcagaatttttcaccctgtcagatgctcagatttgctagagaactctggtagtggcaagaaccagagctgttactcagaattgggacagaggcattgtcccaaaaaaaaaaaagcccaaatcagagcagtggcaatgtaagtgcagggaggacatgatgtgggattatttagaaaacaggccaaatgacatgcaactactctgcggatacagacgaagcaggaatcagggacccaataagtctcaggtgctttcaagtaagagcatgtaggtggaaaggggcaggactctgggttccattctaagtaactgagactgaagcaacagtggaacctccagatacagataacccctgacagactgaaatacgatctggcgacagcaaggaggtggcagcttgagagaggtctacaacccacctaatggtttagagccacctgactaccaggcctgtgtgtggacgggaaagtcctgaggattggactctggaaaaccatcacacttaagagacagaggaaaaagagcagtcacggaggtaggtcacgaaatgggtcaacaggacccccgaagagttcaagatactggaaagcactggccatgagtgccagatctccagcacacacatcatgaatttgcttctccccagaggaaaagaagctccttcagggtggtgcctggctcagggtagctggtcaacaactagcttttaaaaaaacagagacacggtctcactatgtagcccaggctggacttgaaatcctgggctcaagcggtcatcccactcagcctcccaaaatgctgggattataggcgtgagccactgtgcacagccaataactacttgttaagtgaatgaagaggtaggagctgggctctaagtggccactggacttgctgattagaagggagtgatgccataaaccacagccactttcaggacagcagcctgcctcctctcctcctacccctatcctgtccaacacctaagcatagtagtaccactgggagtctgtctcctcaaaagcaagaatgttcaggtacacatgtgtgagttcacctcctaactataggggagaaagcctgtctttatgtataagtctcattcacccattttgaccaaaacccttcagagggagatgctgtcattatgatgggtacctcttcaagactacgcaacagtaacagagcctataaaagctacacagaggccgggtgcggtggctcacgcctgtaatcccagcactctgggaggccaaggcaggcggatcacctgaggtcaggagttcgagaccagcctggccaacatggtgaaatcctgtctctactaaaaatacaaaaattagctgggcgtgctggctcacgcctgtagtcccagctactcgagaggctgaggcacgagaatcgcttgaacctggtaggcagagattgcagtgagctgagattataccaccgcactccagcctgagtgacagagtgagatatggcctcaaaaaacaaaaaaaagccacacagaatacaagcaagaaagtacttttagattaaaattcgtcttatgtgaattatggcaaatgaaatcaccccactgtttacctgttttatgagtttttacatttgcttaaaattagcatacttgatcttttacagttcccatctccaccaattagtattggcagatttccactatatgtagaagtcaaaagatcagactgtaaaaatatcagatattgtaattaagagctccaaacaagtcttgcagtttcaaaggtagaaacccacccagccagttcagctgcttggacttcaaagccctccgcctagccatctcagccaggctcaggttccttctcccacccatcaggccaagcaggacttgtcaaacatacacattcaagttcctagcacacagtaggtgctaagtgggaattgattataaacttgaattcttccatcaacaaatatccacctctcctgtccagcttgcctcagatcttcaggttctctcttctctgaggcagctaagcttctacatccttcatgaagtttcctttacttctcgacagaagacagttccctttaggcctatcatctctaaatgcaactggctttccattttccacttactcaacactccacaaagtacacttgctacatggtatttattcaatgactgtatatttagtcaccacctcaatcactgctaagctctcttcatgtctatctgtaccacagtttcccatcttagactgtgacgtcagctggcaagggctggctgttggccgattcatcatgactgacatggtgtgtcacaaagagctccaagtaaatgctgtgaaggaagaggatgaggatggagatgaggatcctgagaagggcccagactggctgcccaacccatggacctgaggcctgagtaaggcctgggagctgctttcccctctgcccaggaactctgtccaggggcgattctaaggcacagtggtgaaggacatgattggtcccccaagtgtggtcctcaggtctcatggcagccactcgcctgggaacagtgcaacaagcattccatttagaagatcttccagaacacacacaagaagcattgtctaatgaaaatggagacaaggtctttcttggaagagagtgcccaagtagatactctctgccccaagactaaccaggtcccttttaaggtccctgagaacagcagcctgggagcaaccaagcctttcaaaggctgacaaggcacagagtggatgaatggaacgaacgatacatgaaaaaaacactttggctgataaaacctccaacctgaggcagggacagtgtcgctcgctgacatgcagaaacatgactgtagcagagatgatgatgatgagaaatgcttcgcatttcccacactgccgatatcccaagccctgtgctaccaccctctccccgaacacacacacacacacacacacacacacacacacacacacacacacagagcatctgcagaataagtcagaggttgacacccagagcctgacgtcaggataggactcttggcactccgcactgaaacaccgtgattagtcctgactagacagcaaaagtaacgccagcctaagcttgaaatgaagggtccatcttgtgaaaagttaggctgcgcccaagacagccaggtctgggaagtctttcacttctcctacttcgctgaaaggctgtccaccttggttgaatgtcagcttgtaccgtaagcggataggttcctgggacagaagagacagaagatgtcaaatcagtggagagcaacccaggaacaggggtcaatgttaagtcaagtgagtgtttcaaacaattctgacacaaaatacctgggatactctctttgggactacaaacaaggggaaacaggcacatatcctgggaacccttcgataattctgcagtcctgaaatcctgagatgggctgcaattcagagaccagctaaggaagacagaccttgtcctttcagaggactccagaggattagggagagttcatgtgtccctcccttggtccccagctatgacaatccatctgatcttccttcagtgagccccaaagacagactccagcgagggatattccacatatacccctaacacccaaccaaaccagagactgactttcttttctttttctcttctccttccttcctttcctccttccctccctctctctctctttcatctatctgtctgtctgtctatctatctatctatttgatagagtctcgctctgtcaccaggctggagtgcagtggtgcgatcttggctcactgcaacctccgcctcttgggttcaagcaattctcctgcctcactctcccgagtagctgagactacaggcgcacgccaccatgcccagctaatttttgtatttttagtagagatggggtttcaccatgttggccaggatggtctcgatcgcttgatctcgtgatccatctgcctcagcctcccaaagtgctgggattacaggcgtgagccactgcacctggccgactttatttttttttgagatggagtcttgctctgttgcccaggctggagtgcagtagtgcgatctcggctcactgcaacctccacctcctgggttcaagcaattctcctgcctcagcctcctgagcagctaggactaaaggtgcgtgcccccacaaccagctaatttttgtatttttagtagagatggggtttcaccatgttggccaggctggtctcaaactcctgacctcaggtggtccacctgcctcagcctcccaaagtgctgggattacaggggtgaaccactgtgcccagcaaaccagagactttagagcaaggcctcaatgtgcctctctctacccacaaagttacctccccttacagttcaggggcccccatctccctgctaccacagacactggaacatactttgtgtggattgtcaagcagcagcatctgagatatcacagctggaggcatcaaaggactgaatgcaggaagcttggagctggatgccggctgcagcttcactctcattgactatcaggggaagaaaaccaacatgtaactcattcctaaccacagcttctaggatggagatcaggtgagggggagctggacctccccaacacccctccaagaggaaatggccctcttaaacgtggtaccccgaggcacctatgggagcccaagcagacagactcccactaattgataaaaggatctaagaggcctttccttccacacacagaatggatcgggagttgtgtggtcaataaccggcatctgagacgcagcatcaacagccagggcacatcttgggttgaattctaactgcttctcactagctctgtgaccttgagtaaaatatttaatttctgagccttgggttaacttataaaacagaggtagtagcagaacattgcccataggactaccgtaagaagtagagactgcaggtcatatttttgtctgtctcgaatcttttcctttcaggacaggccccttcccctgtgactgtggggtgcctgttaatcagtagggccccacttcccttgaaaagggatggatgttatctcacattggccaagtgtctcatatcccaggatacaagttcctggtccaaggtatggaagtaacaccaacaagcccaatcagagccctttcctgggtaatcaatatatgtgcttcatgcccggtgagagtttctgagataaagagggttaaggaccatgcaaccctggagctgtgggtagccactttcctgtttgtggagaaactgtcagaatggtgccaaagaaaagcagagtcaagagatacagattcttaaggcattgtttaagaacctatttggattcactcatatctgaagtcagatattcaggaatccccagtcaggtaagccattacattcccactttatcttcagttagtttgagtgaagattctttccttgacactcgacaggtaagtcccagaaaagaacctggcactcaaaaacgacagccattactgagaaatccccaacagatgactcacctttggcacagccacttgaaacatgatatcccagacaggctggggagccgtgctcatcatggtcaagagcagcacctgtacctctgggtgcccaggggctcccgtctgggagaagtggagcagaattctgaatccattccggtcatacacaatgagaggcggcaggctgcctggtataaagggcacaagcagaaggtttaacaccactacaaaccccccggacagccaggctggaaagagatgtacatgttatccccagatgctgttgcttctccatgcagaacatgtccaggactgaattcctctgcactaccataatccaagtcctcatgactctagctggactcctatgaccctccaaactgacctttccccaccatccaaccatcatacacacaccaccagttattaaaaatcacatttttgaggaagatacgatcattattaaaataatgcatgaacactatagaaaatagagaattatcagccaggcgtgggggctcacgcctgtaatcccagcactttaggaggccaaggcgggtggatcacttgaggttaagagttcaagaccagcctggacaacatggcaaaaccccatctctactaaaaatacaaaaattagctgggcatggtggtacacacctgtaatcccagccatttgagaggctgaggcacgaaaatcacttgaactcgggaggcggaggttgcaatgaactgcactccagcctaagtgacagagcgagactctgtctcaaacaaacaaacaaacaaaaaacaaaaagccacacacacacaaaaacaggattatcattaaaaaatgaaataaatgcttttttttttttttttttttttggacagactttcgcttttgttgcccaggctggaatgcaatggcatgatcttggctcaccgcaacctctgcctcccggattcaaacgattctcccacctcagcctccctagtagctgggattacaggcatgcaccaccacgcctggctaatttttgtgtttttagtagagatgggatttctccatgttggtcaggctgggggaggtcaggcctcaaactcccgacctcaggtgatccgcccaccttgacctcccaaagtgctgggattacaggcgtgagccactgcacccggccaatgcattcttaattctacccagaaataagcacttacttccttctggtctcttttatatgagtacaaacacacacatatgctcacacacacacaatataccaccttatatttaattgtacaaaactgtagataccaaatcacctcaaattaataagtttaataacattccaatggaaattctaaagagacttttaatttagctaaggagtgactctaatgtttatttgaggggggaaaactatgtaagactgaccaataaatttaaaaaggggggcagggctatagcaaatactcagataaaattacaattcaagtaaagtgacataaacaaaacgtgtggaacagatctaaatgagactgtaacataacatatccttcaaaaatcagggctggctcaatgaatggcactcagactggttaatcagctaaaaaaaaaaccttaatatcaaaatatacattactaaaatatagcttagagctgggtatggtgtctcatgcctgtaatcccagctactcaggaggctgaaatgggaaaactgcttgaggtcaggagttcaaaaccagcctgggcaatacagtgagatctgcctcccaccctcaaaaagacaataaaaatttgctgggtgtggtggtgcatgcctgtcattctagctacctgggggtctgaggcaggaggattgcttgagcccaagaagaatatgaggctgcagtgagctatgactgtgccaccgcactcctgcctaggcgatggagcgaggccccatctctaaaaaaatttaaaaaaaaattaaaacatagtttaacaatgaaactaccaaagatttaagagactgaaaataccagtggggtatggtggcaagagtatggggaaaaaaagcaaccttttcagacgggaaattggtaatgcagatcaaaattttaaatgtctacatgtggcatttcactggtattatgatctcctcataatcaggaaggtataaagaaaggcatccaaagatgttctttgtagccctggcatccaaagatgttctttgtagccctggttttttttttttttttttttttttttttagacacagtctcactgtgtcacccaggctggagtgcagtggcgcaatctcagctcactgcaacctccgcctcccaggttcaagcgattctcttgcctcagcctcccaagtagctgggactacaggcgcccaccaccacgcctggctaattttttttgtagtttttagtagagacagggtttcaccatgttggccaggttggtctcaaactcctgacctcaggtgctccacccaccttggcctcccaacgtgctgggattacaggcatgagccaccacacccagcctgtagccctgtttttaacagcaaacaggtagaaagaaattgaccttcagagaaggacttaataagctggacatagtggcgcatgcctgtagtcccagctacttgggaggccaaggtgggaggatggcttgagcctggaggatggaggttgtagtaagctgagatggcgccactgcactccagcctgggtgatagggccagaccttgtctcaaaaataaaataaaataaaataatttaaaaaaaaagactgaatagggccgggcgcagtggctcacgcctgtaatcccagcactttgggaggccgaggtgggcagatcacgaggtcaagagatcgagaccatcctggctaacacggtgaaaccctgtctctactaaaaatacaaaaaagtagctgggcgtggttgtgggcacctgtgtcccagctactcgggaggctgaggcaagagaatggtgtgaatccaggaggtgaagcttgcagtgagccgagatcatgctgctacactccagcctgggtgacagcgagactctgtctccaaaaaaaaaaaaaaaaagactgaataaacagattacagtacctctacttaatagtgcatatatatataagttcattaaaaatcaagtttttaaagaacaactaagggcataaaaatggtataggcttataaagtaacagtaaatagagtataaaacattctatacacactgtggtatcaaattattaagaactgtatgtacatatatatgtatatgataagacaagaaaatctatcaagacatgaagagaatttccatctctggctgttaatggtatagatgattttacttttctagtcttttttttttttttttttttttttttagacagagtcttctctgttgctcagactgaagcgcagtggcacgatctcagctcactgcaacttctgccatctgggttcaggtgattctccaggctcaggctcctgagtagctgggattacaggtgtacattaccacacccagctaatttttatatttttagggtttcaccatgttggccaggctggtctcgaactcctgacctcaagtgatctgcccaccttggcctcccaaagtgctgggattacaggcatgagccactgcgtctggcctattctatctttaataaaactctacattttgaacatgtatttttgtttttaacttttttattttttaaagtttgttttgtaataatttcagacttataaaaagttataaaactaatacaaaaatttctatatacccttcatgtagcttccccagatgttaacatcgtaactacaatacagttattgaattcagaaaattaacattgaacatgtattatttcttaaatcaaaaatcaataaagaaatgtgcaaagagctcccattgtttatcaactctgtttatttataaatttgtctgcctggctttcagggctctctgcaatctaacctcaccacaaagagccataggagggctctgtgctaaagagtccaggccctggaacagacgacctgagttgtgtcctgctctgcatactggtgtagagacggtaggcaccttaattagccgagccttccatttccttcccttttaacagagataatatccacttttctgccttaaggaggatccctagagaaggaggatcactagccaaattcatccactcgtttgaattctacctcttgccagtcatttcaggccacattaaacattcccttcttgaatcccaacccaaatcaacgaacattatgtgcctaagtaagccttttaattaaattctgcctgcccatatccttgacagtgtcaatactaaggaaggctaagaaatcagctaaaagacaaagaagcaaactttttttttttttggagacggagtctcactttgtcacccaggctagagtgtggtggcatgatcttggctcactgcaacctccacctcctggattcaagcagttctcctgcctcagcctcccaagtagctgggattacaggcatgcaccaccatgtccagctaatgtttgtattttttgtagagagagggcttcgttatgttggccaggctggtctggaactcctggcctcaagtgatcacctgccttggcctcccaatttttttcttcccccccaaatagagacaaggctatgtcgcccaggctggtctcaaactcctggcctcaagtgatcctcccacctcagcctcccaaagtgctgggattacaggcgtgagtcaccatacctggccacaacctcttactttctgccctcatgcaaaatctctcccatttatcaaccaaatttaagggccacctctatcaaactggagtggaaaaagctgggagtctaatagattcccagggaaaaaaaaaaaaaggtggggagtgaaattgtacttactgggcttaacagactccaaagggacaaacacttgagccagaggtgtattctgtgaagatggggaaggagccaacgggccagcctcccaggaccaacctggagaggacttagtacctggtggcacttccttggggacacttttctgcgaaacataattcctacaaagaaataaaaaatatcaaagactagcaaaaattgtagcgatttcctggaatctgggttaggcttattaaagaacaaggaaaaaataacacacacacacacacagagttagatgttatatgccttttttttttttttttttgatacagtatctcgctctgttgcccaggctggagtgcaatcgaacagtctcggctcactgcaacctctgcctcccaggctcaagcgattctcctgactcagcctcccgagtagctgggattacaggcacctgccaccatgtccgactaatttttgtatttttattagagacagggtttcaccacgttggccgcgctggtctcaaactcttgacctcaggtgatccgtccgcctcggcctcccaaagtgctgggattacaggcgtgagctaatgcgccagatgttatatgacttttgtcaagtaatcgaactcatacctcagcttcctcatctgttaaatgggaataacagaagtaatttacctcctagggctactgtaagaatcaaatgagacgatgtatgaaaagcacttagaggctgggcacggtggctcacgcctgtaatcccagcattttgggaggccgaggcaggtggatcatttgaggtcaggagttcaagaccagcccggccgacatggtgaaaccccatctctactaaaaatacaaaaattaaaaaaaaataaaaaataaaaaattagccaggtggtggtggcacacgcttgtaataccagctactcaggaggctgaggcaggagaatggctagagcctgggaggcggaggttgtggtgagccgagatcacactactgcactccagcctgggcaacagagtgagactccatctcaggaaaaaaaaaagaaaaaaacaaaagcacttaaaatgtccacacataataagaacccaataacctagagcctttgttatgaaggttgttcatgttgtacctgtcgggcagtccctgacaataagtagctcagtcaggttgtttcccaggtgtgatcacaaagggacttgagccaggcagatgatacacaaattataccagctactatccactccatgattttgttcatttgggacacaaactgaaaacattttagaaaactaaagtcctgagaggagaaataacccaccctgcccgagtggctgaaaaaaagaagactgcaagaaatgacctctgggtggcaaatgggaatgaactcccaggacatcccacttctgcctgagcctggtggtttctatcaggaacatgggcactttcaggctgtttgggtgaaggtaagctgcacttttccagaggcaaagggacaggatctatgaaaatgttgttacattcacaccttagagaacctctcccttcagggatctatactataaggcactcccccaagcacctccaaaccagaaattatgtaaatgtccaaaaaagggaaatgatcaaatacatccatgcaataaattgtaatgtagctattaagactgaggcatatttatagaaactgatatgaaatgcatcacagatataatatgaaaaggtcatgctggagtgcggtttataaattaaaatcctgtttgtgtaacaagacacaggaatgtaccactacatgtatacaaaaaaagcaaaaaaggaacgttcaaccttgtttttagggagtggcactttgcactttgttgtatgtttctccatggatcaaattttgcttaacttcaattatatggttattagaagggaaaacaaaaacaaacggcaaaaacctcatgttctactactcctagtccttaaataaacctcttttcagatgtcttggccaaagcaggtattttcctacgacttaggaaaagaagtaaaatgagaaaagggaagcagcacattaaactttttttgagacagggtctcactctgctgcccaggctggaatgcagtggcatagtaatggctcactgcagcctcgactttccgggctcaagtgatccttctacctcagcctcctgagcagctgggactacagtcatgacctaccacgcctggctaattttagtattttttgtagagatggggttttgccatatctcccaggctggtcttgaactccagggctcaagcgatccacctgccttggcctcccaaagttctgggattacaggtatgatatggtttggctgtgtccccacccaaatctcatcttgaattgtagcacccacaattcccacatgttgtagcagggacccagtaagagataactgaatcatgggtgcagtttccccatactgttctcacggtagtaagtctcatgagacctgatggttttataaggggaaaccctttttcgtttggctctcattctctcgtctgctgccacataagacacgccttttggctgagtgtggtggctcatgcctgtaatcccagcactttgggaggctgaggcagacggatcatgaggtcaagagatcgagacaatcctggctaacacagtgaaaccccatctctactaaaaaaaaatacaaaaaattaaccgggtgtggtggcacacgcctgtaatcccagctactcaggaggctgaggcaaaagaatcgcttgaacctgggaggcagaggttgcagtgagctgagatcgcgccactgcactccacccagggcgacagagcgagactccatctcaaaaacaaacaaacaaacaaaaacacatgccttttgccttccgccatgactgggaggcctccccagccacatggaactatgagtccattaaacctctttttgtttttaaattacacagtcttgggtatgtctttatcagcagtgtgaaaacaagtacaaggcatgagccactgcacctggcctaaactttcaatagaaagatgtttcttggccaggcagacggatcacctgaggtcaggagtttgagaccagcctggccaacatggtgaaaccccgtctctactaaaaattaaaaaaaaaaaattagctgggcatggtggcgcgtgcctgtaatcccagctacttgggaggctgaggcaggagaatcgcttgaactcaggaggtaaaggctgtagtgagccgagattgtgccactgcactctagcctgggcaacagagtgagaccccgtctcaaaaaaaaaaaaaaaagaaaaaaagacaaaaaaaaaaaaaagaaagaaagaaagatgtttctccagggcgagaggctgtcttagagcaccattctctggcccttgtcccatgagaaggaaccgcactcaggagccacactctcccactccccttgcccagaagactcacagagggcacggagctggctgtgctgagaggaggtccagcaaattcctgtctgcagaagggttctgaacaccaccgcctggcagcgtgctggaggagggattcctcttttcctcacagcaattctgaccagaaacctgtcaaatcaggaatggctaaaataagaccagggtatgaatgaccatcagccacagtaaaaccaaggcacagctctcctgagcccacccaagctgctgtggcccagactggtgacatctcttggggcaagaggggaaagaaagggcaagatcacatgcagctcctgggcagacctccaggaagcaggagcctggtgcaacctgtctcccccaggtatcagccagacagtatgggtgaggaagaggctttggacctccaaggccatgatcccaccgggacagtgcaggagcacctctctgctcgccaggcagtgctgcctcacaagggcaggtctgagaccctcccattctctctccgggccctgggaagggcatccttaccatgcctgtaacaggagcatcactgattcctgtaagaaaggagtagagtgagatgcctaacagtaactccacctgcttccagatgaagagtaatgccacacccatcctttctaggacatccagaaagtctagacaaataagcaacttactgaaggtcatgtgactcgtccatggccaatctgtgactaatatgcaagggggaccctctgaactgcccagaacacctgattcccttggcagcaggtatgtgctccccaagggaaccagctcactctcctactcacaaccaccctgattgcctcagcagcaggtatgtgcttcctgaggggaccagctcactcccctactcaaaaccaccctgattccctcagcagcaggcatgtgcttcctgaggagaccagctcactcccctactcagaaccctgctgattctctcagcagcaggcacttgctcccagagggaaccagctcactcccctactcacacccatcccgattccctcagcagcaggcatgtgctccctgagggtccagctcactctcctactcacaaccaccctgattccctcagcagcaggtatgtgctccctcagcagcagacacgtgttctccgagggtccagctcactcccctactcacactctccctgacttgctcagcagcagacacgtgcttcccaaggggaccagctcactcccctactcacacccatcctgactccctcagcagcaagcacgtgctcccagagggaaccagctcactcttcctattcacaaccatctcgactccctcagcagcaggcatgtgctccgcgaagggaaccagctcactcccctactcgcacccatcctgtgcctgctccccacaagcacctgccctcacccaaggctgccaggtcctgatgaagcaaagatggcaccacagtccccatctgcgcaggtccattgtccacctccaagtcaatcagggggcaggtcttcatgcagcctgctggattctgaaagactagaaagcccagggttaggaagagaagtcagttggacatgagagcaaagtctccacataaatcctatcagcttccctcagaccacctcctaatcaaatggtaacgccctccctgcccttccaagaaccttccactcagctgagtgtcctgacacacaagctcagctggcatccaagacaagagggagccaaggcctgccttcctaccccagggatcataggccctcctgcaaagatcccatcactctggaggaaagcagattcggccttctccagctcaggccattctgaggcttctgaccacagctgattagaatcacccacagtgcttgaaagacgcacacctccaggcccagctccaagcagtcttgattcagaaggtccaagccagggaccgcatttcaaccagtgctccaggtgattctgatacagctgacctggcactaggaaccactaaggaagatcatttcttttgtctctagctcctgtatgcaagcatttatgagaattcaaacgcaggcacagcttagccatctgcttttgtgtgtagtcaaagctggggtccagcccggcaaccagctcatgacaattcctatggctgggtgtggcaacatatccactttcacaggaaggggaacaaagggcgagttctctcatttctattccttaacccagaatatgtttaggacccatttcttttctgggaattacaggctgccccaaggcagagaaggcaaggagaagctttcaaacatacctctggagacagggatgtctcccaatgagctggtcactctgtttccaaaggtgacccggccctccatcacctgtttgtacagcagaactccttgggtgaggaggtcatttgcctggagaatttccgctgaagaatgagggaagactcagaaccccctggtttggcaaccaacaatctcagtcttttctaagcttttccataaaacagccttcatatggctagactatgttcagtttatccacacctcctgcctccaggttgtgtcatcggaccctatcaggcctagtcagttaacctgagtcctaacatgttagtagttctcaatgcagaaggaagcaaatctgttcaccttctacacctgtactgtccagagtaatggccagcagtaagcactcaaattaaggccctttcaataacaaacttttaactttaactcagaatctgaagctgctggctctgtgcagtggctcatgcctataatcccagcattttgggaggccgaggcgggtggatcacctgaggtcaggagttcgagactatcctggtcaaaatggtgaaacccagtttctactaaaaatacaaaaaatcagccgtggcaggtgcctgtaatcccagctattcgggaggctgaggtgggagaattgcttaaacccaggagacggaggttgcagcgagctgagatcgcaccattgcactccagccggggcagcaagagcgaaactccatctcaagaaaaaaagaaatatcagaaacagaacatgagcagcatcatgggggatgccacgagcaaaactgagaccgagagaactgtcaattcagagggcctattttcatgcaaggaaaaaaggctgtgtgtggtggttcacgcctgtaatcccagcactttgggaagccaaggcgggcaaatcacttgagcccaggagtttgagaccagcctggccaacatggcaaaactccatctctactaaaagtacaaaaattagccaggtgtggtggtgcgcaactgtagtcccagctactcaggaggctgaggcatgagaatcgcttgaacacaggatgtaaaggctgtagaggctacagtgagctgagcacgccactggactccagcctgagcaacagagtgagactgtctcaaaaaaaaggaaaaaggattgcagagggcatgcacatgctatccactaagagagacagaagaaatataaaccaattatatggcttttcttttatgtctgatttagaacaattttttttttttaagttagcaagagatgattaaggagaaattttatcagggcaatctgaacactgactgaatctttgattattctgaaatgtccagaggccggggatcgtggctcacgcctgtaatcccagcactttgggaagccgaggcagacggatcactagaggccagaagtttgaaaccagcctggccaaaatggtgaaatgtcatcttacaaaaatacaaaattagccaggcgtgatggtgggtgcctataatcccagctacttgggaggctgaggaaggagaatggcttgaaccagggaggtagaggttgcagtgagccaagactgcacaactgcactctaacctggacgacagagcgagactccatctccaaaataattaaaagaaaaagaaatgtctagaatttgcttcaaaacagactagggaatgggtgtgtacaaagagaggtacagatgaagtaagattaaaaaaatcagctatgagctggtaattattaaagatgagtgaagaatatataggttttactattcccctctctcatgtttcgagattttccacaataaagagttaaaattcttttttagtaactgtggacaattctccacttccttacagatgtaccttccatttcccatcggcctggccctcttagttgacctacctggcccctgaaggtacaaaagcccgtgatccccttgagacaccacccacagctgtttctctggcccctgcgattggtcagcttttcctgaagcctccagtgggatctttcttctacctctcacaccccaatctccatggtcaatttccacttcttttcaggctttagacctgctgctgatttcttactgaagcctggatcctgctggaagtcagttctgaggcaactcaggccacaccctccccaagcccaagctccacggaaccgaaagtccactctgtcttgttcctggcacagcagtgtgacaggagggaccgagtctgtcttgcacctgggctgctagctacacccaaggaaagaaaacttaccgagtgcatcatcgtcatcagtggtgtcactcgccaaccggaacagcgtgggccgcagcttttcacacctctcatacacgacctgaaagagcagagcttggttcatgacacacgcccaggcaccccataacgcccccctccagggccccaggagccttcgatcaggcagacggcagagtctggggcttcagaaggcctcccaatggtcctgacttagagactgcagttttgaagtaacatgacagagtttcagaaaaagactacaggctacaagtgtatgatttctgaaaataaaataatctgaccgggcagggtggctcacgtctgtaatcccagcactttaggagaccaaggtgggctgatcacctgaagtcaggagttcaagaccagcctggccaacatggtgaaaccctgtctctactaaaaatacaaaagttagtgggtgcctgtaatcccagctactcgggaggctttctcttaggaatttggaaagacagtagttcatttctactaatcttgtgaagtggaaggacaggtaaataaagaagttacgtggaggctggctctcctcctgtgcagagagacataaaaaactggaatgcagagggagatggctgaaacagacctgcagaaggaggtggagaacagagttccaagggagaccaacagcatggctgcctcgaacctggcacagacaggctgtggtttctttttgattgtttgtttttttggtttttttttgagacagagtttcactgttgttgcccaggctggagtgcaatggtgtgatctcagctcaccgcaacctccgcctcctgggttcaaatgattcttcctgcctcagcctcctgagtagccgggattacaggcatgcgccaccacgcccggctgatactgtatttttagtagagatggggtttctccatgttggtcaggctggtcttgaactcctgaactcaggtcatccgcctgcctcggcctcccaaagtgctgggattacaggcatgagccactgcgcccggctgggctgtggtttcttagatgtgataacaaaagcaccaggaagacattaaaaaaaaaaaaaggccaggcatggtggctcatgcctgtaatcccagcacttcaggaggccaaggcaggtggatcacctcaggccagggttcaagaccagcctggccaacatggtgaaaccctgtctctactggccaggcacagtggctcacacctgtaatcccagcactttgggaggctgagacgggtggatcacctgaggtcaggagttcgagaccagcctaaccaacatagagaaaccctgtctctacttaaaaaaaaaaaaaaatacagaattagccaggcgtgctggcacattcctgtaatcccagctcctcgggaggctgaggcaggagaatcgctcgaacccgggaggcagaagtcgtgcggagctgagatcacgcaattgcactccagcctgggcgacagagcgagaccttgtctcaaaaaacaaaacaaaacaaaactcccgcttcaaaagatgctatcaaaatagtgaaaagacagcccaaaggaagggagaaaactgtctgataaggaacctgtatccagaatatataaaaaacgcttgtaactcaaaaaagacaatccaaaagatgggcaatggatttgcacagacatgtcttctaagatgcacaagctgccaatgagcataggaaataaataagccatcaagaaacagaaagttgcaatgagacagtacttcacaccctccaggaggactccaatcaaaaagataacagcaaatgttggcaggatgcagagaactggagccaatacattgctgctgggaatgtaaaatggcatggccactttggaaaacagcttggcagttcctcaaaatgttaaatatggagttaccccaagatccagcaattccatttctaggtatatacccaagagaatttaaaacctatgttcacataaaaacttggacaaagttcaaagtcattattcgtaatgaataattcaaaggcatcattcataatagccaaaaagtaggaacaacccaaatgcccatcagctgataaatggagaaacaaactgtggcatagccacacaatggaacgctatccagccatgaaaaggaatgaagcagtgacacattaccagatggatgcacctgcaaacattaggctacgtaaaggaagccagacacgaaagcccacgtattgtgcaaccgcatttggacgaagcatccaaataagcaaatccagagagacagaaagtggattagtggttgccagggactggggaaaggggagtttgggaaagggggaatgactgttaatgggtacaaggtttcttttaggggtgattaagatattctataactaggtaggtgtgatggttgcttttatggtatgttaattatctcataaagatgctatataaaaaccaagatctcaagatgtggaggagctagaacttgcatatgctgctgttaggactgtaaaatggtgcaatcacccttgaagatagcttagccactttgtttcctaacaagttaaatatatacttagcatatgacctagtaatcccagacatttacccataagaaatgaaaatcgatgttcacacaaaatcccgtacaaaattgtttacagtagcatgattcacaatcacccaaagctggaaacaacgcaaggcccatcaacaggtacatgctgtggtacatccaggtgacgggacagtacccggcaataagaaacaagctactgctacacacagcaacgtgaatggatctcgagtgagatccagaaaccaggcaaaaatagagggttatgtactgcatcattccatttatacaagagtctgggagttgtcagccaatcagaacagaaagcaaattagcagctgcctggggactggggagcaagggacagacaaagggaggacaaagcagcacaacgacatttggggaggtgtcagatatgtttaccgtcttgactctgagatggcttcatgggtgcaaacaggtgaaagcatttcaaacccactttagtaaacatgtgcagccccctgtgttacacctgtattacctgcagggcctcctggtcgggcggggcctgccctggcctgcggtacatgctcagcatctcctgcagcaccttcacatggcttcgcacttcctccaccgcactgaccctcttggacaccttctccgatttttcttgttccttttgggaaaaagaggaggatgggagtgagggagcagaaaccctggctgaagcctgaacaagggatgggaaagagtcactattgagagagctcgctcaggggcatcaccaggatgttaagtgcatgggagaactcacacagtgggtgaaaaaatactcaaaagcccagagttcctggggaggaaaatgcagtttggggactggtgaccatgacctctgcctttgtgccaccagcctcaagtcctctgaaaagcagattcctaaacctggactttgtccataccaatacctgttgctgggacccaagctggtgtctaggaaatgctttgagcagcatggatgaaagcagctgagaagtacggcagcgggatttctggttccaatcaccaccttgctgcccttgagggagactatggctgttccccagagttcagggctaggagccactctttctcccaggcaaccgttcctctacccctcaagcataggctcatatgcactgtccttcagcctctgtcaaatgctacttctactgaaccaactggaagaatgcccacctccttgaccaaattcttgattaaccggtttgcagcctgaaggtcctcggggtggttgctctttagaagccttgtcagaagctgcagagagtgaacaggaagagtaggtgagaccacaactccctcaggcctagagcagaagcagcagcaacagaagagttaacactaacaacagtgcacacattttacatgcaccatctcaccaaatggtccaaggacactacgatgcaggcactctgactatcccaatacaccactggttttcttttctgttgttttttttttttttttgagacggggtcttgctctgttgccaggctggagtgcagtggcgcaatctcgactcactgcaacctctgcctcccgggttcaagcaattctcctgccccagcctcccaagtagctgggactataggcgcgtgccaccatgcccagctaatttttgtgtttttagtagagacagggtttcaccatgttggccaggatggtctcaatctcttgacctcgtgatccacccacctcggcctcccaaaatgctgggattacaggcgtaagccagcgtgcctggcctgccactggttttcagtggggtagggggatgtgggggttacttctcccaggggatgtctggctaagtctggagaaatttggttgtcacaactagagagggggtgctactggcagctcgtgggtagagtgaggaatgctgtgaacatcctacagtgcacaggacagtccccaacaacagagaattctctggcccaaaaggggactaggtctgcagttgccctggaccatgtgctttatgacacaacagaccctggtgatcttgttcatcccttcatttccagcgcccagcaggatgcctggcacagagaagtcactcaatctttgtgggacggatggcaggaaaagtggggataatgagggctggtgacacaggattgtttctcagaagtcacaccatacctccttcctagctcctcccaccctctgcaaacctaaggcaccaagcaggaggaaagcggagaaaggtggcctggaacctagactagccttgctcattctaacaacagggacctgatggccacagagtatctaggcccaaggagtgggtacagggagagggtgcagttgacaggcagagcataccacgcagaaacgagtacgcagcgtgtagccttccaacactccatgaactagaccttgtgactgaccaagaacagtcatgaccaaaagcaccgccagcactaggccaaagggctccccactcacaggcaccacagttatccctgggtcttggccaccttcttcttcttgtccctctagatactgatgtccaaggaataacggtttggggagttcatggtggatggaaaatggatagggccgggctcactggcactgagaaagagctgaagcaacacacagcagcaagttcttccactgtccccaccccaacaccacacccacacaggacatgacccatccatcacccacactccccacgggctatccttctgcaccttctttcccccaggaaggctgtgcacaaaagggagagggcacaaagtacccttgaaggaggagcaggaattatgtcctgggcccagatctacactggggtaaggcaggatcacaaacagatcctaccaagacccaggatgcagtgtctgcctaagaaccaggctgaatcaaaacagactggcccttattagttgacttatccatgaagaacgcacccaaaccttctgctacctcactcctaagggcctgtctggagaggagaacccatgtaacctgcccccctccatactccgattcaagcatcaaagggcatttacagtgcctaagagaaaaggtctgatcagacaccatgtaggtctgtttccttaccttggacttttcttcatcagcatcaaagatggagctcttgggccagggagatggtgggggtaagattttatccactggtagtttagggtcttgttttataattcctaaaaatgcaatttacaaagttaagacaccgatatggtacccagaaacttcagtcagaatccagtataaagtctggaaacccctggttcctaataccatgctagcaaagcactgtcaacagccttcaaagacaacacccagtgtatgaacgaagttttgcatcatctcttaggagaatccaagggaccatggtggccgggacagcagagccaactatgtcagagaagagccagtcctgaaggcctgcagtctgtgggccttatgctgtaaaagcatggatcagtttatccagctacataacctcccagggatcaaaagtttctggagggtccctgatgaagctcctgaaaatgctgagtgtatgtgacagggaacaacagtccatcctgaacctgagttccttcttttaagagcccaacataaaaaggaattcagattcccatcttccaaacaggacacacaaaggtgggaactatcacccccatcgtgacaacaacaaaacactggaaagtgtgcaaattcacaatatttttgttgtttttgagacagattcttgctctgtctcccaggctagaatgcagtggtgtgatcatggctcgctgcagcctcaaactcctaaggtcaagcagtcctctcaccttggcctcccaagtagctgggactacaggtgggcaccaccacacccaggtaatttttttaaaaaattttttgtagagatgggggtctcgctatgttgcccaggctggtctcaaactcctggcctcaagtgattcctcacctcaaactcccaaagtgctgggatcacaggcgtgagccaccatgcccagcctacagcttccctgaatacatcagagagcccagatcacagggcaacaaccaagtaacctgaaatctaaggaaaaaaacaacctccaaggattgacaaaaggcaataccaatagtaacaactaagctagaattatttaaaaattgtctacaggccagtgtgagctaccaagagaatacagaatttctggaggctgcaacaaaaagaaaataagctcttctccagaggctcacgaaaacagcgggaaggcctgaaggcgggattagggggagaagagtaacaaaccctgcagccttagagcaccggtggaacccactgcagctagagaaaaaacaggggagaaaaaacaaaaacaaaccctagtacccttggaggaggagcaggaattatgtcctgggcccagatctacactggggtgaggcaggatcacaaacagatcctaccaagacccaggatgcagtgcctgcctaagaaccaggctgaatcagaacagagactggccctgcccgccaccctatccctctgacaagggatggctgtctactgctacgagtggcaagaacaaggagaaaggctctctctgaggtgcagaggaaagtgaagacctacagctgagagaacagatactgaagaaaactaacaaactagctagcccccaacctaaacatcagctaacactagaggaatctgaagtctgatatagtaactacagcaacaacaaatctcacacccagctcaaatcctgtctaccaaaaggaaagctctacccaattccagggattaaaaactccttacctcactgatggatatgccaattaccctgatttgatcactacacattgtatgcatgtaccaaaatatcacattgtactccaataaatgtgtataagtatgtgtcaattaaaaataaatccacagccgggagcggtggctcacgcctgtaattccagcactttgggaggctgaggcaggcggatcatttgaggttgggagtttgagaccagcctgagcaatgtggtgaaaccccatctctactaaaaatacaaaaattagccaggcatggtggcaggtgcctgtaatcccagctactcgagaagctgaggcacaagaattacttgaacccaggaggcggaggttgcagtgaacagagatcgccccactgcactccagcctgggcaacagagtgagactctgtctcaaaagaaaaaaaaaaaaaagaagtaaataaaaataaatccactaaatgattactgaaagatcttttgtaactataaaatattttatgtctgcacgttgttacttttatcacaatagtatttttcaaactctagctcataggtagcatttatctgtacttcatagtaaggttccactatttcaggaaaagaggttaaagatgggcatggtggctcacgcctgggaggctgtgggaggatcatttgagcccagtagtttgagaccagcgtgggtaacattgcaagaccctgtctctacaaaaaatacaaatatttggtgtaagtgagacagcaagtgagacagagacagagagagaggaagagagtgtgtgtgtttgtgtgtgtgtgttggggtgtgggtgggagaataataataaatgaaaaaattagttgggtatggtggcacacgcctgtagtcccagctgcttgggagactgaggcaggaaaatggctggagtccagaaggtcgaggctacagtgagccatgactgcaccactgtgctccagcctaggtaacagggcaacaccttgtctcaaaaaaaaaaaaaaaaaaaaaaaccaaaaggttagtttttaggcaaacaagtcttttaaaagataaataagtgctttagtgacataggtagcttgtattttgacctttttcatgctgtggtttcctatgatttccaggcaacagggaaaaaagcaaaccctacatcatctttccaggtttgcactatggcttttaaaggtaagtagataaaagatttattgcgtaaaaaaaaaaaaaaaaaactctacctcagtgtctatggtcctacataagaagtacagctttcaacaaaaaattataaggcagatgaaaaagcaagaagatacaggcctagtcaagaggaaataagacacagtaaggcaagtcagaccttgtttcttcagcatctgataagcgtctcgaatcttgatgtcttccggaaaccagactgtccaactgaagagtatttcaatgactcttcctttaacttttcctgtggcccaggaccccaggtactgaaagtaaaaaggaaagagaattctagagctggaagggacttgggagaccgacactttaactaaagaggtagctgctgaggcccagagacacaagctcccaggcgcggtatgagtgtgaggagagactagaggccacaccatctggcgcccagccccggagcccttcctgggattcaaggaattcatctcggcaatactcacactaaaccccaccatgcaagagcctgggtcagagcctgttctacaccactggggacagtcattttttgccttggacaagaatataataataaaatttggtctttgtttccgttcctggcacagaacttcaaaaatccttggaatttcctgagtcacaagagtgtcttgttattcaagagacacactcgcagggtgcacctgagttttcactaatgacttacagtgagtgcctagagagcttcaagggctggccactccaaagagatcaaccttgtgatcagagggctgaaactttcagccccatcccctgaccggtgcccccacatccccccacctgtggaggtggtggggcgggcaggggggtgtgaactagagattgagttcaactatgtggccaatgatttgaccgatcatgcctaggtaataaaacctagtgctagttcaagccagcaatgatgtgtaaaaaaacaaaacaaaacaaaaaaacctcagatgaaaacactgaaacaaggaagctcagagagcctctcagttgaacctacgttgggaggatggcaagctcagagtccaggggagggcacagcagctctgtcccctcttgccccaccaagaccttgcctatgtatcgcttccatttgtatcctttacaataaaacagggatagaaagtatagtgctttcctgtgtacgtgaatcattctagggaattatggaatatggggcggtgggggtcataggaacccctgaatctgcagctggggatgcagaagtgcagcagcttgaggacacatgagactcacggctggcagctgaaacacaggaagcctaagcagcactgagccctcactgcgtggggtccgggtagcatgcaactcaggggagtgtcagaactgaaatgaactgtaggacccatggccagcatcggcactgttgtgggaacacaacaaggcagggctcaatgttggttacctgagactggctgagctaagacaggtgccaggaggacaggtacagaggacaaggcaggaggtgataggaaactttcacgccacccctgggatctctcactgtctctatcaggaacctgtgcctccaagctggagttcctcatctcctctaggccacacgttccccaggccttcttaaaagggaaatgtgaaaatgctaacagtgaggggcaggggtcagctaatgagcagagcctcttcctagagcttggagaggagagcgcttctttcacaggcaggagcaggttttgtccatgcgtgggcctgcctctggcctgaggagggagccaggagtttgacagtgggcgtaggtgcgacacagtcagcagagccaagcccaggtactcacctttggggacaacactttgatcagttcgttcaggaaacgaaatttggccacctcgctgtggaacttctccccacagtggttcatgcacatctccagcacctgcacagacacaggacccccaggagaaggtggaaagccagtggtcccaggctcccctccaggctggtaatcacttgctggagactgcgctggaaccaaggctaaccctgcctcaagcctatgaggacactgaagttttgatgaagaggacgttttcagatcaagaaaaaaatgtcccctgttcaatcttgctataactgcctgaggtttatgcccaggaaatagcttagtgaggtatgtcaaaccctgaggtcaccccaccttttaaggagaccctttgagaggagaaagtggctaaagaaccaacccctccccagaggcagagatctggtatccagtgcccaagaccagccggatgtcacccactggcactcaagaggcaagctgagcctgcagacccctcctctcgtccatactgtggctttcaacactgcaaattagtcaccaacatctaaacactcaaacatatacaaagacctaaactagcaaccctgagcccatactcatacctgccaacagctagtgggccctgtgctagaactgccctctctagaaaaggcacatgaacttgccagccctggtctaagaagggcaaatgaaataaaaccttcctttccttctcccacagtagactcaatgctgccctgaagaaacagacgagaaacaggaggaagaagggtggggaccctggcccagatctccctcctccaacctgctgtgaaggtaaacctctcaggggacctcccttctccagtgaaaaggatctgtgtggaagcaaagcgcctctcggctctctatagcacaaggacaggaaaggttaggctacaaggcaagccaaactcaccgttaaggcataaagagcttccttctcttgcggagactggatcttgtgggccagtagccagggcgcatgtgtggggctacagggaaacaaaaagacctagactctgggcgggcaaaaagaaactaacccgagtggctgagcatgctcagtaaaatcacttttcttccaggggctggtgtccaaaagcagaggtggagcgtgcctgacaaacaggccacgcgggggccctggagagggccacctcgcacccaccctggttgcacctacagcacccaaggtcctcctcctgcccagggcacactgccctcccctcagccaacccccagcccccaaactccaagctgccagtcccagcccagtcccatgagtagccacagcagcacaggccctgtatggctgtgataaatacctaggaaatgctagagcagaaagtgcgatcaaactctgggttcaaactggccaaatatgcgacaccacacagattaaacatctggatgggccaggcacagtggctcacgcctgtaatcccagcactttgggaggtcagggcaggtggatcacctgaggtcaggagttcgagaccagcctggccaacatggtgaagccccatctctactaaaaaaatacaaaaaattagccaggcatggaggcacgcgcctgtaatcccagctacttgggaggctgaggcaggagaaccacttgaacccgggaggtggaggttgcagtgagctgagatcgtgcccttgcactccagtcttgagacactctgtctcaggaaaaaaaaaaaaagaaaagaaaagaaaacaaaacaaaaacaaaacatctggatgactcacttgattctgattcttcaggtcctatccagatgctgtggaaacagaattcaataaaaccttccccttttcctttttcttaaaattacatttaaatggtggagaatacacagatctcttttaattaggtaacgtgtctatagtctatcagtaacattcagagttctcctcagcattagtgttttataacagtatttaaaattaataactgccagttgcaagtgagctatcctgtgttttttttcccccacatgaatttgctaattttagaaaaataatgttctcaggattataggggaaaatgagagaatgaatgccagcctgactgcatttctatttttttgagacagagtctctcactctgtcacccaggcaggtctcaaactcctgggctcaagcaatcctcctgccttggtctcccaaactgttgggattataggcatgagccaccgatccttgcctagagagcttaaccctaaaacagtcttgagagacaaaggcctacactcagtgtggggtgcccccagagtcaactatgtgtgtgagaagttaccttacccattggggtcagtgttcacctgctcacagaaattctggatagctgaccaatcctgttccgacatgcttgggtctgtggctttgtctgtcaaataaataataaagttagagagtacataataggaagaaatttacacccctccccatacacatggtggccaagagctgtcttatcacagatctacaggatcagaccagtgggcagacagctggaaggagaggaattgtgcctgcgctgcctaccaccacccagcacagcattgggcacatggtatgcccttactgaatatttgctgattgaatgaaccagcaaattaacaagctggctgggcacagtggctcatgcctgtaatcccggcattttgggaggccgaggtggggggaatcatttgaggtcagaagtttgagactagcctgaccaacatgatgaaaccccatctctactaaaaatacaaaaaaattagccaggcatggtgatccatgcctgtaatcccagctacttgggaggctgaggcaggagaatcgcttgaacttgggaggtggaggttgcagtgagccaagattgcgccactgcactccagcccaggagacagagggagactctgtctcaaaaaaaaaaaaaaaaaaaaaaaaattaactgacaagttattcccctgaaagcggctccacttttagtgcagaggttggcccgggtgttggcttcacactcgagttgggatgcccccacctggcctgtgacaagcggagacagaagagaggccacctggaagtgtctcagctgtgtgacaggaagacaagaacacaccaccagaaggaataccatcttgaccgttcataaaacttccagtggcagcatggtggctcacacctgtaatcccagcacttcatggggctgaggtgcatcgcttgagcccaggagtttgagaccagcatgggcaacatggggaaatcacatgcctactaaaattttaaaaaattaagaccaggcgcgatggctcacgcctgtaatcccagcactttgggaagccgaggcaggtagatcacttgagttcaggagtttgagaccagccttgccaacatggtgaaaccctgtgtctactaaaaatacaaaaaattagctgggcgtggtggagtgttcctgtaatcccagctactcaggtggctaaggcaggaaaattgcctgaacccaggaggtggaggttgcagtgagctgagatggcaccactgtactcagcctgggcaacagagcgagactccatctaaaaaaaaaaaaaaaaaattagctgggcgtggtggcatgtgactgtagtcacagctactcaggaagctgaagtggaaagactgcggctgcagtgagccaagatcatgccactgcactccaacctgggtgggagagcaagatcctgcctcaaaaacaaaaaaaaaaaacaaccacccttccaactcccctctggccatctggtcctggcctgcccagcctctctgatgagaaaccgtactggttctgacagagcagctcttttaggctctggaaatgaggcgttgcttctcggggcagtacttctgacattattatcctcctggcccgagtgtccactctgttcctctcagtgccctatccatattcttccagacccatctgaatttccagctcctgcagaaaacttcctcccgctgcgccaaccccactgcttctccctctgattactcaacacagcacagtccgagttgaatttttcctgactgcagtcacatttatgtcacgtggaagtcatgtgtctagatagggagggtcaacggacaggtaatcaccatcttcctgcccactgactccattctaagtgaagagagaacacaagggcgagggaaggatcagtgattgattcctatattctcctccccacccccgcaaagctctctcccatgttccgtatcttaaaatcctatctacccttgagtcccaagtcacattccaccctaaagacttctctgacctttttatctcccgtccccataaaacaaaagctgtctcctcctcctctgaacagatattttatctgccccttctccgatagggatctccagctacacccattagtcacatgtacttggactcgctgagcctcagtttcctcaactataaaataaagaaaatagggccaggtgctgcagctcatgcctatgatcccagcactctgggaagccaaggcaggaggaccgcttgagcctaggaggttgagaccagcctgagcaacataacgagacccaatctccacagaaatttttaaaaaaaattagtcagaaggctgggcgcagtggctcatgccttaatcctagcactttgggaggccgaggagggtggattgcctgaactcaggagttggaggccagcctgggcaacacggtgaaatcccgtctctaccaaaatacaaataattagctgggcgtggcagcgtgcatctataatcccagctactcagtagggtgaggcaggagaatcgcttgaacccgggaggcagaggttgcagtgagctgagatcgtgacactgcactccagcctgggtgacaaggtgagactctgtctccaaaaaaaaaaaaagccaggcatggtggcacacacctgcagtcctagctactcaggagcatcacttgagcccaggaggtggaggctacagtgagctatgattgtgcaactgcactccagcctggggggacaaaatgagaccccgtctcaaaaataataataaaaacagtctgggcacagtgtctcatgcctgtaatcccagcactttggaggccaaggtaggaggatcgcctgaacccaggacttcgtgacaagcctgggcaacatagtgaggccccatctctacaaatatgtttacaaaaaataaaacaaggaaaatagtaccttcctcatgggactgtcatgtgatttaaaggggaagggtctaaaatgcttagtacagcagcatgcagtaagaggtctacaaaggataattgtttattattacgtacagtctctggcttttactgtaatatgtagacatgtcttgtcctacctaaagagaatgaaaccttaagggcagaagccatatcttccctacagtgccttacccatacgtacaacatagaaactcatcaaataaattatttaaagcagtgattctcagcgattatgtgtctgaatcacctaaagtctacaccatttaagcttctgtttcagttcactacaaggtcaaggttgacacctcaaaagaattctgacttcagcatgtgactggacctggagggagagaagagcagaggcaggaagagaacagggggaggcagggagagaacaggagaggcagagaacaggaggcatggcccaagctcccctcacagaatccagagccttctcactcctccctggctgccaagtgaaagagacacagcactgacgggcaccacctttttttttttttttttgatatggagtctcgctctgtcacccgggctggtgtgcagcggcacaatctcggctcgctgcaacctccgcctcccgggttcaagcgattctccggcctcagcctctagagtagctaggatcacaggtgcccaccaacatgactggctaattttttgtattttcagtagagatggggtttcactatattggccaggctagtctcgaactactgacctcgtgatccgtccacctcagcctcccaaagtagtgggattacaggtgtgagctaccacacccggccggcaccagctttctttaagaaagaaaaaacctctctgaggttaaattacgttccaaacccttaaccaaggccaagcagcaatacaatccacaaaatgtaaggaggtttctttcttatttgctagagcttgtatcatgaggactcaatcaagatttattggtaatcccagaactttgagaggccgaggcgggaagatcccgagtagggacggggtttcaccatgttagccaggatggtctcgatctcctgacctcgtgatccgcccgcctcggccccccaaagtgttaggattacagatgtgagccactgtgcccggctcagttttcttttacataagcctcttcatttgttgaaaccataagaccttcctcacagtgtagaaacctgaaagctcccagcagccagcaatgaatgaaaggtaggggtggggccgctggcagggcggggcctggtgaaccacgtgcctaggctcccgcatcacgatgggaacagggcatgtggaggggactctgggccagattggttcctgggaaccaggagagagctctggtggttggcagggcaacctccttcagttggtgggaagcagtggaaggaagaggagctccctctgtgctctcttctccgcaatcacagctctcaggcttgttgtatctagacccattctaaggaaaccaaacaggttcccaagggacccttgtagacaaggcagctcaggggaggcagctgaggtggggtgcgggctgctagtggggagcagccccacagccaagggctggccctgccagcgtgcctttgctgggaagaggtataagtgctgagctctgcagacttggaagcaagggaaggcccaagctaccggagaggagccaggagccgagctgcctcacggggaacatgctgagctgttgcttgagcaccaatgccagccccaggtagggtcggcccaggggggtctgcggagctgtactgtggctctgacatctatgaggcggtggcaagcagaggtgcaggccaaggcagagaggagtggaggcacagcagatggaacacgctgttgcccaatgccagccccaagcggggcagtgtgcggggcctggggagctgtcctgcagtgctgacatctatgaggcagcgtcaagcaaaggtgcaggccaaggcagagaggagcagaggcgtcgcagatggaacatactgctccccaatgccagccccaagcaaagccagtgcagggtgtggcgggtggaaccgccctgcagctataacatcacgcaggcggaggtggcagtagcgccacaccccactgctgtggagcctgcccagtcggatttaggagcccgcaagggccatgacctgcagcacatcagtgaccaggagatgcccaaatattttgcttctgaccatccaagggaaagtacgctttttttgagaaaatatcaaatgagtgtgcaagaaaagaggagctctcacctatattatatataccatggcatcttgatagaaaatacacctcgtgttacaccatattgctagataacagaacagtcagccagcctgatctttgacacacattagaaagtgtgacttgggcaatatattacaacataaagcacagatacgcaaatagatctctggctatttttgacaagccaatacacccactttcacaagagaaggttccagggaaatccttcgagcatgatcccaaacacaactgtactttcagacatttctgtactctttttcaagtcataaaactacagctccatgtgcaatcgtagctttggtgtacatcgaacgacttttaactaatggtagcatcgctctgtgtcctactaattggaaaaagattgtccttggagccatgcttcttgcctccaaggtttggagaaatcatggtctgtggagtgtggatgacagccagaatcccaaggacattgcagttgagaacatgagcaagatggagaagtgttttttggagctacttgagtttaatattcatgtgtctgccagtgtttatgcaagatattacttcgacctgtgtgccttggcaaatgaccgtgacctgtattttctatttagttttcctcacaaagataaagcacagaaactggaggctgtgtcatggccgtgtgaatacaaagacttgcatcaacatgccgctgctataaagggctgtcagcatgaatttcattggtattcggtgcactaatgccatcttaaagagagaaattaacattataagatcctaaacttctcaactgtaaagactagaaaatatcacttctgctgaaagaaacaacaaaattaggattttctttttttgttgtttaggattttcatcgagaggaaacatcttcaagttagccacttgaaggaactgggtgatggtggtatgaacagtgggtgccaggtgctttctgcccttcttgttccactgggtccagatggcattcctagggcaccaccttcttgaacaactcttggggagaaggagtgtcacatggacacagcacatccctgctcagagtccacaatcacccacagtctcaagcaggtgccagtgatgtccacagtcacccacagtccctagcatgtgacagtggtctgagctgagctggagtccaaaaaactttagaattggctccagatttgtgagagcacctgggtatggttctctgcccactgaggcactgaatgcatgatggcccaaaactcaacaatggtgggaagagagagtggcatcggggcaaggctgtcattactccaagcaccagggtggcccaggcctgctcatctactctttggagggaatctgtgcatgtgaaatgaggcccctacgtcatgattataaaggaagagatgaaatcagttcatcttaccccaggccgataatggtcatgccacctagggaagcagtaaaagacctggtcttgggattgttaggggagctaccgaagtgaaaactgaatttacccacttccaggaaaacaacaaaagaggaacatctgggttcaaacctttatcagaagatcatttacccagctaatcttgctgtggtgcattgtatggtctcagcaattgtcaacaaaagcctcttaataattctaacacagggacacactgcaactcacattttccagtgcacctcagtggttaaagagattgctggtgctgcctgcatctgtcagtctgttcacatatggagaggagcagcggttctcacgggagcagcttctgcatcctgaggaagtttgcccagacatttctggttgtaatagctggtggctcccactgacatgcagtcaacaatgggaatcctatggtgcacaggactgcaccccttctcagtcaaaaaggaattttctggcttccaaaatagaaagtgctgaggatcaactgccccagagtctacaagggaaacactttctgagactttctttttttcttacaagaacaccagatccccaccaatgtgagatgtcagattaagtttttgtggaagggtggatattgggggcagaatcctaagacgccccatgatctctgctgtcttttgttacaccctgaatcctcatctttccttgggtatggccagacctgtgccttgttcagaacatttgaatatggcaaagtgagggagtggctctctgggagttacctttcctttccttttatcgggaacaataggaatccctattttctttcttgtgtttgctttcacaatacagtggtttggaatatcccactgtcgatttgcgatttcctcctccaaccatagtctatagccctttatacgtaattgaatattttcatgtattgattttttgtgtctgaagatgaaatattagatgaaacatgttaaaacatttcatgcaaagccttcagtggttgtagagtctactctttggtgaatacacaaattgatctattttatatattaaaaattgtattagttgtaataatgatattttcttttttatctttacttgtaagatatagttacttaaatgtttccaaaattaatgatattatatcttatatttgatttaaaacactactaggatatttggattgatagttgaaaataaatggcaaaataagaattgctgaaacctagtgataatgtacttacgatgagtttattatctattatcccatcattgttaaatttttaaatttccatgaaaacctatacacaagaacttaaaatgttgtgtaaaatacttcgtgccctgcactttagctccactgcatactgaataaaaggaaaacggattttcctatggggggaaaaaagatttatcatggctcaaaagtaacagtaaccgtcatttttaaaagtacctaatatggggccgggtgtagtggctcatgcctgtaatcccagcattttgggaggccaaggtgggcggatcacctgaggttgggagttcaagaccagcctgaccaacatggagaaaccccgtctctactaaaaatacaaaattagccaggtatggtgctgcatgcctgcagtcccagctacttgagaggctaaagcaggagaattgcttgaacccgggagacggaggttgcggtgagccaagatcgtgccattgcactccagcctgggtaataagagtgaaactccgtctcaaaaaaaaaaaaaaaagtacctactatgggtcagataccatgccagatgtcctcagaacaatccaggttggcacgatcatctacaccattttacagatgaagaaacctacccaaccacaaagcaagggagtggcagaaacaaaaattaagtcataggctggcccagctccacagcctggatgtgtttctaaccactcttgcggtgaggtcttcagttccttgacaaagttagggcctctcttggaagccagcttgatcttcgtgctcataaactccttgaaggcaaaaagcaggcctgtctcattcactctcacaggctctagtacctagaagagttgctggcaggtatctactgaatgaacgattcctcttttgctagacagtgtttggccagctggctggacatactgataacacggagagatggctatctcagttctgaaataactgggcccctaaacacataatcccagcctgcacaaactatttcagaagacttgagcagctccaaaaaatgacccccagggggccagcagctgggtctgaccaggccacagcaaccgccgtaggtctgtttgacaccaatctgctccaaggactagctaggggccagacagggcacggccagggagaaattcaaaggatgccttctctgttttgggctatcccagactccaaggtggtttatttatagctggcacttgagcaggacagaggggtgctgagaaatagcactgctgccatgtatttcctcactaaaagcagtgtttgtatgattcatttcaagcgtgctacagggccagaggtgttaagaaaacagctgagacctccggctgtgagtgaaatggctcatccaagagtgactaattcagaagccaaaccatcccacgtcagctgccaaccaaccaccggggtcatgaccctggcaccagcagccgcctgtgctagcaaggggagccccaagactgtgaggaagtggtcaccccgaggagcagaatgcaatccttcagcagtccacgctgcagggggactccttccctgggagggacacgtggaccccaagagtccggcaatcatacaattcagcacatgtgaaaacctccaagactcagcatgggaatgtcctactcatcacctgggagtaggaccaagtggaaggaagaaacagatttactgagcacccaacttttactaagccatggcctccctggtagcgctaccagagctagaattctagagcccaagaggactgagtgctgtttttaatagcgcaaggctagcaacacctaagatgtctaccaacagggacccggttaaatggatcctaggacacccatacaacggggcgtctaaggcttttcatttaaaagaacaaggcggctacatctgcagtcatgtggaataatgaccaaaatacatgaagtggaaaaaaacaccacagaactgaatgacagaatgcacaggcgctgccgtttgtacttttaaggcatgagattctggtaacggcttcctgatactcctctgggaacaacccctctcctcaattccaggtcccccattcaccctccccacctttggctctgggttgggtactgtcccccaccccaccccaccccaggtctggccatcttcatatttcatgaccccaggtcatgctgactccaaggtggacataaaacccaagccaacaggcggaagaacaataactcttgcaaatcaatggggaaaagaaattctgctgagattgcagtagggagaagagcaaagcagagaaaattcaatcaaagaagtgaaccgtggagctcctggactgagcctacccctactctgggactttctttactttcctttttttggtaagcgggtatgggtatgagttagtttcaattacttgcagctataaaagcctaatgataataatagctagcgcttcttgggcacttactacaagcatagtaaggcactattttaagtgctttctgtgtattaaagcctttgattctctcaacaaccctaagaagaggttttattactctcttcccatcttaaagatacagctgccttgtttgcagggacctgatcttggccagtcctcagacaccaccccctggtgacttcatgtagctcagacccatgagcttttgccttcaactacacccatgtcttggccatactatcaatcccacgacccccttatccctccattgcagcaccaatggcccaccatccccaacaaatctgacttaacccatcgttcacttcatcttctctgctcctactcccagaagaaaacaacaacaaatacagccatgaagactgcaacccacattcctgatgtccagtcagcattctgcagtcctcactcaggaactcagcggggagatgggtaggagtgatcccatcccactcaaccctggggaaacatggcagtatctggtgacatttttggctgttatgactgggaggaagggtgtgagctttggtatccagtggatttagcccagggatgccactaaacatcctacagtgcacaggtcagcccccacaacacagaattatcgggcccaagatgtcactcgtgcaaaggttgagaaacccagctctccgtccgggtgggcccacttcggtttgcctcaccagccactccccaacgcttccccaccttcctcaagtcccctgttccacttgagcacccaatactcaggtggcaatggtggcactgacgaacttgtttgcatgtgcaatcatcttgatctccttcgccagacagtcagaaaaacaaaaggtgtccttcctctctgtgaggccaggtccccctttttgctctggctctgagctccttcagcaccttcaggcccctctgcaatggatgggacactggacccagaatgggggaggggcagttccccaatggaacatcaacatgaagaggggctcacatgtccccctctccttctaataatctcctttactcctaaattccctctcgctattctctccccctccttctacattcaagactcatgaaaaacagctgaggaggccactggctgcaccctccccacacatttattctgcctggccttccccaaattatgggccaaagtaggcaccaacttctgaaaacccacgatatttcacttaagaatataggttctagccgttcctgaaaaacaggaagatctagcaactttgggacactgcccccaaaagctggagcttaatacaatgtatatgccatgaaaaaaaccataataataaaacacaaattaggccaggctcatgcctataatcccagcacttcgggaggccaagactggcagataacttgaggtcaggagtttgagaccagcctgacaaacatggtgaaaccctatcgctactaaaaatacaaaaattagccagacatggtggctaatgcctgtaatcccagctacttgggaggctgaggcaggagaattgcttgaacctgggaggcggacgttgcagtgagctgagatcgtgccactgtactccagcctggacaagaatgaaactccatctctctctctctctctcacacacacaaattagccggttgtggtggcgtgtgcccgtaatcccagctacttgggaggctgaggcaggagaattgcttgaaccaaggaggcagaggttgcagagagccgagatggcaccactgcactccagcctgggcaacagagcaagactccatctcaaaaataaataaataaataaataaaaatacatttaaaaaaagctagaactggggaggctgatgtgggaaaaatgcttgagcccaggagaggggtaagctgcagtgagctgagatcatgccgctgcactccagcctgggtgacacagtgagactctgtttcaaaaaaagctggagttgaagaactgtgtccttgggcagcctcagttccaggcactccttttatctcctccacctgaggcagctactttctcttactccggctactttttttttttttttttgagacagaatctcgccttgtcacctaggctggagtgcagcggtgcaatcttggctccacctccacaacctctgccccaagggttcaagtgatcctcccacctcggcctcccaagtagctggaattacaggtgtgcgccaccacacatggctattttttgtattttagtagagacggggtttcaccatgttggccaggctggtcttaaactcctggcctcaaaggattggcccacctcagcctcccaaagtgctgcgattacaggcatgaacagcctttttttctaatttttgcaactccagtctaagccttctgttctccattgcctcctaaaactactaccttctgtctctactgtttaactcaaggatgtctcattaaataactggttggttaccaaattcaaagttctctcttctccttcctcattctcctccatctttaaggagcaaaactacgttacaaccacatccctcctttgctatcagtgggtgcccctgcaggtctccccctgcctgtttctgctcagccttcagtcttctcttcccatctgcctcttcaatgctggggctccccacgctctctttccaaacctctgctcttaatatacgcaagcttctcccgcaagctcactgccaatgaaccagactcccaaaccgtacgtcccacacttgccctctccagtgccaaccagctgcctagagggcatctcttttttgactatgccacaagcacctcaaactccacatctcaaccttctctgcctaaaccagctcctcctcacaggggaggcatctgtaacccaccagttcctcgagcctgaaacccgcgatctagcctagatttctccttgtcccctgtctgcattccaaggcaccgaggctgctgactacgcctgctcattgcttctccctctccccactgccttagtcctcctgcggcccccaaccaccaccaaaagagctttttagccgctctccctgcctgaagtctcaccctctccgcccaatttagcaccatatggctgcaagtgacgcctttaacaggcttccttgatcagattctccggctgaaaactcccaaacagcaaccccgccctcggataaaacataaactcctttctgcagcacacaaggctcttgaagatctcgccccaattagccgtgcagcccctttcccggattcctgagctttaggcttgcactccagcggactgacctacttgttcccggagtgctccacattctcttgtccccagcttttgcacacgcagtttcttctgcctggaatgcggtcggctgtgacgacccccaggtaaaccaactcctaccaccacaggtgaaacgaacgccctcctcctcctcgccaatcccgttagtaaggtgatgtgactgccggcttgtacccactaaaaaatgttttggtgagcaaggaccctgtgttatgcatctcagtgttcctggcacctagcagagctgggtacaaggggaatattctttatcccctttgaacctcaatccctcattggtaaaacggagataataataacccctaagatgactgtgaagcttacaggagacatgcagaagaattctggccaaagggtttgagcccaaccagggtaacataatgagaccccgtctcttaaaggaaaaaaaaaacacacatatatatatatacgcacacacacacacacgtgtgtgtgtgtttaaaaaaaaaagtctggccaaagtaaacacaaaaggtaaaaaatttctttttgacgcggtagccagatagagatctttctcagccccaaacagactgcatgtcttgcacgactgcgtctccttaagcctcaaggtccccgcttccgtagtggggttaataatagaagccagctcggggtgggaatgaggattaagcaggactaagccgctgtgagcacagtgcctggcgcaggggaaagcgcaggtcacgtagccattggggtgggggtcggggtcctgtgctgctgctaagttggggggtgggcggagggggaggggcagagctcagaagggggccgctgccccggcggatgcttggggctcctctcgggggacccctgggcgatcttccccaccgcgccgggcccaggccccctacccggccgccggcctcccctgcggccgcccgccccgaagcaaggccccgggaggcgggaagcgaggcctcacgtgcggcgcagcggctgcgccgaaggcctgccaggctactcactgagccacagctccagcgacgctgccgggcccgggggaccctgggccgactcggttcccgccacagccgccgccaccgcggtcgccgccatcgctccagccccgacgctgcggccgcgggcgccactgcctcttcagccgctgtagcgtcctggcgctctcctctgctgactgcgcggcaggagcggtggacacgtgacggggcggggccgctggcgccacgcccaccccaggccccccctccacgcgggaccggccggaacatttcttagtccagatccctccacccagcgctggtcttctaagaccactcaccgtacggttgccagataaaatacaagacgcccagttaaatttgattttcagaagaacacgaataattcttttagcatttttattttttaagagacggggtcttgctctgtcactcaggctggagtccaatggcgcgatcacggctcactgcagcctccacctcctaggctcaagcgatcctcccgcttcagtctccggaggagctgggactaggggagggcaccaccacgcctggcgtgtgtgtgtgtgtgtgttagagactgggtttcaccgtgtgtgtgtgtgtgtgtgtgtgtgtgtgtgtgtgtgtgtgttagagactgggtttcaccatgttgcccgggtggtctcgaactcctggtgttagagactgggtttcaccgtgtgtgtgtgtgtgtgtgtgtgtgtgtgtgtgttagagactgggtttcaccatgttgcccgggtggtctcgaactcctgggctacaagatcctcttacctcgacttcccaaagtgcttgcatttattttttatttttctttttttctttttttgagacggagtctcactctgtcgcctaggctggagtgcaggggtgccatctcggctcactgcaacctccacttcctgggttcaagcgattctcctgcctcagcgtcccgagtagctgggactacaggtgcatgccaccacacccagctattttttttttttttgtatttttagtagaaacgagggttcactatgttggccaggctggtctcgaactcctgacctcgtgatctgcccgcttcgccctcccaaagtgctgggattacaggggtgagccaccacgcccggcctatgtgcttgcatttttattcacagaagggttttcctggaacactttttttttttttcagatggagtctcgctctgtcgcccaggctggagtgcagtggtgctatctcggctcattgcaacctccacctccctggtttcctggaacacttctaaactaacatgtcctgcattcctcaatactctgctttattttctgcatcacacagtacaccatcgatgtattatttacttgcttattctgttaaaagataattttcccaaaaaagtatgtcatgattatcataattatgaaatgaatacgtgttaaatattttatttaattacatgagggaaccaagcagatgttataatcaatccaaaagtgaagtcaaagaagggcaaatttatctggaaaaaaaggaagataagacgaatgtgcaaatggaggcaaaactggcttttcgaccggggtgagagctgtccctccagtgagcggaatttacctatttataggcaagaattattttgcattggtatcaacttaacagagttatgagacttctcaaagacaaagaaaggctagaacctggaaggttgtgctgtctagacaacacataattttccattgaagctgttgtgccgtacccctattaacttcagtagggatggcaccatgtttgaaaggcggaagaagagacccagagccactgaatgaggcaggtttactgaggggacttacggggtggtctagtggcagtgggctggacaggaggaccactaccatttgtaaagagcatcagtttatatagtattttcaactagcacccttcccctagcaacctccatctggcaacctcaatttaaccccaaagggccttgatcccccgtatggcctgcgttccacaggatggggccaagggttcagatgttcctcttagataaagagtgaacctctgggctggccactctgtgattctgtagcttggaactcagaacacacattcttcttagaccataggtacgtatgccatacagaagcacaaattcttccttgtagataactgaatagcaatgggtgatgattcttgtccacacacaagcaaatgaatactgttctgggaacacacagacttcttgtggaaaaaccagttctgcccccacttgcacatccatttcaacattcctgatctatacatgatgtccattctttggactggtttgaacatctcaccagtttcctcattaaggagttaaagaaaatcttttttttttttttttttttttttttttgagtctcgctctgttgcccaggctggagtgcaatggtgcaatctcagttcactgcaacctctgcctcctgggttcaagtgattcccctgcctcagcctcctgagcagctgggaatacaggcgcccaccaccacacccggctaattttggtatctttagtagagacagcgtttcaccaggttggccaggctgctctcgaactcctaacctcaggtgatccgcccacctcggcctcccaaagtgtcggaattacaggcgtgaaccactgcacctggcctaaataaaatctttaatacatatttatctcttgaagattctgaacatctggcaacactggacccggctttccacatttcaacaaaacctggacgtgactagagtctccacatgctacagggggcatgagctctacagtttgccaaggaccatccttcaactcctgaaactttacttattttaagcacctgcaatcctttaacatttttacattgttggagctcagaaaaccatatcccagagcatggtgttttggcatagcgagtactttgaactcaaagacagtggaaaccctcagaagcagcctcagagcaaaggttctctgacctcctgcccgtctttcttctcccaaggcaagccacagaaactcaattcctctttcccaagatgggtcagggaaactcaaacccctctcccctaaagccagccacaaaacctagacatattactccagccttcctttatttctgcttaagagttggccataaagaaattctcagtcgggcatggtggctcacacctgtaatcccagcactttgggaggctgaggcgtgcagatcacttgggtccaggtgttcaagactagcctgggcaacatggtgaaaccgcgtgtctacaaaaaaatacaaaaattagctgggtgtgctggtgtgtacttgtagtcccagctactcaggaggctgaggcaggaggaccacttgagcctgggaggcggaggttgcagtgagccgagatcacaccactgcactccagcctgggcacggaatgagactctgtctcaaaaaaaaaaaaaaaaagaaagaaaaaaagaaaagaaaagaaaagaaaaaaaaagcaattatctgagctactttgtctgataacaggtggtcatgcccccttattcctgccctatacctaggaagaaggagtgatatacaggtaagccaagaagaatttggacaggccttgctggatccccccacctaagtctaatagatcactcataccattttgttcaatcctatttctacctggctgttggtcatcaaacctaaatataaaagtagacagccttccctcggtctttatttctgaaagctcccatgtcaacataaaacttttttttttttgatgaaactttttttgatgaagtcctgtcgcccaggctggagtgcagtggctcgatcttggctcactgcaacctctgcctcccaggttcaattgattctcttgcctcagtctcccgagtagctgggaatacaggcaccccgccaccatgcctggctaattttggaatttttttgtagacacgggatttcaccatgttggccaagctggtcttgaactgctgacctcaaatgatccgcccacctcagccttccaaaatgctgggattacaagagtaagccactgtgcccggcctgtaaaactttaattaaataaatctgttatgcttttctcttgttagccttttttttttgagacagggtcttgctctgtcaaccaggctggagttccgtggcaccaccagagctcactgcagccttgacctcccaggctcaaatgatcttcgcaacctcagtcctcagagagtagctgggataacaggcacacacaccaccgctcccagctaatttatttagttttgtagagataaggtctcaccatgttgcccaggctggtctcaaactcctgggctcaagcaatcctcccaaagtgctgggactacaggcataagccaccatacctggtcttaacccgtctttttgttataggagtgttggccatgaccctttggagaggtgaggaaagatgtaaggtatagatgtcccacaacatctagatcaatggttttcaaactagcatgtgtcagaatcaggtttgttgcaaattgcagggccccgccacacagtttcagatctagtacgtctggaatgaggccccagaatttgtctttgtaatagatctccatctgacattgatgctgatggtctggagaccacaacagaaaggataaaggctaagtgggtaggaagtggttgaggagtttaatgtagtggttgggtgtgcaggcattgtgattagaactatgttgttttcatctaagaaataagataagtgcctatttcatggggttttttttttccttaatctaaaagagataatatatatatatataaatatgtatcagctgggtgtggtggtgcaagtccctgtagtctcagctacttgggaggctcagataggaagattgcttgagcccaggggttcaagatcagcctgggcaacataatgacaaccatctctacaaaaccaaaaaatattaaaaggccaggcatggtggctcacgcctgtaatcccagcactttgggaggccaaggcagatggattatatgaggtcaggagttcaagatcagcctggccaacatgacaaaaccccttctctactaaaaatacaaaaattagctgggcatggtggtgtgtgcctgtaatcccagctactcaggaggctgagaccggagaatcgtgtgaacccaggaggtggaggcttcagtgagctgagattgcaccactgcactccagcctgcaaaaaaaaaaaaaaaaaaaattaaaattaaaaataaattacccagcctccgatatttctttacagcaacacaatgacagactaacacacagcttaagctgaaataccaatcttctgtccttggtactcctggatttcaggcattcaggtttggattggaatctacactactggctctccagctttcaggcccttcaactacaccactggctttcctgggtctccagcttacacaagcagatcagatgacttttcagcttatctatcaatttttattttttctacagacagagtctagctctgttgcccaggctggagtgcagtggcacaatcataggtcacttgcagcctccaactcctgggttcaagtatccttccacctcagcctcccacagtgctgggattacaattacaggcataagccatcacctctgacctattttttttttttttgagacagggtcttgctctgttgcccaggctggagagcagtggtacaatcacagcccactgcagcctcaactgcctgggctcaagtgatcctcccgcctcagcctccctaataggtgggactacaggcacacgccaccatgcccggccaatttttttttctattttttgtaaagatggggtcttactatgttgcccagactggtctcgaactcctgggttcaagcaatcctcttgcctcggcttcccaaagtgctgggattacaggcatgagccaccacactcggccttttcagcttctataatttggtgaggcactatctaataataaatctctcttcctagatatatatcctgttgggtctgtttctctggagaaccctaacctaggcccttagaggctgtgatgagagaacatggctttatcgtgaaaatagcccttttctgtgcctcattttccaatcttctcctactggggctccttccttccatctgctcctgcttaagtctctccttggcatagttgccagagtgacctttcaaaaaccacaatctgctcatgtcatttccctgcctaaaacatttcactggctctgcacctccctccttatgaagacccaactccttgccttcattaattgaaccctaactttgctgaggtgcctgccactccccacctggccatgcacctcagggacacgcagactcccttcatctccagctctggatctgactgatttatggagaccctcacttccccagcagggatggctaaaaatttggaagttgagtagagggagggtacttaggagtttccttgctgttgggagacagccatagaaagccaccctctccccagctgacatgaaggaggaagtgcagaggcctgactgctgcaggcagccaactgtggctgctgcagatgctgtggccaggagggtggagagagagaaggaccctgggtcctcactgatgtcaccacacgtgtaattaaccaaccctgcagcccaccttaccaatgaacttcctgctaagtacgataataaatcttatttaagatttattgctctcttgcctaggctggagtgcagtggtgcaatcacagctcactgcagccttgacttcctgggctcaagtgatcctcctgcctcagcctccctagtaggtgggactataggcacatgccaccatgcccagctaatttttttcttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcctgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccccagctaatttttttctattgaatctgggttttattatttggatctcacatctgcctggtttctcagcagccacttctacctctcccctgactcctactcttggtccagtcctgaacaactttgtgaagctttatttttcatccctctccttggaatagccttccaacacccatctacctgggaaactcctactcatccctcagaacccctgaggtgcatgccaccacacctagctaattttttgtgtttttagtagagacagggtttcactgtgttagccaggatggtctcgatttcctaacctcgtgatctgcctgcctcggcctcccaaaatgctgggattacaggcatgagccaccgcgcctggcctatttatttatttatttacttatttatttttattttttgagatggagtctgtcacccaggctggagtgcagtgttgtgatctcggctcactgcaacctctgcctcccggattcaagcgattctcctgcctcagcctcctaagtagctgggattacaggtgcgcaccaccatgcctggctaatttttgtatttttagtagagacggcatttcaccatgttggtcaggctggtcccaaactcctgacctcatgatccacctgacttcacctcccaaagtgctaggattacaggcatgagccaccacgcctggctgacatttatattttttgagacagaatctcactctgtcaccagggatggagtacagtgacacagacacagctcactgctgcctcgacttcctgggctccagctatcctcccacctcagcctctcaagtagctgggaccacaagtgctcaccacaatgctcagctaatttctgtatttttttgtaaagatgggggggtttcaccatgttgcccaggctggtcttaaacgcctgtgctcaagcaatcctcccccattggcctcccaaagtgctgggactacaggagtaagccaccacacccagccaacaacttctaattttagtccccactaaacacatgtcagtcatctgtccccagccttcacttccaagctttgtcaaaggtagtttctcccagacagctggattcaatgcaaattacaagcaacagactggactgctaattatactggcaaatcttgcaaaagaggaaagacttccccgcttaaatggaagtgatactggtaactgttaagagtctggcagttagaccagctgatgagtgccatttctgaagaaactgatcttactaacatagtcctcaaacactttttcatcatgagatcttgacccttactatgtatctggcaacgtgccaggtgctatggttatacaaaaagacagacttcctgccataatctcatattcttttgagtaagagagtaaatatgtacaaatatataatttcatatagtaaaaagtactatgaaggcaaaaataaagtaggataaaggcagtatgaatgggattccaaatttggctataaaaatgtaattttctagaacggatactgtcttttttttttttttttttttgagacagtcttgctctgtcaccctggctggagtacagtggcactatcctggctcactgcagcctccacctccctgggctcaggtgatcctcccacctcagccacgccagtagctgggattacaggtgtgcatcactacacaccactaatctttgcattttttgtagaaacagggtttcaccatgttttctaggttggtctcgaactcctaggctcaagtgatccactggccttggcctcccaatgtgctgggattacatgcatgagccgccgtgcccagccctggaaaagatactctctaaacaacaccgaaaaagaacacgctcaggggaaggaactggtttcccacacactaaagtgagccacctgcagccatgatcatagaatatgactcccattgaccacagctgattggaccaggggtagacacctgacccaggctaggccaatcagattctcccctgcgagtttgtatgtggaatattggttatttaattggtgatgtaggagaagagagatgatttaccttcagggctagggcagctgttggccaactgcagagataaagagaaaggcagcctgcagagggaaaacaaggggagcagacacacagaggggtgaatgttagaaactgtgccatctcagagggccgagtggctgcctttggtcccaacaggtttctaggtacagattccattcttttgtgaggtccagttggaagtcctgccctttagatctgtgagagtcctaattcttccaataaattcctttcatggtttcagttagtctgagtgtgtttctatgcattgccaccaagatcactgtttctaaggatgaaaataatggtgatagttacctaacatttattaaatgccatgtaatgttctaagaacttcatatatgttgccaggcgtggtggctcatgcctgtaatcccagccctttgggaggccgaggcaggcggatcacctgaggtcggcagtttgagaccagcctgatccacatggagaaaccccgtctctactaaaaatacaaaattagctggctatggcggcacatggcacatgcctgtaatcccagctacttgggaggctgaggcaggaaaaccacttgaacccgggaagtggaggtttcagtgagccaagatcacgccattgcatgccagcctgggcaacaagagtgaaactacgtctcaaaaaaaaaaaaaaaaaagaacttcgtatatgttatctattccaatccttacaactctttgagatgggtacaattcttattcctattttacaaacaagaaaattgaggtacagaaagtcacatgtgaataaggggcagaatgtttctgaatctagacagcctctgtgcccttcactgctgcactataccctcaaaacactggggatgggcttgaggttatttaaaatgtatgaaattccttcaaacacttttacttagccaggtgtggtggcatgcacctgtgattccagctactcaagaggctgagataggaggatctcttgagcccaggagttagagctacagtgaaatataattgtgccactgcactccagtctgggcaggcaacagagcaacatcctcttaaaaaaaaaaaaaaaagtcttactgatcctgagcaaaaccctcaaacagaagacagacgtctggagctgctttcaagatagcacagcacacttcacttgaggaagtagcaacagctttattaatttcgcttttttattaatttcttgttgagacagagtgtcgctctgttccccaggctggagtacaatggtgtgatcttggctcactgcaacctcccgttctgtgggggttcaagtaattcctgtgcctcagccacccaagtagctgggattataggtatgtaccaccacacctggctaatttttgtacttttagtagagatggggtttcaccatgttggccaggctggtcttgaactcccggcctcaagtgatctgcctgccttggcctcccaaaatgttgggattctaggtgtgagccaccaggcccagctctaatttagtattttttaaaaactgtggtaaaatacagaaaaatataaaatttaccatctcagtcatttttaaatatacagttcagcggcattacgtatctttataatgttgtgcaattatcaccaccattgacccctgtaactacatcttgcaaaactgaaactctataccctaaacagtaacttcccatttctgcctccccaagtctgacaaccaccatcttattttctgcctgtataattttgattattttaagtaattcaaataagtagaatcttacagtatctatccttttaactttattttattcatttttttttttttagacacaggatcttgctctgttgcccaggttagagtgcagtagtgcattcatagctcactgcagccttaacgcctcagctcaagtgatcctcctaccttagtctcccaagtagctgggactacaggcatatgtcacctcacctggctaatttttaaattttttgtagagacaggatctcactatgttgcccaggctggtctccaaactcctggcctttgacaagcctaccacctttgcctcacaaagcattaggacgtatttgtccttttgtgactgacatttcatttagcatgaagtcctagaggttcatccatgttgtagatataccagaatcgacttagtattttgaccactcactttgttaaaaacactcacttgaccatgagccaagaagctccttttaaccattcttaatgtcttagaaacagatgctctgacaacactcagtagatcagagttaagcttggactctggatcggcacagatctgagtttaaatcttggttttgcctcgtactataacctcggaagttttagttaacttttcagaacctcggtttccatatctgtaacagaaaaaaaaaatactgcttctctcatagtgttataaaaaaaatttactgagatgatggactaaggcatttacgagcattatctgacacctgggagagggtgaggctcatataagcgcacaataaattacaagtattattattgtccccttctgtggtcaaccacctgttgtttctgccattacatcatcttctggagaaagctccctagttttccttgagaacaacttttcctccattgcatataatccctgtgaaactacctattactggccaaggaatggtagcaggacctcagatagcccaacagatacttgctcctcagaatctgaaccttgagcagagtcatccaaaactgaggggaaaacacggagaaattaacaacaacaaaacggctgtagttcatgtgtcgccatcaaagaactcagacaagattggccattagctcctgtagctagttcctgtcttttccaaaacctgttttttttttggctttttggtagatgctgtggctctcttatggcctccaataaacataagtgaggcagagttggtttctattgtttgcaaccaacgaacttaatggattctgtattagaaagaactggtatatttctttaagcaaagactaggactctatggggctcaacaaactctgtaatcgcctttccactcccctggacaaaataaatatattgtctactgctgaaacgcaaattatccccaaaccaagtagctttaaacaataaacgtttactatctcacagttcatgtgtgtctgacgttccggagcagcttctctgagtggttctggcttagggtctcccatagaggtcacaagcgagatcagctaggattgcggtcatgtgaatgcttggctggaattgaaggaccagctttcaagattgcacactcccatggctattggtgggaggcctcgatcccttgtcatgtggagcactccataaggctgcttgagtattttcatgacctggaagctggcttcccccaaagtaagcgatcaaagaaaacaagacagaagccacgatgtattttatgacttaccctcagaagtcaaactctcatttcttcaatagtgtagtggttacacaagtcaggcctattcaatgtgggaaggaaccacacaagggtgtgaatagaagaaggcagggatggttgggggccaacttagaggctggctgccatgcaggggaagcctagaagcctggtaggggttcatgtaccctgccaccatcctcctttcacttgctattcctcttcactgaagaccccaagaagcatatctcatttcagaaaccagcagagatgatgacttataagtcatggaggaaggacgaggtggatttgaagagaaagccacaaaataggaagggtgaaggtctccagtccaaggaccaggtctggaagactggaaaaacggaacagatgacgtttagggaagggagacacaggctgccccaaggttcaagaataaagggtagcataagacaagagtgcttacccttggcagtggagtcacacttctccttttacaaccccaaagaaagtctggtgtccagttcagccctgcttgtgtcacgtatcctttgctgctctgagtccttggggcctgagaactgggacccatgagtcctgctgcccagctgctacgggctgaattctgtccccctaaattcttacgttgagaaacccctggaacctcagaatgagactgtacttggagattgagcatttaaagaggtgattaacttaaatgaggctggttaaagttaaaatccagtccaactggtgttcttagaagaggaacgttgggcacataatgaaacttagagatgtgtgtgcatggagggaagaccgcacaaggacacagtgagaagacagctgtctgcaagccaacaaaagaggcctctaggaaaaaccaggcctgctgacaccttgatcttgaacttctagcctccaaatgtgagaaaataaatctctgttgtttaaaccacctggttctgtggcattttgttatgggggccctagcaaactgaaacccaagccttctgcactgttccgggatgttaacttttctgtgaactaactccaaacctctgctgtgtaatgtgtgagaaaccagacccggagaatgcctttccagagtccaggaggttagatgggttgggcttccccagccaattgacaaaaacgtgcctgtggtggatcacaaatgcacttgtgtgcagtcagagattgtttccactcttagttccttcagcaaacttcccgacgggccccaggcctccttctggtctctgaaagctgtttctaagctcacaggttcttagggcgatctccactgcccgaaacatcctctccctagctggaaaccaccttctggatccgttcccgtacttcctttggtcccaaggccaacatcatctcagctacaggaggtccttgctaagaacaaaaagagcaaatattgccttactaccttaaacagcctaaagaactgaagctcagccttagtctgcagaaattattcccaggccagcccccacactgctgcctgtgttctgaggatcagtgcttgtgttatttccctggaaaaggatgggtcctaagagcctgtttctcctccaaccaccgcccttttttttttttttttttgagatagagtctcactctatcacccaggctggaatacaacggtgcgatcttggctcactgcaacctctgcctcccaggttcaggcaattctcgtgcctcaccctcccaagtagctgggattacaggcgcaccaccacccccagctaatttttgtatttttagtagagacaaggtttcaccatgttgcccaggctggtctcaaactcctgacctcaggtgatccacctgcctaggcctcccaaagtgctgggaatacaggtgtgagccaccgtgcctggcctgattttcccatattaagtaagctgttgctaggtctgttatccccaataaactgcaaaccccatggaggcagagattatgtatgtgtgtttaattctatattgtattcactgtacctaacacaatgcttgcacatagtaggtactcaatagtgtctgttgattgactaaatgaggggagtgatcatgtttcattcacctttgtatactcaatattgagctcagtgcctgccaggaaatgtaagttcaaaggatcaatgaggggctccagggaacaatccaacccgtgtccctgcctcacctgctgtccactgagggccatccgaaggagtttcatcacattactgtacttggtgccttccagaccttctgatagcttcttcagttctccattcagcatatcctgagttaagctcatactagatctttctagaagcctagaagaagagggccagtttacagggcctgcatgggccaatggcaagtgggtgggaggaagggcttcagaaggttattgatcagctacagtacgagcagcacaaccaatgttcaagcctgttttgagggaggtgaggaagatattgaccactttctcccttatccaggtcgggaaggaaaaaccaccaagggaccacacacagagaagccagtggtcacaatgcagggaggtaagaggtgccataagaggctttactcattgctacctctgtgtcatgcaatctttatgcctcagttttctcatttgtaaagtggggagaataatagtatctgaggctggcgcagtggctcacacctgtaatcccagcactttgggaggccaaggcaggcagatcacttgaggtcaggtgttcgagaccaacctggccaacatggtaaaaccccatctctactaaaaatacaaaaatattagccagggatggtggcgggtgcctgtagtcccagctactcaggaggctgaggcagaagaattgcttgaacctgggaggaggaggttgcagtgagccgagattgcaccattgcactccagcctgggtgacagagcgagactttgtttcaaaataaaaaaaaaaaaataatagtatctgtcctgcacaaggctatcgtagagagttaaaacttataaagcaccaagtgcctgaacacatgataaatactcagaaatattacctttttttttttttttttttggagatggagtctcgctctgttgcccaggctggagtgcaatggcacgatctcagctcactgcaacctccacgttccaggttcaagcgattctcctgccttagcctcctgagtagctgggattacaggcacgtgccaccacgcccagctaattttgtatttttagtagagacagggttttaccatgttgatcaggccggtctcaaacacctgacctcaggtgatccactcaccttggcctcccaaagtgctgggattataggcaggattataggcgtgagccaccatgcccggccaagtattacatttcgtatttgaatttaaaatttttaaaaattagttaagtacaatcaagagctttgagacattacaaaaggatctaaaaagaaacagttctgcttgcaggcacaacaaaaaagaaacttaggaatagatttgacatagaatggataatttctgggaaattatctgaaatacagctttaagattggtagagagagacttctttggagacgtagccaagaagagaagaaatcagaagaccccacccagctccagcaatggctctgccaccaacttgctatggccattcttccacaaattgaagcctctaggattccagcgggccagcaaccaacccccacatcctggcagtccagctgagcaagatgctctgcccaaaagcttttgtttcaggagaaattctccattcagttagaggtggacttaacaaaaatttgcctcggccctgattgagttagtcaagagatgggaataggctggggatgagtatatttcactgcaactttccagttcctctcagtttttaaaaataattaattattttttttttaagacaggatcttgctctgtcacctaggctggaatgcagtggtgcaatcacagctcactgcagcctcaaactcctgggctcaaacgatcctcccacctcagctgcctgagcagcttggaccacaggcacccaccacgatgcctggctaattttatttttaccttttgtagagatggggtcaagctatgttgcccaggctggtctcaaactcctggcttcaagtgatcctccccattcaccctcccagaatactgggattacaggtacaagccacagtgtccagcctcccttcagttattactggagattccaacatggaaacactgaagaggaactggggctggacatctttctggtgcagatggtctgtgatgtcagttctgaccctgcctgctcaaacatggtccaggcaactgcattccaaagtcaactcagtatggaccactactgtctcagggaactgggttcataagtgatttgaagaagcagcctttcagtgcagacagatctccttactaactgtcagcactgaagcagatgagtttcaatttcagacaagagtgatcgttctttttttttttttttttttttgagacagagtcttgctctgtcgcccaggctggagtccagtggtgcaacctcagctcactgcaagctccgcctcccggattcacgccattctcctgcctcagccttccgagtagctgggactacaggcgcccaccaccacacccggctaaatttttgtatttttagtagagacggggtttcaccgtgttagccaggatggtcttgatctcctgacctcgtgatcggcccgcctgggcctcacaaagtgctgggattacaggcgtgagtcaccgcgcccagcaaaggatgatcgttcttactgcatcatctctatgttcggaatgtttgtgttcccctaaattcatatgttgaaattttaacccccaaggggacagtattcacaggtgtgggctttgggaggtgaacaggtcatgcaggccgagcccttatgcacagatgagtgcctttataaaagacaccccagagagtccctcgtccctccaccacgtgaggatgcagcgaagggctggaaaagggaagggcccaggaacaaggctctcaccagacactgaatcggcggcaccttgaccctggagttctagcctctagatctgtgagaaataaatgtctgttgttgaagccaccagtctatgttattttgctatagcaaccccatggactgagacaattattaactgggtcacatgagtactgctatttacaaaaatcaggagatgaaatactgaagacaaaaaatataatgtgggaaaaaagcagacactctccccaatggcactgcagggaagcaggctgccgaggagctgatgaaacaatgacaggccccaggccgggaacaatggcagttccagacctgctagagctggcccagagttaagaaccatggcataggcacagaaaggatttctagtgatctggcagctcctgaacatttgggtatcagctttcctgactcgagagggagtcccagagcaaatctaaaacccaacctcatggtggagacaggcagttacgacactgaatcctggtgaattagaactaataggccctggccagacactatggctcacgcctgtaatcccagcactctgtgaggctgaggtgtgaagattgcttgagcctaggagtttgagaccagcctgggcaacatggcaagaccttgtctctacaaaaaataaaaaaattagttgggcgtggtggcttgtgcctgtagtcccagtttctaaagaggctgaggtgggaggatgagccctgagctgcttcctgcagattgctacataatggagaaatgtacttccacaaaggacatgcgctgtcatttcttttgtctggtagagagtcttgccctctagttacctgatacacagcctctgcaggaaaagtggtcagcatcggcgagtaggggcagaaggggaaaggcagagagcgaaagcgaatcttggtaatggagtaccgactcctgcattaagctgtgcctcaagcagcccttcttctagcatctacagttacataagcaattattcccctcttgcctaagccagctttggttgcgtttgtaattgaaagttattactgttacagtaagaattagcatcatctctctctcactgagaaggaaaaggaagctcaaataggtacagtaacttggccaaagtgaagccgcctgagcaaggtgacataatctggtgagtacacggcagagctgggatgcaaccaggttggtgcaagcagtgaacacatgcctatgtccagagaaagcccgggttctccgggtaagccctcctcaccagcgaaagccagtgaagggtcacttcttcactggccatggagttgtgctggggccccaacagcccagccctgaaggaaagagagccatgggacagagagagggaaggagggtgtggaaccctgagctcagcctgcgggtactcaccccagcacacgcttggcaatcacatccaccttctccgagatggcgtccagctgtgctcgacctactgcagggcgagtccacaggtaagagtatactggggacaccaagtcctgcaggcggcaaatgtgaccctggggaaggaggcagtcattgaatgcactagggacagggctctggaaggcaggaggaattgaggcacccagtaacccctccctcagcttcccagaatcctgacaccacacctgtctcagcaggaggatcctctccacgtagactgggttgaggacatccctgttttgcagctggcaaccaaaggcctcctccacaaggacctgcagcttccccaccagctggcgcctctggctctcattgctcaccagccgctggaggtgcagtctgcggaagaaatcaaggggctgccctgctgtcaacaccccaacccacccaaaccgtctctcccccagggaaagggtgaagttggaagaatgacatatcaggtcccatgagccctccctttcgcaagctagaagaatctcttcacgtttataaaaagaaagggatgtgactaaggtcacaaacagcctgaaagtcccaagcaactcggagacgtgctttcttttcaggggtttggtttttgtttttgtttgagagtcttgctctgttgcccaggttggagtgcagtaccacgatcatggctcactacagcctagacctcctaggctcaagcgatcctcccatctcaccctcccaagtagctgggcccacagacacacatcaccatgcccagctaattttttagttttttgtagagacagggtcttgctatgttgtccaggctaggcaacaacaagcaatccacccagctgggctcccaaagtgccaggattacaggtgtgggccaccatgcccagccacgctttcagtgttttcaaaatagtagctgaccttttatttttatttatttatttttgagacggagcctcactgtgtcacccaggctggagtgcagtggtgcgacctccgctcactgcaacctccgcttcccaggtcacctgccactcagtcctgctggacctggagaagcttttggccaggtgcagtggctcacttaatcccagaactttaggaggccaagaagggaggatcacttgaggccaggagtttaagaccaacctagcaacatggtaagatgccatctctacaaaaaaaatttaaagtaacaaaattagcctggcatggtggtacacacctatagactcagctggtctggaggctgagggggaaggatcacttcagcctgggagtctgaggctgcagtgaaccgagatgtcaccactgcactccagcctgggtgacagggcgagacccagccactaaaatatatagaaagaggcattttttttttttgagatggagtttcactcttgttgcccaggctggagtgcaatggtgtgatttcggctcactgcaacctccacctcccaggtttaagtgattctcctgtctcagcctcctgagtagctgagactacaggcgcccgccacgtcgggctgatttttttttttttttctatttttagtagaaatgtggtttcaccatgttggccaggctgatctcgactcctgactcaggagatccacctgcctcagcctcccaaaatgctgcgactacaggcatgagccaccgcgcccagcctacatccactcttgaatgccccattcaaaagatgcccactgtttactgtgtgaactttggctagtttctttcttttttttttgagacggagtcttgttctgtcacccaggctggagtgcagtggagcgatctcggctcactgcaagctccgcctcctgggttcacaccattcttctgcctcagcctcctgagtagctgggactacaggtgcccgccaccacacccggctaagttttttgtatttttagtagagacggggtttcactgtgttcgccaggatggtctcgatctcctgaccttgtgatctgcctgcctcggcctcctaaagtgctgggattacaggtgtgagccaccatgcctggccactttggctagtttcttaacctctctatgtcctgggttcctcatacgtgaaacagggcaaaatcatacaactgacctcataggtctgatgggagaagtaaataaagtaatagccctaaaatatctgcaactgatgttaattctctgggctcatgcaagtaaatgcactgatactgtgtccccaaaccagtgctctaggcaaagtatcaggaagaccctcaccccaggtgcacacctggctgatggtcttgcaaaccactaataactttttttaaagacagagtatcactttgttgcccaggttggagtgcagtggtgtgatcctgtctcactgcaacctctgcctcccaggttcaagtgatcctcgtgcctcagcctcccaagtagccgggactacaagcatgtgccatgtccagctaatttttgtatttttagtagagacagggtttcaccatgttggccaggctggtctcgaactcctgacctcaggtgatctgccaaccttggcctctcaaagtgctagaattaaaggtgtgagccgccacacccagccgacactaataccctttgactcagacatgttaactatgatctgagttggaacgatatttggaggtttccaagtgaagagctacttgcaatatcaaatacatgaaatataaagtagatgccatgagacagtgctcactcactgtgttggctggatgtaaggctgagggtggggagggagtctaaaatgaagatacacctctccaggctttggttgttaacagagtccatgcaaggggtggctaggaacataatgttaatgataaaaatatacgtaccatttactgagcactttgtatgtgccagggctatacaagatattttcatgcaacacttaatacaagatactttcatagaacaaggatataagatcagtactgttattaatcccattttagagaagagaaaacagaggctcaaagaggctaggtgatttagccatggtcacacagaattaggtaccagagcccattataccctctgctgtagggatcatcataagcaagaaagccctttgccaccaggggatctccatgctccccactcacctgttgaattctgggagcttctccaggtccagcagggctgagtgacaggtgacctgtgtcaggttgaactgtgtgatcagctccggcagggtcctgcccatttggttctctgcaaagaagagaggcccagccactcagcttcctctctcccttcctccttccactttatctcttttttttaagagacaggatcttgctctgctgcccaggttggagtgcaatggtacaatcctagctcactgtaacctcaaactcccaggctcaagcaatcctccagcctgtcttccaagtagctgggactacaggcacatactaccgcacctggctaatttttaaatttttctgtagagccaggcatggtggcttacacctgtaataccagcattttgggaggcagaggtcggcagatcatgaggtcaggagttcgagactggcctggcaaacatggtgaaacccatctctactaaaaatacaaaaattagccaggtgtggtggcgcatgcctgtaatcccagctactcaggaagctgaggcaggaaaatcacttgaacctgagaggcggagattgtagtgagctaagattgtgccgttgcactccagcctgggcaacagagcgagactctatcaaataaatacatcatacacacatacatacatacatttttctgtagacatggagtttcactatattgcccaggttggtctcaaactcccaggcttaaatgatcctcctgcactggcctcccaaagtgctgggattacagacatgagccactgtgcccgccctccttctactttcaaacataagggaggctgagtgagcaagccctgggccccccattccactttgcccaaagggatttaacttctagctatttatatatcaagagcctgaatgagctttcattttcagaaagggttccatcattaaagaaaaaaaggtctgaaaacaatcaggctaaacccatctccattactctcaagacacgagctgcagaacagtacgcccattgcctggctgtaccagagactctgagtcaactgggtttggttggggtctgagcatattttagaagcttcctagctgattccaaagcacgatcaagagttaagaaccaggccaggcacggtggctcacgcctgtaatcccagtactttgggaggccaaggcgggtggatcacctgaggtcaggagttcgagaacagcctggacaacatggtgaaaccccatctctactaaaaatacaaaaattagccaagcgtggtggcgggtgcctgtaatcccaggtactcgggaggctgaggcaggacaatcgcttgaacccaggagacggaggttgcggtgagccgagatcgcgccattgcactccagaatgggggacaagaagttctgtctcaaaaaaaaaaaaaaaaagttaagaaccgtagtgctgggagctgcttcttgtgagcagcagctcagtcccatacggtcagcaggcatcgtgatcaggcataggcctaaagcgctatatccctcactaggtgtgtgactttggcaagttactcagcttctctgagcttcacaatcctcttacaaacagtggagatatgtatctaccccttaatagtatgttgtgttaaatgaaatgagaccagcaggcaggctattctggacacattttcagaaatccttcaggtcatcctatttgatgcttgcttcttcaaggtttgggtctaagtcttggaccatgggtaagtgctcagcttgaaataaactagattcatctggcagtaaaatgaagaaggaaaaaaagaaactaaatccatattaattctagtcatactgttagcatacatgcttgtaataattgtcacaatcatagggtctgtcattttttgtgcttacagtgtgacaggtgctgggctgggtaccttacactcctgagctcagtgaatcctaacccaatgaggtagacacttatccccattttccagatatgcaactgaggctcagagactataagtcccttgagggcagggatcatgtctatctcacccactactgtagccccagcacttaatgtggtgtctggcaaaataaacatttattgaataaaagaataaacttgtccaaggtcacctggctggtaggtggcaaagctgggaccaaagagcaggactgtctgagccaaagccctgctcctcctggccatgctctctgctgccaggactattcaggtgggcacgtacctgcaaaacctgagccacagttggtgatgatgtccaacaaggaatcgggcaggaagccatcagcagcaaagtgctccaggaaaacgtccccttgcctcttggagagcttgctgccatccctgttgaggagcaggggcaggtgggcgaagtggggtggctgccagcccagggcctggtagaggagcaggtgcttggcagtggagacgagccactcagagcctcgcagcacgtggctgatgcccatgtggtggtcgtccaccacgcaggccaggtggtatgtggggaagccgtcgctcttcatgatgactgggtctccctccacgctggccacttcatgcctattccagccatagaccaggtcctggaaggctggcaccacctgctccaggcggaagcggatcgcaggcttggggtccttggccagcttctgggccacctgctcctggctcatgttcctgcaccgattgtcatacctgatggggagcagagcagcatgagtactgttgatggaaaggttgatggacaggagtcctacctctgtcatagctgtgtgaccttaagcaagtcagttactgctgcaagctgcttcctcagtctataacagggatgatggtacagttgtgtggaaaactgagataacatggtgtagcagacactaatgtctgcctatctaccagccattccacgcttcttccttgctaacaagaaaatagcaaaatgcttagtccgaggggttgaatcctgattggtatagccaatcttgcaatcctattgctccatgccagtgaccagtccaggcaggaatgtaaccccatcctagtcactgggatgcaaagaaaagcatgcctggggagtaagaaaggtttaaggttccgggaaaggtttttctctccaaaggacaagaagagaaagccacaggaggaaaatcccttcttaaaatttcccactgccccacttctgtcctctttggatgttgtcctgtaaggggagcatgcttggacctgcggcagctacttgcaactgcaggagggaaggcaatgaagtcagagagaagccaaaatagagccctggtgtctctacactgctagtctcatcctggagtcacccacctccagccttgtgcagaatcaaaagacaaatgtctatgattgatgccctggctactgaaagtgtggtctgtgggcccctagcatcagcctcttgggagtctgccagaaatgcagactcttaggctccaccccagacctactgagtcagaatctgaacattaactaggtccccaggtgatccatctgtgagttaaagtatcgtttgtcccttctaacagggtattccactaactgcacccaaaagcgttctgagacacagatggaatgcttgtaaggttagtctttgccacagctaagtgttcaatcaatcaataaatggtgcacagggctggacacagttgctcacgtctgtaatcccagtgttttgggaggtcaaggtagaaggacagcctgacctcaagggttcaagaccagcgtgggtaacatagcaaaatcctgtctcttatttaaaaatttaaaataccagcctgggcaacatagtgagactctgtctctacaaaacaaaacaaaacaaaatcagccaggtgtggtggtgcattcctgtagtcccagctctgtgggaggccaaggtggaagaatcactggagcccaggaggttgaggctgcagtaaactatgatggcaccactgcactctagcctgggtgacacagcgagaccctgtctcaaaaaaaaaactttttttttcttttttttttttttttttgagatagagtctcgctgtgtcacccaggctggagtgcagtgtcgtgaccttgactcactgcaacctccacctccagggttcaagcaattctcctgcctcagcctcctgagtagctaggattacaggtgcctgccaccacaaccggctaatttttatatttttagtagaaatggggtttcaccacgttggtcaggctggtctcgaactcctgatctcgtgatctacccgcctcggcctcccatagtgctgggattacaggtgtgagccaccgtgcccggccaaaaaagaaatttttacaaatgagtcagttgcacatgagtgaacaggagggtgttcagctgcagaagcagggcagcattatgtctgaatcaaaggaacttgtttcttcaagctcttctggcaggaattctgacagtgagtttgacaaaaagttaaagaagaaaaagtaagttgctccagaaaaacttgtaaaggaacaaaagactggcaaaactttgggagctctgtcatcttccaaacagagcagcggcagtaaacataataacatgtttattttcttttttaaatttcatatagagatggggtttcaccatgttgcccaggctggtctcgaactcctagtctcaagtgatccaccctcctcagcctcccaaagtgctgtgattagattacaggccactgtactcagctgataacatgtttcagattgggaaaatgaggtaccttagtgtttgggatgttaaaggggaagtgctaattgatggtattagagattattggatggatctcaaaggttaaataaaaccaggaagaaaaggtatttctttaaatccacagcaatggggccagctgaagaaacattcattcattcattcatttactgagacaggggacaaggtctcactctcgttgatcaggctggaatgcagtggtgcaatcatggctcactgcagtcttgacttcctgggctcatgtgattctctcatctcagcctcccgagcagctaggactacaggtatgcacgactatacccagctaattttttgtatttttagtagagacagggtttctttcttttcttttctttttctttctttttttttttttttgagtcagggtctcactctgtcacccaggctggagtacagtagagtgatcacagctcactgcagcctagacattcccaagggtaaagtgattctcccacctcagcctcccaagtagctgggactacaggcgtgcaccaccatgcctggctaatttttgtattttttttagtagaaatgggggctcaccatgttgcgaaggctgggctctagcaatctgcccaccttggcctcccaaagtgctgggattacaggcatgagccaccgcacctagctggaacagatattctaatcgatacattgatgatgcagtaagaaaactgtaaagtctgagccatacaaaacctacactatcctagttgggtttttttgttttttgttttgagatggagtctcgctctgtcacccaggctggagtgcagcggcgtgatcttggctcactgtagcctctgcctcccaggctcccaagtagctgggattacaggtgcacgccaccatgcccagctaatttcagcagagatggggtttcaccacgttggccaagctggtctcgaattcctgacctcaggtgatctgcctacctcagcctcccaaagtgctgggattacaggcgtgagccaccgtgcctggcttctagttgtattaatctgtctttttacattggcttctgttttctaaatgttgttctccaagctgtcatatgtttggattacagaacaacttgtaagatgaatacttgttttaaatgtgcattattgaatatgttctgtccaagtgcggtggctcactcctgtaatcccagcatttcgggaggacaaggcaggagaactgcttgagcccaggagttcaaaaccaacctgggtaacgagaccttgtctctactagaaatttaagaaaaaaaaagaattagccgggcatggtgggtacatgtgtgtagttccacccacttgggagactgaagcaggattgcttgagcccaggaagtcaaggctgtggtgagtcatgattgcatcgctccagcctgggtgacacagcaagaccctgtctggaaaaaaaagtcctaagggaagctaactgtcagctttattaagaaggattgctttgtacctaccacctaatgtaaaataaaaccaagtaatacattctcaacagttatggcccccctccttttttttttttttttttttttgagacagggtctcattctgtctcccaggctggagtgcagtggcacaatctcagctcactgcaacctccatctccctagttcagctgattctcctgcctcagcctcctaagtagctgagattatgggcacacaccaccaagcccagctaatttttgtactttaatatagatagggtttcaccacgttgcccaggctgcagttgtgtcctttttttgctcataagagctagtactgtttaaggcccaaagtaatagtttttacagatcttttagtttcaactaagcttttacaatagaaaggacttgtattgcattgagtttataaacttttggtttgtgaaatccatacttgatctgttcttttccaaccaaatgtctaggcttgacttttccaccccaatgacatttcactttattaaatattagcagatatactttgataaccaacacagcttgtatgaaaactgagcaagtgtccatcatgacccatagggttctgggtagttgttaccttactgtttagtccacaaaaaataacgacttagataagctgtctgatttgctttcgcttattaaacacgttcaccatgagatgatgtgtgtaacatcagataccgttaaattagactaggatttaatacaaatcctgaaagcttaaaataaataaataaataaatggctgcaaggattccacaacagggcatgactataatttaacaaaaaaaaaaaatctgttggccaggcatggtggctcatgcctataatcccagcactttgggaagctgaggtgggaagatcgcttgagtttcataccagcctgggcaaaataggggaattccatctctacaaaaatttaaaaactagctgtgtgccagccgggcatgatggctcacacctataatcccagcactttgggaggctgaggtgggtggatctcctatgctcaggagtttgagaccagcctaggcaacacggagaaaccccgtctctaccaaaaaatacaaaaaaaatttgccgggcatggcggcacacacctgtggttccagctgtttgggaggctgagatgagaggactgcttgagcccaggaggcagaagttgccttgagccaatatcacaccactgcactccaatctgggtgacagagtgagaccccatctcaaaacaaaacaaaacataacactctgtgtgtggtggtacatggctgtggtcacagctacttgagaggctgaggatgtaggattgcttgaacccaggagattcaaggctgcaatgagctgtgatcatgctactgcactccagcctgggtcacagaatgagatgagaaaaaaaatattctgtcaagagacaaatacattgtttataataaaaaggcaatgtcaccgtaaacgtcatgaccttggccaaacagctgagcccttgaccaaatagttcactggaactgcaatgtaaatgttacaatgctattgcagatgggagtgtaaacaagtaaagggccagccacttggcagtatccatcaaagctacaactcgactctgcaattccacctctaggaaggtattcagcaaacatactgcacaagtgcaaaatgacatatgtcaacattagtcatcacagctctcttcttttataaccaaatattagaaataacataaaggtttgggctgagcgcagtggctcatgccagtagtcctagcactttgggaggccgaggcaggtggattgcctgagctcgtcctagcactttgggaggccgaggcaggtggattgcctgagctcaagagttcaagaccagcctgggtaacacggtgaaaccccgtctctactaaaatataaaagaaaattaaattagccaagtgtggtggcatgcacctctagtcccagctcctcaggaggctgagacaggagaattgcttgtatccaggaagtggaggttgcagtgagccaagatcacaccactgcacaccagcctgggcaacagagcaagactccgtctccaaaaaataaataaataaataaataacataaaggtttattaaggccgagtgtcgtagctcatgcctgtaatcccagcactttgggaggccacttgaggatcacttgggcagatcacttgaggtcaggagtttgagaccagcctgaccaacatggtgaaaccccatctctaccaaaaaaatacaaaaattagcagggtgtggtggcgggcacctgtaatcccagctactcgggaggctgaggccagagaatcacttgaacctgggagatggagattgcagtgagccaagatcttgccactgcactccagcctggggaatagagcaagactccatttctaaaataacacaacataacataaaacaaaacaaaacaaaacaaaaataaatgtttgttaagacgaaactgattaagtaaatgaagttatatccacaaatggaatattatgcattattatggactgatatctgatcctcaagatggtaagcggacatggtaaattgcaccacatagcatgtacatagtacattgcatgctaccatgtgaataaggaaaaagagaaaataatatgtacttataggtatatgtactgaatgtctctggaggagacataagaaaattttaacactggttatctctggagagcagaattgagtggccagagtcaagattggaagagagttctttcaatatatatctttgtggatcttcttttttttttttttgagacagtctccctctgtcacccaggctggagtacaatggcacaatctcagctcactgcaacctccaccttctgggttcatgcgattctagtgcctcaacctcccaggtagctaggattacaggcgtgcaccaccaagctcagctaatttttttttttttttggagatggagtcttgctctgttgcccaggctggagtacaatggcatgatctcagctcactgcaaccttcgcctcccaggttcaaattattctcccgcctcagcctcccaagtagctgggattataggcacccgccatcatgcccagctaatttttgtatttttgtagagatggggtttcaccatattggccaggctggtcttgaactcctgacctcaggtgatctgcccacctcggcttcccaacgtacggggattacaggcatgagccaccactccaggcctaatttttgtatttttagtaaagatggggtttcaccatgttggccaggctggtctcgaacttctgacctcaagtgatctgcccacctccgccctcccaaagtgctggaattacagacgtgagccaccatacttggccctttgtggacctttcatttttctttttttttttttttttttttgagacagtgtcgctctatcgcccaggctggagtgcagtggtgcagtcttggctcactgcaacctccacttcctgggttcaaatgattctcctgcctcagcctcccgagcagctgggactacatgcgcaccaccacgcccagctaatttttgtatttttagcagagacggggtttcaccacattggccaggctggtcctgaactcttgacctcgtgatccacccacctcagcctcccaaagtgctgggattacaggcgtgagccaccacgtccggcctgtggaccttgctcattaaaaataacaaataattaaaattactttacacattactttctgagaccaaatcttggcttctaacatagccccagtcattctcgccttctggtgtttctgtccttgtgtagtcccctccccttgagtgtgggctgggcctagtgacttttgtctaatgaacaaaaataatgccaaatatgcctaatctgaaatgctccaatggtccaggtgcagtggttcacgcctgtaatcccagcactttgggaggctgaggtgggaagattgttcgagttcaggagtttgagaacagcctgggcaacatggcgaaaccctctctctattaaaaacacaaaaattagccaggtgtggtggcatgtgcctgtagtcccagctacacaggaggctgaggcacgagaatcccttgaacccgggaggtggagactgcagtaagctgagattgcaccactgcactctagcctgggtagcagagcaagactctgtctcaccaaaaaaaaaaaaaaaaaaaagtcaggtgcagtggctcacatctataatcccagcactttaggaggccaaggtgggaggattgcttgaggccaggagttcaagaccagcctgggcaacatagtgagatccccatctttatgaaaagtttaaaaaaaaaaattagccaggagtacagtcctagttacttgggaggctgagatgggggcactgcgtgagtccaggagttggaggctgcagtgagccaacatcacaccattgcactccagcctgggtgacaaagtaagaccctgactctatgaaaaaaaacaacaacaacaacaacaaaaaaaaaaccaaaaaacctgatctggctgggcacggtggtttacgcctataatcctaacactttgggaatctgagaaaggtggatcacctgaggttggcctggccaacacagtgacacccgtctctactaaaaatacaaaaattaaatgggtgtggtggcgggcacctgtagtcccagctacccaggaggctgaggcaggataactgcttgaacccaggaggcagaggttgcagtgagccaagattgcaccactgcgctccagcctgggcgacagagtgagactgtctcaaaaaaaaaaaaaaaaagccacaactgatctgacatttgaaaccttttgagtgctgacatgatgccataagtggaaaatacaacacccaaacacatgtgacaggctacagtcaaaatagtcaaaactttgtttcgtgcacaaaattatttaaaatattgcataaaatcacctccagcctatgtgtataaggcgtacatgaaacataaatgaatctcatgtttagacttgggtcccacccccaagatatctcattatatatatgcagatatttcaatatgcaaaaaatctgaaatccaaaacacttctggtcccaagcgttccagagaaggaatacatagcctataaaacaaaagtggtgagaagttgcttccacaactaggtagactccagctcgtacgtgctcactctctccttggctggctttgagaaatgctggctgccacgctgtaagctgctctatggagaggctcgcatggcaaagaactgatgtctccaggcaacagctagcaaggacctgaggttggccaatagccttctgagaggagatggaagtagatcttccccaagctaagctttaagagaactccaggactggctaggacctgtagttgcttgtggctttgagagaatccctgagccaaagaaacaggtgaggccacgctcagatgcctgacccacagaaactgagaggtaatacatgtttaggggaatttcttacgcagcacaaggtaacaaacacacccaatgttgatgaggcatctgcaacaagctgaggttcttaccggggcgtctggtggttccgcaaggcctccttcttcaggagctccagccgctggggtgagcagaaacaggggtaagcagctccggtcttcagcagcgcttctgtggcctgggcatacagctccaaccgctgagattgctggtagggcccagcaggaccgccccggcgggggctctcatcaggcgggatgcctggaacacagggaataatgacagctaaggtgcacacagcgctcgttctcaggcattgctctaagcactttatgcacatattaaagctttaatcctcataacaatccatgaggttggcattagtacaatgtcctccccgccgcctttttttttgaggcagagtcttgctctgatgtcgccaaggctggagtgcagtggtgcaatcttagctcactgcaacctccacctcccaagttcaagcggttctcctgcctcagcctcccgaatagctgggattacaagcatgtgccacctcacccagctaatttttgtatttttagtagagacagcgtttcaccatgttggccaggctggtcttgaactcccgacctcaggtgatccacctgcctcggcctctcaaagtgctgggattacaggcgtgagccactgcacccggcccaatgtcccttttagagatgaaaagttaaaacacagagaggtgaagcactcaaagtcgcatgggctcatggactaaggagcaaacggaggtgtacgggctccaaagtccacatccctaattgtatgtcctctcaatccctgatgggattccctggagagggagaaacaagcccaggcctgggaacagctgacttaggagaaaaaagcatggttcagagaacagcccatcaggccctggtgggactcatggctctgccacttagtagctgtgacaagggatcctgaggtgctaccaacgtgtgagcaccagggtgctgagtgccataaaagacacttttccctgaagcctcaaacccaccctaccaggtaggtgcggttattcccccactctgtgaggacactgaggcacagagatgctttgtcacctggccgagtagaaggggcacgatcagcttcaaacccagactaatgggcaccggagccgatattcttaaccactcattacactgctgtttgtgttacttagcctttctttttctaagagatggggtctcactctatcacccagctggagtgcagtggtgtgatcatagcacactgcagcctcgaacttccgggctcaagccaccctcctgcctcaacctcccgagtagctagaactacaggtgcacatcaccacatctggctatttttttagtagagagcgagtcttgctgtgtcactcaggctagggtgcagtagtgcaatcatagctcactacagtctccaatttctaggctcaagtgatcctcccacctcagcctctcgagtagctgggattataggaatgtgccaccatgcccagctagacttaatctttctaagcctcagtttcctcttttgaaaagtggagctagcagcctcctgtgcagagggaattgtgagaacaaatgtgtcagtgcttataagcacttagcccagtggtgtatatttaggacagtttcaatatatgctatagaatagattaaatatgatctactgtaagccaaaccccaaacccaaagtccaattccctccgattacataggataaatttcattatgaatgctttcaggagagggcacagggacacaagaactggaagatggtgtttctgccctcaaagagctttcaaaggaattgggaagataaggacattgttcaccttgctaccctcaatgctaacacaaactgagctgagtgggcctgggttcaaacgtaccagccagctcagagatcttgggcaagtcatctttctgggctctgggttctcatctgtcaaagaaggaaacaagtagtaactttctcatgaggatcatcatgagactagagtaagatgatctaagtaaagtactcatcaagtggcctgtgaccggtgctctctatgctttggtatttatgtatttatttatttgagacagggtctcactctgttgcccaggttggagtgcagtggcacgttctcggctaattgaagcctcaacctctcaggctcaagtgatcctcccacctcagcctcccaagtagctgagactacaggtacatgccaccaggcctggctaactttttttaagttttctatagagacaaggtctgcctatgttgcccaggctggtctcaaactcctgggctcaagtgatcctcttgcctcggcttcccagtgttgggattataggcgtgagccatggcacccagccatctgtgattatcagtgttacttggctccctctcatgggacctccatttcttcatttgtcagaaaggagggctaaatcgggtaaatttggggggatcccttcctgatctaatgctaaacaagtctctttaatgtggtatcttggaatgccccagggtttaagagggactcccctaggagaactgaaaacatgttaacttaaactctggcatgtaaatgttcatagagttttattggacagccaaaaaccagagtaactaaaatgctcattcactagtgatgaataaacaaaatgtggtataaccatatgatgaatattatttggctataaaaaggaatgaagcatgatagcccacagatgcgcttatggtaagtgaaggaagccagtcacagaaggccatatattatatgatctcattcatatgaaacgtccagaagaggcaaatccatggaggcagaaagagatcagtagttgccaggtggtaggagagggtagaatggaaaacaactgctaataaggaagagtttcttttaggggtgatggaaatgttctggaattagtggtgacggttgcgcaacacagtaaatatattgaaaaccactgaattgtacactttgatatggtaaatttcatatcatgtgaattatatgtcatttttttttccccgaagacagagtctagctctgtcacccaggctggagtgcagtggcacgatctcggctcactgcaacctccacctcccggttcaagcaattctcctgcctcagcctcctgagtagctgggattacaagcatgtgccaccacgcccaactaatttttgtatttttattagagacagggtttcaacatgttggccaggctggtctggaactcctgactttgtgatccgcctgcccagacaagagccaccccatgtgagagccaccacgccttgcttatatgtcattatttttaaaaggctgggcatgctgggtcatgcctgtaatcccagcactttgggaggccgaggtaggtggatcatttgagctcaggagttcgaaaccagcctgggcaacatggtgaaacaccgcctctaaaaaaataataataatagccaggcgcggtggctcacgtctgtaatcccagcactttgggaggctgaggcgggcagatcacgaggtcaggagatcaagaccatcctggctaacacagtgaaaccccgtctctactaaaaatacaaaaacaaaattagctgggcttggtggcagacacttgtagttccagctactcgggaggctgaggcgggagaatggcatgaacccgggaggtggagcttgcagtgagccgagatcgcaccactgcactccagcctgggcgacagagcgagactccatctcaataaataaataaataaataaataaataaataaataaataaaatgaaaaaaattaaaaaagaaagaatgactcccaaagtaaggtgctccagaagtcagccaccatgaggtgcctgaatacctgccctctgcctcgccaaaacaccagggtgggggacaagctctgggctgcaagcctcattctcacaatgatgctgccccaggaattccacgagggtgggacccgccaccatcaccgttgttcatcactgtatccctcatgcctggcgtggtacctgataagtagcagatcctctgtgaaactgaagccttcatcttggtctgtgaggcaccatgtaatctggctcctggaaagccttttttttttgagacagggtctcacactgtcgctccaggctggagtgtaatggcatgactgacaggagacagacaaattcctaggcagtcagggacaggtccctggtgaaatctgacttctaagccaaagacagcctgaaaaccaaactgtcaagtcaggatagagtccatgactggagtgagaacttgtttccctgtctcacccactctctcgattggttccttccggatgatgttttaaccaactgaatggtcctttttccaagaccactcatggaccaatcggcaggcatgcccccattctaagcccataaaaatgatagactcagcctcacagatggctaccactttcagggtcccctctcgcagtggagagtttcccttctgtcattcaataaaattcttctctgccttactcactctatggtacctgcacacctcattcctcttggttgcaggacaagaacccaaaactcgccaagctgcgggtgacgggaataaaagagctgtaacacgctcccgctcaccagactacaggagaaagagagctgtaacacgctcccactcaccaagctacaggagtgaagagctgagacagtgctggggactcagatctcaggactccccaaacaagagctataacaccccttggagctccacaactgatggtatttcccaagtttttgggtgccaccatgttcccctcatctagatgccagcacccaacacagaagccactcgtggcacacccagtccagccatgggctgagtgtggagccatggcaggtgtgggatccaagtgggcatgagccaagtgcagcctgctgggccaaatgggcccagaaggcccaagcgaggccccgacagaggtgagggcagctgcagagatttctggctggcaaagtggcactgaaggaattctgtaacatgatcacagctcactgcagcctcaacctcaacttccccaggctcaggtgatgctcccacctcagcctcccaagtagctgggactataagagtgcaccactacacctgggtaattttttgtagagatgaggtctcactatgtggcccaggttggtcttggactcctgggtccaagtgatcctctcttcttggcctcccaaagtgctgggattccaggcgtgtacccctgtgcccgacctggcaagccttctatcctcacatccctggtcattctgctcactatggttagaccaagctggtctttttgatgctcctcaaatacatctagaacactcctgctgtggggcctctgcattggctattctttttgctttgaacattcttcccccaggtcaccacggggctggctcctcacttcatgcaggtctctgctccagcatcacctcctaagagaaaactgccctatctacaagggcatccctcgccctagtttctaagcctgttactcttttctccatactggttattatcatttagtatcctatgaagaatgaattaggagccaggagcgatggttcatgaccgtgatgccagcactttgggaggccgaggcaggagaattaacttgaggtcaggggttcaacagcagcctgggcaacatagcaagaccctacctctacaaaaacataagttaataaaattagctgggcatggtggcacacagctatggtgccagctacccaggaggctaaggtgagaggatcccttgagctcaggaatttgagattacagtgagctgtgtttgaaccactgcgctctagcctgggcaacagagcaagattttgtttgttaaaaaaaaaaaaaaagaaataattaatccactcatctgtcttttcccttggcactaagcacatggtcttttttttttttttttttttgagacagagtctcactctgtcacccaggctggagtgcagtgatgcaatctcggctcactgcaagctccgccttccgggttcacgccattctcctgcctcagcctcctgagtagctgagactacaggcacccgccaccacgcctggctaattttttgtatttttagtagagatggggtttcactatgttagccaggatggtctcgatctcctgacctcgtgatgcaccagcctcggcctcccaaagttttgggattacaggcgtgagccaccacgcccggccaaccattttatactctttaggaatccagagtttagtgagtaatttacctgagattagaacacacatctcaaaatagtcttggggtttttctttctttttttttcaatctctagactagcagagtcttggtatttttccttgggaatctcccctttcctagtcacacccgtccatacaggtagacaactgtcgacccatgaaaaggaaacacactcctctttgttctccctgaccttagctgtcctcaggataaaacttcccacaagatcaacttcagaagctgtacgtgttttgtgtggcttatacaacatggttaaaaaaaatctgagcccagatttaataatggttaagtattcatccagaaaaactggatttctggctcctcttgcaactcagaggattggacaagctgggccagcattcccgcatgggcacaaggagctggagctcagaggcactcccaactctggatgaggtgtggttttcacagctcagcactggcccagctcctccagttcccacttggccctgtgtttcctgcctggcccctgtagggaatgaacttgagattctgaggtgaaaacaggaatctcaaaacagccttggcagtggctcacacctgtaatcccagctctttgggaggctgtagcaggaggattgcttgagcccaggagtttgagaatagcttgggcaacacagtgagatctcatctctacaaaaaaattaaaaattagccaggcgtggtggtgcgtgcctgtagtcccaactacttgggaggctaaggtggaggatcacttgagcccaggtcgaggctacagtaagttatgattgtgccatggaactctagcctgggtaacaaaatgagaccctgactctaaaaaattaaaaaataaagaaaccaagttgggcgcggtggctcatgcctataatcccagcactttgggaggtcgaggcaggtggatcacgaggtcaggaggtcaagatcatccttgctaacacagtgaaaccccgtctctactaaaaatacaaaaaaacttagccgggcgtggtggcgggcgcctgtagttccagctacttggaggctgaggcagaagaatggcgtgaacccggaaggcggagcttgcagtgagccgagatcgcaccactgcactccagcctgggcaacagagcaagactctgtctcaaaaacaataaataaataaaaataaagaaaccagtcttggagctgtgtttcagagagcttcggcattttttcaggtgtcatctgccaccccgggcagggcagtacaaatgtagccacttctccaggaactccccattttccactcagaactccatgagaagacccacaggctccttttcctgcttcctgttccttccctgcagaaagatcctttctctgccaggcttacctgcccactccagcatgtcctcaatattctccgctgccccaggcacaacgcgagtctgatctgtgtcctctagcctcaggatgaagctcccctggtacttcttagcaaagatgtagttgtacaaggcagtgcggaggccacccaggtgcaagaagcctggagaagagaacagctcagataagacagggaagataagctaataggcctcagcaaggggcaagtaagcactactgtgacagaatgttgcaataaatttaaaagaccagcaggacacattggctcacgcctgtaatcctaccactttgggaggccaaggccggggggatcacttgagcccaggaggttcctgtaggttttttaagacaagagtctcactctgtcacccaagctggagtgcagtggcacagtcttggctcactgcaacctctgcctcttgtgtttaagcaattctcatgcccagcctcccgagtagctgggattacaggtgtgtgccaccacgtccagctacatgtttgtatttttggtagagacaggcattcgccatgttggcaaggctggtcttgaactcctggcctcaagtgatccccccagcctcggcctcccaagtgctgggatcacaggcaagagccatcacacctggccaatttttgtatttttagtaaagataggattttgccatggtggtcaggctgatctcgaactcctgacctcaagtgatccatctgccttggcttcccaaagtgctgggattacaagcgtgagccattgtgcttggcctgagtttgagatctgcctgggcaacatggtgagaccttgtcttagcaaaaaatataaaaatttagctgggcatggtggtacatgcctgtggtttcagttactgaggtgggaggatcacctgagcctggggacgctgaggctgcagcgagccatgatcacgcctctgcactccagcctgggcagcagtagagtgagactctgtctcaaacaaaaaaaattaaaaattaaaaaattttttttcaaagactaagaactagttacccctgtgccctgtctccagacacatttaatccctcatcctgaaaatggaaaccacccaggatttggagcatgtcattttattaaaaggctccaattttccccaactgcatccaccactctattttgatatttgtctcaaggccaagtttcgcctgaaagagaagcagagagttattcattgaggccatatcatgtacatttaacttacagaaattcaatgatgtgcgctgggaaaaaaattaattacaaacaaactagaaatttaaaatactgtacaatcatattgtgggccaggtgcagtagctcacacctctaatcccagcacttttggaggcagaggcacgaggatcacctgggtctctaaatttgagaccagcctgggcaacattgtgagatcctgtctctacaaagaaaaaaaaaatcggtggggcatggtggctcacacctttaatcccagcactttgggaggccgaggcgggtggatcacaaagtcaggagtttgaggccagcctggccaacatgttgaaaccccgtctctactaaaaataccacaaaaaaaattagctgggcatggtggtgggcgcctgtaatcccagctacttgggaggttgaggcaggagaactgcttgaacccaggagacagaggttgcagtgagccgagatcgcaccattgcactccagcctgggcgacagggcgagactccatctccaaaaaaaaaaaaaaaatcacattttgcatatgcagtctatgcagtgtgcatgactgtccacgtcgtacattttaaatttcatctacttgagatttttacttttttaaagaaacaaaattcatttttgaaatttgagatggggtctcactcttgcccaggctgaagtccagtggtacagtcacggctcactgcagcctcaaccacccaggctcaatcaatcctcccacgtcagcctcccaagtagctggaactacaagtgtacaccaccatgcccggctaatatttgttttttggttttttttttgcagaggcaaggtctcactatgttgcccaggctggtctcaaactcctgggctcaagcaatccttacacttcagcctcccaaagtgctgggattactggcatgagccaccatgccttgccaagattttcaccctaattgctggctttaaacactaaccaaaagtagtgtttgattccactgtatttctcttcatcagtttaaactcctaagatttgcctttttcatcattcctgtctgaaaactgaaagttaacagcttttccagagttgtcattacctcttaccgtaccttcttcggaccagcccacagccctaagtctccacaatgagctcatctacatttacaagtacaagaggcagcagaggagagaaaaagctcttctggggccaggccgaccctgcttcaacactgatgtgtgtaaccttcggatagttactgcaaggacaccagaaaaccagtggtattcagtggcactgagtcccacgagtccccaagacaaaagaggaacccagctgctgaaaacaaagcctcttacatcaagtacacctggattcaaattctgcatccaccatttattagttgctaccccttgagaaggaactctacttaacttttatgagcttctatttcctcatctgtcagagggattaagagcaaaaaaataagaaccttctttattatagggttgctctgaggtctaaatgctgaccaaagtaaaccctcaattaatttcagctactgtaatgatctgtgcctgataattcttttatctgtttatagtcaaaagcctttcccacatgggctttccccgcaaatgagcaaggaaatgagaagtacaatcatcataatagaggctgtgtattaagtgctttctgggtgtactagaccttactaagtggttcggctgcatgagcttaaccccataagacagatattattattagccccgttttgacaaatggtgaaactgaggctcagattcattaaataatttgcacatctaggccaggtgtgatggctcacacctataatcccagcactttcggaggccaaggcaggtggatcacttgagctcaggagttcaagatccgcccaggcaacatggcaaaaccccatctctacaagaaaatacaaaaattagctgggcgtagtggtcacacacttgtagtcccagctactcgggaggttgaggtgggaggatcacttgagccccggaggctgaggttgcagtgagccgagattgcaccactgcactccagcctggacgacagacagagccaaaccctgtctcaaaataacaataataatttgcacatctagtaagttacacatctaataagtggccacgacagaaatttggacccaggcaatcccaggctttggcattctacataagtgctcttcaaagcaaagtgtgcaatccagtgctggtctgaaaacagttgtcagttcacaatcaagtacagaaactgagagtaaaggtttagaaacttttgttgttgttttgagatggagtctcactctgtcacccgggctgcagtgcggtggcacgatctcggctcactgcaacctctttctcctgggttcaaacgattttcagcctcctgagtagctgggattacaggcctgggccacatgcccggctaatttttgtattttagtagagacaaggttttgccatattggccaggcgaaacttacatagcaatctggcagaatgattttacctctgctaacccaaataaaatgagattggtttgtattttggatgttttcaaaattttatttttctggtcattatattaattttgtgcaaatattgatacacaattgattggaaatttaaaaccagcacttccacaacagatggtttgaaaggcactgctctaggctatactgcctgccagaaagatcctgtcatgtatagctgggattttactacaaagatctttgtatgttcatcctgggatttgggatgagaggcatactccgtgtagagaacgtagaaggtagccttactggtgggaaccaaaaggccctgacgagatctccaacaggctatacaatgggcctctgtcaccctctagcttgctaagctcccaacagcactagcacagtgccttggtacctgcgatttcctctacccagaaggttccttcttttttgtttttgagacacagtttcgctcttgttgcccaggctggagtgcaatggcgcgatcttggctcaccgcaatctccacctcctgcgttcaagcgattctcctgcctcagcctcccaagtagctgggattacaggcatgcgccaccatgcccagataattttgtatttttagtagagacagggcttcaccatgttggtcagacggctctcaagtgatccacttgacctcaagtgatgcacccacctctgcctcccaaagtgctgggattacaagcgtgagccaccgcgcctggcctccagaaggttccttctataggcttcacatagcgtgctccttcttgtcatttggatctcagctcaaatgttacctgctcagtaaagccttctggagcgtccttcttaatccccagtctcctatcctgtttcacttcccgcatggcacatgtgactctaaaattacacttattttttataagtgtctgcggcagccactagaatgcagacttccacagagcaaggcccctacctttctcaatgatcactgtatcccagcgtctacaacacctgttacacaggttgtcatcaatgcacatgtatggaatgcatgaaaaaaagatcgaaagagatgggatggcacaaaaaacacaagaaactcctggcaatttgaattatttccgctcctgcacctcagtttccgcctctgtaaaatgggctcgcgctgccttaaccctcctccgcccgcccactctgacaccaccggaaaggattcattcgggaacattcgtggggcggagacgggacagggggcctcggcctgtagcgtcacgtccgccagggttacctgtggggctgggagcgaaccgcactcgcaccgcaaccccggcatcagtgcccaggttggcctcgcgccgtcctacggggcggccagaggccgccgaaggcctctcgcgctgcagcagtctcctcaggagcgccgccatgtgggatggaatagcacacgtgggcttctccctgcgtcacttccggggactgcttccagccaatcggcctccgccacagccagcgcagccttgccccttaaagtcacaggccccctagcgcgaaatcccacgcccccctggacggctgcggccgcactcgccaccagggggcagaggccagagaaagggctatttcccggacccgcccccttcagcttgggaaagcgaaagcgtggcaggggccggacctgggagcggaggaggcgggtctccatagaaacctccacctgtttccggccgggctgtgagagattaggggctgctgcgggggccaatctcagccagctcgcctcttcccagcggcctctgcgggagcggtgggtgttgtacacaatcatcatggcggcggccggggccccggatggtgagtgcggcgggggtggcgggcgccgggccggggctgaggttgcggtcgctcctctgggggatgcggcccggcccgggagggagaaccgcggctcgggaacggaggtccggcggcgcccggacagcgtccgttcccaagcccagcccgcggcgagcgcccaccccctaacccccttgcaggcatggaggaacctggcatggacacggaggccgagactgtggctactgaggctcccgcgcggcccgtcaactgcctggaggctgaagccgcggcgggggcggcggccgaggactccggcgccgcacgaggcagcctgcagccggccccggcccagccccctggggaccccgcagcccaggcctcggtcagcaacggcgaagacgcgggcggcggcgcgggcagggagctggtggacttgaagatcatctggaataagaccaagcatgacgtgaagttccccctggacagcacaggctccgagctgaaacagaagatccactcgattacaggtaattcctgtggcgctgacagccagtcttccccaccccgcctcctgatggcccttgcaccctactaggcacctggtggctttccttgcatcaggtccccccatccttacagcagtcttctgaaggatacttggatgcccattactcagctggggaaagagactcaagtttatagagctagtaagttgcagagctgggattaaagccgaagtctgacgtttaggccccagtttctcattgatgttgctctaacatctctaattaaaaaatcacctaaggcgcttgttttacagcttctgggccctttcccaggagattctgattcagtgggtctgggatgtagccaggaatttatttttagcaaatatcttaggtaattcttctaagtgaagtttaggaaacgctgctattgactttgatgctggttcttcacagtcgattctgtttcttaattttaccttgttcatagctctttgccatctgagatttcttttctttttcctatttttttttttttttgagacggagtcttgctctgttgcccaggctggagtgtactggcaccatcttggctcactgcagcctccgcctcccaggttcaagcgattctcctgcctcagcctcccgagtagctgggattacaggtgcccgctaccccgccgggctagttttttttattttatccacccacctcggcctcccgaagtgctgggattacaggcataagccatcactcctggccttgaacttttttttttttttaaagctttctacatgtagccttgtaatctccattaagaacaggagttttgtccctattggcttctgtagctctgatgcctgtggattctcacttaatatgtgaatgatttagatgactgaggaacaacttggaaagaatgagagctagtacttactgaacaattattcaatgctagccaccgtactaaatgccccgcattggtctcttaatccttgaaacaggtctgtacagaaggacttactctaataaatcttctacagttctagaaactgaggttcagaggttgtaaatctcccaagttcacaaagctaataggtggtggaggcagtattcactttttggtctgttaccaaagagctgtgtagtatccatacatttttctgtccttccttcctttcactgtccaccttctaccttttcccaaggtctcccgcctgccatgcagaaagtcatgtataagggactcgtccccgaggataaaacattgagagaaataaaagtgaccagtggggccaagatcatggtggttggctccaccatcaatgatgttttagcagtaaacacacccaaagatgctgcgcagcaggatgcaaaggccgaagagaacaagaaggagcctctctgcaggcagaaagtgagtccatcttgtgcttcttggtcttgagaaatttgaggctttgtcctcttgagccgtggctggttatattctccctagaataagctcctttttggacagggcccatgatggaaatttatggcagcagttgggtgccgcagagtggaggtgacaactacctgagatttgcaactttgtctcatctggcgggtcagtgtgtctcaagtctacctactttaggataagaccttggtaaagggaggcttcagaccatgtgttgaaaggaatcagacgtgggtttctctctcttatttagtgccagagaaaactaccagtactagaagtaagccctcattttgtacaagtgcttacatttggctttttggtttgtggctttccccaagtcaacaagcctggctaggcatggaaatcaacaactctcggaggttcccctaaagctgaccgtttcaggaagctaaatgaagctgagtaggaagacaactacactgatggatttgtttatttatttttttgtcctgatctgtgaaataggagcttggttttttacgttctctgttcttttggctgcaagagatcctgccttgtcttgtgctcatcatagccattaacattctttcacgtaacgaggaaaagtgagattattttactatggaaggaacaggttgtaagaatcattacttgttatctttttacctggcaaattatactgattgctgtgtagcctcctgatcgttcttcctagtgttccaaggaagacaggtattctcaactgtgtctgaagtagagtagataaacttcaatcaacatcatttagtgaccatagacactaagatatatgaccaacagtaagaaaaggacacagtttgtgttacagatccataatcccccatgtgtgcttccaaaaccccaaaggagtataaaaacgagaagtgtttttataaatttaacagcaaaacctgaccagaattagtgtgaattttcctctttggtgacaaggtactgccccagaccccacagagaagattgttatgtatttgaaagcaatattatctttataaaaattccaaaaccctgaaagttcaaaactctagggtttcagataaggggttataaacctatattaattatctaaaaggtgttgatttggagacttcacccccacatatggggtctcagtgtcttgaaaccgattgagtttcttctcatattcctgtttttctttgccacatgtatgaaatagtgaaatgtgagcacgtcagataggagtggtcgcaatggtcacacccttggagcataacatgcctcctaaatacaggtttttagttactaatggtagcttaacaggcttagaactgttctccacagtacaggaaatcttgttcaaaaggtacttgaaaggtgtgactcgaattgtacttccagcccatgctgctgtgtttcattgaggccaattatgatgcatcacatgacctaatgagagggatatagtcccttgcctttttaccagcttattaaggggtctgggggtgatgtctggagtgactttttgctagcagtctggcagtgctgagtttattcctcccagagggattccaccatgccagtgaggatttgggctggcttgtggctgcctagtgcttacatttgattaaattgttaccttctatccattcattgtcccctagttccagccttccaagcagtggctatgcctataaggccacagatggagaagaaagaagactcaggcatttgggccaggcaggagaactgtttaaggggccctgaacttagaatccttgaagagctgcctcagagttcttggggcaggtggtaggggtggagtttagaggcttcttaatgtcaggttatagagtaataagcatttctttctgaaaggtggctcttccaggttcctgtttagctggagttaagggtagggcagtggggaaaacttcggcgatgggctgggtctccatttgttgaagaactgctcctcctaggcagttagacggattaccagcatcttatagtgttctctggaagtttaagttgaaaaaggtgggtgccattttttgtctgctaggagagcaacaccctttgtcgccctctttagtttgatggtttaatcatttcagtggtgatttttttttttttttttgaggggaggagggcaatctggaaatcccgtttgctgtagaactttgatatctaatatggtagctatccacatgtggctggttaaaatgaaattaagaattcagttcctcagtcatagtagctgcatttcaagtgtgtaatagtcacagcagtaggtagtggctagcacaggtacgaacatattcgccctcccagaaagttctgctggacagcactgtgctatagtttcaaaggatccatagtctgtcgtcattaaaagcttttgagccaaaacactaaggctttcttcatcctctctttcaagggaatagtaacacgacgaaatgtagtcagctgtttcatttcattctctcttctgacttatagcaacacaggaaagtgttggataaaggaaaacctgaagatgtgatgccatctgttaagggggcccaggtaaggcggatttctttgtgagcattctgaaaatgaggcagccccaccgtctgacttgaggttcctccaatcctgtcccttctcttttttccctgtttttttttttttgagacagagtcttgctctgtcacccaggctggggtgtgccaccacacctggctaatttttgtatttttagtagagacggggttttaccatgttgcccaggctagtctccaactcctgacctcaggtgatctgaccgctttggcctcccagtgtgctgggattacaggcgtgagccaccgcgcttggcccccttctctttttttctgactgtccctccatctcttaccattctctcgtgccttcaggagcgcctgccaacggtaccgctgtccggcatgtacaataaatctggaggaaaagtgagactcacctttaaactagaacaagaccagctgtggattggcactaaaggtatgttcttcctcgcctccttgctggcccactgcctgcctctggcacccagcagcactcacattttagagtgcgatttcacccctccttctgaaacctctctctccactgtgctttgcttgcttctggcttttaaatttgcttttagatgctcgccttttgtttggaccgttttccctcattgttttcagtctgatcttagggctgatccaccaaacagtggctcttcagttgcacacagatttgggggtcccaaacacgtggcccaagggccaaatctggtccacagaaaaatgttttgtgggatgacacacaatctgtaaaaattgggagatttcactaatctgattttttttttttttttggcttctcttgaaaactcaaatgatctggccctttggggcctgcattctcacatggcatcgatccactagagccgagtggtggtttccagtgggccatactacagtcttcatggtcccatttatcttagaagtagccagctttgttcatttgtcacctgcctggcccctgtaggtcagagtttgaccctatagtaggtgaagttttcctaaccgctgccgaggaatctgcctctccctccccgcctggttgccctctgcctgccccacccccgcctgtgcacggtgtctggatcagccttgctgtttgctgggaagtgtctctgactgtcctccctctcccttcccccagatggttacaaagtcttgttagttacactgcagaactgtctgtccctttctttgccacactgttgtgccagttaaagttcccaagcatctttaaacttggtctgttcaaagcgagttaccctgtttcactgccccatctgtgttttcttctgtcctgtccatcttacctactgctttttatcctgggtacccgtgctcaaggacctttggctgtttaaggacacattcaaatgcctaaccatagcgttcagtgttctcaacactgggccttagtttaaattttggttccagcttctggcccgtttgccctgtggtcccctgtgtattttagccgcatctctctgtgaagctcccagtgtgctttgcacagctccttgtctttgctcatgctgtgcccttacctggaatgcctttttcccattccttgttattaataaaatcttccaaggccctacttaaatgtcctctctgaatgaagccttccttgattctccccccaccctccaaatgacttgctgccgcttctgttcatagagcgcttcgtttatatccccagagcactcattactctctgacttgtctgtccccctgttagattcctggagggaaccgaacatgcctaaatcacctgtttctgaccagcactgtaggtattcagtgttcgaggtaaatgctaaagagaagtatagggggtcccatcatctgacgttcactggtttcagggacagaccatttagtgagactccacttaaaatgggaccaagttttatggagaataattggggcaggggtggtgggaagagagagtttttaatcatctaaaacacaaaaatcagtgttcaaccctatactgattgttaaaatgaacaaaaattgaaatgccaaaaatgcttgagttttctatcaattttatgataacttgctattttcttcatttcacattcaactctaactgcatggtcaaagcaagttttgcagaatatctgagggttccccccagtttttgcaagggcctttgaaccctctgctagatcattctcttctgtagagcctgtccatcttccctttatcagtagtaagctgcccagcctctgtcaactttgcaggtgattttgcttagttctgtctcatcacattcacttgctgaagtgcatagacttcctgcctcttgctggacctctacttttgcttgtgggcagcctcattgaaggcagttgctacggctgacctggaaagaccctgccatgaagataggtgcaggcagagaagtctggatgggaactaagtctgtaagtgctcattggttccttggggaatatttctgtgtcaggaagttgtatagggaacacatcataactgcaggaactgacagaacaagaacttcctgaccctgtattggaagttttctttttgctagtaggagcagccgccttcctgctttggcctaaagggagagctgtagaagaagctcaatatgttggggcttctgagcccttgaaagcctccttactcaccagtcttgttgaggagcatggccatggactactcatgttttctagggttgaacaaggttaagattttcattcccacccatagcactgtacctctggagcccaaggggcaggcagtcttgtcacttgcccagtcctgttacctaagtgtcataagcactcataagaggacagcttgttctgggagttggctgctagccactggcttcgtctttctgctggcaagaagaagcggctatggaatgaccatcccagcagcgagttggcctcttcgtggggcgctttgctgagtaagtgacccttaagggctgctactcttgactaaactctgctagcttgtgtaggaggaggcagttctaacagcctcaaaagaatgagaacaagctccaggcaggaaaccggaagccgctggaggagagcatgtaccctgctcgtaggaaagttgaatctggctgaaggtctgatgtagtgatcaggagtgtgggtccagaattgcccaatttttggagttttcaagagaagccagaaatctgttgtatatttttgtgaaatctccagacatttcaggatgaaaggtgttttaaaagtttccatcttaaagacagctgctgcccaggtcctgctttagggccgactgttgtagagccactagaagtccaaacctaaataaacatcttcaggtcccttctccccagcccccatttttcagatactgaggcccacagaactgaagtaaaatgtcttaagtccccagctagaccagaacgctggtctctaaattcctagtctgtttggccaacttatctatttttagactctatctttccagatttttctttctgcaaaggctgcaagtttttttccacttggtttagctgtttgctgagcctccctgcccccctccccctgcgcccccgtccctgaggtgtctgctgctccaggatggccatgtccccttgtgcaggtgcacctcgcctcccctgacctcacccagtcccgcttcacttggctcactcccggcagtctcatctcactccaggcatcccttgctgcccccttctcttacctgccatcctccttaaactcgcctcaatgtcttctgaccccatgtgatcagtggtatctcaagtgttaatcacaaaaggttataaatgttttaagagaacttcataaaagtgtgtgaatatagagtgcggaggactcgaggagggaggccggggaagggagcagggtcgtggtatagaatctagccctaaaatccaggcactccccttcccttgtgagagccacaggggaacgtgttgcctctttgttcgtaggcctcttgactctccctactgcccaagaccttagtcaatgctgggcttgcataaggttacaaaggaatttcttgggtatttatttattttatatttttttttgttgagatggagtttcgctctttggcccaggctgaagtaaagtggcatgatctcggctcactgcaacttctgccccccgggttcaagcgattctcgtgcttcagcctcctgagtagctgggattataggtgcccaccaccacgcctggctaattttttgtatttttagtagagacggggtttcaccatgctggccaggctggtctcgaactcctgatctcaggtgatccacccaccttggccaaatcctgactcacaagatgttaggattacaggcttgagccaccgcgcctggcctttcttggatatttattaaccatcagacttttaaaaaataatcccagggaagatacaattctgccctcagagacctttactataccattgccaaacccagtttcccacttgctcctacggagttcccagctcccacacgaagccctatgtgcactggtcagaagaccctgtcgtgttgtccccagagggcatggcgccagtcacttgagtttactgtagatcccgcagccaccagccctgatgagggactgctgagtcagagaagttagaacaggagggccctttgaataatcactgtaatccctctcaacttagagcggactgagaaattgcccatgggctccataaaaaatgtggtcagtgaacctatcgaaggacatgaagactaccacatgatggtaagtagcgctggctgagttcagcccctctcactagactcccacttcacctggcagggaacagttttaactgagcttgtttaacggaagaaaactcagtctccagaagatgcacttttttaagaccctgatgttttcttcatctacttagaacttaatccatggcctctattcctagttctgtttattttacacccccccacacacaccttccatcagtttaaaggggatatgttttctcttacctcttttagaaaagtctctcttgcctccctcttgtcgtgtgttgtttctagaccaggaaaataaatataaagaggaggaatggcttgtggattttcattataagttttatcttgcttataaaacaaaacttgcccttagccttggtgttggtgagggcaccagacagcctcttttctgtaataacgatgccgctcttccaggcccagtggctgagggcctcgtggggaagacgggctctgtggagcgtctattctgcatagaacccactctgcagagagcaggctactctttcccaagacagaatgtttggaggtgttgtgcaggtctgcagaacaaagcaaaaaattcattcatctggtaaaatgagcagcttaggcagtttccaaaattttcccagtgctctttggaggagccacattgaccacgaagttgattctgcagttgcccatcaggggcctggcctgagcagctgtaatgtgagggcggggcctccggccattgttcatccaaggaggcaggcctttcagtgtccatcccacagtgatgaagccacatcagcccatcccagggaaaagaaggaactagtggtttgaccagtagattgggataacaagtcccaggcagagagatgtgttggaagatcctcttgctatagaaaaaaatcaaaggggcttaaaatatggtgggcaagggaggcagccctgttggcatcctgcctagtgtggctgtagcaaggctgtagctgggagtgcagtccctaggctgtggggctcttggggttttgtcttctggaagtgatgatgccccttggcagcccttccacccctactctctctgtagtctttttttttttttttttttttgagacggaatctcgctctgtcaccaggctgaagtgcagtggcgctatctcggctcactgcagcctctgcctcccaggttcaggcgattctcctgcctctgcctcctgagtagcagggattacaggctcacgccaccacacccagctaatttttgtatttttagtagagatggggtttcaccatgttggccaagatggtctcaatctcttgacctggcgatccgcccacctcagcctcccaaagtgctggggttacaggcgtgagcctccatgcccagccctctctctgtagtctttattacaaggattgcagacaaattggtttggcctggtcagttatttttttctgttttaacagttgggccaggcgtggtggctcatgcctgtaatcccagcactttgggaggctgaggtgggcggatcatgaggtcaggagtttgagaccagcctgaccaacatggtgaagccccgtctctactaaaattacaaagattagctgggcgtggtggcgggcacctgtaatcccagctactcaggaggctgaggcaggagaactgcttgaattgcttgaacctgggaggcgaaggttgtagtgagcagagatcgtgccactacactccagcctaggtgacagagactctgtctcaaaaaacaaacaaaaaaacaaaacaaaaaaaaacagttggacttgaatgtttttaactgggccccatcactcctttttgaatagtttgtgttgccagtcacaccctgtagggtttgtagcctgacttttcaagcagtgtggtggtagggagtccaaggaagttgagtggactgttttggacgtctttggaggaattggtgtggatgggtaatgacttagtatttcattgaaatgttcatttctctcgagttatttctggcagaggatagctctagtagtccccttctcttttccaaacacctttacctttgtcctaatgaaagtacttagttatctctttgggcagatgctatttctctagctaaattaacatgtcatcattcacagttggaaaactgtggctgtgctttttcatttttagagaaatgtttttaaaatacagaaaagaggctgggcgcagtggctcacacctgtaatcccagcactttgggaggccgaggtgggtgagtcacttgaggtcaggagtttaagaccagcctggccaacatggtgaaaccctgtctctactgaaaatacaaatatttagctgggcatggtggcgcgcacctgtaatcccagctacttgggaggctaagggaggagaatcgcttgaaagtgggaggcggaggttgcagtgagctgagattgcaccgctgcactccagcctgggcaacagagagagactccagctcagaaaaaataaaaataaaatacagaaaagaaagagaataactgtcacaaacccatatatccatcactgagaagtggcaattgtaaatattttgtaatttgctttaatttttttaaataaaagaaataaagtttattcacagcaatgatggccccactgtcttcccctcccccattaccatcgtcatgtgtcacgtgcgtccttcccatctatccattctttgatttacacgtgtatccacgaacaagatggagtgttgttttgtgcttccagttttcgtaaatggtattatgtattgttctacaacttgcttttctttggttcaacataagaatctgtcagtattaactgtagatccatatggacccagttgatacc

SEQ ID NO: 33 - DNA, 150482 bp, Homo sapiens
tacttcagtgaacacatgaatgacaagaaagtgaaacaactttcttgccgatgcagagagtcttagtggtctgggtagaagatcaaaccagccacaacattctcttaagccagagcctaatccagagcaagactctaactcttctattctgtgaaggctgagagaggtgaggaagctgcagaagaatagtttgaaactagcagaagttggttcatgagatttaaggaaagaagctatttccataacataaaagtgcaaggtgaagcagcaagtgctgatggagaagctgcagtaagttatcgagatctagtgaagatcattgatgaaggtggctacgctaaacaacagattgtcaatggagactaaacaaccttctgttggaagaagatgccatctaggactttcatagctagagagaagtcagtgtctggtttcaaagcttcaaaaaggatgggctcattactcattaggggctgatgcagctggtgacttaagttgaagccagtgctcatttatgttccaaaaatcctcaggcccttaagaattatgctaattcactctgcctggagccctagaaatggaacaacaaagcatgaatggcagcacatctgtttacagcatggtttactaagtactttaagcccactgttgagacctactgctagaataaaagattctttgcaaaatactattgctcattgacaatgcacctgattgcccaggagatgtggtgtacatgtacaaggagatgaatgttgttttcatgcctggtaacacaatatccattctgtagcctatggatcaaggagtcattttgactttcaagtcttattatttaagaaacatattttataaggctatagctgccatagtgattcctctgttggatctggacaaagtaaattgaaaaccttctggaaaggatcaccactctagataccataaagaacattcatgatgcatgtgagagatcaaaatatcaacatttacaggagtttggaagaagtaaattccagccctcatggatgactttgaggggttcaggacattagtggaggaagtcactgcagatgtggtggaacaagcaagagaattagaagtggagcctgaagatgtgactgaattgctgcaacctcaggataaaacttgaagggataaggagttgctttttatacatgaacaaaaaaagtcatttcttgaaatggaatctactccttgtgaagatgctggaatattgttgaaatgagaaacttagttgatcaagcagtggcaggatttgagaggattcactccaattttgaaagaagttctagtgtgggtaaaatactgtcaaacagcatcacacattacagagaaaccttttctgaaagtaagagtcaatcagtatgacagacttcattgtcttattttaagaaattgccacagcaccttaattttcaggaactaccaccctgaacagttagcagtcatcaatatcaaggcaagaccatccaccaacaaaaagattatgactcactagaaatacccagtgtagatgacggttgatgggtgcagcaaaccactgtggcacgtgttatacctgtgtaacaaacctgcacgttcttctgcacatgtatcccagaacttaaagtataattttaaaaaaagtttaaaaaaagattatgactcagtaaaccctcagatgatcattagcatttgtagcaataaagtcttaaattaaggtgtgtacattgtttaatggacgtaatgctactacacacttaataaactacagtatcgctaaaacataactttaatatgcactgggaaacccacaagtttgtgagactcacttgattgtgatatttgctttattgtgatgctccagagccgagcccacagtatctctgaggtatgcctataatagctaagtaaatgtcttaatctgtcactagtactgcttatatgcaaaataatatgactttaattataaattaatctattatgaatcatgcctcaaggaactctgagacagtgattctgtgttttaaatagcaggataactgctttattggaacaaaaatctcttttctaatttgatttggccaatcatattgattagtgagattttatgacaatcattgattcgtaagattgattagtgagattctattacacttctttttctgttgtgactggatgcaaattgggcagaattatattcagatttttaactgaggcatttttattgacagcaattgaacctggccatgattaactatgttttggtcgtctatggacttgccatttctctccttggaataggacagcctgaggtaagatttgtaacagtggtaataaacaattaaaatgatattgacatatcttataaaaattattttctcatttttacccattttcttctctgtaccttctgataattttgtctgaaatatctcagtttaatttagtttgtgtttttaaagaatatttagtttcctattagaaaaaggctttgccaggcaatcagtgggaatctactttttatttgtgtaaaaattagtatgtaatgtatcatgattgatagatttcagaaacataatcttgagggaaaggcaagttggaggacataaacattgtgatcccacttatatactttttggaaaacatacataacagtactatatactgtttatgaattctgtgcatcttgtaaaaaagtgaaaaaatatggattatgtttatataaaatttaagataatggctgcctttagtgatggccaggagggaatggacctggggaggtttcgtgttatgctgttttcctagaaaaacaaaggtaacaatgataacgttagtatctcttatttgtacgtagaaagtacttggatattgtattatttctagattgcaggcttcctataactgcatgtagtcagtgtatagacatgagctcccaggatttccattagtcatgctcctgcctggctctcctggaatgtttacctacctatactgtttggcattataactttgctttctgaggttttgagtttgctataaatgttgaaatgctctagaattacctcaagtataatatataatttggtctctatttttccctgtctagatgaaggtttaactctaacttgccacctagtgaggatctaagtagtcttttacgttctgttctctcccagaagttgacagtgcccaagattcattttccttgatctcagtgtcacagattaataatgtctcccatgaatgctctctaattctattttccaagagacagttggagacagaacttcatgattttcattttattcctgacagaataataataaataccatattttaccttattagaattgaagaaatcatttattacatttgtgatttaatgtaaaatagcgagactgatttagaaaaaaaaaatgtgttatagtagaacttacatgtttaaaagaatttcatcagaggacagcccttgcttcaaacgtttttagaatgcctcctttggaactggcctcaaagctccattttgtagtgacatttctttttttcactcacagtagggttaccagtatttcttagaactatgtatcttttggatgttttccaaaaacaaaattcattcaacttagtggtttttcactgttgagaatattcaaaaaagaatgtactctaagctatgttaagtgtttactaatgggctgtttttaagacagagctttcatccgtcttgtgccacaaaagactgtgacaacgtcattggaatggcattccttccaagggattagcacttaataggatctatgttatggtgtgtttacaccataattagccttttttaaaaaacaaaaacaaaaacacgatttgactctttttagtattagccagcacacgccaggcccttagtgcgtactagtaaatgcttataggttgattgtctgatgtgttcagcaggattggtttggttgtgtctctgactatccatatgatcagaaatttatataattcctaagaaagtgaaacacagaggtataattttgccacaggaatttggggatatgcagttgttattttaatattataaaaaaaatcaacctttagataaaatttatttcagtatttctctttgtatgtaagtgatcattgttttcactgctattcaaggaattatctgaagccgaaaaccagtttaagaggattattgaacactaccccagtgagggccttgattgcttggcctactgtggaattggaaaagtatatttgaaaaaaaacaggttagtagaaatgacactactttaagctctaggctggtaactcatttaaaatccaatgtgataatgatccattttctagaattattttgatatctcctctgtagcacactatcataattgtgatttactttgaggacctgaaatttcactatcagtattaattgttaaagcaaggccagtcattgcagttcttggtacttcctgattttaaatctaataagtcaacaatatagtaatttgacattaaagatttaatagtctagtgtataatcatctatagatagtgagtgaattgatataaactaatgtttttaaaatctgattgtttaatttttttgatttaattattttttaaaaatctgtatgaagatggttttaaataagaggtatatatgtgttcaaagacatcatgagtgagttaggaatataaaagtctgtcctctgaactctattgtagttgtaatccttacctgcagtttaatattgaagctgttctctaaatgcctcatgtctcttagtcttgtctccccgaatgtcagtatgtccctgaggggacaggattatgtcttgagctttaaaaaaagaaaatctgtttctgccacttgtacccaatatagaggtaggtatgttagattataaagaaataattgttgactgattgaatattatttataatttctaactgtctttaaattttcatgtaacttgttaggggaaattttatgagattttggggaatcccccccccagccatcttagaatgtgcctagaacctcctttatagttttttttaaattaaagaaagtttttttttggccaggcacagtggcgcacacctggaatcccagcactttgggaggccagtgggtgaatcacttgaggtcaggagtttgagaccagcctgaccaatatgttgaaaccctgtctgtactaaaaatacaaaaattagctgggtgtggtggtgcgtgcctgtagttccagctactcaggaggctgaggcagaaagaatcacttgaacccaggaggcggaggttgcagtgagctgagattgcaccactgtactccagcctgggcgacagagtgagactccatctcaaaaacagcaataacacagagacacaacaaaaaaagagaattttagacaatatccctgatgaacatccatgcaaaaatccttaataaaatactggcaaaccgaatccagcagcacatcaaaaagcttatccaccatgatcaagtgggcttcatccctgggatgcaaggctggttcaacatacacaaatcaataaatgtaatccagcatataaacagaaccaaagacaaaaaccgcatgattatctcaatagatgcagagaaggcctttgacaaaattcaacagcccttcatgctaaaactctcaataaattaggtattgatgggacgtatctcaaaataataaaagctatttatgacaaacccacagccagtatcatactgaatggacgaaaactggaagcatttcctttgaaaactggcacaagatagggatgccctctctcaccactcctattcaacatagtgtcggaagttctggccagggcaatcaggcaggggaaagaaagaaagggtattcaattaggaaaagaggaagtcaaattgtccctgtttgcagatgacatgattgtatatctagaaaaccccatcgtctcagcccaaaatcttcttaagctgataagcaacttcagcaaagtcccaggatacaaaatcaatgtgcaaaaatcacaagcattcttatacaccagtaacagacaaacagagagccaaatcatgagtgaactcccattcacagttgcttcaaagagaatacctaggaatccaacttacaagggatgtgaaggacctcttcagggagaactacaaaccactgctcaatgaaataaaagaggatacaaacaaatggaagaacattccatgctcatggataggaagaatcaatatcgtgaaaatggccatattgccaaggtaatttatagattcaatgccatccccatcaagctaccaatgactttcttcacagaattggaaaaaactactttaaagttcatatggaaccaaaaaagagcccgcattgccaagtcaatcctaagccaaaagaataaagctggaggcatcacgctacctgacttcaaactatactacaaggctgcagtaaccaaaacagcatgttactggtaccaaaacagagatatagaccaatggaacagaacagagccctcagaaataataccacacatctacaactatctgatctttgacaaacctgacaaaaacaagaaataggcaaaggattcactattcaacaaatggtgctgggaaaactggctagccatatgtagaaagctgaaactggatctcttccttgcaccttgtacaaaaattaattcaagatggattaaagacttcaatgtttgacctaaaaccataaaaaccctagaagaaaacctaggcattaccattcaggacataggcatgggtaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacgaagggctaatatccagaatctacaaagaactcaaacaaatttacaagaaaaaaacaaccccatcaaaaagtgggcaaaggatatgaacagacacttctcaaaagaagacatttatgcagccaacagacacatgaaaaaatgctcatcatcactggccatcagagaaatgcaaatcaaaaccacaatgagataccgtctcacaccagttagaatggcgatcattaaaaagtcaagaaacaacaggtgctggagaggatgtggagaaataggaacacttttacactgttggtgggactgtaaactagttcaaccattgtggaagtcagtgtggcgattcctcagggatctcgaactagaaataccatttgacccagccatcccattactcggtatatacccaaaggattataaatcatgctgctataaagacacatgcacacatatgtttattgcggcactattcacaatagcaaagacttggaaccaacccaaatgtccctcagtgatagactggattaagaaaatgtggcacatatacaccatggaatactaagcagccataaaaaaggatgagttcatgtcctttgtagggacatggatgaagctggaaaccatcattctcagcaaactgttgcagggacaaaaaaccaaacaccgcatgttctcactcgtaggtgggaattgaacaatgagaacacatggacacaggaaggggaacatcacacactggggcctgttgtgaggtggggggaggggagagggatagcattaggagatatacctaaggtaaaggaccagttaatgggtgcagcacagcaacatggcacatgtatacctatgtaacaaacctgcacgttgtgcacatgtaccctagaacttaaagtataataaaaaaaatatatatatataaacaacaaacaacaaaaaagtgtacacctgccacaataaagccagtgtccaagacgagttgtgtttaatgtatattacttttatagcaaacagcaatagtgactttgtttttttaaagaaaatttaggttacattgaatattgctgttcagtgattcatcaaatgtattcgtcccagtaagcttgagatctttggtgacttttgaagggagtgaaaataccattttacatctttaatgcctttttcataattatgactttagatttctagaagctctcaatcactttgagaaagcaagaaccttgatttatcgtcttcctggagtgttaacttggcccacgagtaatgtgattattgaagagtctcagccacaaaaaataaaggtaaccatttatttttgcagagtgtttcttactgtgaatgcttatctgcattgactgactcaggtatcaggaggcggagaggtaggagcattccatccccacctcccttacacgcatttcccctctactgtctaatgagaatctctgacatttattgaatgttttctgtgtgccagtgtgtaccttcatttatcattatgcttaatccttatagcagccccgtgcaggggggcactgtgatcattcccattttacagatgaggaaggttaagtttagagaggtgaaatgatgcactcaaggtgaaacagcaagcaaattgtggtcctggaacttgagtccaggcattctgacttctgagtatgcatgatcatgcactctgctggacttggttgtacttagaggaaggtatagtattgttgtttcatcataaagttaccacagttactgagatggtacttgaagatttagaaaaatatgaatttagtctcatatccagaagcataaagatgctttgcttgttctagaaagacttacgtgtgaaatgactgagataggcttttacttgtagtgaactctcacatgtactcagaacttgattttggctgaagcttttaaaatcacagaagtcaacttttacaactcaataataaaaagacaaataatctaagaagtagtcaaaggatctgaatagacatttctgcaacgaagatatacaaatggccaaaattagcacatgaaaagacattcagcatcattagctatcagagaaacacaaatcaaaaccacagtgagataccacttcacactcattaggatgtgggcagacaataaatattggcaagggtgtagaaaaatgggaacattcagacactgctggtggtaatgtataatgatgcagctgctttggaaaatagtctggcagttcctcaaacagttaaacatagagttaccatgtctcagtccatttgtgttgctataaagaagtacctgagactggtgatttatgaagaaaagttggcttatggttttgcaggctgtataagaagcatggtgtcagcacctgctggtgaaggccttcaatagctcctactcatgtcagaaggcgtaggagagcctgtctgtagagatcatatagtgagagacagggaagtgccaggctctttttaacaaccaactctttagggaactaatggagtgagaactcactcaccccagggagggaattaatctgttcatgagagattcgtcgccatgactcaaaacacctcccactgtgcctcacctccaacaccggggatcagatttcaatgtgtggtttggagggtcaaacattcaaactgtagcataccatatgatccagcagtttcactcctaggtgtgtacagagaaaggaaaacatgttctcacaaaaacttgtacatgaatgttcatagcagcattagtcataatagcccaaaatgggaaatagcccaagtattcgtgagctgataaatgggtacgtaagtattggaacctgggaggttgaggctgcagtgagccttgattgtgccactgcagtgcagcctgggcaacagagtgagagtctgcctcaaaaacaaatggccagtcttggtggcttacgcctgtaatcctaccactttgggaggccaaggcaggaggattgcttgagctcaggagttcaagaccagcctgggcaacatggcgaaacccatcaatacaaaaattagccaaacatagtggcacatgcctgtagtcccagctactcaggaggctgaggtggaagggtcagttgagcccaggaggcagaggttgcagtgagctgagatcgtgccactgcactccagcctgagtgacagagtgagacgctgtctcaaaaaaaaaaaagagtactgataacatgctgcagcatggatggaccttggaaacattatgctaagtaaaagaagccaaacacaaagggcttgtgtgagtccattcctatgaaatctccagaataagcaagtctgtatatagtgacagaaagtagaccagtgattgctgggcctggaaggttaggggaaaatgaggagggactgctaatgcgtatggagtttctttttgaaaatgttctaaatttagaccgtggtgatgtcagcacatcctgtgaatatgctaagaacaccgaaccgtacacttcatttgagttgtatagtgtgtaaattatgtctcaacaaagctattataaaaaatacaacacagggattcttggatttacctctcttcatacaagattgggatagaggcataggagctattgataacaaaaagccagcactggaagcatggcatgagtctcttgggggcttcattagcagtggaataattctccagggagtccacaaacaacagtggcagagctgcaaggaggaagataatgggagtgttaggattctggatgaggtgatgttgggcaagaggagcctggtaaagtcctcaggattaccctaagggttattctgccttacttgacttcctcttaatgcttatggaagatttctgagagctgtaaattataaaatgcgatttgatgattgtaacaggacaaaattttgattctttcgaaattctgaaaaaaaattttgtccagtcctctttttaaatctctcttatgtctcttatcagccttccttttaaaaggaaaaactttaaaagttgtatgtagtttgttgttggtgaaaaaatttagtcattcttatgctgaaaatattttgatggcaagaggttattgaaatcacaagcatttttattgacagattagtattgtaatggtatcatttttgtttattttgttttagatgctgttagagaaatttgttgaagaatgcaagttccctccagtgccagatgccatttgttgctatcagaagtgccatggatattctaagatccagatatacataactgatccagactttaaggtaaataatgagtgtacagtgggacattaacttgcaaaatcatttcttaaaatgggctcaaaacaatctgtaattggaggcacccaagttctctggctagttagcagtcgtccacccctttcccaggattttttttttttttttgagataagtctcactctgtcacccaggctggagtgcagtggcacgatcttggctcactgcaacctccgcctcctgggttcaagcaattctcctgcctcagcctcccaagtagctgggattacaggcgtgtcccagcacgcccagctaatttttgcatttttagtagagacagggtttcaccatattggccaggatggtctcgatctcttgacttcgtgatccaccccctcagcctcccaaagtgtgggattacaggtatgaaccaccacgcccagccttcctggacttttttaggtctacatcgtctcacatgggaaccagagccactgatgtataaacgctctgggctggggtagtgacctgagaaggcaggctggctcattctttttcctcttcaagctaccttaggaggataggaaacaaagtgagattgttacctctgatttgttgcaattctgatctctcataaaatttgagtcccaaatctaaaggtcattgtgatcattgaattagctgttagagacctaaatttgagataagtctggcacttaattgagttatactggtttattcaagaagctagtagctgcccttgtcctgctgttccaatgtccctggttagtaaatcagatgaaataatgtttataaaatatttgatatattttgaagaatgatgcaactttatgctgtggaaataaatatgttagtcaagctctctctgtctttatgtatgttgtagtgagtgagtgtgcagagacatctttaaaacgttaattaaaaaattttttgtaaccctagggttttatacgcatcagctgttgccagtactgtaaaatagaatttcacatgaattgctggaagaagttaaaaactacaacctttaatgataaaattgacaaggtaaagcataacaggattgtctgaatttttcagtatacttattgtatgtcaatttttcccccaagaattccttcctgaacattctgcacataattagaaaattttaaattataactttaataataaagtggaaaatcaaatttgtttttatttggacaatcataaaggcattaaccatagaggctttgtttttttaaagagacggatctcactgtgttgcccaggctagagtgcagtggtgcagtcgtagctcactgcagcctcagactccttgacccaagtgatcctacttcagcctcccaaagtgctgggattataggcatgagccactgcaccaggccccacttgaaagttttgatgtggaattagggatttcaaaaccaaaatttgatgaggtaatttgtactaagaagtcaactcaaaacaatttttttaatgttgggaagaaagatcaacttcaattttaaactgccatttctctccagggattttcttattaccaagataatgatgttaattaccattaagtagacatactttgagggaagtcatagtattacaatcttatttgtattcatagaatttgtttctgatctatagaaactatggaccttttcctacacttcttaggcttatgcagaccactgttcttattggggaaagaatgaggcagttgtactaggcatctgttaacaatagcaattattaaagtatggtagaaataaattctcacattttgtacattttcacataattaattaacaatataatgatatgagtaaataactgtcacctttgagtcacttctgctatgtctttgtcttacctaaattgagtttctctagtgatataccctcttttagtggtcttaactattcccatcattttaaatacactctgtaaattagtcagctttccctaggatatgctgaagtgatgcaacccaaatatcttgtggcatacatcagagaagtttgttttttgcttacatgacttgtcctgcagttctgcagttgttggctgggactgggctgtagcagctttattttgtgtggctctattccttgtttctcaatctaagttgaagaatgacccttttctggaacatcttcctgtgtcagaggaaaaagaacaatgtccagtctatgaagtgtttgttaaaccttttgtctagacatgtgtatgtcatgtctggtcactttgcattgatgaaaacaagtcacatggtcagacccacacctgaaagtatatttttcctacacggaagccttaaaattcgcatggcagtgagtaaggattttcaccacttgcctgaagatggttttagtccgtattttgactgttcctagtggtaaaaatagtatacgtgtatagatttatcccccctagacataacatttttcttgttttttttttttttaatcaaataggattttctacaaggaatatgtcttacccctgactgtgaaggtgtcatttctaagattatcatcttcagcagtggtggtgaagttaaatgtgaagtaagtaataaaggggaaaccttgttagatagataaccaaaatgtttacaccttttgaaacatgatttgaatttgtagatatcatgtaatttggatcttttccaggaaagaaacaattacttcatttaagaaaatataggaaatactgggatgtgagaatgcttcattgtaatgaaagcattcttatattcttttatttcttaataggaaaaggaggctttttatatcttagttttactatttttactgtttttgataacttcattttcttaatcccggtaaacttttgggcagtagtgggtgtgcaggtttttagggagggggaagagcgtcttgagggattacctttaacttcatgacatgggaatggcaagagtgggtagttgtaataatatttacactttattagatcgtctgcttactcttaattttttaaaaactttttcctcaagtgtgtctaccctcttgttcctcttcagtaaattattttgctaaagctttctgggcttttgtctgggtcagaacatcatcactgttctctatcaaactgaacattatgtgtgcttctgaaatacttgttacttgtggttttgtgttttatgtcatgggagtatgagacaaattttggatgtctttgttttatttaaagtttgaacacaaggtcataaaagaaaaggttcctccaagacctattctgaaacagaaatgttctaggtaagatttttaacaatcaatcagtggtttgatgatgtctcttagaatataattctattaaatgcagatttctaaattatgcctttttaaaaattggctgtgtatacatatattcaaataagtgttttttaaaatgatttttatggaaaattaaaacttaaagagaactagcctagaatgattaaatactaaaaacttgattcagaattatttatctagtggttgaatttacaattaaaattataacatttgatgctgtgaaattacatgtttgattaatagatttggcatttatataaaaactatacagtttgctctcagttgttgaaactttaattccaaaagcatatttttctttttatctctcttcagtaaacattttgaacctatgactattttttaccctgaaatactcaatgtactgtctaaattattacttctctatagctttttgtttagatcaaataattcagattcttttttcttttctttttggtcctgcttcttgtttttctttctaagaagtgatttttttttatcatttgtgaccaagaaaaagcaaaagaaaagatgaacagaattatttgttggagagaattcattgtaaccagatcaaccaaattatagtgttgtgggttattattgagatgtgaaaattatattttactatgggacctttcttagaaatgagagtttacatgaattattttgcagagtaatttgtactatttctgtttaccctatgaagtaacttagatacatgaaagtgacatctatacaatctgtagactgcatccttagacatcacctaatcattgaggtttttgttttcatgaaacaagtacccttattttgacaatactgacagtttcttacattgaatggaagatgtaggccgggctctgattaaaaaaggaaaacttctaatatattgcttggaagatggtttctacgatagtcaaaggaaaacagttcattgagttgtcactaattgtaaatgtttatcagcctagagaaactaagactgaaagaagacaaaaaattgaagagaaagatccaaaaaaaagaagcaaaaaagttagcacaagaaagaatggaggaggacttaagagaaagtaatccacccaaaaatgaagagcagaaaggtatgcagaagccaaaggcatgataagaataatatactctcatttaaatgtataaatgtaagcatcttttgggccttatattcatcattattgaattgaaataaagatttcacttagtaatttaatactatcactgtcttctgttactcgaagacagaattgggttggtgtaaagaacactgaaaaacctttcagagattgtattcccactgaaaaacctttcagagattgtattttaactttctgtgcttaatgactaaacatatttattgtatataaagttaaggtagttgatgaggctgggttaggattgttgaaggaagtggccgtattttaggggaactaagttgttttttttttttgttttttttttttgagacggagtctcactctgttgcccaggctggagtgcagtggcgcgatctcggctcactgcaagctccgcctcccgggttcacgccattctcctgcctcagcctccccagtagctggaactacaggtgcccgccaccatgcccagctaattttttgtatttttagtagagatggggtttcaccgtgttagccaggatggtctcgatctcctgatccaccctcctcggcctcccaaagtgctgggattacaggcatgagccaccacgcctggcctagaggaactaagtttcaaatgctactacatgaatggttcagaatgaagggtgtaaaatgcttacttttggtatgtttattttagcgtacactttcatgtcttttcaaaagtattgttaagtgtttatatttctaattaaagtttcttgagtttagtaaaacagtataatcaatctgaatcatattttatattatgtaattttgttatttctaagtttatgtaattgtgaattagtcctatttatcactttaaccattgttatttatccttagaaactgtagacaatgttcagcgttgtcagttccttgatgacagaattctacagtgtataaagcagtatgctgacaagattaaatccggcatacagaatacagccatgcttctcaaagaattgctttcttggaaagttttgagcacagaagactatacaacctgtttttctagcagaaattttctaaatgaagcagtggactatgttattcgccacttgattcaagaaaataacagagtaaagacaagaatatttctgcatgttttgagtgagcttaaagaagtggagcccaaattagccgcctggatccaaaaacttaatagctttggtatgtccctttatattccagagcaataaactttaatacgaaggggaagtgtaggtctctgagtcattttcattttcctgccatataatttataactttaaatgcaggactataaatttgtatggttaagaatacttttccagtcccagctacttgggaggcggaggcaggatgattgcttaatctcaggaatttgagaccaacctggcaatgttgcaagacctgtctctaaaagaattttttaaaaaaagaactaaatatatgaaggcctttaaaaaacagaaaaactattacacacacacgcacaccacaatttttaggttattttatagataggttacagtatacttcttcaaaaggtgcaatctaaggaaagaccagtcagtaaagaaatccagacctatattagactaaactatttgtaaatgtgtagatgtgtgaatactaggcacaaccatggtaaataacacatcctggagtctgccccctgctcaggagctgtgttgagaagacaaatctataattcagattctttgaagaaaaatttagaggcaagagtggatgagactaattgctcagggtcacctaaggcaaatctgtatctagagattaagaggaacatatcctagggttggactgagctgtggtaaatcacaggattatataactctgtactgtgttctgactttcgtaacttggctgggagaagggaagagtgagcaagccccctgccctcccctaaagcaggcgctttgcctaaagccatgcaggactgcagaaggcagctgcagatacagttgttgtgtaacacgaggtagggatgctttgggcacctaccagggcactatttatcttgctgactggatagcaactggcctagcacaatagttcattcagtcggcagctattagataagaggctaaagtacgccacgggaaaaaggcagggcctttagccgcagaccacagagtgaggcctgctaagcctctgccagccgtccccacctgtctgaatgtttagaaacgtggggctattagaattctagggtttcagagaagatactggtcagcttctgccagaagagacgatgtaagatggcagcaagcctggcatagttagacagctgaacatgcctgctttgaacatagatcctcatggatttgtgatcccggaaagttatttttaagtgacaagattgtcactagtgagtatcaagtaagcaaattataaagttaatgcttgctttaacatgctttaggagatactcaggactggagaaataggtttgcctgggttatgctacacggtcaagactgccagccactgttcattcaggtaaatgcagcacttgagccctccagctcaactggcaggaaagggtgaacatgtcttttgatataaaccatgtgttttttttgtttgtttgtttgtttttttgagacagagtgtcgctctgttgcccaggctggagtgcagcggcgcgatctcggctcactgcaagctccgcctcccgggttcacgccattctcctgcctcagcctcccgagcagctggtactacaggtgcctgccaccacgcctggctaatgttttgtatttttagtagagacggggtttcaccgtgttagccaggatggtcttgatctcctgacctcgtgatctgcccacctcggcctcctaaagtgctgggattacaggcgtcagccaccgcgcccggtcgatataatccatgtttattctgtagattaaaggtatcattttaataaggatatatgtatactatttaaagtagcaatttttatttaaagttgtgaaatgagttcaagcatgttaattagtaaggctgttactacagtcctgaagtaaaatgcacacttacttaaatagtaagtaaagcagttttcatttcctggaattttcttcaataaaacgactattgggtggacttacatcatgcacatatttaccataagagaggtccagtttttatgttcagcaaaagatgaagggaggaaaggaggaaaggagggagggagagagagaaataatagagcactagtgagataaatttaacatcccaatagtgaacactgcctgcctgcattcccctcactgaccacaagctctgacgtggatagggaacgggaatgtgctattttttcattcggctctcataaatcttttattgtgtgagtattctacatggtcccttattctggtgtttaaagatcctaattttcctgcaacatgatctctgcaagctaactctttaatccagaagcaagcagtctaggataattttgactctgagcaatctctgcttcatttgttgacttcatttgttgactaaggccctcggaagaagtgaccgttttatattagaggcatgatggagaaactggacagagctcctttttgctggctgttcatcaggagtggggcttcaccgtcatttcagtaggagtctgtatgagattgtagtcacctgttttctaatttggagagtggagaataaaagtaggcatactgaccaccttgatttttgtagagaggggtgaggacccacattttggggaataaggaatgttattttaggtgttggggaatgggtttacccatttcctcttttagacacatttgggaagattctgcatattgttgatgttttattactatggaatccatataaagaatcataaaatcttgctagtttatactaattggaatgaaagtctttatgaattagtgaaaacattgtttgggtttgtttttttttttagagatagggtcttgccccatcacccaggctggagtgcagtggcgccgtcatagctcactgtagctttgaagtcctgggctcaagcagtacccccacctcagcctcccaagtagctgggactacaggcatttaccaccatgcctggctaactctttttttttttgtaaagataggggtcttgctatgttgccagggctggtattgaactcctggctcaagtgatcttccagccttgtcctcccaaagtgctggggttacgggcctaagccaccatacctggcctcattgttatatttttaaaggaatttaatgctatactttcatctcctaggtctaataaaggtaactatgatagtagaaggctttggcccacattattcaaatctaatagacaagaattattataattagcctaacaatgttaaatggtgtttctaaaatgcccaatagcttgaacgaatctgttctcaactatttaaatgtttttgctgagaatataagcaaactataatcagctggctttcagagatgtgaaactaaatgtgattttacagtaaataatttccctcctcttctgatttgggttttgtttttattacaggcttagatgccacaggaactttcttttctcgttatggagcatctcttaaactgcttgattttagtatcatgactttcctctggaatgagaaatatggtcacaaactagactctatagaaggaaagcaacttgattatttctctgagccagcatcattgaaggaagcccgttgtttaatatggctgctagaagaacacagagacaagttcccagcattgcatagtgctttagatgaattctttgatataatgggtatgtggactgagtttagacttatattacatttaatcttaagggggaaaaaatctgtgaaggacctagcttgtttaaatatataacaaagaaaatagtgaaaattattatggtacaatcagtttatgtggggaagttagtgattaacagtagcaatttttttatatcatgaagcttttttactttatcagttaaagagatactcaaatgtaggtatgttatgctaacaatacacaatgttcttcccgtcttagatattttcacagcatcatgggaaagattgcatgttacactgacagaatctattagtaagtggtttgatttatagcattttagaaaacattggtctgcagaagtaggtgatgtttgcagaatctagaatggatagcattctaggatgttttaatgggaagagcctagaactgggggtcaggaaaagtaggttgtggcacagcttcttccttagtttggttcattaaaaaccctgtgggcccagtgatgggtgttgagaaggaattcagaaatgcttacacttgtctctgcccttgaggaccttgtgttctagaaaagagaataagaagcatgcactaataacagtaacatggtagtaaactcaatacgggagggccagagaaggtgccaagggcatcaaaggaaggacccaacactttctttctccctgggagagaggaaagctgtggtgcaggggtagagtctcagatgggctgtgaacgtgaaagtggaattagaaagctgggtgtcagggcttatttggaattggggaccctatttgggtaatggcatggagtccagcttgaactaactagctagctagcagctaattccttcttttctcttagatcttaatttcctcacattaaaatgagatgatttggaggcagtgacatgtgtggtcctgttttacttaaaaattataatattcctagattctaaatgataatttcttacctttcatactatatgaacatattatgataatccccaagtccctcagaatcagaagtctcctttatgtgttgttaggagttagacttttaaatgtcatgctgtttgttttaaagggtacattaaaaggtctggccttgtacgatggtgtcacagatgataaagttccaatgcatataaggagtggaaagcttacttttgacaacaaaagttcttagaaaagagcacactcaaatacagatggctttatcttttcaggatactgcttcatgactgaaggtgacatgctacttgatagcctgaatttattgccatcagtttgctgctgctggtaataaaatgctgtcccgggactgagcttacaaaacctgatgcatgtttggatcacaaaacaagacaactaaaaaggacacaattccctctcagcatacactcgtcctttaacttgtgttctctacatataatacacagcacttccagctgccactgtttctctgtttctagtcatgaggtcagaagccactaaccaaattattggcaatcccaatggattctcaagtgcagtagctctgccttccaccttcaccccaaacattttcagttttatctcttcatttaaaagaatagttatatttcttaaaacttttcaaaatctactgatcttgtagatcagagtgtttgacaatgtcatgagtgctttgataattgagagccccgactttttccctgacctcttcatgcatgatcccctagggtatttctgtgagacagccaaatagccccttaaagcagtatgactgaacccacctatcacatcttcagagatctgtttttcctcaatttatctcagtcaataatattgtatatctagtatttaaacaggaaactctgtaattagtctcaattctttcttttcagtattaagagtataacttgtttgtcatcaatccaaatgagctttgtccttgatctgtcctttgctgtccaccccacttcccgaggccaagaccttagttgtctttccacagttagaccactatagtagcctccaaactggactccatgcctctagaatctcccattttccgtcttcctcttatattgcagctagtgactcttctagaacatctgtctaacattctgttaactattcaatttgggaaacatttgtttagttttaattgcagattaagttcacatcatctggggtctgggttcatcatcatcctctatctctgagcacacaccccactactgactgtgcccaaacctgccttgtgctttcctgcctcctgtcttcactcacgtagttcccccagccatgccccacccctttgcttgttcatttcaagagtaacttaaatgtcccctctacctcagagcttctttgcccctcctgtgggcctctcccttgcagacttcagacttgagtccttcgtgagcctttgttgccttgtgtttcacgtggtccttagcacgctgggttacaggagtttgtctgtttgtctttctggcagtagaacaggagttcatcaatggtagggactgtcttgtgcatctctattcccaggactagcatagatggtacctagaaggcactcaacattatgctgaatcagattgaagttttatggttctttgtagttggtttcccgtttagtcagccattttgcccttggtttctaaactacacttgtgtcaaagccaaataaggaatagaacatggcctatgccagtagtatgaggcgttattttaaggctttagtgtactatatggaaatgtaaatatttagttttctcacaaaaccatctgtatattcctacagacagccgctgtactgtgttaaggaaacaagatagtggtgaagcaccggtaagttacttggatcacttgaatcttacgttctaatctgatgttaaaccaaggatgagaaggggacccaggccagtgtttattgacatcacagccagcattcaagaaccacattaaaaggacgtctgggtagtacgtactattattcattagaaagtcactgccagttttcctctcggaattggagcaataatcagcaaactatgaggcttaaattagacaatttctataaagtttcagagctgataaacattaatattctaattaagaaaggaagagttcttcatctcctggcataaaaatgaaaagttgtctttaataactaaacttctaatgttctgctctagaaggaaaacaaagggactttgttttgagtggctctaaattacgtttaagttaaaacagttccagagttgtcttccttagtagtttgcagttgccttttattcattcttcagaaattcttcagtttaggaaagtgagtaaatagagaaaagcacaacattgtggcagttttcaaagagaaaaatgcctgtttactgattttcaggagcaaatcatctatctatatgaaattttgtcttaatctgctccatcaaatattgcccagctaagcagggaaacacagctgaaatactccataaggagctgaaggcttctttattcactgtttgtgccccagtgtctggtcaggtgcagaatgtctagtttggcttagtaaaagaaatatattaataataaatttactattatggcatctaactggaattacttaaaagtctgattaattacttgaaataacagtccaaccctgtggaaaataagataaaaatgttggaacaacttaattttagtatacattagtattattaaattttgtttgttttctattataaatcgtagcacttgggctgatacactgtagtgttatttttgttaaacattttatgtacatttaacttatggctagtctgtaaaaactcatatggtttctttatgttgagcttcataatgctgttatttgagtgttcactgatttttccccccattttttagtttagttcaaccaaggtgaaaaacaaaagcaagaaaaagaagccaaaggattcaaaggtatggagtattttctgtattaattcttgtctaaactctccaaaatagttagttggacatatacattagaattgagcaattcttgggatattttgaaacatttgtagagaaagactttctaggacttaaagatgttttggcagtcttctacattttgaagaaattccaggttcatattatataatagcaagtcttgacactcgtattctttattgtcttttttatttttctaggtatttctgagtaaaaaaaaaaaattgtcataatgtcccaaaaaataaataagtctcaaaaaatagataacatatttaaactaaaaatgatgaatactaatcattatgacagtcccaggattgatagaatcccttccttcctctcaccaaaggctctcctccaagcccattagataagtagggcatttttatttttatttttgagacagggtctccttctctcacccaggctggagagcagtggtacagtgacggctcactgcagcctcaaactcccaggctcaagtgatcttcccacctcagcctcccgagtagccggaatgacaggcgcatgccaccatgcccagctaattttttgtattttttggagagatggggttttgctatattgcccaggctgttctagaactcctgcgttcaagcgatctgcctactttggccttacaggcgtgagccactgtgccagaagtagggcacaatttttaagtctttggtgggttcttcatggctcttgtgtgtatgtggggagcagaaagggggatggagtgagagagagtagcaaatcttcaaaggatgagaacagttaaggagttccaatacaacttttatttttatctttgactatgtatttagtttagataaaatgggagtttaaactgagtaacatttaaatttttttggagcattggaaactatcctaaatgttaatttgagcttatttttggctgttgaaacttttattactatgtgttcctgtttataagaaaatttggatagatcttatatatcagcaatttgtatgtgtgtttatataagtattcatcaattttaatgatttttctctttaatggaattttaaggtagaaaatcattgtcatttttctgtcttttaaaccagcctatgttagttgggtctggaacaacttcagtaacttcaaataatgagatcatcacttcaagtgaagaccataggtaagtataatttttaaatttttgcttcattttaactcaaatgtctttacttaataagttgtgttaatttaatatatataaacttgtgttttatttccctaactttcctttctaaagctgtgcatctgacaacctgatgtaattccatcttgattacatttatatagtgtggctagaaggcattaagaattcattcaaactgtgttaaagtcacgacactggtgacattcattcactaagtacatattgagaacctaccatgtgcaaggctctgtgggaaaatcatagaaaaatgtctagaaattattctttaaaatagtcaataaagagaatgtcctgttaatacttactaggcatttttgcctgtaagagaggaagctgttttgggagctgtatatgatgttatgttttcaccttatatattagtgattttcaatgccatctggttgtcaaaactgagttttcaataaacaaatatttaagaaataaaactagtgagtagcagtaacctttttatatcatactcctttatgaaccaaaaatgtacaacatggttttttttttctcatttcttaaaggagctatcagagcagttaaaaattacgtggtcatttcatggattctttaagtagggtaattgttttaagttaaaataatagcctgtcttagtcagtttgggctgctataacaatataccataaactgggaggcttacacacagaaatttatttctcacagttctggaggctgggaagtcccaagatcaaggtactggcagattcagtgtttggtgagggcctgctttctggttcatagatggtgcctttttgctgtgttttctcatggtggaagggacaaggcaactctctggggcctcttttataagggcaataagtccattcatgggggtagagcctaattacctcccaaggaatccacatcctaacaccatcacattggtgattaggtttcaacatatgagttttgcagaaacacaaacattcagaccatagcatagcctttactgagattaactcttatgtatcagacattgttttgggggtttacatacataaactctttcaatccacttatcctgcctaggaggtaagtgctattatattctgtccaatgtacagataaggaaactctgaggcacagtgcagagcgacttgcccaagaacacaaagcttataaatagcagagctgggatttaagtcatgcagcctggttttagagtccacactcaaactactacatctttttagagtgctaacatcttacatttaaaaaaaacttttgtttagatggagtttcgctcttgttgcccaggctggagcgcaatggcgtgatctcagctcactgcaacctccacttcttgggttcaagcaattctcctgcctcagcctcctgagtagctgggattacagccatgcgccatgacgcctggctaattttgtatttttattagggacggggtttttccatgttgatcaggctgatctcgaactcctgacctcaagtgatctgcctgccttggcctcccaaagtgctgggattacaggcgtgagccaccacacctggcttaaaaaaaaccttttattaataccatttaccagtctcagtctcactttaagttaatttatagcagttataatacaatcttcatttgtctttcagtcatttaacaagttataattaatgcaactttttttaaaaatatggagttttaagaattttgctctttggagcaagactaaataattgaaagtgcttacttagattgtcagatatgatatttctcgcctataactgtggaagggtaacttttctacactaagttccctggtgctatttttttgcaacatagagctgagtaatatattgccattattgtgtttatttcaattagacattcttctggttaaataataaaccaaaggtctatcatccacaaaattgggtgttttttgttgttatttaccagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgagtaagtgggttgaaatttttacaaccattattttatactaaggctgccaattaaagatcagaagttgtttaatttgtgcctgtttttagagattttgccacattttacacaaagttaatttaggattttttttttttttttgagacagagtcttgctgtgtcacacaggctggagtgcagtggtgcaatctctgctcactacaacctctgcctcccaggttcaggtgattgtcatgcgtcagcctcccgagtagctgggattacaggcttgcaccaccatgcctggctaatttttgtatttttagtagagaagggtttcaccatgttggccaggcaggtctccaactcctggcctcaagtgatctgcctgcctcagccttccaaaatggtgagattacaggcatgagccacctcgccccgccctgaggatttttaattattaaatttagagtcctaatgattattgattttgtcagtttgagctactaagtcgatactgagtggggtggataaaacaagtaaaaaattcaggaaaatctcagatagcttaccattttgagctttgtgttattagatagtgcatgaggccttccttttaagaaaataaatcaagggctgaggtctgtaatagagtattaatttaaaagccaactcttctcctggaagtcctgtcagtagcatatccaccatatggccctttcttctgttttcctgtattgcatcattcctatttagttctgtgctcttagatccttcttcatggtttttctttagagttgaaatgctgagcaaatcatatttccagagaactcttgggtgacagtgtggaaacaactgtaaaattatactattatttcttaaagtatgctagaatttgcttcaggcatccaaaagtaaagctaaagtatgtagttttcagtatttactgtacgcaaattcaaataggatttgtttttgagatttgattttctctttttatttaaaattcttattggcattattatctttcctgaataaattttttgttgttgtttttagaataaattatgtaattacatagttgaaagttatgaaataactttttgatttccttttgctttcccctgctcccagaaaagttttaaatgatcattttctaggaggtagacaaaattttctttatagtatcattgattgcagttaaccttatgtttgttatatttgttgttgaggaaaggttgagatcagtgaaaagtgaaacagtgttttcctttgggagaataaaagtttttttcaaatagacatattcaagtacttccttatagtaactcatgtaaatgtaaattttttccaagttacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaagaaaaaaaggaagaagaaaaacattaaaacaaaagtagaagaaatttcaaaagcaggggagtatgtacgagttaaactacaactgaatccagctgctagggaatttaaaccagatgtaaagtctaaaccagtgtcagattcatcttcagcaccagcttttgaaaatgtgaaacccaaacctgtgtctgcaaattctcccaagccagcttgtgaagatgtgaaggccaaaccagtatccgacaattcttctagacaagtttctgaggatgggcaacccaaaggggtctcttctaattctcctaaaccaggctctgaggatgcaaattacaagcgagtctcctgtaattcccccaaaccggttcttgaggatgtgaaaccaacttattgggctcaatcccatttggtcacaggatactgtacgtatcttcctttccagagatttgatatcacccagacaccgccagcatacataaacgtgttaccaggtttgccccagtacaccagcatatatacacccttggccagcctttctcctgaatatcagctaccaagatcagtaccagtggtgccgtcttttgtagccaatgacagagcagataaaaatgctgctgcctattttgagggtcatcatttgaatgctgagaatgttgctggtcaccagattgcctctgaaacacagatccttgagggctctttgggaatatctgtaaagtcacactgcagcacaggtgatgctcatacagtcctgagtgagtctaacagaaatgatgagcactgtggaaattctaacaacaaatgtgaagtaattccagaaagcaccagtgcagtaacaaacattccacacgtgcagatggttgccatacaggtaagagttaaatagaaaagtcttcttaatactgaagttaaattttccttttcatttttcattgccgttatatttgcaagaatccttaaagttgattgactttataatgattactgaagcttttgcctgaaaatacttttaaaatatgaactcttttgtgaggcatgacaggtaatcttctcagaaagaagcttgggtccaataaacaatacccatctttgctactgaaattctacacagattgagaaataagacagcaggtggagccaaaacgtcatcctaagaattaataaaggtgctggaggagaaggtggctgtttgtaggaaagttcaagtgctagctggaagtgtagcctgcatcacagtgccttacctgccagttacaggagggcccacctggaggccttccagcgtggggtgcctgccccataggacttagcgcatgaaggaggaagggaaaatgtgctggcagctcctcagaaagagaaggaaaaaggaagactctgacctacacaggcccagcttctcctgtcaaaccaggggaggaatgagaatgttaaaaagagacagccaggtagaaacaagagggatgtgtatgagttctttcctaacaaggaagagatgaaatcaagattctcctatggttgcctttatagggtatgaattcattaaatccttattgaattgccccactcattatgttttctaggaagctttgaaaaaaataggttaagagcaatggatcataatcatttccagatatgctaattctaaataactttcctaatatacatgtttacggaaagcatggaacatgatctaaatgggaaaaaaaacttgaaaaaattgtgggtgtgttttaaagtgttactacttgatgggcttattttactagagcgattgagataaagtgaattttattttttgttttgcccacaggtatcttggaacataatacaccaagaagtcaatactgagccatataatccttttgaggaacgacaagtgagtcaaaattacattaaactgtttaaaggtttagttttcattaatttatctagatggaatgatgaactagaactattttggagtcagcttattccacacaaagttatcatggaataagcttgagaacataacaaaaaaatgattttgtttttattgttgaaatttgagaagggaaggaaaaggtaatttttttccagcatacttatttcaaattataacagcgttattgttttattttattatttttaaaattttatttatttttattttaattatttttgagacacggtctcactgtcatccaggctggccagctttattgttttaactggtataatgagcatataataatttataagtaagcttattcatgcgaataatacagaaagataaagaccttctctactataataatgattcaattagaaaacctactaatataatttagttcgttaatatgcatcataagagaaaagttgtcttatcaactcaaagttgctgtaaaggtattggataaaattcaggtcactgtcttgaccaaaactagtaagaaaatgggaattgatgaatatttctcaacatgctaatattttaagccaaaagccatcatcttgcttaatggtaaaacatcaccattaatatttattgttatcctgggtatattaactgagaaagcagatatgagaaagaaagaagatagaaaagaggagatgtgagtatcattatttacagaggctagggctgtgtaccaggaaaatccaaaatgatcaactgaaaacctacactaacctatataaacctatacttgtatataaaaatatatataaacaattacctgttagaaagtatgttgaaagaaaatattttcaataccaaaaaagagataaaatacttaaatgtatataaagaaaaatttttaaatgctatggagagacacatagaagccttaaatgaaaagatatttcatgtacttggataagaacacatattatgataatgagattggttctccctaaagctttttaaaatttaacacaatcccagtatatacatgaacagggcaaattagttatgtatattgctgtatatataacaaacaacctcaaaagctagtggcttaaaacagtaaaatatttcacaattgtgaaatctcacaatttcgctaagtcaggcattcaggagcagtttagttggatgcttctggagattctcatgtagctagccaagatgttgaccagggcttggtcatctgcgggagtaactgggcccagaggttctacttccaagatagctcactcacatggctggcaagcggatgttggcagttgtcaggaagcttcagttccttgccttgtggacctccacctagccctgcttgacctcatggggctggcttttcccagagtgtgtgataccaggcagaagcggcagtgctttaggaagtcacaaattatcacttctgcgcattctcttggtcacatagatcaatccaccaaccctgatacatggtaggagaggtctatacaaggctgtgactaacaagaggcctggttactgcacaggattaatttgaaactagacaaattgattttaaacttcatatgtaaaaatgaacatcaagaatgggtatggaagagaaactaagaaaaggagttgtgcaactaaatatcaaaacacaatataaatctatctatattaccacatacatagaccattaatatgagagtgcctggccaacatgttgaaaccccgtctctactaaaaatacaaaaattagccaggtgtggtagcttacctgtaatcccagctacttgggaggctgaggtaggagaattgcttgaacctgggaggcggaggttgcagtgagccaagatcacgccagtgtactccagcctgggcgacagagtgagactccatctcagtcagtcaatcaagatggtagattggctgggtgtggtggctcatgcctgtaatcccagcactttgggaggctgaggtgggtggatcacgaggttaggagtttgagaccagctggccaacatagtaaaccccatctctactaaaattaaaaaaaattagctggccgtggtggtggacacctgtaaccccagctacttgggaggctgaggcaggagaatcgcttgaacccaggaggcacaggttgcagtgagccaagattgcgccactgcactctagcccgggcgacagtgcgagactctgtctcaaaaaaaaaaaaacaaaaaacaaaaccgaagatggcaaattatcagtgagcaaaaactggattattaaatacataggagaaatggattgccatctagaaaaaatcaatcttggtccctacctcattccttataccaaaataagttccaggcagattaaagattttagcataaaaaatggacctataaaagtatccaggaaaaaaacgggaaaaattttttgtaagatcagtaaacagcatgggaaaaaagaatgtttatattcatatacacatgcatgtaatgtgtatatcctatatgcatagcatatgtatgacaacaaatacatacacatacacatatcaaaacacaggagagaaacaaggaaaattatgtgcagtgtgaaacagatagagaactaatttccttaacaacaaagtttctataaatcagtaaggaaaagatcaacaatctgtcacaaagatgagaatggatgtgaatagacaattcacaatgaaagaaatacagatgatttttaaacatataaacagatgcccaccccacttgaaataggaaaagcaatcattcacattttgaaagatagtgaaactgaaatttctgggaaggcagttaggaatcgatctgcactcatatatgtatagagagaccagtgagccaaggggatttgtatgtttgttttgtctgtatttgaatcagcagaaaattgaatacaatctaaacctccatcaatagcggactagttaaattatgatatacctataaaatgaaatatcatgctgtcatttaaaaagcagttctatagttagatatggaatgtttgacaagatcaatgtctagttaagtaggaagaaggtcagagcttgtgtttcctgctgctatttgtacaaatagtgtttagtttttgctaatgataaaataatatatagagttcttaaattttttaaatgaataataccaaaaattatgaaagagaaattgaaaatcatctaccttcccatcactcatgttaatattttgatgtgtagccttccaggatgtttgaacatttacatataattaaacaatagtttttaaaagatgggatcacagcatatatattttatttgaaatttgcaggcttcaattaatatattgtagacttgtttccatatcagtaaatacgatttatagcatcattttaaatggatacttggttttccattttattaatgtgtgatcatttatttgaccaatttcttgttgttgaacatttagattgtatcagctttttatgcttacaggcagtcttatagtgaacattttggcctgtttactgttgttgaagtcttatgctgtgcttagctttaaaccaggtaggctctgttgtttaatgagtcagtgcttttgaccatcaaatgaatgtttttatcagtgatgggaatgttcacaaatgctttcttaaattagctgttagttttaggaccttgatgctagtataggtgattgctggcttctcaaccagtgagaattgcatttgaatcccagcattgctactttctcctgggactttgagaagttgcatcacttggttctctgatctattaaaggcaaacataatgtatttctcacagaagtatcgtgaagtttaaatgtaataacatagaggtggcatttagcttcctgcctgtctctgttggtaatttggggcatgtaaattcattcacgacagcaagttactattcactgtgatccttttgctgaattaagaattaaaatggaggtaactaaagtcttaaaccataaagttttgctcctggttgatagtaaggttgactgtttaattaatttagttaagcatggactctatttatagtactaaactttcggtctgagcagacaaagtggcatgctccaaggcaaaagggcatgtatggtcaatctgaccataattcacagttctccaactgatcattcacagagtttcaaatacttgattccctgcttttttacacttgaaagatactaaggtattgggggaaggtacaggaaatgtcagagctggaccaggtttgtgcctgggatagatttctaaagcctggctgccacagggaggacagttacctgcagctggagaagctgccagcatcaaacagatgctctttcagagttatatgcagtttgaaaggttttaaaaaataattacataaatgacatttattgtttgccaacagaatggtttctgggtttggggttttttttgttgttgttaagctggtgcaagaaatataactgacaataattcatagataatattttaatttgtcattttgaaataaccagcaactatttatttgaaacacctaaaagtaaagccaaagttaaaatgttctgtttatatctaaaatatgtataatatgtgcagctttttaaacctaataaataatcgttggtgttaattgtggagagtgacatttaaatcaaactgttgatctggtattgaacccttctaaagcaaatattcagaactaattatagtatagattggagaatttatgaatttcaataatatgaatgattatatttataaaagtgctggttttgctaagcagtgtttaggggtttttaattcctgaatgattgtgacatttcccttgtaaattttcatctgctttttactctcctttgtttattttaagaaacagtaaagaacaagatcataagtaggcattttaaatgatttttaatagattgttttgtaattcacttttagggggaaatttcacggattgaaaaggagcaccaagtattacaagaccaacttcaagaagtgtatgaaaattatgagcagataaaacttaagggcttagaagagaccagggacctggaagagaagttgaaaaggcacttagaagaaaacaaggtaatcctgtctgaaacctgtctttaattgcatgtagcatagttaggagaatgtgagtgtagctgtgcttgtgcggcctcagctgaacttctgcattggtggctaaacaaaagattctttctcagaatcgcctgcttcagatttcttcatgacatattaaagtggctgttgccatgctttagaacttctgcaaactgccttatgagaaaggggctgtaagtctgggttttcgtttagctatagttcagtttccctggttaactaaaactctattttatggtgactgagctctgaggtaaattcttgtttatattgagaggcagcataggaatagaggttcagaatgagagccctggagacagactggctgggttcagatctaggcatggttctatactagttctaatcttgggcaatttacttaacttctctgtgctttagttccttacctggaaaatgtgagtaataataactcacattttgtatggttagattaatacttataaagtacttaaaactgcctcgttagtaaggactcagtaagtattgtctgctactgttatgatcatcatcttcatcttactcctaaggaagtataagaataacacatggagccttagacatactagaactgtaaagtcacccagagtattttgttgagatctgctgaccttgaattctgttagtcaagactgatcatcagatacatggctagtggagggatagcaattagtggcaaagccagattgaattagtgagaaaatggaatcacagatgtgaggaaatcatggtgcatttgtttttaaaagctaccatcatctgtttagaaaggtaacaaaagaatagtaattcatttaagaaaggaggaatttgttccagaagtctggatcaatagctgggataacatattaaatagaagaaaactagcttagtgggaccttaatcaggaaacctatttactaagattttagtagaaatcttagggtcagtttgtaaaggtaactgtcataacattccccaggacctgtttatactcaagatgaggctggggagagtctaaggacaagaagaattagatagatcctgagactttactcagtttcctggctgggagaagtaaagaagaacaaaatcctacacagcatagtgacacatggaacacaagtttctataagctacttgtgggtttaacaaaacaaaatagttttataaactttatattgcctcaggaaacttcagttttaattcccatgtgggaattcctgtagctgcctgtttgagtgatgaggcagattggagacatagtcttaaaggtagcattcagccggtgagatatctttctttctggccgaggctttcctggctttataaattgctggtctgactgtgtgttctgtgtgcacagttcatcaaggctctttctttgtacagtcagtccagaagagtctcggaaataaagcacccagtgggagggccccagctctcaggcttttttttaacttgttaaggctttgagtctgctgttgcgtggccctactcaagagtgccttaaaagggcaattactaagccccccagatcacaggcctgataagttattagacttgccacgtaaaatgtatacctattccctaccaggataagtcgctaatctgagttccttgggttggtgtccacataagagtagatgagatttagccacagtcatttctttattaatggtggttacgctcatagctcatggagaaatttcttaaaacatagaaagaaatgagtggcttttcctgatatgtccctttggcctttgactgcagattgctgaggttatgagctaaccaacttttcctttatactccagttacttgatgccatgtttggatgtagcaaatgcatacccagccccttatagagaacagaaaaacagggaagctatagaaatctgagtgcattagagtcccactgcccataccacaccctagcacctccatgtagtagctttgtgatgttagacaatttcttcagcctctttgaccctcggtcttctcattaataatgtattgtctacttcacagctttgtgaggcctcacctggggtggttgaaaaaggacaggggctagccagagatagtaagtacagtactcaaggaggaactgtcccacccaaaattctgcttgtgcctctgctaagcaaattgtttttttacaaaccactttaagaatacttagcatatggccaggcgcggtggctcacacctgtaatcccagcactttgggaggccaaggtgggtggatcacgaggtcaggaggttgagaccatcctggctaacacggtgaaaccccgtctctactaaaaatacaaaaaaaaaaaaaaattagccaggtatggtggtgggtgtctgtagtcccagctactcaggaggctgaggcaggagaatggcatgaacccgggaggcggagcttgcaccgagccgagatcacgccactgcactcccgcctggacaacagagcgagactgtgtctcaaaaaaaaaaaaaaaaaaaaaaaggaatgcttagcatatacaggccgggcacggtggcttacacctgtaatccttgtaatcccagcactttgggaggccaaggtgggtatatcacctgaggtcaggagttggagaccagcctggtcaacatggtgaaaccccatctctaccaaaattacaaaaattagcctgatgtggtggtgggcgcctgtaatcccagctactcgggaggctgaggtgggagaatcagttgaacccaggaggcagaggttgcagtgagccaagatcgcaccattgcactccagtctgggcgacaagagctagactccatctcaaaaaaaaaaaaaaaaaaaagaatgcttagcatatactaagcatcagtaaaaatctgagcgaggtattatatatagctgatggggttctattattattcatgagctaagaatggcctctttaggcaattaggccagttatctattctctgccggcggaaaagtggctttttaaatttttttttttattttttagatggagtcttgctctgtcgcccaggctggagtgcagtggcatgatcttggctcactgcagcctctgcctcccgggttccagcattctcctgcctcagcctcctgggtagctgggattacaggctgcacgccaccaagcctggctaatttttgtatttttagtagagatggggtgtcgccatgttggccaggctagtcttgaacttctgacctcctgtgatcctcccacctcggcttcccaaagtgctgggaaggcaccgtgcctggccaaaaggcacgtgaggcaccgtgcctggccaaaagtagcttttttaaagccagaatctcttgttgtttttattgtaccctaacctatgactggcaggttataactggttgcaatattgctgaaggacataggttcatttttgtttgagaataaaattctcataacataaaatttgctgttttaaccattacaaagtatacaatttagtggttttttgaatattcacattattgtgtaaccattaccactgtctaattccagaaaacttttatcaccccaaaaaagaaaccccatatttattaatcagtcactccctatctgcccaggacatatggtcttaaggtgctttaatgagatgctaaaatgggcattgagtcaacattaggtcttaaaacactgtcaaattatttggcccagaataatttacagggtagaattttggacctttgtctgtattagaacagaatcttggccctgcctgccaaaacttcctcagcccacactggtgcagaggtgggattctcctcttcagtcatgggtccttgtcaagttcagccttttttaaatctatcatttatgaagctcctactatgtgccacactcaattgtttttacatgtatttaatctcaaaacagtccttatacaatagtgttatactgtagtacataaataaatctccatgttactggtgaggaaatggaggtgggagcagctgatgcagctttccccaagccacaccagtacgaagtggcagaacaggttgtgtcaggcttcagagcccatgcatttgttctcccttaagagaaggtcagctccacggcctagttcaactaactgttaggaatgtttctcaccactttacagcagtgtaggcatatcagttaatcactgtcataataatgctgagtgactcccagccacaaaaccccagtgacacatgactgtaatcgctaagcgtagaagtctggatcagctggtcctgcttgggctcggctgggtcagttcaccttagggctagcaagagctctgcagcatctttgctgttcttgcctacatatctgggttcagctggctgtagattgatctagaatggcctcagctgggatgactgggacaactagctctgctccacatgtcttgcatcttccaccctgaaaatcctattctgaaggcagtaggaaggtgcaaaggcaagcaaagatggccacacggcacctttcaagcttctactgacttcaggtctgctcagaccccaccggcaaaagcagtcacatagccagccagagcccgggctggggaagatagactttgcctccttagcgaagggaactgcaaggtcacatgataaatggaatggctagagtgtgaaggatggagctatgaatgccatccctccactacagtaggtcagcgccagtaatttactaacactcagtaattaccaagagccttctgtgattggtgcctgcttcatcttccgccttctcccttgccagttctctacattgttctctaatttaatggataatgtttgtcattcgatttctcacttccaaaccttttcccagtaccatcccttctgcctggagtggttttccttctccctgagcctgactccctcctgcttctcctttgggcatcactttcttgaggaaacagttgttgatggcaacctcaggcttgcttacaggcctttgttaatgcagtggtggtaataatgactatgtgagatggtaattatcattttataacatctttattgagatataattaaccatagcataacatttacctattaaaaatagacaacttaatggttttgatatatgcccaggtctgtgtgtagcacaatctaagtttcaaccattttcatcaacctaaaaagaaatcttatactcactagctgtcactccccattctctcctgtatcccagcccttggcaaccactgatttactctctagatttatctattctgggcattttgtataaatggatcatgttacatgtagtcttttataagtgtcttctttcacctatagtgttttcaaggttcatccatgtacatccatctatgttaatatgtatcagtgtgtcattcctttttactgtggaataatattctattgtatgactatatcacattttattcattcactagttgattgacatttgcgttctttccactttttcactattctgaataatgctgctgtgaacattcatggacaggtttttctttggacatatgttttcatttcttttggatatatatgtaggagtgaaattgctgatcatatggcaattccacatttaagcgtatgaggaactgcgagcctgttccaaaaccatcctaccagcagtatataaggattccagtttctccattctcacttacacttatcatcgtttgtctttttatttaggcctcctaatgggtatggagtggtatctcattgtggttttgatttttatttccctaaaggctaatgatgttgagcatcttttcatatgcttattagccatttgtatatcttctttggaggaatgtctactcagatcctttattcatttttgaattgagtttgtctttctattattgacttataagagtttttgggccaggtgcggtggcttacacctataaaaccagcactttgagagaccaaggcagaaagatcgcttgagcccaggagtttgaaaccagcctgggcaacatggcaaaatcccatctctacaaaaagttaaaaaattaaccaggcatgatagtacgcacctgtggtcccagctacttgggaggctgagctgagagggtcacttgagcccaggggttttgaggctacagtgagccaggatcatgccattgcaccccagcctgggcaacaacagagtgagaccctgtctcaaaaggaaaaaaaagaaacaaaacagggctgggcatgatggctcacacctataatcccagcactttgggaggctaaggcaggaggattgcttgagcccagtagttcaagaccagccagggcgatgtgatgagaccctcactcgctacaaaaaaattaaaaaattaaataaataattaggtaggtatggggatacatgcctgtagttccagctactcaggaggctgaggtgggaggatcacttgagaccaggaagttgaggctgcaatgagccatgatcttgccactgcactacagtttgggcaacagagcaagaccctgtctcaaaaaaacaaaaacagagagtttttctatattctggatacaagttgcttatcaaatatttgatttgcacatatttacttccatcttccatatttgtaaatgtatctcctgtctccattttgtgggttgccttttcactttcctaatggtatcatttgcagcacaaaagtttttactttgagtacactaagtccaatttctcttattcttctgttacttgtgcctttggtgtcatagctaagaaacccgtctacttcaagcgcactgcttacccatttaggtctgtgatccatttcacattaatttttcaaatagtatggtatagtaattatcttttatgcatattttctctaccaaactgtgatcttgaaagtaaggactgtttttcattttgtttgttttttgaatgggggtctcattgtattgccaaggtagaactcctgggctcaagggatcctcctgcctcagactcctgagtagacaagactacaaacacatgccaccagccccagaagggtggttttcaaaattatctttggttgacagcacctagcttagtatacaaactaggagctttgcaaatgtttatcaaacagtgtgtgcttggcccctgaaaagctgcatttaatgaattgtgttttcatgttctctatcagcctacatcagaggacatcaggctcacattctgtgaagtttgctgctttgtttactgctagtatggagttggggatattatccattctttcatgtgacagatatttcttgaatgttctcttaagtgtcaggctctgtgctggtcttgtggggcgtttctgcagcatcctcttcttgaggcccttctgtctgccatcacttccagggcctctcttgtgcaactggtttgtttttatgttttatattgaattgtacagttcattatattttctctttgaccttgtctgccagaaagttttcatgttatttctaaagaatggttaggactgcatgccattcatttttatattactctcactcatggttttgtattgtcattcctctctctctattctgttttctttatctgcttagcattctttttattttgtcttttaaatatttatgtatatattatctttttttttacaccatggaatactatgcagccataaaaaatgatgagttcatgtcctttgtagggacatggatgaaactggaaatcatcattctcagtaaactatcgcaagaacaaaaaaccaaacactgcatattctcactcataggtgggaattgaacaatgagatcacatggacacaggaaggggaatatcacactctggggactgttgtggggtggggggaggggggagggatagcattgggagatatacctaatgctagatgacgagttagtgggtgcagtgcaccagcatggcacatgtatacatatgtaactaacctgcacaatgtgcacatgtaccctaaaacttaaagtataataaaaaaaaatggctttataaggagaaaaaaaaaagaatgttttaatttcagtaagaatgaaacaataaaactttagaaaatgtaaaaaaaaaaaaattaaatatttatgtatatattatcaaaggtacctcaaatatttattttagaacaacactgaggtttaataaaaaagataagttttttcctaattgagaaaaagaaattgtttatagttatgtcaataaactgtaatatagcagatacagttgtgtatagcctatttgttttatgctaagtttgaaagaaaaacgttcaggagatcattctgtcttccatgcagtcagaaacaagctcgtgatagctgacctgtttagcattgtgaggcagctatggcattcagcagtggttagtacaaacagaagatgaactcatgtggtattttcgttgcctgagctatatgtgtatgtatgtgcacatatgtttataatactttgtgcttcttgatacttgaactcccttaggtacttgttgccaactaggttcttatgcctcagcataaccttgtggttgcacataatctcccagccaaagggatggatcccaggtgagatcattggctcagaataggagcacaggataggtgagaaacaagattggcttggctgccagcagcaaggcatacaaattcacattggtcctggtagaaccgaaccaggtggaacacaggattcttaagtagagtaggcatggtggtcacctcagtcacagtaatgactcaagaaattcaggatcaacaaggttgcagctaagaagatgtgggaagaactggttcctatgttaaagggaacattactgagctgttgttcaatttttgccacctaagaacagttgtcctgtgccaaaatcaaccttatccctgctgtaggattcagaaatcttaaaggaccttgactggttagcaaatctgcctttaaaaaacatgaaaaccttggtgtctaaggctgaagagggagtagtggtctcttaagttgatagagcttttgacctgagggccatgatttcctatggaatccatgtaggttgactttagtgtcctttcttacagagaagacctcgagtttctatagctgaaatgacctacgtgtgctctaagcctaagcaggaagttcaggctgtagggaacctgataggaagtaaaaaattaaaagtttccctaaagcaaatgtgaagttaggatttcattaagccgtcattgataatagtgagattttaaactagaaaatatttgtttcctttaaatattgctttgattcacgtttaaattaattattagaaatattaacatagggaatgttttacttataagtgactggtatttataagcatgtgccccacccaaaccccttgctacaattaaatagatgatacttcaaaaaagacatcaaacctttagagaatgtgtagattcagaagtttcaaaccagcaactacataggaagttgacaaagagggttaggtgtcaagtggtgctgtaccaaaccctccaggggaacggtaactagcattgtctccaaagaggttttcatttctctttgtcacactgcctgaaattctggcaggtatctcaacccaaatgcctttaatgaccagcaagaggattacatttatatttataaaagcaaacaaaaactattggccttgccaactaaaacatgcatacactccctgtagattagagaatcatttaggctggagagtaagtgtgaacacttctgggcacgtcggagtggttcttcggggtgtcttactgtaatcaggtacacgtagcgggtaggatgtggctgtctggtgtgacttggtgtcccaggcttggctggggggcatagtctgccacagggcgccagcttgggagtgtgttccactgaacttaggtcattgtttaagctatggcaccgtcacaattctagcctttcagtctcttttgttaaaaagtatattttgccatttatttaagtactttctaaatgtttttagatctcaaagacggaattagattggttccttcaagatttggaaagagaaattaaaaaatggcaacaggaaaaaaaagaaatccaagaaagactaaaatcactgaagaagaaaattaaaaaggtttcaaatgccagtgaaatgtaagtaatgattgaaaggcagtaatttttatttaaaaaaaaatattgtggcttttggttattttcacatttttgatatttaatattaaactacatcaagtaaagtaaaaatgaatactgttttcattgttttgtctcatttaaaaaagtattcattgagtaattatctcacctgaatttttttctaaacttaacattttttcagataaattatataaaagtgagagtagcatggaactgagaatccccaaggaactgacttccttccagtttgaacaccatccctttctctggccctcttttttcttatcagcaaaacatgggggctggtctaaaatctaaggttcttttcaaaagtaagattctgtgatgattatttataattacttttatcctgaatctataaattattaaaatttgtcttgtagtgtgaacgatttgataacatatacagatcctaggaatgattgtcaggtgggccaagagtgtgttttaagattctctgtgatccatccctaacctccctctgctcttaacagtgataggtcaaattcttcagcttgttttctaccactgtgtaagaaaacacccaaaagtcagtttctttattagcagccattgtatttgctcatggtcctgcaatctgggctgagttcagctgggccattcttctgctggtcttgccaggagtcctcatgtggctgaatttagctgggtgatgactgggggtggcctcagctgggatgctggggtggcttggcctcactttctctctgtgtagcctctctgtgatttttatttatgtggtccttccatatgatctctattatgatagccagacttcttacatggtagctaaggacttcaaatggtgcagaagtggaagccactaggcctcctgaaggttcaggcccagaactgtcacagcatcatctctgctaccttttattccttaaaacaagtcataggcttggtccagattcaagggcatgaataatgggaggctgggttcactggggggccacgctacacactcacctttcaagggcttttgtgtttttccatgccgcatgccatatgatcagatgactttcattatgagtcttgctagcattacatttaggcagtcctcaaacaatgaggaaaagtaaaacactgcctcagaattttcactccctgtgtcatgtcattttgatgatcaaagtagcttcactagtagaacacacttacggaaacaataatgtctgtaaagctttttacctctaatatttgagcatgaccagtcttggtcattttgttactaaaaagtgtggaaatatttatatttaacatactttttttgttcaattcagacatactgtcaaactagacaaggtaactagaggctgttaatgataagaaattttttttctgtactagcataaaagttaatttctgctggagaataaactttttattgttgacttttttccattttattattagatttctttacctttcctgtcacaatttaaagataagccacacgcttctctctaagttttttgcttttttttttgagacagagttttgcttttgtcacccagcctggagtgcaatggtgcaatctcagctcactgcaacctctgcctcccatgttcaagcaattctcctgtctcagcctcccgagtaactgggattacaggtgcccaccaccacgcctgactaatttttctatttttttttttttttttttagtagagatggggtttcaccatgttggccaggctggtctcgaactcctgacctcagatgatccacccatctcggcctcccaaagtgctgggattacaggcatgagccattgcacctggcctgctttttacattttccaaataaatgctttaaagctcaatttttctatttagatttttaagtaaaatctttaaactttttggatctctttctcagagatgcacaagggacatgaaaaatgatttcttggatgtttctgtgctcttgatcacacttagtattcgttaagaaatgactagaacatagagctcatgattggtacagtgacacaaaccacagatggctatgaaagaaggcagggcttccatgagagtgtcagagtgtcacccagtatttgtctatttagaggagggaggaagtgttttacaaaagaagtaaaataatagttaaactggcttgtattagaaacaagcggctttagtaaacagagatgactgcaaaggtatctcagggtagcatgaaagaagaggcagaacccgccttgtgcagggcatggctcaagaatcggagattcacacacttgttttgaaggattatcagagaatgtgagtgtgtgtgtgcgtgcgcacccgcgtgtgtgcatgaatgcttgttttgactttaagttctgttttaaagagtagaaggctgttttcattttgaatgagaatccacatcttctcattttgaataagatctctggttacactgatgatgatgccgcagtacctgtgttctctgcttgagctgcacatcttagactgagatagggtgatttacctgtaagcatatgccttagagtgaagaaaaaggtgatctggaaggaaaatttcccaaaagggaaatgacctcaaattattttcctatttagaagatactaaaaatgaaacaaaatgtaaaaatatatatattaaaaaatcaagaaatgtttttaaggatatgggtgcaatttactgtgtgggggtcctgttaaaaatttttcaaaattaattaatatttggtgattatgcttttataggtatacccagaaaaatgatggaaaggaaaaggaacatgaattacatctggatcagtcccttgaaatcaggcaaattaagcttaaatttatttttaatatattttaatacttttaatgccaggagtacaagcacagtagactttgaaatatattgttgcttgtctatttcttttaaataattatgtttctgttttctttatttctatttctgttgcattttaaaaattaatttataaatatattctttgaatatttaaatatttttattttacaagatttctgcatttatttcccattgtcaatataaaaatactgaatttattgttgtcaactttttttggattaacttgaaactataaacatgttgtaaaaacttttcttttgtgttacttggaatattcgtctccactgtaggctggtagtttgttgctgttattgctttataattataggttcattaaatttttactatgaatctatgcaaagtttccttttaacccttgcttgctaatggaaataatatgttttcacatactgctaaccagtacattcagtgataagcagttgcattctgcttttctcactattgtttcttacgcacattcccatcccggtttttgaataattttgtacagatttctttttccctttgggttctgtccttgtaatatgcgtcaaaacagagtttctggctcaaaggatagggaatgttttataaagcttactttttaaaatttttatttatttattttttgagatagggtcttgctctgtcacccaggctggaatgcagtagtgcagtcattgctcactgcagacaccatctcccagctcaagcaattctctcgcctcagcctctcgagtagctgggactacaggcacgcaccaccattgtattttttgtagatatagggttttgccatgctgtctaggctggtcttgaacttctgggcccaagcgatccgcctgccttggcctcccaaagtactgggattacaggcctaagccactgtgcccggcctatacagtttattaatgtcaccagattgtactccacctgccctcataaaaatggtgaactggaacagtaccctcaccttgattctcagcatgcccacctaatgtgcacttccatttcatatctgcctttgatcacttataaagcacaaagagcacacttgagcctgtgtattgtgtagtaaaatatgagatgagaaactgctctggaagatgtagctgaggctatcgtggtgtggtttcaaagctcatccagcctgaaacctttgtcatctcactgtgaaattttgttcaagaaagttttttttttccttcaatatttgtagcaacacacttacaaatgagaaaatgaaaatagaagagtatataaagaaagggaaagaggattatgaagagagtcatcagagagctgtggctgcagaggtgagtccatgacacttagtgaccactatggcatttgtcatttgtttttgtgtttctttaatgacatatgaggcataacagacattactgaaaagtgtggtgcataaaggatatcctgtaacccataatatatcctccctaaaacgaccactctttttccttgcctatagccttgtaatgttttaccggtattatgttgttacttaaatgcactcatagtgtacaccaaattttgtaacctgccttccttatttaccattataattcagccatttcctatattatacactttgaatactttcatcatatttaatcaagtgatgtaccatgaagtagccaaccatatttgccaatacttggaaaggaacttgaaaataatccacatattaagaatacgctccttctgcccctagaagaatatatagcaatgtcagtacactgtttcagaaactactgagacaaaaatcaaaattatgacatctggctgtattttatttagttccagaaacatgattctctatgtttctgtagctgagaaacaaatgatatttattggcatatgtgtctgtgattattctggtaaagtaagaaaagacttagtttatacagtctgcaaacattaggcttttcaattaagaattgactatgcacctgcttctaaggacaggaaaggaaaaagagccaaagtatgaatactttttgggtcctacaccagcatccgtattcctgagcttgtttaattcacaccaccgtttggtaagcaggtttgcctggtgggccctgtcaagtttactgacacctggattaaaaggctatttaatggatcatttggaccatgaggccattttacatttcctgcagtgattctcacaaaaatggccagttggtttgtggggaagccacagagagtctaaaatcttaaaagcataccccgaagcttttgatgcccttgccgagaacagcttctctgaggcttttctaaacttgcagaggatgcagcctttattaagggttattctgctgcaggaccataggtaatgcacactcgtgtacacatgcagttaacctggctctgtgcttatatatagcttaagcagaaagccatgtacagttattcatatctgcaaaaaggatcatggaaggtatgcatttgtgatgtcattttgttctgttttcaaatctcaaagtctaattcatgttcacctatgatacaatcaagttctgatgattctgtcatgcttcatttaaggagaaatgggaaagtggtttgaatgtttaagttttaacctttaaaatagtttcaggctgtcatttgtaaaatactcatatgtcttctgatctactggcaggtatccgtacttgaaaactggaaggagagtgaagtgtataagctacagatcatggagtcacaagcagaagcctttctgaagaagctggggctgattagccggtattgcagtttcgtgggtgttctcagcacgtcatttagaagataaagctaggaccatttgagaaaaacattattttgtattaggaccattttatttttaatagttatataattgatacatgttcaattgtagaaaagttaagacatacaaacaaaaatgataaaaatcattcctaattctaaatggatagataacatttgtattttggaataaattcatgaagtgtttgaaaaaatgaaaatttatgaattatttttactaaatagtatataggaaatttattttcatattggtaattacatatctccaacctaattttgaaaagttggatagtaattgagcatagaaacatgtcatgatttaccaaacactgctgtgctggaacagtggagttgtttgtgaatttgtgttaatataagccaccctgcagtgagcatccttatagttaactttttatgcacattattagtcatttccatgcagtaaaatttggaatgaagatcacattttcaaggcttttaaaattttttgccaagttgctttccatagtagctattatttaacagtctgcatgacagcatgcgagaatgtttacaaagtatattcacacatgttaattttttttcaactctccacataatctctacctgtttttgtttgtttttttgcgacagagtctcgctctgccacccaggctggagtgcagtggcctgatcttggctcactgcaacctctgcctcctgggttcaagcgattctcttgcctcagcctcccgagtagctgggattacaggcgcgtgccacatgcccagctaattttttgtatttgtagtagatatggggtttcaccatgttagccaggatggtctctatctcctgacctcgtgatccacccacctcagcctcccaaagtgctgggattacaggcatgagccaccgtacctggccttgttcttgtttgtttgtttttgagatggagtctcgctctgtcgcccatgctggagtgtagtggcgtgatctcggctcactgcaagctctgcctcccgagttcacgccattctcctgccttagcctcctgagtagctgagactacaggtgcccgccaccactcccagctaactttttgtatttttagtagagatgaatttcaccatattagccagggtggtctcaatctcctcatcttgtgatccacccaccttggcctcccaaagtgctaggattacaggagtgcctcccaaagtgctgggattacaggagtgagccaccacgccggccggccttgtttgtttttaagataaggcttgctgggattcctagaggatcttcttcaccctagtacttagcacttctctatgtgggattacttttcattgagtccttttaccatgttctatacacagattttgtgtttttaatcccagggttttgatccttcctggtgcttgccttttgattcaaatttcaaaccctcagcattgaaccagagattgtgtgaatcacggacagttttagtgtatagttctttttctttctttttttttttttttttttttttttttttgagatggtgtcttgctctgtcgcacaggctggagtgcagtggcgtgatctcggctcactgcaacctccgcctcctgggttcaagtgattctcctgcttcccgagtagctgggattataggctcccaccaccacgccaggctgatttttgtatttttagtagagatagcatttcaccatgttggccatgctggtctctaactcctgacctggtgatccgcctgcctaggcctcccaaagtgctgggattacaggtgtgagccaccatgcccggccccttcttcattttcaagatttaattttttttcatgagaaaacttttctgattaaaagtaaaatgctgatttagaatataggactagtacagctgaggttgagaccaagtggtagtcaaccgcctgtactaagcacccaccataggctgcattgtggctcatctgggaaacaaagataatctcagactcatttcatctaatagtatcaactcttccaataaacggtagagtatacaaagattctttcttcaggatgccatgctaactctgccttctccaccaaagtatagaaacatagaaaaggggtaaaaagaatgctctgttttttcttcaatatgtataatgaggtcttactatacccacagattggtagtgtttttgatcttctcaattaggagtagtcaatttatctgtcactttcaatagaccagattcatgaggtgctgagattcatgaggtgctgagattataaatttatcttaggctcatcctttatttttatattaaggtaatgattagggtttgattggaatcttttgaatgtttcagactacctttttaaaaaatctttaaatgcagacgctgtctttaatattaaacataaagatgtcagatgaagaacggtcaaactttcaaatttgggaaaagaacttaaaattcaggagacttattttctctctgcccttcggttttagagtttttgttatattaataattaaaattttctaaagtgtctctagtggcaagtttacaagataagcaattccttaaaaatagttggatttttgtgtgtatgtgattatgttaaatgtctcttttgctcatgtttagatgtttatttgaccgtaagtgcttttaatttttaaaatttctaaagcagttttatattatactttttcagtgatcctgcagcatatcctgacatggagtctgatatacgttcatgggaattgtttctttctaatgttacaaaagaaattgagaaagcaaaggtaagttgtaaacatcttttaatcccatcaaaatctttatgatagttataattctcgggaggctggtgtcatattgaatctatttcttttttatctattattatcaataattttttttgttgaaagtattatgagcttttcatggaactaatggttttgttttgtttttttgagttggagtttcgctcttgttgcccaggctggagtgcagtggtgcgatcttggctcactgcaacctccgcctcccaggttcaagtgattctcctgcctcagccccccaagtagctgggatcacaggcatgtgccaccatgctcggctaattttgtttttggttttggtttttagtagagatggggtctctccatgttggtcaggctggtgtcgatctcctgacctcaggtgatctgcccgcttcggcctcccaaagtgctgggattgcaggtgtgagccaccgcgcccagccggaagtagtgatattttcttaattaaattaaccatcttgacctctgccttgattggtaagattagaggagttatgtttgaaaaggctttggagcattcggtttaatgaggtcttattttgaatttccttaccaagacagttatgtttcatttataatgtgtaggaagaaacaaagtattaattgacaattgtggttttcccacactttactttctactcacagtctcagtttgaagaacaaattaaggcaattaaaaatggttctcggctcagtgaactttctaaagtgcagatttctgagctttcatttcctgcctgtaacacggtaagtctagcacatcttttttttttttttaaaccataattcatttgttaactggccaaagtagttatttgttgttgtttcctgggagtgaggatgagattggttaataattgccttaatgtttcattattggtgctactgattaaccttttaagctttataacattcttatataaaatagatcagtctttctacatctgtatgagggatggactgagatgaatacaccattgctacatttctatcactctcatgttccttggcctgtcttctatctttgtgtgtgtgtgtgtgtgtgtgtgtgtgtgtgttgtatatgtattcctgactttgaacaaataatccaggagtagcagttgcctgttgcgcactgcttttgtgattcaagcaggccgctatcaccacctcagattatactcttattcctagatatttgggacataagaccaaaatctaaaaattaagaggtttcctcctcaaatacagaataaaagctgctatgcctgaggcatacagggctttgttggtccggcacatcatattttactatttgtttgaggtatttgccgaatcttgttaataacagtgaataatcttgtctttttattttaatatacacagcacagtaaagaaaagcattaattgcattttgtggactttacaacatggctaaacccatatttcttagatttggacatagatagatgcttagtaaatactaaattgaaatgaattaggcccagaggagatcagaccataggaatttaaagttagatcttgagagaaaacttaggtaaaaaagaaaaacaaaattaaaggaggactgtgtgtgagagttgaaagatataagttccagaatgttgtggcaggacagtgaaatcttctggttcctaaagacggaggagactctctcccagcacctgacttccaccctcccactactgccagacctttgcctgggctgttcctagcctggagcactgtccccgctctgcatcctgccttcccctgaaaccccgtcaggcgtgccctcttttggcctcccactgtgtcccttctctcatgtgcattagatctcagcctggccttgaatgtctctttctcaccagtaccttgcacagtaaacattcaaacttactgtgaattcatctgaaaaaaaaaaaattaagtgtggaaaaagtgtgaccaccctgaactgagtaaaatattctgttgagatccagttttttctctccattgaatgtgcagttttagttagaattacactaaagggcacttatcatttatcgtttttccaagttcttgtaacagatatgtatagagaaaacgttggctctcaataggatattttactgttagtttgtaatcctagcttatgttattttatcaatactcaaaaggattttcatatcctaaattctgggaactcttagtgtgccaggagcttgagtaataagtgtgcctaaaaattatttgtatctcatttctccctcattcattcattcggtaattagtggtgataaagactgatgtgggctgtgccctcaaagtgcacatggacttggggaaaggcagactttaaacccattgttacctgcagcagagtgaggtttctcatggcagaatgctggagcggcgtggatcaggggccactaacctaatctagaggtgtggcctcagcgggagattcccagttggaagtctcccagagacagagatctgcaataggaacttaccagacaaaggagtgagaggggtgtgtttggacggttagagttccagatggaacacacagtgctcctggagcctagagagacagagaacacactcctttcatactgtaatagaagcccagtatgacgcaggggcaaagccaatggagccttcttctctaagctgtgttacagcagcttagacacttctagcttcattagaccagacaggataggtctcaaataagggaacagcagcagaacaggagtccctccttcttcatggcttcgctttccgtggtttcggttatccgcagtcaaccgcagttagaaaatactcaatggaaaattccagaaatacataattcctaagttttaaattgcacactgttttgagtagcgtgatgaaatctgtattctcacatggtcacattgtgacctcctccctttgtccagtgttttcatgctgttgctgctccctgcccgcgagccacttagaagctgatttggtgaccagatgaacttctcgcgttaccccagtgcctgtgttcaagtcacccctattttactccataatggccccaaagcatgggagtaatgatgctggtcaatcagatatgccatagagaagcaatatattgcttcctttaagtgaaaagctgaaagttctcaacccaataaggaaagagaaaagatcgtatcctgaggttgctaagatctatggtcagaacaaatctacccatgatattgtgaagaaggaaaaagaaattcatgtacagtatatgtagggttcggtactctttgcgacctcaggcattcactggggggtctcagaatgtatccctgaggattacgggaagctactatgctttttgaagatgagcttgccactaatgtgggggaatgttggggaggggcttgagtgatttccatttgttcgattatcagtttattgccatcagcctgtcctggatggggcatggcagtgggggtggagggaagagaacagatgtgagaggtgattgggggtacatttacaggtgccatgctgctcaggagaccaggccccatgtgtccacgtgggagttgagggtgagtcttgggcttccgtccaggagtactaggggaagagcaggactggggaggctgcctgaggctggtttccaaaacactgactttgagttgccttggaatcacccaagtggatttgcagatttggatctcaggaaaatattctagactgcaaacttttaaaaagatttggcctcaggcagctgcatggggaggagtgtcagcactgcaggcgtggacggaggcctgagagctgccaggagagctggcagggaagaggaggcggccccctgggatggagacagctctggggagtgtggtggccatgatgttccatctgtcagctacatggtttagctcagaaggggaaaagtgtaaccaggtagaggctgaaggagggccagtaggcaggcaaaatggtctcatcttacagagaaaatagtgacttatagagataattatttagaagtctgagccctcctactcttgttctaataactaacaagttattgtcaagaattcttttaaaacgaaaatatttaattcatggtattcaggtttcctgtgcacggagcctctgcgctgcgttactgtatttattcatcggcctttgtccttgggcgtttcatccttcaagggaagccctaagtgatccatggtgtggtgtgttcctcacaggttcatcccgagttactccctgagtcttcaggcgacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacaggtatgaacagaaaatgtctgtgactgtgtttaatactttatcgaactgaggtttcctgattagataaaatcatggctagttaggtgttaacatgaaaagggttgcataattgttttgctcagaaagacagttgctacatttctttctttttgtaaatatagagataagtattttcaaataaattggtgggttttttctttctttttttttttttttttgagacagagtctcactctgttgcctaggctggagtgctgtggcacagtctcggctccctgcaacctctccctcccgagttcaagcgattctcctgcctcagcctcctgagaagctgggattataggcatgcatgactaagcctggctaatttttgtatttttagtacaggtggggtttcaccatgttggccaggctggtctcgaacttctgacctcaagtgattcacccgccttggcctcccaaagtgctggggttacaggcatgagacgccacacccagcctcaaataaattttttaatgtgcatatgtaaattgaaaacattgagcactgggtaatattcatcagaacccatgacaatttgctaagattttgatgagaccaatagcactgtctaaaactagtgttatagtatcaataaatgaacgcaaaacaataattttgcatcatttggggggacaaaattatatatagcaaagaaggcagcagcaacttaaaccttgttatataagacctctgatttgttagagtgtgaggttgaagactggatggaattccatagtgaatggggcatgtggacatgttaacaaggggtccttgtgaatgtgggaaaaagctgcccttacctgagtgagcaagagctgtaaatagagttgggatgatggcaggctcttcagtagcgtttctgcctccacctctggtttccgctgttcaggttgttacgagggggacagagttgcctcttgtctcagctgtgaaagatgatgaggtagaggcggtgtctctgaagtgcagctcggatcaaaggactctatgctcaggaatgacctttggcatgtgccctattatttcagtttctgagacagtgttaattacaggcttcaaaattgaaatttgtaaacaatggggcagttaaaatatgattagccagcaggcatggtggctcacgccaggccgaggcaggtggatcacctgaggtcaggagttcgggaccagcctgaccaacatggtgaaaccccatctcttcttaaaaaaaaatggcaaaactcgcttgaacctgagaggcagaggttgcagtgagcagggatcgcgccactgccctccagcctgggcaacagagtgagacactgtctcaaaaaaaaaaaaaaagttatgctttttagatagttattgttgttatcagtggtcttcagattaattttatgtgcatttgtctttgtttctttgggttgggctgttggattaatattggcatgtaatatttcttagcagtagagaactttctgttgtcattcatcactcactctccctttcagcactgagcttgctggttttattaaaaaagtgcgaagcaaaaacaagaactcactctcaggattgagtattgatgaaattgtccaaagagtgacagaacacattctagatgaacagaaaaagaaaaaggtattttatctagatgttccagtttatccttatttatttataaaatatgagaattgttaaaaaaaaaaaaaagcttcaaaccaaaacctagagagcaatgtactaaagacagaagatggtcaagttgttggataactggttgcttccctcttgtcccctccccgccacccctgttattttcgcagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgtatgtataactgtatagttttgttttttaatgaaaaacaagaagcaaacaaaatttttaatccatgatttagccccattcatttctagacctaatttatttgatcccaacattagaaactgaatttcaatgtacttgaatgtgtccagttagagcaatcagtgaatggccgaggtcatggtgtctgctgtgatacgtttgggcccagcatggagagaagcccctgcacatgagtgacaagggctctgaccatcgtgggggatctgagccttctctctcttgcccttgttttgctgcagatggtcaagtacatgaactttgtacatccagtgtggtattttgaacagttggggaaatcatttttgaataattttcttctgtgtaaccatggctttggaattacacagatgtgtcaatgtgtcgtgtggccacacccaccccaagatagaccgtgattgcctggagaagagggttctgtttttgcttcatgatggatgtttgtagtaacgaagatataaaagctgacttactgaaacttcaccagattgtatgagaaagaaaaatatgtgttcaaactgggacctaatttgataaccatagtttgttaaaattaaaagtattaattttcaaattacaaagtattacatacaatagaaaatacaaataaaaagggcatttaaaaacccgccctgtaatcagtattaccactttggtatatatttttctaaactcttgaatgcatggatatgtgaattagtcaaaactgaatacgctagtcacactttgtatgttctctgaggggctgaatgttttggttgttttccatttttttttttattgtggttgtcctttttttcttttagttagaaatatactgtgcccatcttttctaggaaatagaaaacggtcaagttaagtgtatatttttttcaaactaaacctggctccgagctttgcactgggcattggagaggccttcaatggctcttccccggtctggcacttcctcttcttccctgaccctcgagtcatgggcagcagtggaggggcatgaaccctccttctgcagcatctgccccatctcctcctgggccgagtcatgccttgggagagacagcaaaaccctgaacagcagttcaaggtcttctcagccttggggtgatgcctccagtgccactccctgaacttgatcccactgccagggctgcctgcattcgcccactccctcagcaggggtttttagagcatgagtttgagctaggttttctgccagctgctaaagacccagatgggactcattttgtgccttcaaggcgctcagagttaagaggcagtgagctagagtagaagttaatggtgcagtaagggtaagtgctgtgagctgcagggagaactgtgcctggagtcccaggcgacactcaggtctgctctcacatcgaaagcactgtctatgctcaccagactgtgagccgctgaggccagagccctccattcatctctgcgtccagcacccgacaccaaccctgcccatggatgtttgccggatgagccatccgtttgttttgttttgatttgcacaagtaatccatgctcatagaaactagaaaatagtaaagaaaaagattaaatctcccttaccctgaggcaaccactgttaactgtttttctaggcatgtatgtatacatgcagcccctttattaaaaagtgagttatatatgatacatgttgtcttgttagctgctttcattcagcaggctgttggggccagctttctatgtcagggattatgggcttccgtcatgattttccttttggctacacaatagcccattgtgtggatgtgttggaatttactaccctcaactgttagatgattaaatgtatgattaattcacaccatgccatgtgattatcccatactgtactttaggtatggtaatcttcacctggggatcttctggtcacataaaacagttttttctctgaggaaattagaactttatacttttctttttgtatttttatattttttcttaagaaatgctattaaaaaataagttgtttcctcagactgtttagctgtaattgtgaataatttgccaccctttgtggcagaagatgtttgaaggccacttgaaggaagaactcgtgtcataaaaacaactgtagttattctttactattcaggtgtgtttgtttccacaggcactgggtgcaagttcctgtgaaatatgccacgaggtgttcaaatcaaaaaacgtgcgtgtgctcaaatgtgggcacaagtatcacaaaggggtaagagctctttttggccatccttacagcatgcattgggaccttcaaatattttcaaaataagaaaggaattgttttctagtcatcagtatttattgtgctttcaaactattttctttgcaaacctcccgtgtcagtgttcagtgcctccctgtcctcacaccagctctgcaggaagggcagctctggagaccgtcctttccatcccttgtggggagaggggaacagcagctccagccactcgttagtgctgagattcaaagcagtattagttccttgaaaggtgatttcttacacacttgactaaatggagaaacagtgaaaccatttttttgacttagtgtagtatatgaagtcagtttaacattttagaggagaaaaactaaacctagctgagtcccttctgcctgacccagggacagtcctgctcgtaccgttctgggatctgtgtgtgaactatcatggtgttctaggtaccgtgagcatttgtgtgcacccctgctgctgggttagaacagatcaggtctctgccatggggatttgctaatcccttggaacgggataaatacagcatgctcactgaaaggaattgagaccacttgccaagtctctggtgtggtgtgcctccttgggtacagggtcttatatttgggctagctgactgtccacagcctctgcagtgtgggcagcagcagcaggagtgtggcgtgcaggctggagggctgttccagagccaagggccaaggccaggccaagggatgggctaagaatgagtgattgggtcatagggccgagaatgccaggctctggaatttggcgcagctgaagtggaagagccgagcctggaaccggggatcagggcaagaccaccccctgaggccaggttggaggcccagagcgctcaggatctgaccctgaggtgggatcgtttgcggctggggctttgtccacactctggcctgagcgggtgttggtgtccctgagtattgggcagctccaggcccaagagaccaagggcaagtgagccacgcctgccaaggagcccagcagcacaggggagctaagcttcctcatggtcctgaaggcatcttctgattttgttttctccttttcagtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgctgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccacgtttgttccccttttctgtttgaaaaacctgttctggtagctccacaagagagatgatactgactttttaaattttttacaagagtctgtattcctgatatgcctatatttttcctcaaagattctgcattttaaggatgggcataagcaaactatattttaataatttatagttaatgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatgagaagttcactgtcactcttgtccattctttcttagagaagtttaaaaatgcattcttctggaaaacttaggacatgtatgtcatgctaacattttaagagtgctttcgtcaggaaagaacagccacgccatgctgtgtctgaggagtctgaccagggatctcagggcgttttagggcctgggtcagaattttcctttgtgcctgcgtaagatcgactataggagttcacacagagatgatagagtttacttcttaaggctaaattaagagatttttcatgtgaatacatataaggatgttgaagataaattgcattccttggtatattttttgaggcatttgtggatttatgggccactgaggctgtcgatggggtttcctctatagaggggcttctgggtatgctgagcactcacagagtgaaagctcatttgaagaaagctcattttcaaaatctgtcttctgttttttcaagtgtattcaaagtattatcagtacgtatttttagtctgatggcatttaatttaatttaaagcaatgactattccttaagaatttaggccggccgcggtggctaacgcctgtaatcccagcactttgggaggccgaggtgggcggatcacgaggtcaggagattgagatcatcctggctaacacagtgaaaccccgtctctactaaatacaaaaaactagccgggcatcgtggtgtgtgcctgtagtcccagctacttgggaagctgaggcaggagaatggcgtgaatccgggaggcggagcttgcagtgagccgagatcgcaccactgcactccagcctgggtgacagagcgagactccgtctcaaaaaaaaaaaaaaaaaaaaaagattttagattagttttccctgctgaactgcttaatctatgttatgaataatggatagcctggtataaaattgaagtggtgccccagcaatgcaaaatgttactacggttttaaggtaatctcaaagactacagaagtgcccccacttattcgtgattttgatttccacagtttgttacccacggtcagccgtggtctgaaaataggcaagtacagtgcagtacaataagatattttaagggggagagaccacactcacataatctttactacagtgtaattgttctattttattactagttctagttgttcatttcttactgtgcctaatttataaattaaacttcatcatagatacatatgtataggagaaaacattgcatatgtggggattggaattttctgtggtttcaggcatccactggaggtcttggaacatatctcccacggataaaggatgtgtgtgtgtgtgtgtgtgtgcagtcgcagcaggtggtcaaagtgctcaacacaccacaaactgaagcagtaaaactattttagagtagttttttagtcagatgactggagaagggaattaaaggaaacagtagaagacacaatagcaaagatggaagttccttctgtcagcctgaggtacttactcaggaggctgaaaaagcagaggccgtaaagtgataggatggttggtcagaatgaggaccaaaaagcatctgcagtatgacctcagaaagaaagaaggtatcagaaggagaagctgggagggtatacagatgagtaaattcctggtgaagtgctcagcacagtgcctgcacacaaactcgtgataaccggagctaacaactaactgtcactaagattaagggcctggaaattgcacaagaaagagtaggatagtacagtaggaaagccgccgttagttaggaagtccacttcctcagtgtggcctggattggaacacgatccagtggtgaaaagagcaagaagaaatcagatcacctcaaagtcgttttggaaaataacagctttgttcctgagatctccctgaattgacttcaggaatattgtgattctatagcaatggatcatttcaccttttggctttcccaaattatcggactgagcagctttgagtcaacctttcctatccagtttgggttgaggatcagggccctgtggtgggctcactagggatatgccctggagcatcggtgtggccaggcaaggctcattgtagtggaggtgtgtagtccagactccctggcttagggtgagaactgttaccatttgttccatcatcgcctctactttttttttttttttgagacggagtctagctctgtcgcccaggctggagtgcagtggcatgatctccactcactgaaacctccacctcctaggttcaagcgattcttctgcctcagcctcctgagtagctgggattacaaatgcacaccagtacacctggctaatttttatatttttagtagagacacggttttatcacgttgaccaggctggtctggaactcctgacctcaggtgatccacctgccttggcctcccaaagtgcagggatttataggcatgaggcactgtgcccagcccattgcctccactttatactgtctcttcctattctccctttaaaggtgaaaaaagataaatattagcaagaatgcagaaactaaacaatagtaaactagaaaatcctaatgagtcatccattaatcaagtcggattgataaaccatcatggcaaaaagagacttttaactatgttaagaagaataatttgggggccagggcctggtggctcacatctgaaatcccagcactttgggatgctgaggtgggcagattgtttgagctcaggagtttgagacaagcctggacaacatagtgaaaccccatctgcaaaaaatgcaaaaattagctaggcacggtggcacatgcctgtggtcccagctacttgggaggctgaagtgggaggatcacttgagcctgagaggcagaagttgcagtgagccgagactgcaccactgcactccagcctgggtgacagagttaccctgtctcaaaacaaaaacaaaaacaagatctccatatgaaaataaatgaagcttgacctctcacagcatatacaaatgtcaattcccaatggatcacagtcctcaatatggaaagcaaaataatgcagcttctacaagaaaacagacaatcttcctgcccctggaataggcaaagattttaaggaatcactagctccaagaataaaatgttgataaactggattttggtctgcactaagaactcttaagttgctgttgagagagtgaaaaggcaaaccatgaagtggaagacgctggtaatccacacttccaacaagactcctccagaatgtacaaataactacaaatcagtaagaaaaagataacaatatattagaaataggcaagagatttgaataggcacttcgcaagtatccagatggtttgtaggcattttgatagccacatttgttcaaaatcaatcaccaaggaaatataaattagaacattgctggcagggtgatagggtttggattcgtgtccctgcccaaatctcacgtcgaataggaggaagggcctggtgggaggtgattggatcatgggggcggatttcccccttgctgatctcatgatagtgagtcctcatgagatctgatagtttagaagtgtgtggcattcccctttggctctctctctcctgcccccatgtaagtcatgcttgcttccccttcaccttcctccatgattgtacattttcctgagtctcccagccatgcttcctgttaagcctgtggatctgtgagtcaattaaacctcttttcttcataaattagccggtctcaggtagttctttatagcagcgtgagaacggaccaatacacagggtattttaagttgtcttgaagtttcctggttctagcaggtaggaccatgtacttagcaaggacctgttttgctgttctctggggcatgggtgaaggtctggggtgtgagaggctacagtgagctgtaatcacaccactgcactccagcctgggggacagagtgagaccctgtctcaaaaaacaaaaaaaaaaattgaatcatgtatacacttatatcaaaaaccaatgtactcctgattacctcaacttattatgttgggattattgaggtctatagtatctgtatggtggaaataccgtataatgcaactcttcccaactctgtgtttagtggggtgacactggtagcttgaaatcaaccatcgttggagtactaacaccacagtcattggcaaatgctgttttgcttccctggaaaagctggtaaagcctggagttctgctggtctggtggtgctggtctggtggtgcttgatacctttctcatttcacatttgaaatggtgattcaggcactcagcaaaccctgctgggatgatttctgctgagagagctccttcccattgctctttggctagggtcctcacttcccttgccaccgcctggccttgcctggttctctgccatcctggaaaggagacactgctctctgcagcgtctctggcccagagacaggccgagtctgtcattgcattagcctcttagtggttccttgggggccactcccagcagaacctctgtccctgccacaacaggtcctgtgctacgaaacaccaaggaagtccccttcctgcctctggccaggccctgcctgagagggtgcatgtgaatgcaaagcaggtctgtttcaggagtgcccaaaaagaagccaccaggaggacacctccatgccagaggtgactcatcttacctcccagaggaaggactggggccggtcccttggccttgccaggacagcctccacaacgagcagctggtatggttacagggctcctgtggcaggcactttcaaagagacaagcttgctctctgtaacatgtgcctttgtgtcaaacagacctgtcattgttttcagcaaataccttgggacttcagtgcataaataccattctaggtatttttcagaagttgtgtataaaggcattctgcctaattccttcagtcctctatttcagtttctatttatttggtgtgatagaaagctcttaatttagatctccccaccgccagttccaagaaatctgccaccagctccaagcctcatgtcctgaagtgccacctcattcccgcggggtgagccagcagcctctgaaaagaggaagccattgaacagatcacactgtgcctcccgccgctggctgccgccccagcgccagcaggactccggctttgactggggactcactggaggccacatcgcttttgcttccagtttccaaactgccaccacctcgaaactgccagacctttgaaagctgaggcacagtgcctcaccccttccttcagaagactgtccagctccccctccttcccctcctccctcccccactggggacctctcctaggggaggggtctggtgtcctcagctggctcctctccaccttcgcttctacccgggggctccagtgcatctggctttatctctggggtgagccatgcggccctggtcatctggacgggccactgaactccacacattcacctgttcactggctcatccattcattcatctggtctcatgtgctgccctgttctaggtgcttccatacaaaggggacagaagagatgatggaaggcctcagtactgcaggaggggagacggatgtcatctacaatcacacaatacatgggaggtcacaggtgatcccgaggaaaacgaagctgggaaggggatgagggagtctctttgtctaaacttgacccaggtttagacagaagccaggaacggcgtcatctgagtgcagcctgagggacgggggaggaggtaggggcaggggcgggcagtcaggcagagaagccagtggagcgatgcccgctagggtgtttccagagcccgaggaggccagagccgctctttgcctggaggattgtacagaagtggggattcccagggggtggatgggggtgggggctggggggcagtggcctgagcctggcagctcagggattcatgcggcaggcggtgcagcttgttggtcaacctcatgaaatactagttttgcacgtggccttagactctggggacttggtctggggccaggtagggggcatttctgatgtgatgtcacctgtgttactctatccgtcagggccttacggagcccttgcttcctccaacacccccaccggctttctcctgtggcttaaaattgacctagtcagtcctgccagtgggtctaccctgcaggcccatgggagcacccatggatcccagtcctggcccaagcacctgccctcactgctacccaccccaagccatcagcctcattctcactttacctcctcacacctggtttcactgaagcctgggccagccccctcaaccccttcccaagctcccatctacccctgccacagccctgctccctgcagcaggggcctcagaagttagtctcttggagcgctggggttaaatgaatgtgccttgcacatactagctgctcagtaaacacaaaaaaactcaacccaggctccagaacaagagccacaccccacaagctggctgtggtggcctctgaatctgaattcccacctccatgtgaccttccttaagcccctcactccagccctgctcttcaccatctcccaacatgatatttactaatggtcatttcaggtactgtgttacctgtccacaaacattgcagcatttaatttccccaagtaccctatgaagaagagattactcttgcctgcattttacagacaaggaaataaacctaaaaggttaagtgatttccccaaggtcatgtaactggaaaatgtcaggatttgcacttgctaagccaactctctcctctagccattctgcttcttcctcttaatacaaaacccacttgtcccccaaggttcagctcaggttcccatgccaaaaccaaaccttcttaggcatgcaggtggcaaaagccttggaacccctgtttactactgctcaccctcacaccacggctgcagtggctttccccttcacgtttgctcatgaggctgatgcagggcaggtgagacccaaaatcggggcttagcccgggagggttcttggcttcaccctggaaagaattcaagggcaagctggtggtgttaagacagcaatttttattgaagcggccatgcatagcggcagcacaggtgctgctccctgcagagcagggctaccccataggcagtgcgtccagagtaacagctcagaggcagtgctgcagtcctatttatagccacttttaattatatgtaaattaaagggcagattatgcaggagtttctaggaaaagggtggtaacttctgggttgttgagtccttgccatgggaaggggaagtaatgtccgggtgttgccaaggcaatggtaaactgacatggcacacgagtgaatgtgtcttatggacggttgcttctttttaggactttatatattctagacacaagtcatttgtcggatgtgttttgtaatttttcttcaagtctgtggcttgcattttcattttcttaacagtattttttaacggtcttttgaaattttgaggaaaagtcttcaattttgatgaagtccaatttattatttttttcttattatttttatacttagttttttttttatttaaaaaaaatcagcaaggctgggcatggtggcttgtgcctgtaatccagtactttgggaggccaaagtgggtggattacttgagtataggagtttgagaccagcctaggcaacacagcaagatccccccctccccatctcttttttcagaagaagaaggagaaggagaagagggagagggagagggagagggagggggagggggaggaagggaaagggtggggagggggaggaggaggagagaaggaaagaagaaggaggaaacaaatctgccaaaccacccaaagtcaataagattattcttctcaaagttttttagtgttcttacatttaggtctctgatcattttctagttgatttttgtatgtgctatatcatgaggattgaggttcactttctttttgcatatagttaactggttatttcaacttggagccttgaaatcatgtagcgtaagtcctctaattttgttcttttccaattttgctgttgactattctatttattgccatattaattttacaattaacatcaatttttaccaaaaagtctgcttggattttgatctaagcatctatagatcaatatagggagacttgacacctttacatgattgaatcttccactctgtgaatatggaatatctctccatttattcaggtattctttaatttctttcaggaatattttgtagtttctggtgtacacatctttcaatcttgcacatcttttgtgaaattcatccctaagtattttctatttttgatgctgttaacaatgtttactttaattttaatttctgattgttcattgctaggatataaaaaagcaattggtttttgtatatttattttatatcctgcaaccttgctaaagccacttattggttctagtagcttctttttatggattctgtagaattttctacataaataatcatgtcatctgagaataaagatagtttaaattctttcttcccaatctggatgccttttatttcttatcttactgaactacatacaatgcaattaagtccaaatgttgaatagaagagatgagagtgggcaattttacttcattcttcatcttagactgaaagcattcagtattttactactaagtataatgttgattgtagattttttgtagatgccctttagcaggttgaggaagttcttttatagttctaatttgctgaaagttttttttaaatcagaagtcaataacagatttgtcaaattttttctgcaatttggatgattatatgtatcaaattttaagttttccttgtttaatctgttaatatgataaattatttttaaatgttaagccaactttactttcttgggataaaccccacttggccatcctttttatattattgttgaatccaatgttctaatttttgaagtgaatattattttaaattgacaaatcataagtgtatatatttatgggatacattgtgatgttttgatatgtgtatacaatgtggaatagttaaatcaagctaacaaatatatccaccaactcacttatttttttgtggtgatacatctgaaatttactcttttagctattttgaatatacaatgcattattaactgtagtcaccctgctgtgcaaatagatcttgaacacttattccttctgcctaactgaaactttttaccctttgacaacgtatttccattctctctcctgtccctactccccagcctctggtagacaccatcctattctctacttctatgagtttgacttttttagattccatatgcaagtaaaatcatgtggtatttgtctttctgtgactggcttactttttttttttttttttttttttttttttttaaatgagacagaatcttgctctgtctcccaggctggagtgcagtggcatgatctcagctcactgcaacctctgcctcccaaatagctgggactacaggcgtgcgccaccacacacggctaatttttgtatttttggtagagatggggttggtctcaaactcctgacctcaagtgatccacccaccttggtctcccagagtgctgggattacaggtgtgagccaccatgcccagcccgactggcttaacataatgccctctaggttcatccatgttgtcataaatgacagaatttccttatttttttttccataagagacagccttaaataaaaaagaaagaaagaaagggaaagaaagaaagaaggaaagaaggaaagaaaggaaggagggaaggaaggaaagaaagggaaggaagggaaggaagggcccttttttttttttttttttttttgagacagagtctcgctctgttgcccaggctggagtgcagtggcgtgatctcagctcactgcaacctctgcttcccggcttcaagcaattctctgcttcagcctcctgagtagctgggattacaggtgcccaccaccacgtcaggctaattttttgtatttttagtagagacagggtttcaccatcttggccaggctggtcttgaactcctgaccccatgatccacccacctcagcatcccaaagtgctgggattgcaggcatgagccactgtgcccagccagaatttccttctttttaaaagctgaatagtattccatggtgtctatagatgtatcatattttctttatccatccatctgttgatggtcacccaggttgatttcatatctcagctattgtgaataatgattcagtgaacatgagagtatgcccggcctctttcactatcaaaaagataatagccattgtaacaggtataaggtgatatctttgtggttttaatttgcattttcctggttgggcgtggtggctcatgcctgtaatcccagcactttgggaggctgaagcgagtgaatcacttgaggccaggagttcgagactagcctggctaacatggtgaaaccccatctctacaaaaattacaaaaattagctgggcatgtgggccgggcgcggtggctcacgcctgtaatcccagcactttgggaggcctaggtgggcggatcacctgaggttgggagtttgagatcagcctgactaacatggtgaaaccctgtctctactaaaaatagaaaattagctgggcatggtggcgcatgcctgtggtcccaactaattagaaatagttgtttccaatttctaatttttaaaagttttttgcatccatgtccatgaagaatattaatctatattttcttatattgtctttctttgactttgataacaaggtgatttggcttcatataatgaacccagacatccttccttcctccctccctctctccgtttcccttcccttcccttccctcccctcccctcccctcccctcccctcccctcccttcccttccctttccaacagggtctcgggccgggtgcagtggctcactcctctaatctcagcactttgggaagccgaggtgagtggatcacgaggtcaggagttcaagaccagcctggccaagatggtgaaaccccatctctacgaaaaatacaaaaaaattagccaggcgtggtggcaggcatctttaatcccaactacttgggaggctgcggcaggagaatctcttgaacttggagggcggaggttgcagtgagccaagattgcgccactgcactccagcctgggtgacagagtgagactctgtctcaaaaaaaaaaaaaaaaaaagacagggtctcactctgtcgcccaggctggagtgcagtggtgcaatcccagctcactgaagcctcaacttctcaggctcaagcgatcctcccacttcagcctcctgagtagttggggctaatttttttttttttttttttttgtgtgtgtacacaaagtttctctatgttgcctaggctggtctcaaactcctgggctcaagtgatcctcctgcctcagactcccaaactgctgggattgcaggcgtgagccaccacacctggtttggtattcttttctctgtgattttctgaaagagtttgtgtggaattggtattatttcttccataaattttgttaaaagtcatcactaaacccatgtgggcctgtaatgttgggttttcattttggttaagttcaaaatatttcctaattttgatcttctctttaacccatgagttatttaaaagtatgctatttagtttccaagtatttggagagttttcagatatttttctgttactaatttctaatttaattccaagagtcagagcatatactttgtataattcaaatccttttacaattattaagactttgagttgttttatagtccacagtataatctatcgtggcaaatgttcatgtgtacttaaaatatgaattctgagccgagcgtggtggctcatgcctgtaatccgagtattttgggaagccaagcagggcagattgcttgaggttgggagttcgagaccagatgttgtgcaatgtgccagacagtcccagagagcgaagtctgattctgtgctcggtaagactttccaaagtcccactgacctccacctacatccgtgctgctgcccagtgatgtgaactgcatctataattttttttttttttttttttttgagatggagtcttgttctgtcgccaaggctggagtgcagtggcacaatctcagctcattgcaacctccgcctcccaggttcaagcaattctcctgcctcagcctcccgagtagctgggataacaggagcccaccaccacgcctggctaattttttatatttttagtagagacagggtttcaccatgttgccctcctggcctcaagtgattcacctgccttggcctcccaaagtgttgggattaccggcatgagccactgtgcccggcccataattttaagatttctaagagctgaatttgaaaagtaaaaatgagctgagtgcgatggcagtcacctgtagtctcacctacttgggaggccgaggcaggaggatcccgttagcctgggagttctgggctgtagtgtgctgtgctgattgagtgtccacagtaagttcagcatcaatatggtgacctcctgggagtgggggactaccaggttgcctaaggaggtgtgaaccggcccagatcagaaatggagcaggtcaaaactcccatgctaatcagtagtgggactgcacctgtgaataggcgctgcatttcagcctgggcaacatagcgagactccctctctaaaaaaataaaaaataagtaaaaataaaaagtaaaaatgaggaaatagaattttagaaatagaatatagaattatattttgtttaatctagtatatctaaaatgtttaaaaataaaatcaatataaaattattgtcattattattattattatctgagttggagttttgctcttgttgcccaggctgcagtgcagtggcgtgatctcggctcattgcaaactctgcctcccaggttcaaacaatcatcctgcctcggcctccagagtagctgggattacgggtgcccgctaccatgcctggctaatttttttttttttttgtatttttagtagagacgggatttcaccatgttgaccaggctggtcttgaactcctgacctcaggtgatccatctgccttggcctcccaaagtgctgggattacaggcgtgagccaccacgcctggcctaatgtaaaattattaatgaggtatattacatcttttttttttctcatcccaggtctacaacatccagagcagccacattgcaagtgctcagtagccacatgtggctggcacatgtggcccatggcaactgtgctggacatggtgggtccagacctcacttcattttatgtataaacaccaagtatcttgtgagctttactgtacgtgaatttctcaggaatgctgtaactgtgcacattgaggtttgaggtttgattgcccttttgttgtttttttctgaacgttactaagggttgttcataattttggaaggtagtattatccaatagcccccgccccctccgcgtccgcagtgtgagtcccctgcacaacatgcactgaagcctctgcatttgtagctctcacattcatggtgattctacccgaggccatgcactgaatatgtcagtatcacggcttgatatcttccagtttagctgtgcctgagtgtctatgtactgaaatctgtattattttataatacatttctttgttttttgagatggggtgtcactctgtcgccctggctggagtgcactggcgtgatctaggctcacttcaacctccgccccctaggctcaagtgatcctcccacctcagcctcccgagtagctgggaccacaggcacacgccagcacgcccagctaattttttgtatttttggtacagatggggtttcgtcttgtgcccaggctggtaaaatacatttctttatatttatttatttattttgagatgcagtcactctgttgcccaggctgaagtgcagtggcgcgatctcggctcactgcaagctccgcctccctgcaagctccgcctcccgggttcacgccattctcctgtcttagcctcctgagtagctgggactacaggcgcccaccaccacgcccggctaattttttgtatttttagtagagacggagtttcaccgtgttagccaggatggtctcgatctcctgacctcgtgatctgcccgcctcggcctccgaaagtgctgggattacaggcgtgagccaccgcacccagccaattgtgatttcctttgttgctatgcatgtaactgatttttgcagtttccatggattaaaaaacatgtatttgctaccagatataaaggaaaatcgtggtaaaagtacactcacttcttaagcatatcttttttatgtatgggattttgcttttttgtttgttttgagacagagtctcactctgtcacccaagctggagtgctgtggcgtgatctcagctcactgcaacctctgcctcctgggttcaagcaattctcatgcctcagcctcccaagtacctggaattacaagtgtgtactaccatgcccagctaatttttctatctttttttaagttagagacagggtttcgccatgttggccaggctggtctcaaactcttggactcaattgatccgcctgcctcggcctcccaaagtgctgagattacaggcatgagccactgcgcccagccatgtaggggattttgaattcaactttgaacttgtgttttcttaatacatattggtgtcgaaaattgttttaaaacaaacatgaatatttaagattttagttttttgctcctttctctcacctttctgcagctaagcctgggtgcatccttttttggtgtatcatgcggcagtacatctgggctcctggcccagcctccccaggtggccccatcagaggctatacatctgtagacagaaaagctggtctccttcctttcacttaagacccagaggttgtggtctagttcttgaaggtctagtccttgacccaggtgggggacagtgacctctgagaaaggaagtgaccacaccctgctttatggggcctttgctgaccaaaccctacctctcataatgcttttcgtttgagttgctttgtccctaagtcttcatgctcagcctcctaccacagctggacgtttgtaaagggaaccagaaacatcttttggggaaatgacagttgatgcagatgacagtaaaccataaacttttggtattatcctgacccttagtcctgatcaagctggcactccccagaatgcgacaatatacagacataggcacaaattctgttttcatacttttctaagtacttaaaacctccacagcatatgtcttttgtatgttatacacaagactgtaaagagactggctggggttggacatgaaaagccctacaaagtcagaatcctgccggcctggagcggggtctatccaagggattccatcttaccagtgacattcatagaaaagcacagtaaagcacaggagatccttgctgagttttaattcctcagtctgcctttctgcatcttttgagtgatacactctaataatttgactgcattttgtgtgagtatagctggatccgctttgattctacaaattaggtgcccttctgtttcttagtaatgtcatattctctgaccactgtagccacttaagatagtctcaaatatgaataattttcagtggccatagtggagaagatgctgacccaggaggcttattctcacctccacctcttagactcacatgtatgatttttttttctccctaccaaagtggctagttttgacagcctttaggttgcagaactgtttatattcgaaagaagaccttaccttcatagagcattttcccgggcagttgttctgctttgtgtttttaatatctactcttattcggagtcccaaaatgagttagcttgggtagctctcacaatgaaaactgatttcttcgcataaaactttattctacctttttgaaaaccagctggaaatgatgaatggtggcttcaacagtaatggttcacgaagaactgatcgtgtccccatcaatgaggtcttacccatggcagggcaatggcggtctactgtaattctgtgttggttgtagtaagttgggggaatatcaggccaagaatcaacagagctacgtggcttaggcaggtcagtttctctgtgcctcagcctgctcacctgtgagatgggaataataaacacccctcagaaggtattgtgaggtcattcactaaaggacatttcagtcctttgaatgggtctggaacataccctagtatttttactctacatagaagaaatcagtcctagaatataattagatcggactttctggtcctttaatcactcgcctccttcctaaactggatccagctgcaaatgattgcgttagtctcaggacttcattttcatttgactcagctgatcaaaactgagaccattctgaggcaggagaatagggtctggaggcagtaaacctaagcccaattcacgctgacttcctagaactaaatcaaaaggaaaaccccaactttccacatccaagtaacaaaaggaccagaggctactccctctgcaacccccctttttccacgtggcagataaactctaagtacctttgattggtcccctcccacagccaatgaggctgttcacaggtcaagacttcatttgcatgggagtataactttgtaacttcagcctctgattggttgctttctgcaactaatcagatgtttgcatagggtatagctttataacttcgcttcagcctctggttggtcctctcctgcaaccaatcagactgattatggtccactacttcatttacacaaggtgtacaccaagtaaccaatgggaaacctctacagggtatttaaatcccagaaaattgtgtcaccgggcccttcagcctcatgggctgctcccaccttgtgggtgtactttcattttcaacaaatctctgcttttgttgcttccttctttccttgctttgtgtgttttgtccaattctttgttcaagaacgccagggtgacgtaacaattcaaaccatgaagaggtaacagagcccttcgcgcgtctcaacacgtggtgacgcagctaataacctgtgatgcatacatgggaacaaatgcatagaaaaacttgtcaatgacacggcaaagtaaaacccaaatgaagcgaggtgaaagaatgggctgcagcgcaggcaaaactgcaccacgttacagactgctcgcctgggatggaacggtggggaggtgcgcagacggatggacaagcgcctggcaaaatggatttcttttcctagactgctaatgctactaacagttccctcctcacagggtcgctataacgaggtaacatacagcacttagaagacggcctgacccagaataacactaatgttcacatggctgcgagtctcagaccaaaatcaatagccggtatctactgaaactgcagcaaggcgaaaccacgggaatggcgctccgttgagtagagcaacgcacagcacatcacatcgcatcctccgtagcgggaggctctggcctcaccgcagcggcacttcccggaagagcccaggatattcggggacccgcaccggacaggcggcccaggccccctggcgcccagctggccgccctgttgcagctctcatgccaagacctgcgcctaacggcagggattccggcggtcatcatttattcttggcgctaagctgccgcttctcttttttatcaccacagagtaacgcagaccccaccgtttccttccattctgagccaaccactccagcagccaccggggcgccaggttatgctggggctgcaccacccggcccgaggcttttgaagccacgcctgagcgcggaggatgggcaggatttgccccgtgaactcccgcgcacgcaggctccgcgcgaggcccgggcgcccgagcggcgattccctcccctatcaccagctccagggtggtgccccccggctgtggagcccagaccccggccgtccagcagcgtatagacgagcccatgtctgcgatgtaactgcaccgcgctggggatccacctcccgccagggtgagggcgccgtcctccagcgtatgctaggcaggcgcgccccgccctcctggtcacgtgaccacgcctacagccgaagaggatgggaaaatgcggccctgttcctgaacaggaagcggaagcaggaaggaactgagaacaccagcatctgctgccgccctgaatcagcgttagcatgtggaggcaacctcagcccccagtttttgaagaaggtgattcagattcagacacaggaattatggtgacggtagaaatggactggaaggttcgttccccttgcccaccaagactccagagcaggtgggttcttgatgtctactctgcatgaagccctgggctttccggccctccctacttttcctccgaattcacagcacagcggagccaaaatgtattcctgccaaaacgggcatttcccaaaagaaaatattgttttagattcattgttcacagcctctttttttttgttgttcatttgaagcaatttttcttttttattattatactttaagttttagggtacatgtgcacagtgtgcaggttagttacatatgtatacatgtgccatgctggtgcgctgcacccactaactcgtcatctagcattaggtatatctcccaatgctatccctccccctccccccaccccacaacagtccccagagtgtgatgttccccttcctgtgtccatgtgttctcattgttcagttcccacctatgagtgagaatatgcggtgtttggttttttgttcttgcgatagtttactgagaatgatgatttccaatttcatccatgtccctacaaaggacatgaactcatcgttttttatggctgcatagtattccatggtgtatatgtgccacattttcttaatccaatctgtcattgttggacatttgggttggttccaagtctttgctattgtgaataatgccgcaataaacatacacgtgcgtgtgtctttatagcagcatgatttatagtcctttgggtatatacccagtaatgggatggctgggtcaaatggtatttctagttctagatccctgaggaatcgccacactgtcttccacaatggttgaactagtgtacagtcctaccaacagtgtaaaagtgttcttatttctccacatcctctccagcacctgttgtttcctgacttttgaatgatcgccattctaactggtgtgagatggtatctcattgtggttttgatttgcatttctctgatggccagtgatgatgagcattttttcatgtgttttttggctgcataaatgtcttcttttgagaagtgtctgttcatatccttcacccacttgttgatggggttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgcctttggttgccattggttttggtgttttagacatgaagtccttgcccatgcctatgtcctgaatggtaatgcctaggttatggttttaggtctaacgtttaagtctttaatccatcttgaactgatttttgtataaggtgcaaggaagggatccagtttcagctttctacatatggttggccagttttcccagcaccatttattaaatagggaatcctttccccattgcttgtttttctcaggtttgtcaaagatcagatagttgtagatatgcggcgttattatttctgaggcacagcctctttctttcgtctccctttcctttcctcatctcttgctctaattggagaatttgacaactctgaacctctgactgtggataaccccaactccagcaagcctgggcaagagtgggacagttgcagcccaaggtagccaaacatctgagttttgcctagtaacagatcatggagaggtcagaccaagaagtggaaggaagtggccggcctgaggcctttgtttgggccactcagggttgaatgaaatgataaaggtagccacgttgtctggatgcgcttcaggtaataattattctctaaggaaagcagtcatatttatatccataaaatcagtttattaaattacatagcaatatacatcccaaaccttttctcaaaattgtcattagctttttaaattcgttaaatattttcatctcattaaaaatggtttcttcctttaaaatttcccagaaagtgtggcctctgttttctgctactcagtttaaacacatcatcaaggatagataattaatgtcaggtgagcataaaaggagattataaaccagaaatgtgttttctgggaaccaagtttcaagtgactcagataagttttattaatttcatgggtgaagcccctggataaagcagtgcctaaatcaggcttgtttacccttggcattatgtcaccaaacactgtttcaggatactggaagtacatacagcttgggaggtctttggcctgagcctgttttggccaagcccatccagaatgaaaagtacaaaagaaggctagtgtgtgtgcaaagcagcatggcttattttgaggtcctattagttgtgggccaacaaaacagtggcaggatttgaaggaagaaatgtattgcaatagtccatatccttcgaaccacaaagggagactgaggaaatgctggctttaggccaaaaaaccctggctcaaaacagcttcctccagtggctcagaggcagaccaaattcatcaagtcaaggaccttttcctgctaccaccttgcggagaggggccttcaccagcccaccctgcacatgggtttctgctgttcagaacctacccagtaacaacaggagcaaacatacatgttttcccctcatgtaactttgcatttaaatatattctgggaaactgctgggcacagtggctcacacctgtaatctcagcactttgggaggccaagacaggaggatcacttgagtctaggagttcaagaccagcctgggcaacatagggagaccctgtctacaaaaaatttgaaaattagctgagtgtggtggcactcacctgtagtctcagctactcaggaggctgaggggagggatcgcttgagccagggaggttgaggctgccgtgagctgtgatcctgccagtgcactcagcctgcgtgacacagtttggaaaactgtctctctctatgtatgtatctgttcagggaaatggcagcgtgagattttatggcagttcttgagacttcagaaacacttcggcaccagccaaatccccccaagagagcaaggaacacttttccagttgcttaaaaaatttaaagttataatgaaaaatgttgtaaaaagaactacagaggctgggtgtggtggctcacacctgtaatcccagcactttgggaggccaaggcgggtgggtcacgaggtcaggagttcaagaccagcctggccaagatggtgaagccccgtctctactaaaaatacaaacattagccgggcacggtggcagtcacctgtaatcccaactactcgggaggctgaggcaggagagtcgcttgaacctgggaggtggaggttgcagtgagctgagatcactccagcctgggtgacagactgagactccgtctcagaaacaaaaccaaaaaactacagaatagagtaggggtggagggaagtcatgcatttccagtggctagcactttgcgctctgccttggcgagtatctgcaaacttcctgaccatcaagtgcgcttgcagccatcctggatgtcaactggccacagaccctttgctatggggagtccctggctacatccattagcaagtcagaggtttccttttgtccccatgatgccactctccagcaagctcaaactgctgtcacaattgttttactgtacctaaaaaggaacagataaggcaagagccacagtcaatgttttctgtgaaatggtcttggcaaatagcattaagaaatcttgttgaatttcaaagaaaaggtctgattagaggtgcctgttggaagcagaagcctcaagaaatgaggaaggaaagttaatttgagggtctgtttcatttctgatacagaataatcacaaaaacaagtatatgccgctggctgtagctccccttaggatttggataaccagctggatttccagatggccactcccgttctctatgcttccctcctccgggctatatcctgcagagcttcagcgggaagttctccgtgatgaggtggtcagggtgaagcagcaccacgatgttaacctcaaattctgagaagagaagagagggtgggtttgtgctcactgttaccaagcagcgaaaccacacgccgccaccactgcagtcgcaggaagctctaacggcgaaggagcacccggtgcgggtgggtttcattgctgtcccctcagcgccaccctgacctttcagccaaactttcagtggagatgactatgctgatgtctgactacctctgtcaactttctctaagtgaatttttgtcctctcatcttggaacatgagtgatcaggcttcaccaactacactttccctgtccctttgctttcctaaaaaggatattctagaaccctttcaattcatttgtattcctttgccttatttttacatttcctacggttcttaatgaaatagcagactgtgaaccagcgcatagctgtctgggcccatgtccccaatccccaggtgagaaacagtcttcagaagcaacaatttcattgttgctccattggatactattcatccatcacctttcagcaaacaggattccttctccaccgactcttcagctgatatgggtgagccttgttgatcctaacaaaagggatgtgtgtgaagaggaagcacctgacgacaaacaagcaccatctccttccccagtgtgaggaggggtgggaagggcatcgtgtgggcagagggcaccctgtgctgagccccacactgtggcagctcagctgtggaaggggccttggagtcagtgcccacctgtggctggggtctgcaggacaacatccccgtgtgggagtgtccacctccgcccaaacatcagccacaagaagagtcggccaccagcagtggccggcctgtccttcctcactttattgtcactacattagagtcctctgggcacttcctgccaccactcccttcaatgggttctccacccctcttgttgtgccccccagaagggtggagggtgtggctggagtggacagagagggatgcccagcaggcaagatagggagctggcgggggctttcctttacagcaggaaaacagctgcactggagccgccatgatacccaggcgctgcttagagtccgagtgagttccagtctcgggcctgaccgtgcatttgaggtcactcgcacggaattggaggggaacacacagaggtgctgctcttgatgtggatgcagtgctcactcctgacttccaacctagaggtccccgagcctctctgaatcacagtcccctgctactgagaaggctcggtcccttcctactgggtctctctgttctacttcttcgtagtgtggagtgatctcccaattaacatgattcttattaagatggaggtcccattacaatatttataggaagagttaaaaacatggaaatgttcatgatacaatgttaagggaaaaaggcagaatataaaagggtgtctgtgacctgattcagatcccatggttaaaatatgaacacacaggttcatggaaactcactagaggcatctaggccgcggggctcaaggccttcctgcttctgagcgctcactctggggttttcacgggtcctggaccttcacacagagccactttctcagtatccacaccaccccccactcctgtggtgctcgttcacgggagttttcttcacggagctcagcgtcacctgcccatgtctacacagagctcagcgtcacctgcccatgtctacacggagctcagcgtcacctgcccatgtctacacagagctcagcgtcacctgcccatgtctacactgatgtgggtctgtgtgtttccccatgtgacagtggaagtcccacaagcaccaggactgcctgtgggtgtgtcccctgtgcggcacagcagctccttaacaaggttttgttgagcagccgaagggcagcaggctctgagctgtatggcctgtggcaggccctggcactgagggaccgaagggcggcaggttctgagctctgtgacccacagcaggccctggcgctgagcggcccttcccatgggcccatgagggctgggaggcgagtgccacttacccactttgaagttggtggtctccagtgtagggcaggtgaacagcctagggaagaccatgtagatggggacagagaggcccctgcacacatccccgtcggcgatctgaatgttctgaatctccgtggcgtcgcgggcatagccttctgcacaccctgcgggagggaggccacatcacgcggtcagggccagcagaggctgcggggtccacatccgcaccggcaccacccaccagtctgctccaagaatcctccagggtcccctcccctcactttccttagacacgcggctactgctaaggcacagccacgctcttacttttgcttccccgacgtcctctcgttttttagagtcagggtcatggtctgctctgctgcccaggctggagtgcaatggtgcgatctcagctcactgcagcctcaaaccaccctcccacctcagcctcctgagtagctgggattacaggggtgcgccactgtgcccagccccccagcatcctcttaaccatggaacgtgagggtggcagtcgagggggacaggcaagcgccaggcctggtggcacggccctcaccgcacgtctccacgcgcaccagctgcagctccacgcttctgatggcggcttccgagctctccaccaccagctctcccgttagtggctgcgtgatgacacagtttgttgagttgagatgtcctcgaaggagaaatttgggaagcaaagctctctaaaacaaaatgaaaacaaatacatcagaatgcaggcaaggggggaaagtgctccatactttggtgcaaataaaacctggaagcgaagttggatagtggttacacagtccaccgggaccgtctcacaaaacgggaagaaaggagcgaagtactgacgtcttggacattagccggctgaattattcaacgactctctacatatggcacctgactgacactctgtgtacagagaatgcctcagagaaccatcctaattgcctagtctcagagctagaaagctccttcttaccaaggaataagacatgaaaaagtctgagggagtcgccatggtgttcaagacaacctgacacacacacagttaaaaagaaaagtcctggccaggcacagtggctcaggcccgtaatcccagggctttgggaggcaaaggcaggaggatcacttgaggccaggagttcaagaacagcctgtgtaacacagcaagaccccatctctaaaaaatgttttaaaaattagctgggcaggctggtgcacacctgtagtctcagttacgtgggaggcagaggcaggaggattgcttgaggctccagtgagcaatgattacaccagtgcactccagtctgggtgacaagaatgagatgctgtctcttaaaaaaaaaaacattcaaagatgttcccaattgtacaatttttaaaacccaagacatttattttatttcatggaaatttgaagaaaactagtttctttgacgcttgatgagaagcctacaaacctttactctgcacacctgacgctggccaggaaggactgatgatggtctagagcaggggtgtccactcttttggcttccctgggccacgttggaagaagaagaattgtcttgggtcacacataaaatatattaacactaatgatagctgatgagctaaaaaaaaatcacagaaacaaaatctcatgttttaaggtttatgaatttgtgttgggtcacattcaaagccatcctggccggtgggctgtgggttgaatgggcttggtctagacagagacaatttttctaggaatctttacctctggctggatcccagttactgaaaggatcagatattggcatactactgtccaacagaaacataatgcaagctgcgagtggaagccacatatataatttggaattttctggtagccacattaaaaaagaaggtaaaattaacgaatatatcaaaagtgttatcacttccacatataatcaatatcaaaaatatgaatgatgttttacattcttcttttcatcctgagtctttgaaatctggtcagtatttacacatccaactcagctacttggtccagccatgtgtccagggtcaatggtgatgtgtggctggtggccacctgatcaggcagtgaagctctggacctgaaaagcccgggactctggacctggcagtccccaaaggtacagacctctgaagaagtctgcattcaagatggagcttttatttatttgtttttattataaacatttttagagacagggtcttgctctgttgcccaggctggagtacatggctcactgcagcctcacctcctgggctcaggcaatccttttgcctaagcctccctagtagctgggactacgatcgcatgccaccacacccagctaatttttacatttttcttttgtagagacaggttctatgttgcccacgctggtcttgaactcctgaccttaagtgatcctcctgccttggcctcccaaagtggtgggattccaggcatgatctactgtgcctggccaagacagagttttaaaaataactaagagaagctatttgtgtagaaaaacaaaaagcagtagcagtacacattaaaattcttttaggcgactgatgaaaaaggatagctttcaacattcagctcaagatactgactaaacaatcattttccctctcctcccactgacatgatattaacatatacaaataaaataaacctatactattttgagtctgagctccagcctagtagttcctgtaaagctgtcttatatccttccaataaatctcttttctacttaaaaatctacaagattttctacaatacatctcttttctacttaaaaagcaaaacaaaaaaccaccagtggcattttgtgaataagcaattttattttatttgctttatgtgttattttcttattttccaacaataaacctgaatggttctgtggaaagaaaagttcttcgtgtttacaaataaacctatacctagaaaagccacaaggaacgccccgtggggaccaccccagtgaagtgtttctgtccggcagaaagtggacagacaatccggctcccgggagttcggggcacccgtcctccaggtggcagggggagcggtgagagcgggtgtgctcgcagggcgtgtggtcagcctgccatcgggcgggggcctgcgaagggcagtaggcaggtatcacaggtgagctcaccagatgggggaagctgccacagactggcaccacagcttcctgcaaaggggatctcccacccggaaaagcagactcggggcaaggtaggacaagtgtcccacgtcattcacagccacaatgcagacagcgagcctctggactcaggagacaagctgcctacaaacaccccggccacgtgccacacccagggcagagcgcctctgatgagcaggtgctgaggaccaggagaacaggttctcacctgggctaaggatacagcctctacaacaccaccacacacattagatcctcatttgtaaatgtaaactgacaaccgaggatcaatacacatttaaggaaaacaaaagcaagaaaaagacacacacactcgacaaacagaaccaacccctgagaaacagaatcaatacaggaaaaggagatgaaaggccactgcgtccgtcatggaagcagcagctatcccgaagaagaaacggtgtctagaaatgaatcacattactgctgaggtcagcgcttccgaagacaggctacagaggtgggagacgggagtctgagtggcccactggggtcgcgtgccctcagagcccggagaagggagacgtgcagaacagacagaggagtggcctttcctccctcacctgtctgaaaggctccccacgacacatgtccagcctctgagggatgaggccaatgacatcccagggcccaggcctcccagcttgtccttcacttgatcctagtcagtgtggtccagacagcagaataaagaattagaggaaggatgaaaagttacatccaggaagaactacaggactccactgtttaggagaaatgcatggcagtggatgagagggcaagatcagggaggccggggccaggcagagttttggacgggcccaagttcaccgtgcagctcgagggaccagctgaggctccaccagcggctgccactgacagccagacagccctgtcctgatgcaggaggcgggggagctgggctggcactgcccaggcgtctgtgtcctcactgtacctgccctggccgtgaggcgtccaccacggagggcactgcggaatctttgaaaagcacgttgctgcccggcctctgtctgatgggaatgctggggaagaaactgcaaactaaacatccatggaggatgacaacaggccagggggccgggcgcaggccccggctaaccatgagaaatgaagggacgtggccgtgtcatgggcagcagggggtcttgggggcccatgatgcagtaaaactgagggaaaatggtgagattaatagacatggaccctccctgaggaacttttcaaaagcagtcctcttctaagctgctttactgagcttaaaaaggaaatcaaatggaaaatactgagtaatttgggtacaatcagaaatctctgccggctgatgacgtgatttccaaatgaagaccacccgggcaatagctagtccgtggggtctggctgctgggaagatacccacggcattcgcctgtgcaggacgtcttacctctttgacgttctgtaaggtttcaggtgtaatcgtgaagtccacgggactgggagtaaacttccccttctgaggctaaaacgagaggtgaaaccgaaatcagtaggtgaaggccaagagttctgcaggtcaaatagcttttccctttcaaaaataaaccaacggcagcctggcgatgcaggaaggacggggaactaagaggcgcaagcctgggtcctgaacacagttctgtcaaatttccccatcttgctgaaactcagtttcctcatctgtaaaatgaggggagagatgtcttaatctccaacgtgcctttcagattcagaattttaaaatcagatctaagaaacagaacagtgttattggcaagtacttatttgaaacctcagcacagtgaccctccaaagggctcttcacacctcccagatggtcccacttcacagacgaggcaagcggggcagagagctcagtggcctgctcagctcagtggtggagctggggggctgagcattgaacccaggaggtcaggttgctattggcctctgagctatagagctgtcacctgaagaatcatactttaaacgttaccaaaacagcagtaacagtgatcacctccatgttacataatttcagaatctacagatacagccgagcttcatgagagcctgcctggcattttttatccaggggctgggatgcaaagggccagtctaccatccagagagccagggggaggaaaggtcctgcctgatgtgccgacgtggagtccctctggcccgcggcctcagctgggggactctgggcccaggacaatgatgcacacgtgatgcgcatgccaccgactgtctctgacccagaagtcttgtgtcttctgccagcacccgtgaaacagtaagaggctaaatggtgagcttgtaaatagggtaaactctcagaccccatgggagattcctatcattaagcaccagagtccccgagtgaagcttacagcggagtgaacgataaattcacaggtctttgtcaagtccttggccaacagagaccgcttcatgtcacagcgcagtgtatactaaaggggagagttggaggaaaaaagttcattttagtgggatttgctttcatcttggaattatattcaaagagacaagtcagtcaacatattttagggaaatgttgtacaatcagtgcattatagaaaattaacatacataatataatacataataggatagttaatgttcaaaataaaggcatttctgttttaaaaatgaaccactttaaggttattcttcaatctgtttgcacagctggcctgcagttggacccactggcaaacaggtgcacggtcccacctgtagcagggagcaggctggcgagacagaaagggcagtgcgctcaggagcagacgccaggccagatcccgttgttgtctgccttactgtgcgagcccagacagataacacaacttgtctgagcttctgcttcccttctgtagaatggggctcttaagacccacctgcagcgagactccaatgagatcatgtgtgacaagcactcagcacagggctggcacaaagcaatgctggaaaacagcagctactttgtaagcgggattagaaaatccatgcagtgaggactgcaaccctgggacagcacccagcatgtcacaacccttcctcgctgggcacctgctctgagtgcatagcactgccctgggcaccagagccaagctcaaggtcacacctggtcctcagggaacttctagtttactgaatatgcagtaacccacacatccatcaaccaacttccacaagggtcaactcatggctaatcttatttctcgagacatctgaggtctctctccatctgccaacacacagatgtagcctgcacctcaaagaaaaagtgggttggaaaacaatgtagcatcgcacttgcacacttgcttttttaatgtggcagagccgcattccatttctctgctgtccctaggttagttttctgagctggttgctaccatggtgcctactgcaaggtgagctctattcccccaaggggagccccactgcagagctggtattgagcttaaagcaggctttgaacggagactgttgcttcaaatccctgtccgtgagctgagagactatttaaaaatgtaattctacagcaggaccactgttgtaatgccagtctttaaaaaaaaatcacataatccacgtttaataaagttagttgttgttttaatcgtccaggaaaaacttcagaattatgtcaaaaataattttcataactcggactctatgcataactgaatcttccaagaagctaatattcgtatgaacaacctgtccgcatgaaataagaagttactatatatatttaaggtactactgggagagtaaaacattgtttaaaagaatcatccttgtctgcaaggatctttatgtagaatatatatacaatatatatattctttttttgttttttaatacggagtctcactctgtcacccaggctgaagtgcggtggcgtgatctcggttcactgcaacctccacctcctggtttcaagtgattctcttgcctcagcctcctgagtatctggaattacaggggccgcgccaccatggctggctaatttttttttttttgagatggagtttcactcttgttgctcaggctggagtgcgatggcgtgatctcggctcactgcaaactctgcctcctgggttcaagcaattctcctgcctcagcctcccgagtagctgagattacaggcatccaccaccatgcccggctaatttttgtattttagtagagatggggtttcaccatgttagtcaggctggtcttgacctcaggtgatccacatgccttggccttccaaagtgctgggattacaggtgtgagccaccgtgcctggcctaatttttgtatttttagtagatacggggtttcaccatgttggccaggctggtctcgaactcctgaccttaggtgatctgcccacctccgcctcccaaactgctgggattacaggcgtgagccacggtgcccagccctgtccatagttttaaagtagattcctataaaaggaatttttaactttgaaaagggatgactaggatctctagaaatgagtgctgaatatacaatttcagcagacatgttttatgtgataggataaacgcttgctagcacagctacaagagtaaagcaagagtagaacaaacctaataaaacttgcctacaatttaaattattgtaaaaagaagaagtagatgcacaaagggcaactacggaagactctgatgatcatatgaagtatctagtaacaaagacaaacatgaacgcaacatgactgagaagaatgtcaagctcttcatctaaaaaatgacaagaaagccaagcctctggaagtcaggaatataatactggcatttgatacatatacatatatatgtgtgtatatgtgtgtgtatatatatatatatatatatatatatatttttttttttaattaaaaaatttttttcttaagagatgaggtattgctatgttgcccaggctggacttgaacttctgggctcaagtgattctcctacctcagcctcccaagtggctgggtttacaggtgcatgccgctgcacccagcacgtctatcttttaaatcctttattctgatttatgatttttaccgttttagattgttacaacacaattcaatttatgaatgaaaaatttcttggcacataatttaagaaagatgatattagggtttagcaacaaaagtttctatccaaagaaatgtgcctatgttaacctttagagtaagtgcggtaaacagtgcgggccgaggagtgctggtctggacccgcaggctgaggctggcctgtgtgaccacaggaagtcactgccgtctctgggcggcacttgctctactataaaactgtaagaaaaagacctgccaaataatggcatgaatgaatgaatggatggatggatgatgacagatttaaaaaaacataatcttagtttctcttaaatttattttctcaaaagacgacaaattttgatatgaatcaagaattaatcaatacttgagaatttttacaaattctgataggtgtgcaaatgttaactgtaattatagagacaaacgtccttagtttttggagatgcgcaatgaggtattttgagatgaagtatcaagactctgaaactaactttaaaatgatttagaaaaaaatctaaatttttaggtgaacaaagatggcaaaatactattaagtgctgaatgacaataagtgtgataaagtcatggaaatcagaggttaagctaagaaatctcttcattgttagaaatcggtgagatagttggggaggtactgaattccaaattgtagtactctgaggttaaccctcaaatggtaaaatctgatgatgaaaagacgagggtaggggcaattattccctttactaaggaacccaccacctgttaactctcctactatattttaagtagcctccaatgtacacacagctctgcagcaacagaagcacacaagctttttgttttgttttcttttgtagagatgagatcttgcgttgttgcccaggctggtcttgaactcctgggttcaagcaatcctcctgccatggcctcccaaagtgcagggatgacaagcgtgagccactgtgcctggccagcacacacgttttctatgtatatctgaacatctgtcttggcaacatgtggaaaaggatggggtttccaatttgactttaaacaaattcatcttcttttggtaagtcttgatgaacgcaggagttaacaaatatgatcactgaaaacgtgatcttattccagtttctaatgaacatattcttgtatttttaaatcaaccatattaaagaactgccgtgtggataaagcaagtcgatactgattctgggtagataataaaaataatttccaaaatcaatgttcaagatatcttcagtattgccaaaaaggcatttttcattcagtttctttcagggtggaaacagtcccaacctagaaagctgatcagaagactcccacccacataccagcaattggtatctgcatggctacgtacgcagcttcctctgaatccaggtactactcagtcatcactgctgcttccttggggctgtccaaagcctttggtgctaacaataaaggactagaaacacttcttttcttcacagaagatgtacatcatactacatgtgtttcctctggacagatctcttaggcaattcataaaactcccatacagatgaatctttaaacactcacaggggtttggggggcttttattttaaaggttctattattttcagcaggataatgtatctactaaggccaaattattgaccaaaacttaataaatcaaaaaaattcctgactttcatccctcttgcatataagactgaagagttgtgtctcatccagcaagggaagtgctgcgaggctgctatcacaaaagtatctttctttctgctgcataaaggaaaggctatctcaccccgcgtggactccactgctcctgagacaacaacagcagactgtcaaagacgtcccttaaccagcagaggtagacaggaagtcataatccacttcccctcattgacaaggtttgttcagtaaagaacaccagcctatgtcaaagtagtagcctttgggtgttaaacaaagagatacttgtaagtataaaacagacaagttaatgctagtgccagaaagaagttagggcatatctgttaccagacaataaaagcatcccttacaatgtgaggtggcctgaaaagagcccagaagaaacagagggaaaagaagttacagcacgagtgccttgaggctcccatcagaaataacggccatacatcaaatgcatttatcagggaaatgagaaattaacgtcgaatatacatgcgaggtctcagcaataaacacagtattaaattcttgggcccgtctactaacgttgagagaaagaccacaccgtttgtcagaagaaaacttgtgaagtcagtcgcgtaggactaggaagctctcacctgaatgttgacaaacacgccatgatacgtctcatacagaactttgttacccttcaagtgcagaggaaattcaaaagggatttctgttttgccgctgggaaatttccccggcttcaccatttctatggtgctgttgataatctggataggctgtaaacaaaaatcagttcagtccatcagcacacacttggaaatgtcctttccaattactaataacgttctgaaggacacagcaccccgaccccctggaggccaccatcctgctgtcttcggcagctctgcgctgggtctggagatgaacagtgacttggctctgctttttaagactctggcacaataatgattcatttacaacatgagacacataggtgcttgagacacatgggaactgaactgatacatccctctctcctccccaggtatctcatttaactgttttaacgaccccgatcttcaggatcaagaagcagacccagcacagtgaggctgcctggctaacagggttgacgtgtgaacccacggctccccctcaccgagccccgtgctcttctgggcagcgctgcctctgctcctgacagcccaccagcttcctcggagccttcctgctgcagccgctcagggagagcaggcctttcctccagccctgtggcctgcacagacctcctcagctgggcctccaaggaggagcaggagggtactaacatttggaacctgccttcaaggcacgtattcatgctttttaagcatttatagtttaacatcagtggctcggagaagacccatgacttaggaagtgaatctcttaagtactaatggattaaaataaagttgtagaaaacataggaagcccctaaatctgaacactgtgaatgcacctttctctgtcttcactcttttccctgcaaaacttaaagcgttaatatgtccttcaggaaaaggcaactacaagaatagagaaagagtttacattctggaacacaaaactctaccctaaatgacaaaaacaacagttacttgctctattttcatcttaccttagtgtcaaatcaacagtagcatagacacagctaataaaatgacagttttgattttggaaggcatgtaacataagccacaggcacaacttctcagaagagctgtgatcttttttttttttttttggagatggagttttgctcttattgcctcaactagagtgcaatggcgccatctcagctcactgcaacctctgcctcctgggttcaagcgattctcctgcctcagcctcccaagtagctggggcacacgccatcacaccccgctaattttttgtgtttttagtagaaacggggttttaccatgttagccaggctggtctcgaactcctgacctcaggtgatctgtctgcctcagcctcccaaagtgctgggattacaggcgtgagccactgcacccaggtgtgatctttttaatggctgaaattaatacatttatagttctcctaatcctatttatcaaataggaataaatataagcagactttcaataacaggatatacttagaaacaaagtatctccattttcgcaggttgattagtaaatatcagaagtgtaactaccaccatcccttgcaaaataacaacagataacaataaaggcacacagcaagtgaaacccaccataaacatgtctttttttaagagacatggtatcttgctctgttgctgaggctggagtagagtgctgtgatcatagctcactgcagccttgaattcctgggctcaagggatcctcctgcctcagcctcctgagtagctgggactacaggcacgcaccaccacacccggctaatttttaaagtttatttatagagatggggtcttgctatgttgcccaggctactctcaaactcctgggctcaagcgatcctcccgccttggcctcccaaattactgagattacaggcctgagccactgcgcctggccctgagccactgcgcccagcccaacatttcaatattgaactaaaaacttgcaatctaagcattctttcttaccttaacagaattataaaaagcttcaaacacacccacacttttggcactgagctggaggtttacagttccttccatggtcaaagacactccctggtgttggactgaatccttactcgatatgaccaccacgccagagagcacttcctgggagagaaaagacagccaccaatcaaattagcatgcttcctccattctaccttgtttattagcaaacgtaggtctccttcatcatcaatttgtttaaagatccagacattcactgagacacctggataccagggtggagaaggcccaggtcctggtaggggacagatgcccactgataatgacgtggcagcctggacacacctgacggggagcacccgggtgtggggatgagaaacctcgtcccgtcactgcctctcagacatgtcttcattcctggttggggaatctcaacagatgtctgaattcaagagtgcaaggagaagggccagggcaaatgtaagttcccagtgatatcacacatgggcatggatgaggtcccttcaaaaggaacagaagaaaataaaactctgttcgttaggctctttctcaatagcgctgactaaaatgacagcacaactgcaaatgcatgagtaatttaacacgatggttagcctggtgtcctttctgcccagaaatgcctactgtgagcaagactggaggttattggtgccacccacgaggcagcagcatgccactttccagaaggactgccctgtccctgtggttcctgctcacaccaggaggcatcggcgcctccattcccttggttcacacatcatcgagagacttcacaacagatcatctgtgcatttatctgaagataattactgagtaatagattacggatagtaactgcattcgctattggagagcagtttcttcctgtcaccatagaactggatggtctcaatctgttacaggggctcgagtggaagaggaaattgaggggatgaaatagtatcaagcggaacagaaagactgaatccacaatccacacagaacaacacgtctcaggctgggcgtggtggctcatgcctgcagtcccagcactttcagaggccaaggtggacaggttgcttgagcctaggagtttgagaccagcctgggtaacatagcgagactccatctctacaaataataagaaaaaaaattagctgagtgtggtggcacccacctgtggtcccagctactggggaggctgaggtgggagaattgcttgagcctgggtggttgaggctgcagcgagctgtgactacgctactgcattccagcctgggtgacagagcaaaaccctatctcaaaaataaacagtaaaaataaaaattggcctgcagatcaaaccattaaaaaacatctgtcctactggtgtttaaatctgcttatcttttatttcttctagttatccagtgaaaaatttttaccaagttcttactttaacttgaattttggaagcaagaaatattctatgtcccttaaatgtgctaagtattttgtttttgtttccactccccatcccaaagccttgaagtctaattaaaacaaacacgatcatctccattttaagcaatcttaagaataaaatgagttctccttgaattctgcttaaaatggagatgactgtgtttgtttcaatgttaatgtttaatgtttaatttaatgttcctaaaaaattcctaagcagacttaaataaaaattcctgtgaagtaacttaaattctaagtttaattaacattaattctattaattttttgtatagcccaaattcaaatggaaatttaatattaaaaattcaggccaggtaacatggctcatgcctgtaatccagcactttgggaggctaaggcaggaggatcacttgagcccaggagttcgagaccagcctgtgctgcatagtgggactccttctctacaaataaaaaaattttaaaaattagccaggcgtggtggtgtgctcaggaagctgagggcaggaggatcacttgagcctgggaggtgaaggctacagtgagccatgaatgagccactgcactccagcctgagtaatagagtgagaccctgtctcaaaaaaagaaaaaaaaatttaaatccactagtatattttttaaagtttacttgacgaatatgtcccacaaataaatgagacaaaataatttgtgagctttatcaattgaaccacacagtagcgcctgaggatggtcccgttcctatgcagtcataaccctttccgtcagtctcacgggaacaggtctctgggtctccctgatgggcatattctaactatgacatcagtaaagccttttccctccttaatccctgcagcgtaggaggaaaaaagtagtgacatacctcggaagtaagcagagtaaatattttatgactcgagacacaatatagtacagaaaatacaaaattaacatttgtggataaattagatattcttataatatacaggtttattcaactcctaccaatgaaagaaggatagggaattagcccacctgaggccgagggccaagggatttagaaacaggagacggtttaacagagaggcaagatctgtctacacaatgcttgattgatcctggcagaggaagataggatacactggtagaacagacattaaggaaaacccaagatctcaccaagaacttctccctcagattttcgtctagactttcatcaggaagacataagatttatggctccagatagtactaatacctcgtccaacatcacaagcagaggccttcaactgggggccgtgactacaaagagggaccgttcacagactggcaacgaacccagaacgtatacaccgaaatcgtgtgcagggtgctactgttttgggagaagagccgtagcttctgtctcatcatggaggaggcgcctggcctgggaaaggccatattgtcaagtgggaggaggaagaggcgcagccccgtgtggtgtgcgtgctcatcagagaagccagcacagacactgggacccactcgcgtcaccaagagccaacccctcttcagggtgagtaaaggaaagagctttcattggaggaatgtgaatacttttcagttatccagcccagagacactgaaaggagacggcagtcccgtcctccccttctctgggttgtgctcatctctcgaaactacctgcttttgccaccagcagctaagctataaattccctcaatcacaccccatccgagactacagcccgcaccctagagcttaacaatggagagccaatcgcccatcaatgccatttctgtaagcctatgagaattcctggcaaacaactttgtatcaccccactccgtgtccccctttctttgccttaacaacctacttgtaacacaggggaacggagttcatatccagggtcactgggtctgtatcttctgggcagctgtcctctctttggctcgagtcagctctttattatactttgtgcctcagctgctttgctttagatggacagaggccatgcacccaagaaccacaccactcagagcctgcttcgaggggctcctccaagtccctgccctggaggagctaagtctggagagaggcctgaagctgcccatcttcaacctcagcccaaagagccgcctggaaacaagcattccaaaggctactggccaccttgctcttctcagctttgctggctctcacagcggaaaccactggcaagtttgttcaaaggggggcaaaagcaaccacattttctaactttgtattctcttttttttcctcattcactctgtcacccaggctggagtgcagcggcacgctgcaacctccgcctcctgggttcaagcaattctcctgcctcagcctcccaagtagctgggactacaggcatgcaccaccacacccagctaattttttgtattgttagtagggtttcaccaatgttggtcaggctggtctcgaactcctgacctcaagtgatccacccatctcagcctcccaaagtgctgggattacaggtgtgagcacccagcctaactttgtattctctaaatgtaaaaggccactaccaaactatacaactctttttcttatttgttctctgtaataaaatgccaaaaccataattggaactctggatttgaaaatagtggcatcaagtccgcgacccctcttggcttcctggaaatcacccaaagaatgagaaccaaaaccacaaactgcattttcggcgaggcaaggagatagctaaataccatgaaataggtggaagagctgttaaaagaagtgaagactgagcagggggacgtgatgaaaaacggaaagaaggcccccagctctgcaaacgtgcttcttctggaaagtgagggtacacctgggaacagctgaggccacacccagagaggcatcctgtcaacccgccccatgctggaagcagtcggtctctgcagtggtggagacaatgagcccctctgcaaggtgcaaacgccctgcagctggttactgcatgggctcatgcaaagtcaagatgaaagaaactctcacgtaaatcctccggctattagaacactccagccagcctggtctaggaataaattcatctcctgcaaggagaggttaaaaggaaccagcagaggagcacatgacatctaatggattaaaaaatgagagtgggaagggaaaggaaggaggggaagtgaggaaggagagaaatacgagtggcagatgaatgcgaaagccaggtcaggtcactgttccacttagatttttcagcagctcaccatctcaagcacacagtaagagccacagcagcctacaaagggggacccgccctctccttacctgacggccctcatatggggccctctgctccctcgctcctgccctggcccccttgccattcctttcagaggcctgcacattccagccttaggcaactgcccacgttccttgctccacctgcttgttcttctcagatacctgcaggactcggttccgtgagcccacatttgaaactgtactactccctccctagcactcattatcccccctccctgactgactgcgctctgtgacacttacaccttccaaaataagacaaaagtgcctccctattttatttattgtctgtctcctgcccctgaacataaactccaccagggcagagtgattggcaacagtaggcattcaatgaacatttactaaatgaataaacgatcattcaccagaagaaaaatccataccatcaagcagatgaaaatggtgaatgtgcatttcaccatgaatttgtaaagtccgatgagacaattgcttctataaaggatgaacacaaaacagagctataagagctcagggaggaaatggtgaggcaaaaggaagagataaaaatataggaaagctcagaaaagaagtaaaaggaaaaaatcaaaccaccacagaaaataaatttaaaagggtctaaggatatatgcagggcagaaatgacaaaatccaaataaattaaatgaaaatttaagaaagaattcaaaaagaaccacaaagagataaaattggagacaggtaacaaacacacagctatgcctaattaagttccaaataagaaaactgaaataatgaagcagaacaaatatttactgtgataattcaaaaacagtcaagggcaaaggaattaggagcactcaatgaaaatactctgtagcaaaagtgttctcattcaaaaaagaaaatatccttttggagtcaggaaaaaagatcgagtcactcataagaggaaaagaaaccatatttctccatagcaaaatggaattcaaaatgcaagcagaatgatacaacaatgctcaaggcagtgaagtgtgaccctagaatttatactcacctaatctgtcattccagtgtaactgaaagttttaaatgtgcaaaaataaaaaaacccaaccaaactaaaaaaaaaaacatatcccaagcaatactatataaaagtccttcttgaggaatgtactaaatagtaaactatagctatccaagagatggctagaaaaactatgtcaaaagaaccaactgtgaggattaactccatttaattgtaagaagaagactgagataagtgatgattataatgaaagaagagaatgcaaaatataagtcctgacaatgtagaatgtaatcgacactagctgggagactaagagaactagaatctaggaagtagtataatgtacatggctttcccatctttgatggctgggatttaaaaatgtattattcaaaccatacttccatacttttaagacagggtcttattgtcacccaggctggagtacagtagtgtgatcatagctcactgcaacctccacctcccaggctccagtgatcctcctgcctcagcctcctgagtggctgggactataggcacacaccaccacacccagctaatttttgtattttttgtagagatggggttttgctgtgttgcccaggctagtcttgaactccagggctcaagcaatcctgccttggcctcccaaagtgctgggattacaggtgtgagccactgcacctggtctacacttttcagtatggtagctgtaagccatatgtgactattgaaacttaaacttatattaatagttaaaattcaggaccttccatttcaagtgtttaatagccacactatggccagtggctatcataagagacagagcagataagaagtacattcacatcatcacagagagctctactggacagtgctgatttaaagttaataagtcaaataatgtcgtacaaataaacttaacagaagtaaacaacgacgaatactataagtaactaagatcaggtagtagcgggaagaaagggaaaaggaaagaggaaatatgctaatttaccattgttcacagtaggaaattaataaataatgtctaaaatgtgaagattcaggtacaataaaaagttgcaagggtaacagttaaaacaaaaataaaactccagatgactagaaaatcatacaaacaactaaagcaaacaagacagactgtaaaaagatgtttcaaaagctacttaaaaacacattccccccaaccaagcaggaatgacagaattaatgccaaacgtatgtcatattaacaaatgagccaaattaatgcctattcaaaaacagacatgaatattccattacaaggcaaaacccaattttatgttgtatgacagagaagcacctaaaatggcaggggtggatttggagaggataaaaaagaaaggataaacaaaggcaaagaaagaaggcatggattgtcaccttaatatcagacaatgctgaattccgagaatgaaggattaaacaagacaaaggggactttacaattctaaaggagcaactcacaataaagacttgtgaggccaggtgtggtggctcatgcctgcaattctagcactttgggaggccgaggcaggaggattgtttgagcccaggagtttgagaccagcctaggcagcatagcgagaccctgtctctaaaaaaagaaaaagacgtggtattattatctgcagatcaaacagtgtccacacttgtaaagcaaaaactacagggaatagatttaaggagaaactgagtaaaacaaattcgttgtgggagacattaatttacagatcatgaccaatagagtagacagaaagaaacaaggatacagaagacctacgtcacatatcaacagggtataatgaactggcatacatagatctctataccctgaaaacagagaatatgctcttttcagtgtccatgatatacttttaaaaactggccaaactgatcccttaataagtccaataggtctttcttctgggggtggggggagggggggaacaaagcaaattattaaataatctaatcaaaaaagaaaaacacaaatatccaaaataagaaataagagcagaaatactagaaaaatggaggtaattaaaagataatattcaacactattcaactgtatataagtaaatttgaaaagctgactaagtgaattatttttctgggaaaatataatttatccaaaatcactccaagggagacatgaaatccaagcaaatcaatcatcatagaaaaaataaagttctaaataaggcccccaaacccgacagcttcacaggagatcattccctgaatttttctgtgtgaagaacagaaaattccactataaaactattagaaagcaacgaacttaaaaaaaaaaaaaaagccaacataacaatgacagcaaaataagacaaaagtctacacactcagagagagagacaggagagagaagagagaaaactagattattctcatttgtaaataccagtgcaaaggtcctaaataaaatattagcaaatgcaatccagtagcaacttaaaacaacactatacataaccaagtagaattcagtcaaggaatataagcatagtttaataatgagaaaactggtaatacaactcatattaatagctattaagagaaaaattatatatagtcatctccatagatgctgaaaaggcatttgaaaaaatttatgcattcttgataaaattcttagtaaaataatagaaggatgaccaaatatatctaccttaccccaaagccagcatcaaacttaatgagaaaacaagatatcatccatttaagtcaggaataaaagaaggatgtccactatcaccacaattaacgttctgcaagtactagttaatacaataaaactagagagagaaagaggtaattcaaaggcaggaggtaaaatgatcactacttgcacaatgagtgtatacctgaagaaacccaagggaatccactgaaaaactactatcaacatgaagagagtttcagaaaagatgacagctgggtacaaaattaacacagagaacccaataggtatcacatataaaccaacaactagtgagaagatacaatggaagaaatggccttattttcaaaaggaacaaaaagttaaaatattataagtcaatttcacaggaaatgtctaaaactcccagatgacaaaacttaaaacatgcctgaaagccacaaaagaaaatttgaagaaatggccaaccatgccagattttgaatgggaaagatttaatgcccttaacaaatctactttcccagaagttggtttataaaggcaacctaatcttaaaagaaaataacaccacaattgtttttcttttttgagggggagatggcgggagtgggagggatacactagacaagctgattctgaagtttatatgcaatgataaatctgaaaagaaggaaattggagaaactagccctgtgagatattacaacgctgctataatttacaaagtgtcatacagcacacatgttcaggctgaaagatcaacagaacaaaagtctagaaatagacccagacagtatgggaagctaatgtttgataaaggtagcatttaaaatccttagggaagagagggaatattcaataagtgatactgggaaactggccagagaactcaaccaaaaaaaattaagttgggccgggcagggtggctcacgcctgtaatcccagcactttgggaggctgaggcaggcggatcacctgagatcaggagttcaagaccaacttggccaacatggtgaaacaccttctctactaaaaatacaaaaaattagccaggcatgatgatacatgcctatagtcccagctacttgggaggctgaggcaggagaatcacttgaactcaagaggtggaggttgcagtgagctgagatcacgccactgcactcctgcctgggtgatagagtaagactctctcttaaaaaaaaaaaaaaatcaagttggaccatactgaaactttttgtgtatgacaaatgtagcaaatacttaaatgtaaaaactgaaataataaaagttttggacaaaaccatagagaataatttttttcacatctaagtgggaaaggcctttctatgaatgcctcaaaactctgaataaatatggccacaaatatgactatgaacaataccactatataaatgataaactaggtaaaatacctacaacttaatataacaaattagcaaagggctgatttccctaatattttaagaatgcctaaaagaaatcaatgaaaggctgggcgcggtgctcacgcctgtaatcccagcactttgggaggccgaggtgggtggatcaggaggtgaggagttcaagaccagcctggccaagatgttgaaaccccatctctaccaaaaatataaaaattagtcgggtgtggtggtgcacgcctgtaatcccagctactcgggaggctgaggcagaagaattacttgaacccgggaggcggagactgcagtgagccgagatcacaccactgcactccagcctgggcaacagagtgagactccatttcaaaaaaaaaaaaaaaaagacatcgatgaaaaagataactcagaagaaaaatgaaaaaaaaaagggcaaatgatctgaacaaagagctcacagaaaagggaatgcagattgttcctaaacacagaaaaatatgctcaatttcaacaaaaatatgataaatagcaattaaaacaaagataaaaaaatgtcattacattgtgttgccagaggggaggcaataagccttctctgcattgctggggataacctgaaatgttgcaacctcgtgccggctatttggcaagaccaaaaacattttacaaacacatgggcccagcagatacatttgcagatgtgagatgacttatgaacatagttattcactgcaacactgtttgtaaataacaaaagatggtcgacaaactaaattccaacaataggaaaattgtgagttttctttcaacaatgtggagatcatttacactagtacatatggggatgcagggctagtttccttcatttatcttaagaactgactccttattgcatatgaatcagcatgtccagtctacgccccctcactcccatacattctacttttttttaaaatttaagctgtatattgcaccatttgtgaaaaagaggaagaaaaagcacatttgtacatatttacttgtagatgcatacagtatctttggaaggaatcacaagaaattgatagctgtggttgccccacaggagaagcccttgatgaatagggtgggtgaggcagggggtatcgatcttgaaattcatgaatgttgaaccctgtgaattgattacctattataatgaatccatttttaaataaaacaaaatcccagagtgggtagcctttagacctcaatgtacaaagttctaagcctcttaaattttgataacctataggcctaatagtctctcctcaggaaaagatctgaagattgtgtgttaaaaagtcacatttctttgggttagttcttattttggacttgaacacaactgctagaaaagtaaaagcctctcaacgcctcagccattctctctgcaatgcttttcctttccaatggtcctggcagtgggatgcaccatgacagcccatcttcgttccccacagtcgtgtgcatatatctgaacaaggccttccctcctaaaccacctgagattctgccatcccatttggtctaaagatccggtacacctatagtgagatgcctttttatttaccaatgaggaccaaatgcactaagtagtgaactaacatgaaaacaaaacaccaaggtaagttactgagctgggtgggaaaacatgagtgagacaattaattgcttgttgaaacactctaccctttcttagtagcactgagagacccattttgattagaaagcggaaatcagaaacattaaagagatttcaatgtgttaggtatccccatctccactattttatgtaactgtttccatcttgtctgaaaaaacaggataaacaatcctcagatagttctccacatggtaagtaatggccagtattatgtgaaatttactgaagttccaggaaagagaattttgcatggaatacactatctccaaactatcatttaaactgagatactccaatgcagttcatttcctggtacagaaacaaacaaacaaacaaacaaactaagacaatgccactcagcaaccccattcctagattttaaaacccaagtgaaatgaaagctatgttcacacaaaaatcatgcccaagtgcttctgggagctttattcatcatcacccaaacgtcttctacaggtgaatagatgaacaaactgtgatacatctatgcaagggtggacaactcggccatcaaaacgaatgaactattaacacacaacctggatgaatccgaacgaaatgcattacgctaatgataaagccagattcaaaggctacaaagcacataatcatatttatgccagttacgtgacattctggaaaaagcaaactatagggactgaaaacaggggctacaaaggagcacaggggaatttggggggtgtcagatctgttccatatcttgaattgtgggtggctacagtctcaaggaactttatactgaaaagagtcatctactgtttgtaattatacctgtttttaaaaaacacagaaattatcacgtataggaggaaatagttatattactttctggacaattgagtcatattctaaaattgattaatgtttaagtaaaatctacaaaagttagttcactagcaatgaaactgtaacaaaataacaagatatcaatttacatggcttacatacatgtgctgccaatatagagaaataataccatcatttgacaacttttttggcatgcttgctgtatcagacactgttttaggcacttggacatggcagggaacacaacaggtgaagcccatgctctgggggcttatgttttagtatcacattctggggcagaaccaacatggtaaaacatagctggttccttctacgtatggtatagtatacacacaggcgtcaatactaagtaaaatgggctgacaaaaagcatactgtccaatagtgtgatgtgaaacttcaaaatctgaaactttcttgagagcctggaaaagaaactgaagccactgaacaaaagtttaaaagaaagggaaaaatactattcataaaaagtaaacattaataaaagtaagtatatgcaggatctttagcagcagagtattaaattctaatcatggtgtgttgcgtggcttcaggagttagatagcacatattaacaaaattatgttaatagagactacctgatttcagatttcaataggatggagcatccctagtctgaaaatctgaaatctgaaacgttccaaagtccaaagctttctgggcactgacatgacattcaaagaagaccctcactggagcatttcggattctggatttttggattagggatgctcaaccattaaatatctacaaatactccaaatctgaaaaaattccaaaatccaaaacacctctagtcccaagcatttcggataaggactattcaagaaataacattccaacttgtaggtttacaaagttgacattcgtttggaactactggcataagtgcatgtaaagactccagactataaaccaaacatttaggagggctccaattacaaaggagcctggaattggcataattacaggccaaagtaatgaccgtggaacacagggagtccgccaaagaaaatgctctgtagagccagcccacacttatatatgaacaaccaaagagccagcagattgaaatcccagagtgaaatcatgtatgaatcacgatagtgcagcattcaaatccaagccaggatgcaggcaaacttcagagtagaggacaagagatgagtctagcagcaaatgaggctaacagcctaaagggcccttgttagaaagcaagagcacggttaggtggggtggctcgcactgtaatcccaacccactttgggaggctaggatgggaggatcacctgaaaccaggagtttaaggctgcagtgagctatgattgtgccactgtgctccagcctgcgtaacagtgcaagaccccatctctaaaacaagtaagtaaagaaagaaagagctcaggctgggtgcggtggctcacgcctgtaatcccagcactttgggaggctggggcaggggaatcacctaaggtcacaagttcaagaccagcctggccagcatgatgaaaccccatctctactaaaaatacaaaaaatagccaggcatggtggcgggcacctgtaatcccagctacttgggaggctgcggcaggagaattgcttgaaccaggaggcagaggctgcagtgagctgagacattgcattctgcctgggtgacaagagcaaaactctgtctagaaaaaaaaaataaataaaagaaaagaaaaaaagagctcagcaaaaagagcactgtagggtagatcacgtgttaattaagcagtacggaacagggtctctgcttcaggttaatccagggtaggctctggggacagatcacctaaggctgctctatgaaactactgtgagatgcagagaatgtcatgtggttaattctgggcactgttcatggggcagcagaggagaaggggcagaagacattcttttgtattagttgcattttcttagcaagtaaaaatatatattttcaatttacaaaatggttttttaaaatctgaaacacacggtcaaactatcatgactgtattttttttagattagaaaaagcttagtttttttcctgatgattactgaagaatgggatttctgcccatcggttcctaattttccattgacaggactgcttgctgctcctttcccaaaggtgaagatttgggttttagagaaattgtcttaaataattctttctgataaaacaaaggaagagctaattttgggctgaaatcatgcctggcatgtgacagtaaaaccataaacgtaaataagacactgtcatgggggaacggtagtgaggatgaagggaccgcgaccatcactggaaagcatgtgagccaatgctactggccaccagagacctgcccaacggatcagagcacacacagcaggtgtaaccctcacagctacccagaggtcaattctgtctgagcatcagtaatccagggtcaggacagcttgttcctatcagaagcaaaagggccacaatctcatgttgtccttcccagctcaagttcccaggacaagtaagtaggacaacagtgaaggtctccagagcccaccagcttttgctgagactgctagtccaagagccccagctgagtaaattctccaggaggaaaatggcagaaactatcaaaggatagtcagtaaactggtgggtctgtacctttttggcttaaatgctccagtaaataaaggcaaaatatttaaagcctcattctatgcactgcatttttttttttttttttttttagatagaggctggagtgcagtggtgcaatctcagctcactataacctccgcctcccaggttcaagtgattctcctgcctcagcctcctgagtagctgggattacaggtgcccgccaccacactaggctaatttttgtatttttagtagagacagggtttcttcatgttgttcaggatggtcttgaactcctgacctcaggtgatctgcctgcctcggcctcccaaagtgctgggattacaggcatgagccaccgtgcccggccctaggcactgtattatatctgaaagctaacagaacttgtaagttttgacacaggaccaaattaaatgggttggcatgaaaaaacttcaactttgttgcctcttgctagtcacaacatcctataactaatactttacaagagaaccactggccgtaggcctgtgaagacacctcagcagccactttgggatgtgaggaagagtcagggaagggagggaggaaatagatattctcacttaaagtagaacagctctgcttttatctgtttataaaataaagtattttaatatgtattattaaaattgacattagaattttatataagacttcatttaataaaagggtttcattgcttttttggaaaatctttatgctaaacgatgttcattttattgacttatttataaggaaacaaccatttgtaacttaccagatgaaaggtaaaatctattttctatcaccttggaaaggcactatttctctgagcctggatttgttttctgccaacaagtgacggcacaagctctctattacagagagtaaaaagcccaggcagtctttttcatggctgctcaccatgtaaacatgtccataaagtgttctgtgtagctaagttagaggacaagaagaagtactttacaaaaattacatctttacatatttgcgtttgtatgacatacttttttcttttattcctgataataaagttttaccattttataatttaaaaatgtaaatatggagttgggcatggtggttgggaggctgagaccagaagatcgcttgagcccaggggtttgagaccagcctgggcaacatgcagaaaccctgtctctacaaataaaaaattagccaagcgtggtagcacgcacctgtaatcccagctactcgggaggctgaggcaggagaatcgcttgagcctgggaggtggaggctgcagtgagctgagactgtaccactgcactccagcctgggtgacagagtgaggctctgtctcaaaaaaacaaaacacaaaaaaacaaacaaaaaaaagcaaatatatgtaaaaataggaagtgcggtttcccaaaatgaggtctgtaaacaactgatctagaaaatgttctggaaaaagtaaaaaaggatcaggatctgaggtcaactgacctctccctgcgctctggacaggcaaacaggcaaggttccctctgaggccgtagcggcttctcgtgggcgagtccctgttcgcaggtgacgtgtggaccacgctcttccgaagcgtctggcctgtgtgctctcggggaggggacgcaggtcagcccacctagccgatggctaacaagtcagtttgttttctgaacggaagcttaaacctagaaaagtaactgggttggggtgggggtgtagccacatgcagtaaaagcactgcctgtctgtataacaacgacctgatgaaaaaaggaacgcgtgaaatggggagtgttagggcgtcacaaactccagtgtggttgaaatgaaagcagaaagcaaatggcaagctggcttccccttccagcttttcacaaccctgccttgctcatggtcagccccaagcacgggcggaagaaaggactggaggggagggaaaggggtggggagcgagggtaccagaggcgtgggaggacggggacaaaggggcagcaagggaccggcggaaaggaaagtcggcgttagctggattggaaacagtccagacagaacgatgggctctgctgcctccgggtggggcaccaagcggggagcggggccacgaggcaggggacagtgaagcaccatgcagcgcccaccagccggcagcgcccaccagcctgcgctgcgctgcacatggtacccgcggccccagctggccagtgtgtggcggagatgagaccctcgtgaagagactaagcggccacagcagggggaagggttgctcacataaccccatactgctcacactacgaggttaactgccgtgagatctgcctgcagccagcagaaacccgttctaggaaaacgttgcccagtgacttcagtgagtgccactgacccgggcgcctccgccccggcgtccggcagcagcaccgattgcgcaggaggcaccttgcaaacaacctttcctgatccgcgctgcagttcccaggccggttgcagccgtttcacagagactgcgcacacaaagcgtctccgtgccctgccattcacctttcgacacagccgcaacccctcttttcagtgttaaaacctggcgccaaaaggaacatgcgatgtgacgtgttacctctgcgcatgcgccgggcattcccagcgccccgaacctgatgaacgcgcggtggggaccccaggcttccgtgctttcgttttcctggaagctacgtgtcctcagtctacatattgttacctggaaaataaagttttctccttttttcttcctttgttaacaggcagaaggtgtaggctgcaggtttcgggcctaagagagggcatggctggcgacacggagtagactcctagatgacataacggaggcgagtctgcaccggggactcggcattaggaggaggcagaggaaaagcccaccaccgtggccgagggagatctagcaagcagcttgcagggggtgaagtgtgtgcaaagcaggctgagacctgtccagtatcgaaacacgccgcggtggtcaagcaggctttaccatgctcaggcgcaggctggtacaagatttgcagcaacaaacaccaagtggagaactacatgaacacttttgatcgcatcccagttttcagacaatctcggataattctgaaaatgcttcttatgcattatataagagtttaggttatgatttaacagacaagctttttcaggagtattaggttattggcagaagaagagacctacttaaagtttggatgactgtattcctaaaaggttcatacctctcaaaattaccttaagatctcttctggctcagagatttaaatttttataccctaagtccttacaacaagcattcactgttacaactgatcattcatttactaagaatccagcaggttaaagtagaatatttaagcttaaaaaaaaaaacaaaaaaactagcattttagctttgcaatttttcttcataataatgaactgttatgtatagggtttctcctttttttttcataagaaattacgggcatgcccaattaaggtagtattgaggttcttaaggtaacagtactcagtccacagtgtataaatttcttctcactgtaacctggctatgctggggagtaaatctcttatttatgtttttcacaaccataatatttaacaatgtcattttcatgagtacatgtgccagaatttaagaatgtaaaacattctggatttataaaaacaaatgaattatatttacactacagaaagatttactgcaggatttttctaaccaataagctcccctacagcgttccaagacacaaagtaatttacagtgcatttgagtccaactttttgatcaagaacacatctgctgcactaagcaaaggagttgcagcaacaccaaaatcacacttggctctcacggccaaaatcgccgtcacctccgtatgttctccttggtcactgactctccttcctccaagcagacatagacagtgggcacatatttgacaatctgtgaagcatctgacaagcactcattatgccatttggagggtgtactaacgtaactagcattgtggcatacaaagggcaattctaagggtgaacagacttcggagcgtggaaaagaacatgacaatgccaccacctattactgcggcccccacgaggtgttggaagctaggataagtgtcttaaaacactatctcatttaatttttaaaatacaacctttgagtaggtatcatctccattctacagatgagaattaagacccagagaaggcacaaagaatcctggatttaggaataaaaagatgcaacttcaaatatttgctatcatcagtccccctggcatgtccctgaattctctgggcctcagtcttctgaaccacaaaacggagaaaacgctacctcttaacagtatatggaggattaaagcactctgtgagctggaaaaggctatcctagtctacctagttataaaacagtattagttaggtgtttccatgggaaatttaatctttcactggaagtagggaattagggaatgtttaacacaattcctgattatctcatatcacccatgggtctttggaaacagaagtcaagtttttaggccaggtgtggtggctcatgcctgtaatcccaacacttttgtcaggccaaggcaggaggattgcttgaggccaggagtttgagaccgacctgggcaacatagcgtgatttcatctctatcttaataaaatacttaaaaaaagaagttttctacccaagtggaaggatgcttagggagaaggtgccccaacagcaatgctgcaagcttggagaaagggtctatattcacgctgagccacaggaactgggatgaagaccctggaaaatcaaaccttggacaattttctattatattccattcctgaatcagagagaaaaccatatttataggaattctggaatctctactcccaatttatttgaatcatgatcttaagaatgactattttaaagcaaatacaagtaatggtgggtgcaatgtgtagctctggggctatgtcaaaataagaataaatcttatcaacatctgtctgaaattgatacctagaatattatttataattacgaagcaaaatccataatgtgcctacaataccatagtttcccctttctgatcaatgcatttataaaattatcagtcttctgcattttgtttaaatgtttcagggcttcaactcatcatttaataaagtttttgagcacctattaagtggtgagtactgccaggcccaggaatacaaagataaacaaaaccaaatattttaattgagtggactaatagaacaaagtcactacaacagaaggtaatcagtgcaatgacagcagtatacacaaaatgtgtttgtaaactattgccagttactactaaattacagaaaacattcccatgttattctgttcactttgtttccttcgctgtgtagaagttttttagcttgatgtgatcccatctgtccatttttgcttgggttgcctgtccttttaaggtattgctcaagaaatctttgcccagaccaatgtcctggagcattccccaatgtttcttttagtagcttcatagtttcggatcttctaagtccttagtccattttgattgtcattcccatgttattttgtcttttcctgacaattagacttgacattccgttatcccatcacaatctcactttcttgttagttactctttttgtaattctgcttgtaagaaagtttctaaaatttaaatattaaaattaggaatttttgtaaggctatgggtgacaagagttgttgctataacagaaactgaagcacacatttctatacaactcatgtcaaaaaaaaaaatggaaattagaagatattttaagttgtacaatgatagaaaatactaccaatcaaatcttgtggacacaattttcagacttggcagtgaagcattatctcggggtcctctgacattcccacagtgcatgaggttaccaaaccatgaaacctcatcaaggtcctttggagcagggtcttctcccagaatctagatggagtgatcctacttccagtctcctctccagcaggatgtgggtagggttacaagggtttgccttacaataattcactcacctattaaaaagaaaaataaaacttaaggtacgaagtactacttagagtagtacttagtgggaaatgtctacatttttaaaaaggaggctacaattcaatatgctgaacagccaacttacaaagtttaaaaaaaaagaacataataaaccctaagaaaacagaaatattttggaaagacagtcaacctaagtcacattaaaaaactgctgttgctgccagattagatgaggatgagcaactataaacacctggtcaaccaagtaaaagaaacagtctaaaggactcaggttgcgtcccaaatgtctgcaaactcttcttcaccaggtttacattgtctattcctcatgactgaaaccagcagtgcatggtgggcacttagtttaacactcagttttcaaaactaggtttgatgaagctccagaagggcccccagcttctcccttttccccccagatgactataccctactttatgctccttcatacatcacagatgctcttatttgagcacttgatcatctttttaatcatcttttattttatatatttgcctatctctactaacctgtaaccctcatgagatcaacatacattggctgaatgaagctgattgattaaataatataaaaaagaatgggactgatgaaaatgttaatatgaaaaggtatccaagataaaggtacattattaagagaacaagttgcgtgtgtgtgcacacgtgtgtctggaacactacacaaatcatcagtggatacgtccaagggcagaacagggagtcaggaagagtaaggagacttcacttttcattttaccttcttctgtagcacgttaatttttttttttttttttgagacagagtcttgctctgttgcccaggctggagtgcagtggtgtgatcttggcttactgcaacctctgcctcccgggttcaagtggttctcaaacctcagcctcccaagtagctgggattacaggcgtgcaccacacccagctaatttttgtatttttagtagagatgaggtttcgccacgttggccaggctggtctcaaactcctgggctcaagtgatctgcctacctcggcctcccaaagtgctgggattacaggtgtgagtcaccgcacccagctgggatattacattttaacgtttatattttttaaatgcttcaactgtaatttttaaaaaatcattttgtcagtgagtattttttcttaaaaaaaaggtcaattttaaatctaagtataacttaggtttctctggtgtccacagaatcaagccattttcaaatgcttccacaactaagatactgaaaagcacaataacagaatcagcatatattcaaagtagaagtcatatcagtctctttttattgaaatatcacaatgttattcacagcactcctacgaaatgaataacaacatttctatattacaaattcctccattttgcataaatggccactcctagggaggcagaataatagagtgttcaatggacatgctttgaactggaactgatctgagttggaatccagactctgtccaattagtcgggtgaagttcttcaacttgtctagttgggttatgaaattcatcaacttgtctaagccaccatttcctcattagaaaaatgagagtgatactgcctggctgtcaaaccctaccccagaacctctgctggaacataagcttgccttatgtgcttacgctgacaaacacgtttcacttgaaagacaatcacttaatgacctcaagcctgggatagtactgcttaggatcaggctaaagtaggtggcagtcacctcaagcaacccataagaattgtaggcatggtgctctggcaggtccataggtaagtcaaatctttggtaactgaatctttactgtcactgttgagatgtacggagaaaagagaaaatgtgtatgctatcagctccattgcagccagctaagggtgaggaggataggagagaagggccgcttctcccacaaccacagcgcaaactagatgtgacatatgcactgtctgcagtcaatgaggcctcctcaaggaccagacagcaaggatcctgctacgtgaggcttggaaaacagccatgacagtgctggctgcctactccacctaccctgaattacagatcatggagtctagcacatgagtcatgggcacacatgtcagagatttttgtcaattgattaattagtttaataactttctcttttctgtcgccttttaaaaaaacatagcaaccatctatttggaagttatactggtttttcttttatattcaccatataaggtttcctttaaaatgcatgtaagtataaaaagtgactgaaggttgagagaagctgccttcagccatcaattgcagatgctgttccttatactagcaccaggagatgtagtctaagggacagagctgactctgtcttcaactctgtgacccgcaggaagtggtcctggctgtgtatgacttctgctggggcaactttaccattccactgcttgtgtcttttctaatgtacttttcattacttgtatcatatttaaaaccacagaaaatatctcagcatcccagctggagtaacatttctgaagagaacatgctaacttgttaatgaaataatgaatactaaagttaaatgcatatatagtctcctgtcactgccctcccattgttattttgaaacatttccaagctccagaaaagttacgagaatacaaagtagtggaaaaattggaaccgtcatacagtgctggtagactgtaaagtggtgcagacatttttggaaaataatttggcaactcttcaaaaagttaaagtagctcagcaaaatccactcctaggtatatatccaagagaaatgaaaacatcctctcacataaaaacttgtactagaatgttcataacattattaatagcgaaaaggtagaaataactccaatgtccatcaagagaccagtggttaaacaaaatatgatctatccatacaatggaatattattcagccacagaaaggaatgaggaactgactcatgctatgacaagcatgaacactgaacattactcgaagtaaaagaagcctgtcagtcaaaagggccacatagtgtacgattccatttatatgaaatgtcaagaataggcaactccagagacaaagtcaatttgtgactgccaggggtcaggagggagggggaatgaggagtgacagctaatgggttcagggtttctttttggggtgaaaatgttctagaattagatcgtggtgatgggtgtgcaactctgcaaatacactaaaaaactactgaattgtatactttcaaagggtaaatttcgtattttaaattatctttataaagctgtttttaaaaagaatacaaagtagacccatgtagcttttaacttcattcagcaattgttagtattttgccacattcactttctttctcctatacacatatgtgcataaacatatgtgcacagtctacggcttgacactttgatcctaaatacttcagcatgtggagtattctacataaccaaaatataaatattacactggagaaattcaacaccaatatacaacaattatagtccatagtcgaatttatattttatcagaaattaagcattctatttggttctcatgtccctttagtcttatagtctagaaaaattatctcgcctttattttttgacactgatatttccgaagaatccacgctacttgtttcacagaatgcccttcaatttggatattccttattgtttccttatgaactgatacggattaaacatttttggcaggaatactacataggtgagttgtggccttctctgtgcatcatgccaaggggtaccgaatgtcagtcgtctcattagttgtgatggtgaagtggtgttcattgttgtgcttggctagaggagtgtgactaccagatttctccattataaaggtagctttttctctttttttttttttttttttttttttgagacggggtctcactctgttgcccaggctggagtgcagtggcacaatctcgtctcactgcagcctccgcctcccgggttccagcgatttttctgcctcagcctccctggtagcttggattagaggcgtccgccaccacgcccggttaatttttgtatttttagtagagaccaggtttcaccatgttggccaggctggtctcgaactcctgacctcaggtgatccgcccgcctcggcctcccaaagtgctggtaatacaagcgtgagccaccgcgcgggccagatttttccctttgtaattaaccatcaaggggatgaccatttgagcttgtgtaaataagagcaggcttccctagttgtcttttgcccaaaagttttagcatccatccaagacctttgtctgaaattctgtcccttttgagattactttgcattaatatgaccaaccactgcgatcaattttattccaaagagtgttggggctgtgatttcaaccctagctgcacatatatcaccggtatcgctgggagtggaacccaagcaatcatattttaaaattctccaggatgactgattctgatgtagagtaagggttgagattccccgagttagaggaaccttacaacaccctcatttgcaaataaggacactgaggcccaaggaggttaaatgactggccaatgtcacaaaacctgttaatggcatagtcaagattttacttttttatacttgcattttaatagccattcctttgtgtcagtcgaagaataaaaccagaaaaagcagtaactttcgtagtatgttagtatgttgttaaaagtgactaccatctaatatatgctgccgccagacatacccatttctgcttccaaggtttgttttagctttcgttcattagacctttgcggtcaccttaggagagagggaaaggggagtttggtcgtcaactcctccgccctcagcgctcactgagggagctcaagcctgagaacccaacaccgccgggtgttcaaggggccagatgggaagagcgcagccccggagctgggcgcctgccctgcacgtcccgcagatgcggcggcggcgcctgccctggggcctcctcgcagggcagccagcctcgcgcgggaagcacctggcggggacgcacctggcgggaacgcacccaccttggcggagacgcacctggcgggacagccctgccccgcctagggacgcgggacgtgcgcagagcgatggagacagcggaacctgcagacccgcccaaccccacctccatccccacccccagcccccacttaccccggcgtgataaactttattcgctcttttaatcttgatgtccagggcggtccccatctccaattctccgcagcagccgccacttccggctgcgcgtgaccccagggaaacaaggggcgcctccccgcttcgttctgggccccgcccctttccctctctgccggcagtggctcacgtgacctcgcagcggcgtcgcacacactccctagctccgaggggcgaatgcccacgccttcctccttccggcacaagagccggccttagtgcgggccgaagcgctgtcacggttcaccccgccccctctgggcgtgaaagacggggccaagctagccccaccccttccgtagggacagtcttacgccggaaatgctcctttgctgtccgggttagcggagggagggaggaacggctctccccgcgtgccccgcggctggaggcggagccgagcctgtctgtcggttgcagcctgcgcaggaaggatgacgctcccgtcaggctgtgcggcgcagacggtcgcccaatggagttgtctttcaggaggttttaacttggtaatgcctgccctcctcaaatgtccttagtctcctcaactctagccctccaccgctttctccctggggttctgaagagccggcgcccccttgtctgtctgcggccaggcgccgcaccctgcccttcccgcgggagcggttccggtcaccctcaggggtgcggcccctgcgtgctagtcctgcaaagcgctgattggccggcggctcggttgcctcgcgtcccagcgccagctgggcctagggccaaggtctcgggaagcgccgggtgacctcgctcctctcggagccgcgggcgctgggtcacccgccagccgggctccgcgggccgcgagggattgtgggtgttccccaggcgcgtgtcctggaaccgggtgttaaatattcagatccgtgcgccccgcgtgaagggtggaaaggcacggcccccaggctctggggcttggagattggttgcaaatgaaagactgaaagctggagtgaatctgcctattatttttattcccagcaacagctgaccccagatacagtttgtgggggtggggggcgttactgcagggcagggcagtgcactgttaacgtacttcgtttattgagttaaaatctcttgtaaatgttataaatgaggattttgccaataagcagaaggtcaaatttcattttgacaaatgatttaattaaataatgcggtgaaaagtgctttttgtttaaattctttgctttttgtttaaattctttgattctgatcattattttttaaagtgcattgcttttgggataacatcagaaactatctgtaaaaagaattagtatcacgaatgcctccctcttaagaatataaaatgttttacaggccagcagtgatggtgctgcagctacaattgcatttgaaggttaataaatggtattttcaaatattcaggtcttggtttgcagctcctctctgccctcagggctttggtctctgtcttcaatgttttcctggcaattcaaaactcagcgattttagaacaattcattagggacttgaaaatcacagtctagtctatttgaattcaagaagtggatccctttccgctagactcacccatcattttcaagtggtaaaaaatcaatctcagtagacactgcagagaaacaggaaaagaaacacatgtatcaacattgtatacttggtttttttgttttgttttgttgttgagacggagtctcgctctgtcgcccaggctggagtgcagtggtgctatcttggttcactgcaacctccgcctcccaggttcaagcgattctcctgcctcagcctcccgagcagttgggactacaggcatgcgccaccattcccagctaatttttgtattagtagagatggggtttcaccatgttggccatgctggtctcgaactcctgacctcatgatccacccgtctcggcttcccaaagtgctgggactacaggggtgagccactgcgcccagcctccaatcgctatccttttaaatcttttccatccctcactcacaccttagatgataccttaactttctggtccatttgagttaccaaaaatcagaccgtgttaaagtgtcgatctcatgtctcaagtgggaccctaaatcccttagtgtgagtgggaaggtgcaaagcgtggttctggcatgcagacacttctcaacgtacctctgcaaggcctggcttctgtgttgagataaggaagaggagagaaaatgagacaaatatctcttaactagccactgctgaattttcttagttgattcctgcctctctggtaactgtctcgtttaaaattcctttcgtggggtacagatggggaggtcgggtggggccttctccctgccgcacagttccatgggagatcttttccatcacccgcccccgccgccgtcagcaccgggcagtacactcagcctctcaggcaagatcactcaggaccatttatcttccgcataggaagaatttgacccaggagaaatacacatctttgccacacaaaagggctggactgaagaccaccccgtggctactcctctctcccctgctatatccctcttcaattttgttgttcccccttgccatacagacagggataagtcagcaagagtgctggaggaacagatctgcaggcaacagatagaataccagactccccttccagcaggccctctgataccttggagagattgtcctatgtccttcccagctacatcacttcccaccagaaacaccgtcctccgcaataccgactgcctcctttcattccttcccctgccttcctgtatagattgaggagaggactggggaagtatttggtggaagcggggccagatctgcagctttttattaagccctgggggaagtggccccaattataggcatctttcattaggagatggagtactatgcctgtagttttccattgtgagcctagtgccaattctgggacaatagtagaggtcccactaaacatctttaagtgggtgctatgattctctgcgcagactcttcctgcaggactggaggacatgttccctgagctgctaggagtattggtctcaacagttttcagctaagtcactcttcaaagcttggctttaatgaagaaaactgccttgcccaaggtcattcccccttctagggggcagcccacacttgacaattaatccatttaggatatagaggcctctccgttgttccagtttaggacaactctgaaggaccattccatattcaaaactcccagtattagttaaatactgatgtgtagcaaattactccaatctgtagtagctttaaataacaaacgtctcattatgtctgcgagttgggaactcaggagcagcttccctgggtgttcctggctcaaggtgtcagattcttgcagttgtctgaaggcctgttgtcggctggaagatccagttccaagatggctccctcacatggctgaggttgggagcactcacttccactccacaggctgcttgagaagcctcacagtatggcagctagcttctcccagaccagtcaatcaagagagagtgcaattagggagctgcaatgccctgtgaggccaagtatctgaaggacatctacttttcttctcttcatcagaagacagtcactaaatcccactaattccatttgggaaggggaatttagctctacctatggaagggagggtcaaagaatttgaggacatattttaaaccactacgctccgcattgaatcctgcttcctacacccaaaccctgtgcgcctgttgatcctgagagcatctccccaataaacttcctgcatgttaaatctccatctcgtattctgccttctggcaacctaacctcaacaatccagttatgctagtttcataataaccctcataataaccctcaagacactcttgtgatacaggaaaaattactatttcctcaccttacaaaagggaagacaggcacagaaagattaatgtacttgcccaaggtcatagagcaactaagtggcagccaccaattctgactccagagttcatataggcaattgctgatcaatgcgctacatacatgcacacaacaaacgcctgggtgcataacaatggggggctcatgatcttaatcaaaagactggacaaaagactgccaatcaaatgggaaaatccagcagaggtgcaatgtcatagtcaaaggcaatcttaaagagaggaatggggggtcattgtatcaactgatggtgaagatagaatattaaaactattgcagaatagtataatgctttagtttgctacggctgccacaacgaagtaccacaaactgggtggcttcaaacaacagaaatttattctttcactcttctggaggctgcaagttcaaaatcaagatgtcagcagggttgttcttctgaggacggtgaggaaagaatctgttccagttctctctccttggcttttaggtggccctcttatgtctcctcactctatctttaaaaaatgtgtcttcatggctgggcacagtggctcacacctgtaatcccagcactttgggaggtcaaggcaggaggatcccttgagcccaggagttcgagactagcctgggcaacatggcgaaaccccccatctctacaaaaatataaaaattagctggatgtggtgacgcatgcctgtagtcccagctacttgggaagctgaggtgggaggatcgcttgagcctgggaggcagaggttgcagtgagccaagatcatgtcactgcactctggcctgggcgacagagcgagaccctgtctcaaaaaataaaataaaatgtatcttcatgttcacgtgatgttctttctgtatcaatgtctgactccaaacttgccctttttctaaatacaccagtcatcttgtattaaggtccactaatgacccccttttaacttgattacctttgtaaagaccctacttccaaataccgtcacattctgaagtaccaagggctaggaccttaatttggcagggaaacaattcaacccagaacaccatcctcatagatgggattagtgccctataaaaggaatggaagggagctagctagtccttttgcccttctgtcccttctgccaagagaggacatggcatttgtcccttctggaggactcagcattcaaggcgccatcttggaagcagagtggaaccagacacaacgtgctggtaccttgttcttaaacttcccagtcttcggaactatgagaaatgaacttctattgtttagaaattacccactctgtggtattttgttataacagcatgaatggactgagacaattgcatgtatggccactaagaacatctcaatgttgattatgtacaagtttgattaaggatgtcctggataccttaactaccacaacttacaccacttggcagttaagacacactttctcaaataacaaaatgtgaagcattctttgtaaacaaacacataaaaatacaatatttgttttttataaacaatatatatgaaatttatatataaataaagaaaaataaaattttaaaataaaatttaaattaaagataaattagccaggtgtggtggctcacacctgtaatcccagcactttgggaggccaaggagtgtggatcatctgaggtcaggagttcgacattagcctagccaaaatggtgaaacctcatcggtactaaaaatacaaaaattagccaggcgtggtggcgcaggcctgtaatcccaggtccccgggaagctgaggctagaggatcacttgaacctgggaggcagaggttgtagtgagctgagatcacgtcactgtactccagcctgggtgacagagtgagatttcatctaaaaaaaaaattaattaaaataaaataaaataaataaaattagaaaataaaatagaattttaaaatgtaaacatacataaaaatttatataaaaatgtttaatgaattttataaaaataaaatttatatataaattttatattttatataaattttttattaaaatgtgattaaaatacaatatttgtttcttatttgtcaagaaacaagtaaaaatatgataccagactaaaaataacaaagtatgaatgcttcacaccaaaacctatgggatacaggtaaaaaaagaatcctctgaaaaattattggaaaaagtttggaaatttggtcagagtgaaatgatatgctatctgggatttgcttctaaataactctaggaggaggaagagggagaaggaggaggagggggaggggagaaagaggaggatgaggaggggtggagaaggaggaggggggaggggagaaagtaggatggggaggggcggagaaggaggggaggaaatggaggaagagggaaggggtacaggaggaggaggaggaaaggttttattcactcattcactctgcctttgtatacacttgagttccataacaaaagaagagaagataaatttacaaagtaggataatatttttgaaatattaagctgaagtatttttaaaattccttgtcattcccagcaggtgcccctcaactctctctccatcaagtttataccctgaagcaaaaaatgtgtgttgaagagcactttgccaaagatctgaaacatggtttggtctagaggaaggggaatagaatgagaagagcagaagtagctcctggggtgggatccagctgtatttcatgcttggagtcaacgtcccagttggggttagaaatgcgcagggcaatagaaaacatgacaggaaactcggagctcgagagagaagaatcaaatgattaaaataacccaaaagttagaggtatgggctgagtcagccaagggggagtcccggctctttctagcggtccctctagtgtgctattgcctgtgcagagatgggattttgagacactccagctgggacgttggcagataggcaagggacatggcatttttgaaccatatgcctctctccatcccaagtagaatgcttttggggaaaggtaagaaggagactgaggatgtgaaaagagaattctaaaacactggctatcagctgggttccaactgaataatgagactgattttcttctcccctgtcctcagcagaaatggttactggggagctaaactgggttaatttatagagaaatgaagactggtacttttttggtcatctatatgtatgcctgtaaattttgaaacagcctacgtatgcaaaaatcaataggcattacgatttaacagcaacaaccagttagaaaataaaatgaagatacagactgtattctcaatagcaatcaaaatataaaatatttggagtaatttgaatgtgatctatgttttagttacatgagaaaagctataaggctgaattaagaaatgtgaaatatggcaaaatagagatttacagtatttctgaatagaaaatctattttaaaatgtccagttgtatacaattaatttttagagctaattactctcaatatcctaataaaatttttcatgaggaaattcaatgaaattctgttaaaattcttctgaaaaaataaagaagtattttgaaatgacatctctttaaagagctaattgtaggagaaaggtttttactaggcataaaatatagtataactgtaagaattaaaagagcatcatcctgacataagagcaattggataggacagatcattcagaacagatcccaacatattatgtataggattatttatttatttatttatttatttatttatttatttatttatttttgagacggagtctcactctgtcacccaggctggagtgcagtggcacgatctcggctcactgcaacctcggcctcccgggttcaagggattctcctgcctcagcctcccgagtagctgggactacaggcgcagccaccacgcccggctaattttttgtatttttagtacagacggggtttcaccgtgttagccaggatagtctctatcttctgaccttgtgatgatctgcccgcctcatcctcccaaagtgctgggattacaggtgtgagccaccacgcccggcctatttattttttattgtatatattcaagttgtatatgaaatttcaataaatgataaaagaggcattgcaaatctataaagaacaggggattactcagtaaatgatattacactaaatgctatttagaagaaaaattcatttagattttaccataacagcatatatcaaaaaaaaggaagagagagaagaaaagacctagttggattaaagagttcaggaaataataaaacaagttaaggcacagacttaatgaaaagtatggaaaacttatatgagaaaaactactaaagtcttgcatgagacgtcacagtagatttgaacagaaggcaaacataccattatcttggataggaaagtgtaacatcataaaaatgttaagtctcctctgcttaatttatatatttaaattaacactaacaaaaatattaatttatttatggagccaggcaggttgattataaaatttatttggaataataaataagggagaatagccagaacaaatctcaaaagagatgaaccggtggggggcagggggaggaggaggagcctaggacgtgtcatacagagagtggcacctgggactcattttagccagtggaaggcagtgagagttctgcacctaaatcttttttttttttaaacagagttttgctcttgtcgcccaggctggagtgcaatggcgtgatctcagctcaccgcaacctccacctcccgggttcaagcaattctcttgcctcagcctcccgagtggctaggattataggcatgcaccccatgctctgctgcttttgtatttttagtagagatggggtttctccatgttggtcgggctggtctcgaactcccaatctgaggttatccccctgcctcagcctcccaaagtgctgggattacaggcatgagccaccgcacccagcctctgcacctaaatcttaaaaaggcctggcaacaggcctggcacagtggctcatgcctgtagtcccaaaactatgagccaaggtgggaggatcgcttgaggtcaggattttgagaccagcatgggcaacccagtgagacctatctctacaacaacaacaacaaaatttttttaattagctggtcacagtggcatgcgcctgtaatcccagctactcaggaggctgaggtgggaggattgcttgagcccaggagtttgaggctgcagtgacctatgattacaccactacattccagcctggatgacagagcaagaccctatttcgaaaaaaaaaaaggcctgacctggcaacttctgcttttacatgctgggagggctgagtatgatgtaaggagcccagtgaccctgatggagacactgttgaaggaccacaaagaggagaggccctgaacaatatggagaaagaaggggtgggagagagagagaaaaccccagctcccccagcgtagccaccaagaatggccctcctgccatgtccacaaggacccaacatacacatgaagccatctcgggatttccactccactgccataaaactgcagtcacgtgaacgacacaaagtgagactggcaaaaggaccactcagctgagccacagtccaccagtagaattgtgaaaaataatacagtggccattgtcctaagccactgagttttgaggtggtttgtgatgcggcagtaggtgaccagatcaaatgattaccgaaggggaaaagacagaatagggcagggagacaggaagagaagcaagacatctctgcatgttatgtcatagaattttgactctgtatccatgtaaatgttttagctaatttaaaaaaattttaatttaaaaaattaaaccacacagaaaagagaaatacaatggaattgttaaaacttcagtggggtagaggtaggaagactttctacatgactgatagaaacatcacaaaggaggccaggtgcagtggctcacgcctgtaattccagcactttggaaggccgaggcgggcggatcacaaggtcaggagtttgagaccagcctggccaagatggtgaaaccccatctctactgaaaaatacaaaaatcagctgggcgtggcggcatgtgcctgtaatcccagctacttgggaggttgaggtaggagaattgcttgaacccgggaggcggaggttgcagtgagccgagatcgtgccagtgcactccagcccgggtgacagtgcgagactgcgtctcaaaacaaaaacaaaaacaaaaaacaaacaaacaaaaaagaaacatcacaaaggaaaaacatagccacagctggatgcagtggctcatgcctgtaatcccagcactttgggatgctgaggtgggaggatcacttgagcccaggagttgggcaacatagtgagacccctatgtaaaaaatacaaaaattagccaggcatggcggcgtgtgcctgtagtctcagctatgcagaaagctgaggccagaggatcacttgagtcggggaggtcgaggctgcagtgaaccgtgatcgcatcactgcattccagcctgggccacaaagcaagatcatgtctcaaaaaaaaaaaaaagaaaaagaaaaaaagtcaatttattatatagaaaattttcctatacatcagtggggaaacccataataagaaggaaagaactgctgggcgcagtggctcatgcctataatcccagcactttgggaggccaaggcaggtgggtcacctgaggttgggagtttgagaccagcctgaccaacatggagaaaccctgtctctaccaaaaatacaaaattagccggatgtggtggcacatgcctgtaaccccagctactcgggaggctgagaggggagaatcacttgaacccgggaggtggaggctgcggtgagtcgagatcgcgccattgcattccagcctgggcaacaagagtgaaacgctggcccccccccgcccccccagaaaaaaggaaagaacattttgggaaatatatacaacaaacatgacaagaaaagttcacattttgaccacagaggatgtgttagttttctacagccgtgtaataaataactataaatgtagagatgcgaaacaacacccactgattagctcacagctctgtgggttcaactggattctctgcttagggtcaaacagggttgagatcaaggtgtctgcctggctgggctattacctggaggctctgggaagcacctacttgaaagctcattgaggtgacgggcagaattcagttccttgtggttgtaggactccagtcacgtgccctcgctgactgtcagcagggaccactctcagcttttaaagacgtctctctgatcagtgggcagagcccctccatcatcaaagccagccatggtgcatcaaatccttcttgtgctttgaatctctttgactgccctttctgcggccagacagagaacattttctgcttttaaaaggctaatgatattagattaggcccacctagaaaatctccctatttgaagattaaccatgccaggtaacataatcttgggagtgatatttcatcatatccacagcttccaccctcactcaaagggaggggattatagaaagaagaaggtcattgggggtcattcttagaattttgactaccagaggggataacattcacatctataataagaactctaagacacaggacatgaataacagtttgcaaaagaggaaatcaagtagttagcagacatatgggaaaatgtttcacttcaattgaaataaaagaaattctagtagaaatcttctactcacagattaaattagcaaaaaatactaaatattggcagctatgtggtgaaacaggcatttcattcattgatgatagcaatgtgaatggtacaacacatgtagaaataaatttggaaatatataccaacgcctttaaaatgtttatattctttggcccagtaatttgactgctgggaatctatgtaaagattaatcctaaatttggaaaaaaaatttcccagcaatcaagtaatcctaaatttgagaaaaaaacatttttaaacactgatatggtttggctctgtgtccccacccaaatctcactttgacttgtaataatccccacgtgtcatgggagggacccggtgggaggtaactgaatcatgagggcaggtttttcctgtgctgttctcatgatagtgaataagtctcacaagatctgatggctttataaagcagagttcccctacacagatctcttgcctgccgccatgtaagacatgactttgttcttcatttgtcttctgccatgattatgaggcctcccaagccatgcagaaccgtgagtccactaaacctctttcttttataaattacccagtctcaggtatgtctttattatcagcatgaggacagactaataaaaacaccatggtattcacggcaaattattaataatgaaaaagtggaaacaatctaattggcaaaatggacattgttggatacattacaccttcaaatcaacaagatattaggcagtcactgaaaacatggttatgctgaaagaaaatacaagaaggtctgataaatggagaagaaacattccatgtttatggagtacaagactcaagatgccatctctccctcaatgcaattgcattctataatcccagtttttggtttaaaaatttaaacacttgtatgataatgcaaagatcctataacagccaacacattttgaaaaagtagagcacagcaggaggatttacactgcctgactttaagacctggcataaaacaacaaggatcgatgcttaaagagagataagcagatcaatggaacagattagggagtccagaaataaaaccgtatacatatggtcaacaaaaatcatatatgactttcaacaaaggtgccaaggcaattccacagggacaggaaagccttttcaacaactggtgctggaacaactggatatccatacgggaaaaaaatgaaccttgcctgttacttgacaccatatacaaacattaacttgaaatggatcatagacctaaaagctaatactataaagtttcttttttttttctaatcttatattttttattttttttgagatgaagtctcactctgtcatccatgctggtgtgcaatagagccatctcggctcactgcaacctccgcctcccaggttcatgcaattctcctgcctcagcctcccaagtagctggaactacaggtgcctgccaccacacccagctaatttttgtatttttagtagagatgggatttcaccatcttggccaggctggttttgaactcccatagtgctgggattacaggcatgagccaccacgcctggcccttatgtttggtttttgctcttctcacagatatgcattatttcaaaactatttgccagtaaatgaaagtatttactattcaagttaaaaatatttcctattgaatttaaaaaaagtgaaaggaaattgacaagagcagcattagcattatttcaactgcaagagccagaaaccaatttattttttattttattttgttattactattatttttgagacagggtctttctctgtcacccaggctggagtgcattggcacaaacaaggctcaatgcagcctcagcctcctgggctcaagtgatcctcctgcttcagtctcccaagcagctgggactataggagtacactatcatggttgtctgattttttgattatttgtagacacagggctctgctatgttgcccaggctattttttttttttgagatggagtcttgctctgttgcccaggctgtagtgcagtggcacaatctcagctcactgcaaactccacctcccgggttcacgccattctcctgcctcagcctcctgagtagctgggactacaggcgcctgctaccatgcccggctgattttttgtatttttagtagagatggggtttcaccgtgttagccaggatggtgttgatctcctgacctcatgatccgcctgcctcagcctcccaaagtgctgggattaccggcgtgagcacagcgcccagcctgcccaggctagtctttaacttctgggctcaacaattttcccaccttagcctcccaaagtgctgggattacaagcatgagccaccatgcccagtccagaaatcaaagtaaataaccttaaaccaaacacagatgaattggctttcctaactcaacccaggtatggagttgttttcagttgagttacatatacaaagtcaatttaccagtttcctaatagtcttcttaccatttataggggagacatctaagttatgtcaataggcaaatcaacgaatactacatcacaaacagtttcaatatttaagaggcaataagagaaggaaagcttgtggaaaccacacattttatttattaccttcatttcattctcacagcctagcaataattcagagctaacgtgtggcaacacatctccactttcctggtttgtgcgtttgcttcctccttgcctgtcccagtgcggggcgtcgtttgcgatgggggtcctgccctgtgctgactgtaaacctcttgaagcacatcaacaatgcgccagcacgtcctgagagtttgtggactgaagttattccaaattctaaaatgtaaatccactaaaagaaagtataagaactgtagcctgaactcgccaaaaacaagtcccccaaatgtgtgtaatggcaggggtccccacccctcccgcccccctgggccccctttgaatcccccctacagacgccgacttgttaggaaccggcggcacagcaggaggtgagcagctgagcagcaggtgggccggcaaagcttcatctatacttacagccactccccatcgctggcgttaggcctgagctctgcctcctgtcagatcagcgtcggccgtagagtctcataggagcatgaaccctattgtgaactgcacgtgtgagggatctaggatgcacgctccttatgagaatctagtgcctgatgatctgtctctgtctctgccacccccagatggtgtgtccggaattggtgggttcttggtctcactgacttcaagaatgaagccgcggaccctcaaggtgttacagctcttaaggttgcgcgtctggagtttgttccttctgatgttcggatgtgtttggagtttcttccttctggtgggttcgtagtctcgctggctcaggagtgaagctgcagaccttcacggtgagtgttacagctcttaaggcggcgcgtctggagttgttcgttcctcctggtgggctcgtgggctcgctggcttcaggagtgaagctgcagatcttcgtgctgagtgttacagcttataaaagcagtgtggacccaaagagtgagcagtatcaagatttattgcaaagagcgagagaacaaagcttccacagtgtggaaagggacccgagcgggttgccactgctggcgcgggcagcctgcttttattcttatctggccccacccacatcctgctgatgggtagagccaagtggcctgttttgacagggcgctgactggtgcgtgtacaatccctgagctagatacaaaggttctccacgtccccatcagattagttagatacagagtatggacacaaaggttcttcaaggccccaccagagcagctagatacagagtgtcgattggtgcactcacaaaccctgagctagacacagggtgctgattggtgtgtttacaaaccttgagctagatacagagtgctgattggtgtatttacaatccctgagctagacataaagattctccacgtccccaccagactcaggagcctagctggcttcacccagtggatcccacaccggggctgcagctggagctgcctgccagtctcgcgccatgcactcgcactcctcaggccttgggtggtcgataggactggccgtggtggagcagggggcggcgctcgtcggggaggctcgggctgcacaggaacccacggaggcggggtaaggctcaggcatggcgggttgcagtcccgaggcctgccccgcgggaaggcagctaaggcccggcgagaaatcgagcgcagcaccggtgggctggcactgctgggggacccagtacacccttcacagccgctggcccgggtgctaagtcccttattgcccggggccagcagggccagccagctgcttccgagtgcggggcccgccaagcccacgcccacccggaactccagctggcccgcaggcgccgcacgcagccccggttcccgctcgcgtttctccctccacacctccctgcaagctgagggagtgggctccggccttggccagcccagaaaggggctcccacagtgcagcggtgggctgaagggctcctcaggtgctgccaaagtgggagcccaggcagaggaggcaccgagagcgagcgagggcggtgcggacttccagcacgctgtcacctctcaatgggaccatctagtttcaggaaaacaagctcagggctcccactgattctacattatagtgagttgtgtaattatttcattatatattattacaatgtaataataatagaagtaaagtgcccaataaatgtaatccacttgaatcattccaaacccattcccctgccctgtccatggaaaaaaatgtctcccatgaaaccagtccctcgtgccaaaaaggttggggaccactgttatggggtaaagctaataactctgcaaagaatagggcaagcctttgtaaaatacatcaacattcacttgatttcctgccactgcaggaatgcctaagaacgtttcagggagtggagctaaccgtggttgaaccatgacagtggccaggtccccactctggcgcccgtatcagctgcaggagccgcagtgcatagcgtgtgcgctggccctgcaggaagaagaggcaggcccatctaggcagcagacaccatgatggagcatggtggactcctcagcaaccagctcttggtggctgccaggattcatcagttgtggctgcaccaaatctctttcttccaccactcccaacggcccgttatcctgggcttctgtttattgggatttcctggaattccaggagtcccatgtggcaataagatgtcaagtgatgccacaggcccttagggaaggtcctcattttggctccagatccagccaggcttactccctgatcctgactgagtgggccaaggcgtgggccctagggacgggtcctccaggtgaggtatccttagttcatgtcagttatggtcccattgatttattttctttctttctttctttctttctttcttttttttttttttttttttgagatggagtctcactttgtcacccaggctggagtgtagtggcgcaatctcggctcaccgaaacctctgcctcctgggttcaagcgacacccctccgccacccacctcagcctcccgagtggctgggattacaggcgcatgccaccatgcctggctagtttttgtattttttgtagagacggagtttcaccatgttggccaggctagtcttgaactcctgacctcaggtgatctgccctcctctgcctcccaaactgttgggattacaggcgtgagccaccatgcccggccccattggtttattttctgtattatcatggagctcttcttggtttacctgaggtgtttcgatattaaccctaactgagggcaaaatgttttattagatagattggtggataggtagatatgtgatacagcaaacatagcaaaacatttattctagaatctggttggtgcctgttcattgtacattttttccagctcctatctacgtttgaaatttaaaataaaagttggggctggaaattgtgatagaggtgcttattatacaatttacagggatttaaaaaaggtatttttcaagccggacatggtggctcacgcctgtaatcctagcacttagaaaggctgaggtgggtggatcatttgaggtcaggagtttgagaccagcctggccaatatggtgaaaccctttctctactaaaaagacaataaattatccggacgtggtagcacacacctgtagttccagctacttgggaggctgaggcaggaaaatcgcttgaacccgggaggcggaggctgcagtgagccgagaccacgccactgcactccagcctgggcagcagagcaagacttggtctaacaacaacaacaaaagatatgatacatttctttggtcagtcattgcacatctatttgctgggtgtcaattatatatggtactgaatcctgaagactcaccagggaacaaaacaggtgcaatcttcccctcatgtagtttacagcccagaagggaagagagatgaccgaacaagtaattccagtagagtgtgaagagttgctgtaagcatcaaagtgttggggggagttagtctcttactagcccctcccaagaccctgcacccctcctacttgtgcacagagtcccagccctggccttcctagggtgttgacatcactgctgcttgcagtacaccctgcaccagctaggccttagctggctccagagtgtggcaggggtgggtgattgcagagatactttcattccaacaatggtcaagtctagttttctccttagttactttagggtgctgtactggcttcctagaactgctgtaacaaattatcacaaaattggtggcttacagcaatagaaatttatactgttacaatcctgggaaccagaagagtccaattttaaggtgttggcagggccgcttccccctggtgtgtctgcaggagaatccatcccatgcctctgtgctggcttctgctggctgccggcagcccttggcgtcctttagctcgttgatacatcagtacaatctcgacttcggttatcacatctgcttctcctctgtgtgtcttctcctttttcctcctcttctttttttttttttttttttttgagacggagtctcgcactgtcacccaggctggagtacaatggcaccatctcggctcactgcagcctctgcctcctgggttcaagcgattctcctgccttagcctcccgagtagctggcattacaggcgcccaccaacatgcccgtctaattttttgtatttttggtaaagacggggtttcactatgttggccagtctggtctcaaactcccgacctcatgatctgcccatctcggcctcccaaagtgctgggtttacaagtgtgagccactgcgcctggctctttttttccctcttatgagaacacttgccattggattttggatccacccagataatcgaggatgatctcatctcaaaatccttaattacacctgcagagaacttttttcaaatgaggtcacatgcacaggttctaagaggacgtatcttttggggaggccaacactcagcccgctatgagtacacctatctcataactaagagactcatagagcacatggtctctctcctctttttaacatgtcgtgggcttattttgtcataggatattttcctctgtcttgggtctgatttcttcactcattatttaaaaaatttctctcggtctgaaccatgatgaatgaattct

SEQ ID NO: 34 - DNA, 176096 bp, Homo sapiens
ttcaaactgtgttaaagtcacgacactggtgacattcattcactaagtacatattgagaacctaccatgtgcaaggctctgtgggaaaatcatagaaaaatgtctagaaattattctttaaaatagtcaataaagagaatgtcctgttaatacttactaggcatttttgcctgtaagagaggaagctgttttgggagctgtatatgatgttatgttttcaccttatatattagtgattttcaatgccatctggttgtcaaaactgagttttcaataaacaaatatttaagaaataaaactagtgagtagcagtaacctttttatatcatactcctttatgaaccaaaaatgtacaacatggttttttttttctcatttcttaaaggagctatcagagcagttaaaaattacgtggtcatttcatggattctttaagtagggtaattgttttaagttaaaataatagcctgtcttagtcagtttgggctgctataacaatataccataaactgggaggcttacacacagaaatttatttctcacagttctggaggctgggaagtcccaagatcaaggtactggcagattcagtgtttggtgagggcctgctttctggttcatagatggtgcctttttgctgtgttttctcatggtggaagggacaaggcaactctctggggcctcttttataagggcaataagtccattcatgggggtagagcctaattacctcccaaggaatccacatcctaacaccatcacattggtgattaggtttcaacatatgagttttgcagaaacacaaacattcagaccatagcatagcctttactgagattaactcttatgtatcagacattgttttgggggtttacatacataaactctttcaatccacttatcctgcctaggaggtaagtgctattatattctgtccaatgtacagataaggaaactctgaggcacagtgcagagcgacttgcccaagaacacaaagcttataaatagcagagctgggatttaagtcatgcagcctggttttagagtccacactcaaactactacatctttttagagtgctaacatcttacatttaaaaaaaacttttgtttagatggagtttcgctcttgttgcccaggctggagcgcaatggcgtgatctcagctcactgcaacctccacttcttgggttcaagcaattctcctgcctcagcctcctgagtagctgggattacagccatgcgccatgacgcctggctaattttgtatttttattagggacggggtttttccatgttgatcaggctgatctcgaactcctgacctcaagtgatctgcctgccttggcctcccaaagtgctgggattacaggcgtgagccaccacacctggcttaaaaaaaaccttttattaataccatttaccagtctcagtctcactttaagttaatttatagcagttataatacaatcttcatttgtctttcagtcatttaacaagttataattaatgcaactttttttaaaaatatggagttttaagaattttgctctttggagcaagactaaataattgaaagtgcttacttagattgtcagatatgatatttctcgcctataactgtggaagggtaacttttctacactaagttccctggtgctatttttttgcaacatagagctgagtaatatattgccattattgtgtttatttcaattagacattcttctggttaaataataaaccaaaggtctatcatccacaaaattgggtgttttttgttgttatttaccagcaatcgaaattcagattctgcaggcccatttgcagtgcctgaccatcttcggcaagatgtagaagaattcgaagctctctatgaccaacacagtaacgaatatgttgtccgcaataagaagctatgggacatgaacccaaaacaaaaatgttcaactctatatgagtaagtgggttgaaatttttacaaccattattttatactaaggctgccaattaaagatcagaagttgtttaatttgtgcctgtttttagagattttgccacattttacacaaagttaatttaggattttttttttttttttgagacagagtcttgctgtgtcacacaggctggagtgcagtggtgcaatctctgctcactacaacctctgcctcccaggttcaggtgattgtcatgcgtcagcctcccgagtagctgggattacaggcttgcaccaccatgcctggctaatttttgtatttttagtagagaagggtttcaccatgttggccaggcaggtctccaactcctggcctcaagtgatctgcctgcctcagccttccaaaatggtgagattacaggcatgagccacctcgccccgccctgaggatttttaattattaaatttagagtcctaatgattattgattttgtcagtttgagctactaagtcgatactgagtggggtggataaaacaagtaaaaaattcaggaaaatctcagatagcttaccattttgagctttgtgttattagatagtgcatgaggccttccttttaagaaaataaatcaagggctgaggtctgtaatagagtattaatttaaaagccaactcttctcctggaagtcctgtcagtagcatatccaccatatggccctttcttctgttttcctgtattgcatcattcctatttagttctgtgctcttagatccttcttcatggtttttctttagagttgaaatgctgagcaaatcatatttccagagaactcttgggtgacagtgtggaaacaactgtaaaattatactattatttcttaaagtatgctagaatttgcttcaggcatccaaaagtaaagctaaagtatgtagttttcagtatttactgtacgcaaattcaaataggatttgtttttgagatttgattttctctttttatttaaaattcttattggcattattatctttcctgaataaattttttgttgttgtttttagaataaattatgtaattacatagttgaaagttatgaaataactttttgatttccttttgctttcccctgctcccagaaaagttttaaatgatcattttctaggaggtagacaaaattttctttatagtatcattgattgcagttaaccttatgtttgttatatttgttgttgaggaaaggttgagatcagtgaaaagtgaaacagtgttttcctttgggagaataaaagtttttttcaaatagacatattcaagtacttccttatagtaactcatgtaaatgtaaattttttccaagttacttctctcagtttttggaggaacatggtcccttggacatgagtaacaagatgttctctgcagaatatgagtttttcccagaagaaactcgacagatactagaaaaagcaggaggtttaaaaccttttctcttgggatgccctcgttttgttgtgattgacaactgtattgcactgaagaaggttgcatcacggctcaagaaaaaaaggaagaagaaaaacattaaaacaaaagtagaagaaatttcaaaagcaggggagtatgtacgagttaaactacaactgaatccagctgctagggaatttaaaccagatgtaaagtctaaaccagtgtcagattcatcttcagcaccagcttttgaaaatgtgaaacccaaacctgtgtctgcaaattctcccaagccagcttgtgaagatgtgaaggccaaaccagtatccgacaattcttctagacaagtttctgaggatgggcaacccaaaggggtctcttctaattctcctaaaccaggctctgaggatgcaaattacaagcgagtctcctgtaattcccccaaaccggttcttgaggatgtgaaaccaacttattgggctcaatcccatttggtcacaggatactgtacgtatcttcctttccagagatttgatatcacccagacaccgccagcatacataaacgtgttaccaggtttgccccagtacaccagcatatatacacccttggccagcctttctcctgaatatcagctaccaagatcagtaccagtggtgccgtcttttgtagccaatgacagagcagataaaaatgctgctgcctattttgagggtcatcatttgaatgctgagaatgttgctggtcaccagattgcctctgaaacacagatccttgagggctctttgggaatatctgtaaagtcacactgcagcacaggtgatgctcatacagtcctgagtgagtctaacagaaatgatgagcactgtggaaattctaacaacaaatgtgaagtaattccagaaagcaccagtgcagtaacaaacattccacacgtgcagatggttgccatacaggtaagagttaaatagaaaagtcttcttaatactgaagttaaattttccttttcatttttcattgccgttatatttgcaagaatccttaaagttgattgactttataatgattactgaagcttttgcctgaaaatacttttaaaatatgaactcttttgtgaggcatgacaggtaatcttctcagaaagaagcttgggtccaataaacaatacccatctttgctactgaaattctacacagattgagaaataagacagcaggtggagccaaaacgtcatcctaagaattaataaaggtgctggaggagaaggtggctgtttgtaggaaagttcaagtgctagctggaagtgtagcctgcatcacagtgccttacctgccagttacaggagggcccacctggaggccttccagcgtggggtgcctgccccataggacttagcgcatgaaggaggaagggaaaatgtgctggcagctcctcagaaagagaaggaaaaaggaagactctgacctacacaggcccagcttctcctgtcaaaccaggggaggaatgagaatgttaaaaagagacagccaggtagaaacaagagggatgtgtatgagttctttcctaacaaggaagagatgaaatcaagattctcctatggttgcctttatagggtatgaattcattaaatccttattgaattgccccactcattatgttttctaggaagctttgaaaaaaataggttaagagcaatggatcataatcatttccagatatgctaattctaaataactttcctaatatacatgtttacggaaagcatggaacatgatctaaatgggaaaaaaaacttgaaaaaattgtgggtgtgttttaaagtgttactacttgatgggcttattttactagagcgattgagataaagtgaattttattttttgttttgcccacaggtatcttggaacataatacaccaagaagtcaatactgagccatataatccttttgaggaacgacaagtgagtcaaaattacattaaactgtttaaaggtttagttttcattaatttatctagatggaatgatgaactagaactattttggagtcagcttattccacacaaagttatcatggaataagcttgagaacataacaaaaaaatgattttgtttttattgttgaaatttgagaagggaaggaaaaggtaatttttttccagcatacttatttcaaattataacagcgttattgttttattttattatttttaaaattttatttatttttattttaattatttttgagacacggtctcactgtcatccaggctggccagctttattgttttaactggtataatgagcatataataatttataagtaagcttattcatgcgaataatacagaaagataaagaccttctctactataataatgattcaattagaaaacctactaatataatttagttcgttaatatgcatcataagagaaaagttgtcttatcaactcaaagttgctgtaaaggtattggataaaattcaggtcactgtcttgaccaaaactagtaagaaaatgggaattgatgaatatttctcaacatgctaatattttaagccaaaagccatcatcttgcttaatggtaaaacatcaccattaatatttattgttatcctgggtatattaactgagaaagcagatatgagaaagaaagaagatagaaaagaggagatgtgagtatcattatttacagaggctagggctgtgtaccaggaaaatccaaaatgatcaactgaaaacctacactaacctatataaacctatacttgtatataaaaatatatataaacaattacctgttagaaagtatgttgaaagaaaatattttcaataccaaaaaagagataaaatacttaaatgtatataaagaaaaatttttaaatgctatggagagacacatagaagccttaaatgaaaagatatttcatgtacttggataagaacacatattatgataatgagattggttctccctaaagctttttaaaatttaacacaatcccagtatatacatgaacagggcaaattagttatgtatattgctgtatatataacaaacaacctcaaaagctagtggcttaaaacagtaaaatatttcacaattgtgaaatctcacaatttcgctaagtcaggcattcaggagcagtttagttggatgcttctggagattctcatgtagctagccaagatgttgaccagggcttggtcatctgcgggagtaactgggcccagaggttctacttccaagatagctcactcacatggctggcaagcggatgttggcagttgtcaggaagcttcagttccttgccttgtggacctccacctagccctgcttgacctcatggggctggcttttcccagagtgtgtgataccaggcagaagcggcagtgctttaggaagtcacaaattatcacttctgcgcattctcttggtcacatagatcaatccaccaaccctgatacatggtaggagaggtctatacaaggctgtgactaacaagaggcctggttactgcacaggattaatttgaaactagacaaattgattttaaacttcatatgtaaaaatgaacatcaagaatgggtatggaagagaaactaagaaaaggagttgtgcaactaaatatcaaaacacaatataaatctatctatattaccacatacatagaccattaatatgagagtgcctggccaacatgttgaaaccccgtctctactaaaaatacaaaaattagccaggtgtggtagcttacctgtaatcccagctacttgggaggctgaggtaggagaattgcttgaacctgggaggcggaggttgcagtgagccaagatcacgccagtgtactccagcctgggcgacagagtgagactccatctcagtcagtcaatcaagatggtagattggctgggtgtggtggctcatgcctgtaatcccagcactttgggaggctgaggtgggtggatcacgaggttaggagtttgagaccagctggccaacatagtaaaccccatctctactaaaattaaaaaaaattagctggccgtggtggtggacacctgtaaccccagctacttgggaggctgaggcaggagaatcgcttgaacccaggaggcacaggttgcagtgagccaagattgcgccactgcactctagcccgggcgacagtgcgagactctgtctcaaaaaaaaaaaaacaaaaaacaaaaccgaagatggcaaattatcagtgagcaaaaactggattattaaatacataggagaaatggattgccatctagaaaaaatcaatcttggtccctacctcattccttataccaaaataagttccaggcagattaaagattttagcataaaaaatggacctataaaagtatccaggaaaaaaacgggaaaaattttttgtaagatcagtaaacagcatgggaaaaaagaatgtttatattcatatacacatgcatgtaatgtgtatatcctatatgcatagcatatgtatgacaacaaatacatacacatacacatatcaaaacacaggagagaaacaaggaaaattatgtgcagtgtgaaacagatagagaactaatttccttaacaacaaagtttctataaatcagtaaggaaaagatcaacaatctgtcacaaagatgagaatggatgtgaatagacaattcacaatgaaagaaatacagatgatttttaaacatataaacagatgcccaccccacttgaaataggaaaagcaatcattcacattttgaaagatagtgaaactgaaatttctgggaaggcagttaggaatcgatctgcactcatatatgtatagagagaccagtgagccaaggggatttgtatgtttgttttgtctgtatttgaatcagcagaaaattgaatacaatctaaacctccatcaatagcggactagttaaattatgatatacctataaaatgaaatatcatgctgtcatttaaaaagcagttctatagttagatatggaatgtttgacaagatcaatgtctagttaagtaggaagaaggtcagagcttgtgtttcctgctgctatttgtacaaatagtgtttagtttttgctaatgataaaataatatatagagttcttaaattttttaaatgaataataccaaaaattatgaaagagaaattgaaaatcatctaccttcccatcactcatgttaatattttgatgtgtagccttccaggatgtttgaacatttacatataattaaacaatagtttttaaaagatgggatcacagcatatatattttatttgaaatttgcaggcttcaattaatatattgtagacttgtttccatatcagtaaatacgatttatagcatcattttaaatggatacttggttttccattttattaatgtgtgatcatttatttgaccaatttcttgttgttgaacatttagattgtatcagctttttatgcttacaggcagtcttatagtgaacattttggcctgtttactgttgttgaagtcttatgctgtgcttagctttaaaccaggtaggctctgttgtttaatgagtcagtgcttttgaccatcaaatgaatgtttttatcagtgatgggaatgttcacaaatgctttcttaaattagctgttagttttaggaccttgatgctagtataggtgattgctggcttctcaaccagtgagaattgcatttgaatcccagcattgctactttctcctgggactttgagaagttgcatcacttggttctctgatctattaaaggcaaacataatgtatttctcacagaagtatcgtgaagtttaaatgtaataacatagaggtggcatttagcttcctgcctgtctctgttggtaatttggggcatgtaaattcattcacgacagcaagttactattcactgtgatccttttgctgaattaagaattaaaatggaggtaactaaagtcttaaaccataaagttttgctcctggttgatagtaaggttgactgtttaattaatttagttaagcatggactctatttatagtactaaactttcggtctgagcagacaaagtggcatgctccaaggcaaaagggcatgtatggtcaatctgaccataattcacagttctccaactgatcattcacagagtttcaaatacttgattccctgcttttttacacttgaaagatactaaggtattgggggaaggtacaggaaatgtcagagctggaccaggtttgtgcctgggatagatttctaaagcctggctgccacagggaggacagttacctgcagctggagaagctgccagcatcaaacagatgctctttcagagttatatgcagtttgaaaggttttaaaaaataattacataaatgacatttattgtttgccaacagaatggtttctgggtttggggttttttttgttgttgttaagctggtgcaagaaatataactgacaataattcatagataatattttaatttgtcattttgaaataaccagcaactatttatttgaaacacctaaaagtaaagccaaagttaaaatgttctgtttatatctaaaatatgtataatatgtgcagctttttaaacctaataaataatcgttggtgttaattgtggagagtgacatttaaatcaaactgttgatctggtattgaacccttctaaagcaaatattcagaactaattatagtatagattggagaatttatgaatttcaataatatgaatgattatatttataaaagtgctggttttgctaagcagtgtttaggggtttttaattcctgaatgattgtgacatttcccttgtaaattttcatctgctttttactctcctttgtttattttaagaaacagtaaagaacaagatcataagtaggcattttaaatgatttttaatagattgttttgtaattcacttttagggggaaatttcacggattgaaaaggagcaccaagtattacaagaccaacttcaagaagtgtatgaaaattatgagcagataaaacttaagggcttagaagagaccagggacctggaagagaagttgaaaaggcacttagaagaaaacaaggtaatcctgtctgaaacctgtctttaattgcatgtagcatagttaggagaatgtgagtgtagctgtgcttgtgcggcctcagctgaacttctgcattggtggctaaacaaaagattctttctcagaatcgcctgcttcagatttcttcatgacatattaaagtggctgttgccatgctttagaacttctgcaaactgccttatgagaaaggggctgtaagtctgggttttcgtttagctatagttcagtttccctggttaactaaaactctattttatggtgactgagctctgaggtaaattcttgtttatattgagaggcagcataggaatagaggttcagaatgagagccctggagacagactggctgggttcagatctaggcatggttctatactagttctaatcttgggcaatttacttaacttctctgtgctttagttccttacctggaaaatgtgagtaataataactcacattttgtatggttagattaatacttataaagtacttaaaactgcctcgttagtaaggactcagtaagtattgtctgctactgttatgatcatcatcttcatcttactcctaaggaagtataagaataacacatggagccttagacatactagaactgtaaagtcacccagagtattttgttgagatctgctgaccttgaattctgttagtcaagactgatcatcagatacatggctagtggagggatagcaattagtggcaaagccagattgaattagtgagaaaatggaatcacagatgtgaggaaatcatggtgcatttgtttttaaaagctaccatcatctgtttagaaaggtaacaaaagaatagtaattcatttaagaaaggaggaatttgttccagaagtctggatcaatagctgggataacatattaaatagaagaaaactagcttagtgggaccttaatcaggaaacctatttactaagattttagtagaaatcttagggtcagtttgtaaaggtaactgtcataacattccccaggacctgtttatactcaagatgaggctggggagagtctaaggacaagaagaattagatagatcctgagactttactcagtttcctggctgggagaagtaaagaagaacaaaatcctacacagcatagtgacacatggaacacaagtttctataagctacttgtgggtttaacaaaacaaaatagttttataaactttatattgcctcaggaaacttcagttttaattcccatgtgggaattcctgtagctgcctgtttgagtgatgaggcagattggagacatagtcttaaaggtagcattcagccggtgagatatctttctttctggccgaggctttcctggctttataaattgctggtctgactgtgtgttctgtgtgcacagttcatcaaggctctttctttgtacagtcagtccagaagagtctcggaaataaagcacccagtgggagggccccagctctcaggcttttttttaacttgttaaggctttgagtctgctgttgcgtggccctactcaagagtgccttaaaagggcaattactaagccccccagatcacaggcctgataagttattagacttgccacgtaaaatgtatacctattccctaccaggataagtcgctaatctgagttccttgggttggtgtccacataagagtagatgagatttagccacagtcatttctttattaatggtggttacgctcatagctcatggagaaatttcttaaaacatagaaagaaatgagtggcttttcctgatatgtccctttggcctttgactgcagattgctgaggttatgagctaaccaacttttcctttatactccagttacttgatgccatgtttggatgtagcaaatgcatacccagccccttatagagaacagaaaaacagggaagctatagaaatctgagtgcattagagtcccactgcccataccacaccctagcacctccatgtagtagctttgtgatgttagacaatttcttcagcctctttgaccctcggtcttctcattaataatgtattgtctacttcacagctttgtgaggcctcacctggggtggttgaaaaaggacaggggctagccagagatagtaagtacagtactcaaggaggaactgtcccacccaaaattctgcttgtgcctctgctaagcaaattgtttttttacaaaccactttaagaatacttagcatatggccaggcgcggtggctcacacctgtaatcccagcactttgggaggccaaggtgggtggatcacgaggtcaggaggttgagaccatcctggctaacacggtgaaaccccgtctctactaaaaatacaaaaaaaaaaaaaaattagccaggtatggtggtgggtgtctgtagtcccagctactcaggaggctgaggcaggagaatggcatgaacccgggaggcggagcttgcaccgagccgagatcacgccactgcactcccgcctggacaacagagcgagactgtgtctcaaaaaaaaaaaaaaaaaaaaaaaggaatgcttagcatatacaggccgggcacggtggcttacacctgtaatccttgtaatcccagcactttgggaggccaaggtgggtatatcacctgaggtcaggagttggagaccagcctggtcaacatggtgaaaccccatctctaccaaaattacaaaaattagcctgatgtggtggtgggcgcctgtaatcccagctactcgggaggctgaggtgggagaatcagttgaacccaggaggcagaggttgcagtgagccaagatcgcaccattgcactccagtctgggcgacaagagctagactccatctcaaaaaaaaaaaaaaaaaaaagaatgcttagcatatactaagcatcagtaaaaatctgagcgaggtattatatatagctgatggggttctattattattcatgagctaagaatggcctctttaggcaattaggccagttatctattctctgccggcggaaaagtggctttttaaatttttttttttattttttagatggagtcttgctctgtcgcccaggctggagtgcagtggcatgatcttggctcactgcagcctctgcctcccgggttccagcattctcctgcctcagcctcctgggtagctgggattacaggctgcacgccaccaagcctggctaatttttgtatttttagtagagatggggtgtcgccatgttggccaggctagtcttgaacttctgacctcctgtgatcctcccacctcggcttcccaaagtgctgggaaggcaccgtgcctggccaaaaggcacgtgaggcaccgtgcctggccaaaagtagcttttttaaagccagaatctcttgttgtttttattgtaccctaacctatgactggcaggttataactggttgcaatattgctgaaggacataggttcatttttgtttgagaataaaattctcataacataaaatttgctgttttaaccattacaaagtatacaatttagtggttttttgaatattcacattattgtgtaaccattaccactgtctaattccagaaaacttttatcaccccaaaaaagaaaccccatatttattaatcagtcactccctatctgcccaggacatatggtcttaaggtgctttaatgagatgctaaaatgggcattgagtcaacattaggtcttaaaacactgtcaaattatttggcccagaataatttacagggtagaattttggacctttgtctgtattagaacagaatcttggccctgcctgccaaaacttcctcagcccacactggtgcagaggtgggattctcctcttcagtcatgggtccttgtcaagttcagccttttttaaatctatcatttatgaagctcctactatgtgccacactcaattgtttttacatgtatttaatctcaaaacagtccttatacaatagtgttatactgtagtacataaataaatctccatgttactggtgaggaaatggaggtgggagcagctgatgcagctttccccaagccacaccagtacgaagtggcagaacaggttgtgtcaggcttcagagcccatgcatttgttctcccttaagagaaggtcagctccacggcctagttcaactaactgttaggaatgtttctcaccactttacagcagtgtaggcatatcagttaatcactgtcataataatgctgagtgactcccagccacaaaaccccagtgacacatgactgtaatcgctaagcgtagaagtctggatcagctggtcctgcttgggctcggctgggtcagttcaccttagggctagcaagagctctgcagcatctttgctgttcttgcctacatatctgggttcagctggctgtagattgatctagaatggcctcagctgggatgactgggacaactagctctgctccacatgtcttgcatcttccaccctgaaaatcctattctgaaggcagtaggaaggtgcaaaggcaagcaaagatggccacacggcacctttcaagcttctactgacttcaggtctgctcagaccccaccggcaaaagcagtcacatagccagccagagcccgggctggggaagatagactttgcctccttagcgaagggaactgcaaggtcacatgataaatggaatggctagagtgtgaaggatggagctatgaatgccatccctccactacagtaggtcagcgccagtaatttactaacactcagtaattaccaagagccttctgtgattggtgcctgcttcatcttccgccttctcccttgccagttctctacattgttctctaatttaatggataatgtttgtcattcgatttctcacttccaaaccttttcccagtaccatcccttctgcctggagtggttttccttctccctgagcctgactccctcctgcttctcctttgggcatcactttcttgaggaaacagttgttgatggcaacctcaggcttgcttacaggcctttgttaatgcagtggtggtaataatgactatgtgagatggtaattatcattttataacatctttattgagatataattaaccatagcataacatttacctattaaaaatagacaacttaatggttttgatatatgcccaggtctgtgtgtagcacaatctaagtttcaaccattttcatcaacctaaaaagaaatcttatactcactagctgtcactccccattctctcctgtatcccagcccttggcaaccactgatttactctctagatttatctattctgggcattttgtataaatggatcatgttacatgtagtcttttataagtgtcttctttcacctatagtgttttcaaggttcatccatgtacatccatctatgttaatatgtatcagtgtgtcattcctttttactgtggaataatattctattgtatgactatatcacattttattcattcactagttgattgacatttgcgttctttccactttttcactattctgaataatgctgctgtgaacattcatggacaggtttttctttggacatatgttttcatttcttttggatatatatgtaggagtgaaattgctgatcatatggcaattccacatttaagcgtatgaggaactgcgagcctgttccaaaaccatcctaccagcagtatataaggattccagtttctccattctcacttacacttatcatcgtttgtctttttatttaggcctcctaatgggtatggagtggtatctcattgtggttttgatttttatttccctaaaggctaatgatgttgagcatcttttcatatgcttattagccatttgtatatcttctttggaggaatgtctactcagatcctttattcatttttgaattgagtttgtctttctattattgacttataagagtttttgggccaggtgcggtggcttacacctataaaaccagcactttgagagaccaaggcagaaagatcgcttgagcccaggagtttgaaaccagcctgggcaacatggcaaaatcccatctctacaaaaagttaaaaaattaaccaggcatgatagtacgcacctgtggtcccagctacttgggaggctgagctgagagggtcacttgagcccaggggttttgaggctacagtgagccaggatcatgccattgcaccccagcctgggcaacaacagagtgagaccctgtctcaaaaggaaaaaaaagaaacaaaacagggctgggcatgatggctcacacctataatcccagcactttgggaggctaaggcaggaggattgcttgagcccagtagttcaagaccagccagggcgatgtgatgagaccctcactcgctacaaaaaaattaaaaaattaaataaataattaggtaggtatggggatacatgcctgtagttccagctactcaggaggctgaggtgggaggatcacttgagaccaggaagttgaggctgcaatgagccatgatcttgccactgcactacagtttgggcaacagagcaagaccctgtctcaaaaaaacaaaaacagagagtttttctatattctggatacaagttgcttatcaaatatttgatttgcacatatttacttccatcttccatatttgtaaatgtatctcctgtctccattttgtgggttgccttttcactttcctaatggtatcatttgcagcacaaaagtttttactttgagtacactaagtccaatttctcttattcttctgttacttgtgcctttggtgtcatagctaagaaacccgtctacttcaagcgcactgcttacccatttaggtctgtgatccatttcacattaatttttcaaatagtatggtatagtaattatcttttatgcatattttctctaccaaactgtgatcttgaaagtaaggactgtttttcattttgtttgttttttgaatgggggtctcattgtattgccaaggtagaactcctgggctcaagggatcctcctgcctcagactcctgagtagacaagactacaaacacatgccaccagccccagaagggtggttttcaaaattatctttggttgacagcacctagcttagtatacaaactaggagctttgcaaatgtttatcaaacagtgtgtgcttggcccctgaaaagctgcatttaatgaattgtgttttcatgttctctatcagcctacatcagaggacatcaggctcacattctgtgaagtttgctgctttgtttactgctagtatggagttggggatattatccattctttcatgtgacagatatttcttgaatgttctcttaagtgtcaggctctgtgctggtcttgtggggcgtttctgcagcatcctcttcttgaggcccttctgtctgccatcacttccagggcctctcttgtgcaactggtttgtttttatgttttatattgaattgtacagttcattatattttctctttgaccttgtctgccagaaagttttcatgttatttctaaagaatggttaggactgcatgccattcatttttatattactctcactcatggttttgtattgtcattcctctctctctattctgttttctttatctgcttagcattctttttattttgtcttttaaatatttatgtatatattatctttttttttacaccatggaatactatgcagccataaaaaatgatgagttcatgtcctttgtagggacatggatgaaactggaaatcatcattctcagtaaactatcgcaagaacaaaaaaccaaacactgcatattctcactcataggtgggaattgaacaatgagatcacatggacacaggaaggggaatatcacactctggggactgttgtggggtggggggaggggggagggatagcattgggagatatacctaatgctagatgacgagttagtgggtgcagtgcaccagcatggcacatgtatacatatgtaactaacctgcacaatgtgcacatgtaccctaaaacttaaagtataataaaaaaaaatggctttataaggagaaaaaaaaaagaatgttttaatttcagtaagaatgaaacaataaaactttagaaaatgtaaaaaaaaaaaaattaaatatttatgtatatattatcaaaggtacctcaaatatttattttagaacaacactgaggtttaataaaaaagataagttttttcctaattgagaaaaagaaattgtttatagttatgtcaataaactgtaatatagcagatacagttgtgtatagcctatttgttttatgctaagtttgaaagaaaaacgttcaggagatcattctgtcttccatgcagtcagaaacaagctcgtgatagctgacctgtttagcattgtgaggcagctatggcattcagcagtggttagtacaaacagaagatgaactcatgtggtattttcgttgcctgagctatatgtgtatgtatgtgcacatatgtttataatactttgtgcttcttgatacttgaactcccttaggtacttgttgccaactaggttcttatgcctcagcataaccttgtggttgcacataatctcccagccaaagggatggatcccaggtgagatcattggctcagaataggagcacaggataggtgagaaacaagattggcttggctgccagcagcaaggcatacaaattcacattggtcctggtagaaccgaaccaggtggaacacaggattcttaagtagagtaggcatggtggtcacctcagtcacagtaatgactcaagaaattcaggatcaacaaggttgcagctaagaagatgtgggaagaactggttcctatgttaaagggaacattactgagctgttgttcaatttttgccacctaagaacagttgtcctgtgccaaaatcaaccttatccctgctgtaggattcagaaatcttaaaggaccttgactggttagcaaatctgcctttaaaaaacatgaaaaccttggtgtctaaggctgaagagggagtagtggtctcttaagttgatagagcttttgacctgagggccatgatttcctatggaatccatgtaggttgactttagtgtcctttcttacagagaagacctcgagtttctatagctgaaatgacctacgtgtgctctaagcctaagcaggaagttcaggctgtagggaacctgataggaagtaaaaaattaaaagtttccctaaagcaaatgtgaagttaggatttcattaagccgtcattgataatagtgagattttaaactagaaaatatttgtttcctttaaatattgctttgattcacgtttaaattaattattagaaatattaacatagggaatgttttacttataagtgactggtatttataagcatgtgccccacccaaaccccttgctacaattaaatagatgatacttcaaaaaagacatcaaacctttagagaatgtgtagattcagaagtttcaaaccagcaactacataggaagttgacaaagagggttaggtgtcaagtggtgctgtaccaaaccctccaggggaacggtaactagcattgtctccaaagaggttttcatttctctttgtcacactgcctgaaattctggcaggtatctcaacccaaatgcctttaatgaccagcaagaggattacatttatatttataaaagcaaacaaaaactattggccttgccaactaaaacatgcatacactccctgtagattagagaatcatttaggctggagagtaagtgtgaacacttctgggcacgtcggagtggttcttcggggtgtcttactgtaatcaggtacacgtagcgggtaggatgtggctgtctggtgtgacttggtgtcccaggcttggctggggggcatagtctgccacagggcgccagcttgggagtgtgttccactgaacttaggtcattgtttaagctatggcaccgtcacaattctagcctttcagtctcttttgttaaaaagtatattttgccatttatttaagtactttctaaatgtttttagatctcaaagacggaattagattggttccttcaagatttggaaagagaaattaaaaaatggcaacaggaaaaaaaagaaatccaagaaagactaaaatcactgaagaagaaaattaaaaaggtttcaaatgccagtgaaatgtaagtaatgattgaaaggcagtaatttttatttaaaaaaaaatattgtggcttttggttattttcacatttttgatatttaatattaaactacatcaagtaaagtaaaaatgaatactgttttcattgttttgtctcatttaaaaaagtattcattgagtaattatctcacctgaatttttttctaaacttaacattttttcagataaattatataaaagtgagagtagcatggaactgagaatccccaaggaactgacttccttccagtttgaacaccatccctttctctggccctcttttttcttatcagcaaaacatgggggctggtctaaaatctaaggttcttttcaaaagtaagattctgtgatgattatttataattacttttatcctgaatctataaattattaaaatttgtcttgtagtgtgaacgatttgataacatatacagatcctaggaatgattgtcaggtgggccaagagtgtgttttaagattctctgtgatccatccctaacctccctctgctcttaacagtgataggtcaaattcttcagcttgttttctaccactgtgtaagaaaacacccaaaagtcagtttctttattagcagccattgtatttgctcatggtcctgcaatctgggctgagttcagctgggccattcttctgctggtcttgccaggagtcctcatgtggctgaatttagctgggtgatgactgggggtggcctcagctgggatgctggggtggcttggcctcactttctctctgtgtagcctctctgtgatttttatttatgtggtccttccatatgatctctattatgatagccagacttcttacatggtagctaaggacttcaaatggtgcagaagtggaagccactaggcctcctgaaggttcaggcccagaactgtcacagcatcatctctgctaccttttattccttaaaacaagtcataggcttggtccagattcaagggcatgaataatgggaggctgggttcactggggggccacgctacacactcacctttcaagggcttttgtgtttttccatgccgcatgccatatgatcagatgactttcattatgagtcttgctagcattacatttaggcagtcctcaaacaatgaggaaaagtaaaacactgcctcagaattttcactccctgtgtcatgtcattttgatgatcaaagtagcttcactagtagaacacacttacggaaacaataatgtctgtaaagctttttacctctaatatttgagcatgaccagtcttggtcattttgttactaaaaagtgtggaaatatttatatttaacatactttttttgttcaattcagacatactgtcaaactagacaaggtaactagaggctgttaatgataagaaattttttttctgtactagcataaaagttaatttctgctggagaataaactttttattgttgacttttttccattttattattagatttctttacctttcctgtcacaatttaaagataagccacacgcttctctctaagttttttgcttttttttttgagacagagttttgcttttgtcacccagcctggagtgcaatggtgcaatctcagctcactgcaacctctgcctcccatgttcaagcaattctcctgtctcagcctcccgagtaactgggattacaggtgcccaccaccacgcctgactaatttttctatttttttttttttttttttagtagagatggggtttcaccatgttggccaggctggtctcgaactcctgacctcagatgatccacccatctcggcctcccaaagtgctgggattacaggcatgagccattgcacctggcctgctttttacattttccaaataaatgctttaaagctcaatttttctatttagatttttaagtaaaatctttaaactttttggatctctttctcagagatgcacaagggacatgaaaaatgatttcttggatgtttctgtgctcttgatcacacttagtattcgttaagaaatgactagaacatagagctcatgattggtacagtgacacaaaccacagatggctatgaaagaaggcagggcttccatgagagtgtcagagtgtcacccagtatttgtctatttagaggagggaggaagtgttttacaaaagaagtaaaataatagttaaactggcttgtattagaaacaagcggctttagtaaacagagatgactgcaaaggtatctcagggtagcatgaaagaagaggcagaacccgccttgtgcagggcatggctcaagaatcggagattcacacacttgttttgaaggattatcagagaatgtgagtgtgtgtgtgcgtgcgcacccgcgtgtgtgcatgaatgcttgttttgactttaagttctgttttaaagagtagaaggctgttttcattttgaatgagaatccacatcttctcattttgaataagatctctggttacactgatgatgatgccgcagtacctgtgttctctgcttgagctgcacatcttagactgagatagggtgatttacctgtaagcatatgccttagagtgaagaaaaaggtgatctggaaggaaaatttcccaaaagggaaatgacctcaaattattttcctatttagaagatactaaaaatgaaacaaaatgtaaaaatatatatattaaaaaatcaagaaatgtttttaaggatatgggtgcaatttactgtgtgggggtcctgttaaaaatttttcaaaattaattaatatttggtgattatgcttttataggtatacccagaaaaatgatggaaaggaaaaggaacatgaattacatctggatcagtcccttgaaatcaggcaaattaagcttaaatttatttttaatatattttaatacttttaatgccaggagtacaagcacagtagactttgaaatatattgttgcttgtctatttcttttaaataattatgtttctgttttctttatttctatttctgttgcattttaaaaattaatttataaatatattctttgaatatttaaatatttttattttacaagatttctgcatttatttcccattgtcaatataaaaatactgaatttattgttgtcaactttttttggattaacttgaaactataaacatgttgtaaaaacttttcttttgtgttacttggaatattcgtctccactgtaggctggtagtttgttgctgttattgctttataattataggttcattaaatttttactatgaatctatgcaaagtttccttttaacccttgcttgctaatggaaataatatgttttcacatactgctaaccagtacattcagtgataagcagttgcattctgcttttctcactattgtttcttacgcacattcccatcccggtttttgaataattttgtacagatttctttttccctttgggttctgtccttgtaatatgcgtcaaaacagagtttctggctcaaaggatagggaatgttttataaagcttactttttaaaatttttatttatttattttttgagatagggtcttgctctgtcacccaggctggaatgcagtagtgcagtcattgctcactgcagacaccatctcccagctcaagcaattctctcgcctcagcctctcgagtagctgggactacaggcacgcaccaccattgtattttttgtagatatagggttttgccatgctgtctaggctggtcttgaacttctgggcccaagcgatccgcctgccttggcctcccaaagtactgggattacaggcctaagccactgtgcccggcctatacagtttattaatgtcaccagattgtactccacctgccctcataaaaatggtgaactggaacagtaccctcaccttgattctcagcatgcccacctaatgtgcacttccatttcatatctgcctttgatcacttataaagcacaaagagcacacttgagcctgtgtattgtgtagtaaaatatgagatgagaaactgctctggaagatgtagctgaggctatcgtggtgtggtttcaaagctcatccagcctgaaacctttgtcatctcactgtgaaattttgttcaagaaagttttttttttccttcaatatttgtagcaacacacttacaaatgagaaaatgaaaatagaagagtatataaagaaagggaaagaggattatgaagagagtcatcagagagctgtggctgcagaggtgagtccatgacacttagtgaccactatggcatttgtcatttgtttttgtgtttctttaatgacatatgaggcataacagacattactgaaaagtgtggtgcataaaggatatcctgtaacccataatatatcctccctaaaacgaccactctttttccttgcctatagccttgtaatgttttaccggtattatgttgttacttaaatgcactcatagtgtacaccaaattttgtaacctgccttccttatttaccattataattcagccatttcctatattatacactttgaatactttcatcatatttaatcaagtgatgtaccatgaagtagccaaccatatttgccaatacttggaaaggaacttgaaaataatccacatattaagaatacgctccttctgcccctagaagaatatatagcaatgtcagtacactgtttcagaaactactgagacaaaaatcaaaattatgacatctggctgtattttatttagttccagaaacatgattctctatgtttctgtagctgagaaacaaatgatatttattggcatatgtgtctgtgattattctggtaaagtaagaaaagacttagtttatacagtctgcaaacattaggcttttcaattaagaattgactatgcacctgcttctaaggacaggaaaggaaaaagagccaaagtatgaatactttttgggtcctacaccagcatccgtattcctgagcttgtttaattcacaccaccgtttggtaagcaggtttgcctggtgggccctgtcaagtttactgacacctggattaaaaggctatttaatggatcatttggaccatgaggccattttacatttcctgcagtgattctcacaaaaatggccagttggtttgtggggaagccacagagagtctaaaatcttaaaagcataccccgaagcttttgatgcccttgccgagaacagcttctctgaggcttttctaaacttgcagaggatgcagcctttattaagggttattctgctgcaggaccataggtaatgcacactcgtgtacacatgcagttaacctggctctgtgcttatatatagcttaagcagaaagccatgtacagttattcatatctgcaaaaaggatcatggaaggtatgcatttgtgatgtcattttgttctgttttcaaatctcaaagtctaattcatgttcacctatgatacaatcaagttctgatgattctgtcatgcttcatttaaggagaaatgggaaagtggtttgaatgtttaagttttaacctttaaaatagtttcaggctgtcatttgtaaaatactcatatgtcttctgatctactggcaggtatccgtacttgaaaactggaaggagagtgaagtgtataagctacagatcatggagtcacaagcagaagcctttctgaagaagctggggctgattagccggtattgcagtttcgtgggtgttctcagcacgtcatttagaagataaagctaggaccatttgagaaaaacattattttgtattaggaccattttatttttaatagttatataattgatacatgttcaattgtagaaaagttaagacatacaaacaaaaatgataaaaatcattcctaattctaaatggatagataacatttgtattttggaataaattcatgaagtgtttgaaaaaatgaaaatttatgaattatttttactaaatagtatataggaaatttattttcatattggtaattacatatctccaacctaattttgaaaagttggatagtaattgagcatagaaacatgtcatgatttaccaaacactgctgtgctggaacagtggagttgtttgtgaatttgtgttaatataagccaccctgcagtgagcatccttatagttaactttttatgcacattattagtcatttccatgcagtaaaatttggaatgaagatcacattttcaaggcttttaaaattttttgccaagttgctttccatagtagctattatttaacagtctgcatgacagcatgcgagaatgtttacaaagtatattcacacatgttaattttttttcaactctccacataatctctacctgtttttgtttgtttttttgcgacagagtctcgctctgccacccaggctggagtgcagtggcctgatcttggctcactgcaacctctgcctcctgggttcaagcgattctcttgcctcagcctcccgagtagctgggattacaggcgcgtgccacatgcccagctaattttttgtatttgtagtagatatggggtttcaccatgttagccaggatggtctctatctcctgacctcgtgatccacccacctcagcctcccaaagtgctgggattacaggcatgagccaccgtacctggccttgttcttgtttgtttgtttttgagatggagtctcgctctgtcgcccatgctggagtgtagtggcgtgatctcggctcactgcaagctctgcctcccgagttcacgccattctcctgccttagcctcctgagtagctgagactacaggtgcccgccaccactcccagctaactttttgtatttttagtagagatgaatttcaccatattagccagggtggtctcaatctcctcatcttgtgatccacccaccttggcctcccaaagtgctaggattacaggagtgcctcccaaagtgctgggattacaggagtgagccaccacgccggccggccttgtttgtttttaagataaggcttgctgggattcctagaggatcttcttcaccctagtacttagcacttctctatgtgggattacttttcattgagtccttttaccatgttctatacacagattttgtgtttttaatcccagggttttgatccttcctggtgcttgccttttgattcaaatttcaaaccctcagcattgaaccagagattgtgtgaatcacggacagttttagtgtatagttctttttctttctttttttttttttttttttttttttttttgagatggtgtcttgctctgtcgcacaggctggagtgcagtggcgtgatctcggctcactgcaacctccgcctcctgggttcaagtgattctcctgcttcccgagtagctgggattataggctcccaccaccacgccaggctgatttttgtatttttagtagagatagcatttcaccatgttggccatgctggtctctaactcctgacctggtgatccgcctgcctaggcctcccaaagtgctgggattacaggtgtgagccaccatgcccggccccttcttcattttcaagatttaattttttttcatgagaaaacttttctgattaaaagtaaaatgctgatttagaatataggactagtacagctgaggttgagaccaagtggtagtcaaccgcctgtactaagcacccaccataggctgcattgtggctcatctgggaaacaaagataatctcagactcatttcatctaatagtatcaactcttccaataaacggtagagtatacaaagattctttcttcaggatgccatgctaactctgccttctccaccaaagtatagaaacatagaaaaggggtaaaaagaatgctctgttttttcttcaatatgtataatgaggtcttactatacccacagattggtagtgtttttgatcttctcaattaggagtagtcaatttatctgtcactttcaatagaccagattcatgaggtgctgagattcatgaggtgctgagattataaatttatcttaggctcatcctttatttttatattaaggtaatgattagggtttgattggaatcttttgaatgtttcagactacctttttaaaaaatctttaaatgcagacgctgtctttaatattaaacataaagatgtcagatgaagaacggtcaaactttcaaatttgggaaaagaacttaaaattcaggagacttattttctctctgcccttcggttttagagtttttgttatattaataattaaaattttctaaagtgtctctagtggcaagtttacaagataagcaattccttaaaaatagttggatttttgtgtgtatgtgattatgttaaatgtctcttttgctcatgtttagatgtttatttgaccgtaagtgcttttaatttttaaaatttctaaagcagttttatattatactttttcagtgatcctgcagcatatcctgacatggagtctgatatacgttcatgggaattgtttctttctaatgttacaaaagaaattgagaaagcaaaggtaagttgtaaacatcttttaatcccatcaaaatctttatgatagttataattctcgggaggctggtgtcatattgaatctatttcttttttatctattattatcaataattttttttgttgaaagtattatgagcttttcatggaactaatggttttgttttgtttttttgagttggagtttcgctcttgttgcccaggctggagtgcagtggtgcgatcttggctcactgcaacctccgcctcccaggttcaagtgattctcctgcctcagccccccaagtagctgggatcacaggcatgtgccaccatgctcggctaattttgtttttggttttggtttttagtagagatggggtctctccatgttggtcaggctggtgtcgatctcctgacctcaggtgatctgcccgcttcggcctcccaaagtgctgggattgcaggtgtgagccaccgcgcccagccggaagtagtgatattttcttaattaaattaaccatcttgacctctgccttgattggtaagattagaggagttatgtttgaaaaggctttggagcattcggtttaatgaggtcttattttgaatttccttaccaagacagttatgtttcatttataatgtgtaggaagaaacaaagtattaattgacaattgtggttttcccacactttactttctactcacagtctcagtttgaagaacaaattaaggcaattaaaaatggttctcggctcagtgaactttctaaagtgcagatttctgagctttcatttcctgcctgtaacacggtaagtctagcacatcttttttttttttttaaaccataattcatttgttaactggccaaagtagttatttgttgttgtttcctgggagtgaggatgagattggttaataattgccttaatgtttcattattggtgctactgattaaccttttaagctttataacattcttatataaaatagatcagtctttctacatctgtatgagggatggactgagatgaatacaccattgctacatttctatcactctcatgttccttggcctgtcttctatctttgtgtgtgtgtgtgtgtgtgtgtgtgtgtgtgttgtatatgtattcctgactttgaacaaataatccaggagtagcagttgcctgttgcgcactgcttttgtgattcaagcaggccgctatcaccacctcagattatactcttattcctagatatttgggacataagaccaaaatctaaaaattaagaggtttcctcctcaaatacagaataaaagctgctatgcctgaggcatacagggctttgttggtccggcacatcatattttactatttgtttgaggtatttgccgaatcttgttaataacagtgaataatcttgtctttttattttaatatacacagcacagtaaagaaaagcattaattgcattttgtggactttacaacatggctaaacccatatttcttagatttggacatagatagatgcttagtaaatactaaattgaaatgaattaggcccagaggagatcagaccataggaatttaaagttagatcttgagagaaaacttaggtaaaaaagaaaaacaaaattaaaggaggactgtgtgtgagagttgaaagatataagttccagaatgttgtggcaggacagtgaaatcttctggttcctaaagacggaggagactctctcccagcacctgacttccaccctcccactactgccagacctttgcctgggctgttcctagcctggagcactgtccccgctctgcatcctgccttcccctgaaaccccgtcaggcgtgccctcttttggcctcccactgtgtcccttctctcatgtgcattagatctcagcctggccttgaatgtctctttctcaccagtaccttgcacagtaaacattcaaacttactgtgaattcatctgaaaaaaaaaaaattaagtgtggaaaaagtgtgaccaccctgaactgagtaaaatattctgttgagatccagttttttctctccattgaatgtgcagttttagttagaattacactaaagggcacttatcatttatcgtttttccaagttcttgtaacagatatgtatagagaaaacgttggctctcaataggatattttactgttagtttgtaatcctagcttatgttattttatcaatactcaaaaggattttcatatcctaaattctgggaactcttagtgtgccaggagcttgagtaataagtgtgcctaaaaattatttgtatctcatttctccctcattcattcattcggtaattagtggtgataaagactgatgtgggctgtgccctcaaagtgcacatggacttggggaaaggcagactttaaacccattgttacctgcagcagagtgaggtttctcatggcagaatgctggagcggcgtggatcaggggccactaacctaatctagaggtgtggcctcagcgggagattcccagttggaagtctcccagagacagagatctgcaataggaacttaccagacaaaggagtgagaggggtgtgtttggacggttagagttccagatggaacacacagtgctcctggagcctagagagacagagaacacactcctttcatactgtaatagaagcccagtatgacgcaggggcaaagccaatggagccttcttctctaagctgtgttacagcagcttagacacttctagcttcattagaccagacaggataggtctcaaataagggaacagcagcagaacaggagtccctccttcttcatggcttcgctttccgtggtttcggttatccgcagtcaaccgcagttagaaaatactcaatggaaaattccagaaatacataattcctaagttttaaattgcacactgttttgagtagcgtgatgaaatctgtattctcacatggtcacattgtgacctcctccctttgtccagtgttttcatgctgttgctgctccctgcccgcgagccacttagaagctgatttggtgaccagatgaacttctcgcgttaccccagtgcctgtgttcaagtcacccctattttactccataatggccccaaagcatgggagtaatgatgctggtcaatcagatatgccatagagaagcaatatattgcttcctttaagtgaaaagctgaaagttctcaacccaataaggaaagagaaaagatcgtatcctgaggttgctaagatctatggtcagaacaaatctacccatgatattgtgaagaaggaaaaagaaattcatgtacagtatatgtagggttcggtactctttgcgacctcaggcattcactggggggtctcagaatgtatccctgaggattacgggaagctactatgctttttgaagatgagcttgccactaatgtgggggaatgttggggaggggcttgagtgatttccatttgttcgattatcagtttattgccatcagcctgtcctggatggggcatggcagtgggggtggagggaagagaacagatgtgagaggtgattgggggtacatttacaggtgccatgctgctcaggagaccaggccccatgtgtccacgtgggagttgagggtgagtcttgggcttccgtccaggagtactaggggaagagcaggactggggaggctgcctgaggctggtttccaaaacactgactttgagttgccttggaatcacccaagtggatttgcagatttggatctcaggaaaatattctagactgcaaacttttaaaaagatttggcctcaggcagctgcatggggaggagtgtcagcactgcaggcgtggacggaggcctgagagctgccaggagagctggcagggaagaggaggcggccccctgggatggagacagctctggggagtgtggtggccatgatgttccatctgtcagctacatggtttagctcagaaggggaaaagtgtaaccaggtagaggctgaaggagggccagtaggcaggcaaaatggtctcatcttacagagaaaatagtgacttatagagataattatttagaagtctgagccctcctactcttgttctaataactaacaagttattgtcaagaattcttttaaaacgaaaatatttaattcatggtattcaggtttcctgtgcacggagcctctgcgctgcgttactgtatttattcatcggcctttgtccttgggcgtttcatccttcaagggaagccctaagtgatccatggtgtggtgtgttcctcacaggttcatcccgagttactccctgagtcttcaggcgacgatggccaagggcttgtgacttctgcaagcgacgtgactggaaaccacgcagcacttcacagggatcctagtgtgttctctgctggtgattccccaggggaggctccttctgcgctgttgccagggccaccccctggtcagcctgaagccactcagctgacagggccaaaacgggctggccaggcagctctgtcagaacgaagccctgtggctgatcggaagcagcctgttcctccaggacgtgctgcgcgttcaagccagtctccaaaaaagccgttcaatagtattattgagcacctgtcagtggtattcccatgttacaacaggtatgaacagaaaatgtctgtgactgtgtttaatactttatcgaactgaggtttcctgattagataaaatcatggctagttaggtgttaacatgaaaagggttgcataattgttttgctcagaaagacagttgctacatttctttctttttgtaaatatagagataagtattttcaaataaattggtgggttttttctttctttttttttttttttttgagacagagtctcactctgttgcctaggctggagtgctgtggcacagtctcggctccctgcaacctctccctcccgagttcaagcgattctcctgcctcagcctcctgagaagctgggattataggcatgcatgactaagcctggctaatttttgtatttttagtacaggtggggtttcaccatgttggccaggctggtctcgaacttctgacctcaagtgattcacccgccttggcctcccaaagtgctggggttacaggcatgagacgccacacccagcctcaaataaattttttaatgtgcatatgtaaattgaaaacattgagcactgggtaatattcatcagaacccatgacaatttgctaagattttgatgagaccaatagcactgtctaaaactagtgttatagtatcaataaatgaacgcaaaacaataattttgcatcatttggggggacaaaattatatatagcaaagaaggcagcagcaacttaaaccttgttatataagacctctgatttgttagagtgtgaggttgaagactggatggaattccatagtgaatggggcatgtggacatgttaacaaggggtccttgtgaatgtgggaaaaagctgcccttacctgagtgagcaagagctgtaaatagagttgggatgatggcaggctcttcagtagcgtttctgcctccacctctggtttccgctgttcaggttgttacgagggggacagagttgcctcttgtctcagctgtgaaagatgatgaggtagaggcggtgtctctgaagtgcagctcggatcaaaggactctatgctcaggaatgacctttggcatgtgccctattatttcagtttctgagacagtgttaattacaggcttcaaaattgaaatttgtaaacaatggggcagttaaaatatgattagccagcaggcatggtggctcacgccaggccgaggcaggtggatcacctgaggtcaggagttcgggaccagcctgaccaacatggtgaaaccccatctcttcttaaaaaaaaatggcaaaactcgcttgaacctgagaggcagaggttgcagtgagcagggatcgcgccactgccctccagcctgggcaacagagtgagacactgtctcaaaaaaaaaaaaaaagttatgctttttagatagttattgttgttatcagtggtcttcagattaattttatgtgcatttgtctttgtttctttgggttgggctgttggattaatattggcatgtaatatttcttagcagtagagaactttctgttgtcattcatcactcactctccctttcagcactgagcttgctggttttattaaaaaagtgcgaagcaaaaacaagaactcactctcaggattgagtattgatgaaattgtccaaagagtgacagaacacattctagatgaacagaaaaagaaaaaggtattttatctagatgttccagtttatccttatttatttataaaatatgagaattgttaaaaaaaaaaaaaagcttcaaaccaaaacctagagagcaatgtactaaagacagaagatggtcaagttgttggataactggttgcttccctcttgtcccctccccgccacccctgttattttcgcagccaaacccaggaaaggacaagaggacttatgagcccagctctgccacccccgtgaccaggtcctcccagggctcaccctcggtggttgttgcaccatcacccaaaaccaaggggcagaaagcagaagatgtccctgtgaggattgtatgtataactgtatagttttgttttttaatgaaaaacaagaagcaaacaaaatttttaatccatgatttagccccattcatttctagacctaatttatttgatcccaacattagaaactgaatttcaatgtacttgaatgtgtccagttagagcaatcagtgaatggccgaggtcatggtgtctgctgtgatacgtttgggcccagcatggagagaagcccctgcacatgagtgacaagggctctgaccatcgtgggggatctgagccttctctctcttgcccttgttttgctgcagatggtcaagtacatgaactttgtacatccagtgtggtattttgaacagttggggaaatcatttttgaataattttcttctgtgtaaccatggctttggaattacacagatgtgtcaatgtgtcgtgtggccacacccaccccaagatagaccgtgattgcctggagaagagggttctgtttttgcttcatgatggatgtttgtagtaacgaagatataaaagctgacttactgaaacttcaccagattgtatgagaaagaaaaatatgtgttcaaactgggacctaatttgataaccatagtttgttaaaattaaaagtattaattttcaaattacaaagtattacatacaatagaaaatacaaataaaaagggcatttaaaaacccgccctgtaatcagtattaccactttggtatatatttttctaaactcttgaatgcatggatatgtgaattagtcaaaactgaatacgctagtcacactttgtatgttctctgaggggctgaatgttttggttgttttccatttttttttttattgtggttgtcctttttttcttttagttagaaatatactgtgcccatcttttctaggaaatagaaaacggtcaagttaagtgtatatttttttcaaactaaacctggctccgagctttgcactgggcattggagaggccttcaatggctcttccccggtctggcacttcctcttcttccctgaccctcgagtcatgggcagcagtggaggggcatgaaccctccttctgcagcatctgccccatctcctcctgggccgagtcatgccttgggagagacagcaaaaccctgaacagcagttcaaggtcttctcagccttggggtgatgcctccagtgccactccctgaacttgatcccactgccagggctgcctgcattcgcccactccctcagcaggggtttttagagcatgagtttgagctaggttttctgccagctgctaaagacccagatgggactcattttgtgccttcaaggcgctcagagttaagaggcagtgagctagagtagaagttaatggtgcagtaagggtaagtgctgtgagctgcagggagaactgtgcctggagtcccaggcgacactcaggtctgctctcacatcgaaagcactgtctatgctcaccagactgtgagccgctgaggccagagccctccattcatctctgcgtccagcacccgacaccaaccctgcccatggatgtttgccggatgagccatccgtttgttttgttttgatttgcacaagtaatccatgctcatagaaactagaaaatagtaaagaaaaagattaaatctcccttaccctgaggcaaccactgttaactgtttttctaggcatgtatgtatacatgcagcccctttattaaaaagtgagttatatatgatacatgttgtcttgttagctgctttcattcagcaggctgttggggccagctttctatgtcagggattatgggcttccgtcatgattttccttttggctacacaatagcccattgtgtggatgtgttggaatttactaccctcaactgttagatgattaaatgtatgattaattcacaccatgccatgtgattatcccatactgtactttaggtatggtaatcttcacctggggatcttctggtcacataaaacagttttttctctgaggaaattagaactttatacttttctttttgtatttttatattttttcttaagaaatgctattaaaaaataagttgtttcctcagactgtttagctgtaattgtgaataatttgccaccctttgtggcagaagatgtttgaaggccacttgaaggaagaactcgtgtcataaaaacaactgtagttattctttactattcaggtgtgtttgtttccacaggcactgggtgcaagttcctgtgaaatatgccacgaggtgttcaaatcaaaaaacgtgcgtgtgctcaaatgtgggcacaagtatcacaaaggggtaagagctctttttggccatccttacagcatgcattgggaccttcaaatattttcaaaataagaaaggaattgttttctagtcatcagtatttattgtgctttcaaactattttctttgcaaacctcccgtgtcagtgttcagtgcctccctgtcctcacaccagctctgcaggaagggcagctctggagaccgtcctttccatcccttgtggggagaggggaacagcagctccagccactcgttagtgctgagattcaaagcagtattagttccttgaaaggtgatttcttacacacttgactaaatggagaaacagtgaaaccatttttttgacttagtgtagtatatgaagtcagtttaacattttagaggagaaaaactaaacctagctgagtcccttctgcctgacccagggacagtcctgctcgtaccgttctgggatctgtgtgtgaactatcatggtgttctaggtaccgtgagcatttgtgtgcacccctgctgctgggttagaacagatcaggtctctgccatggggatttgctaatcccttggaacgggataaatacagcatgctcactgaaaggaattgagaccacttgccaagtctctggtgtggtgtgcctccttgggtacagggtcttatatttgggctagctgactgtccacagcctctgcagtgtgggcagcagcagcaggagtgtggcgtgcaggctggagggctgttccagagccaagggccaaggccaggccaagggatgggctaagaatgagtgattgggtcatagggccgagaatgccaggctctggaatttggcgcagctgaagtggaagagccgagcctggaaccggggatcagggcaagaccaccccctgaggccaggttggaggcccagagcgctcaggatctgaccctgaggtgggatcgtttgcggctggggctttgtccacactctggcctgagcgggtgttggtgtccctgagtattgggcagctccaggcccaagagaccaagggcaagtgagccacgcctgccaaggagcccagcagcacaggggagctaagcttcctcatggtcctgaaggcatcttctgattttgttttctccttttcagtgctttaagcagtggcttaaagggcagagcgcttgcccggcctgccagggtcgtgatctcctgacagaagagtcaccttctggaagaggctggcccagtcagaatcaggagctgccttcctgctcttctaggtagtcacacttcactaaagtgtcatccaccagtgtgttgaatccgaagaatgacaattttctaccactggtgtaaaaaacaaacatttgaagacccttgtgcattgtgtgtcacaaagctaaatacatggaaatcgttaatatcgctgatattaagtaatttccccactctgagtgaatactttgatgattgccaacagtggctaataaaatgacggctaccacactcatgggtcactggggctgcgcagggctctttgaggtgggtggcttcttttggaaagtactatgaacgtctcgaagcagtattctagtgataagaattcttaacatagccaagcgccccacgtttgttccccacgtttgttccccttttctgtttgaaaaacctgttctggtagctccacaagagagatgatactgactttttaaattttttacaagagtctgtattcctgatatgcctatatttttcctcaaagattctgcattttaaggatgggcataagcaaactatattttaataatttatagttaatgttaaaatattggctgatttagaccaaaagattcaaatctcctctttgtgaaatcccatctgcatttgattttttattattttatgttcccccgttagattgttttaagtgtttgcttttcatcttttatagatgtaatctgattttcaaaaatcattaacactttttaattagtatcgactaagactttttccccctggaatcgaggctgtgtgtccgtcatcccagcccccggttggagcctgctctttgaactccgctgccttccttagcagcttctgtcctcttctgtgagtcagtcagcgagtgcttgggatccgcatccagccgtgctgagcacacaacaggctgtgtgtggaaatggccaccaccattctccttccccaccccaccacaaaaagagaagctgtgtctttagacaaccctgaggtatctgtgttacaatcgttctgtgtttgatatttgtgtaaagtatgcatgcagtcttgtactgtgacctaagaacaaaactgtaactgcattagaaaccatgaaaaaattagatattgttttgtgacttttagacagtggtaaatatagaaccatgaattctggtcacattccatttctctccaacatgaaggatcaaaaaatgtttttcaatgtgttctttgttccactggaaacttagagtcatgagtttatgagctgatttggtcaccttcctctgcctttgttcactgtgagttctgatgtcttagtgacttagttcttagaagctcacgccttagtttgaaacagattctccacggtggtccccaaaacactgtctgcatatccataagaattgagcgctatgggtgttaacgtgcatgaggatcagtttgcagcagcaagtacaaaaggagaagaggaacatccgttgaatgagtgtgttttgtacataacttcagatacttgtgaacatgccttatatttgtccaacaactgtcagaataaagaacattctaaaatgagaagttcactgtcactcttgtccattctttcttagagaagtttaaaaatgcattcttctggaaaacttaggacatgtatgtcatgctaacattttaagagtgctttcgtcaggaaagaacagccacgccatgctgtgtctgaggagtctgaccagggatctcagggcgttttagggcctgggtcagaattttcctttgtgcctgcgtaagatcgactataggagttcacacagagatgatagagtttacttcttaaggctaaattaagagatttttcatgtgaatacatataaggatgttgaagataaattgcattccttggtatattttttgaggcatttgtggatttatgggccactgaggctgtcgatggggtttcctctatagaggggcttctgggtatgctgagcactcacagagtgaaagctcatttgaagaaagctcattttcaaaatctgtcttctgttttttcaagtgtattcaaagtattatcagtacgtatttttagtctgatggcatttaatttaatttaaagcaatgactattccttaagaatttaggccggccgcggtggctaacgcctgtaatcccagcactttgggaggccgaggtgggcggatcacgaggtcaggagattgagatcatcctggctaacacagtgaaaccccgtctctactaaatacaaaaaactagccgggcatcgtggtgtgtgcctgtagtcccagctacttgggaagctgaggcaggagaatggcgtgaatccgggaggcggagcttgcagtgagccgagatcgcaccactgcactccagcctgggtgacagagcgagactccgtctcaaaaaaaaaaaaaaaaaaaaaagattttagattagttttccctgctgaactgcttaatctatgttatgaataatggatagcctggtataaaattgaagtggtgccccagcaatgcaaaatgttactacggttttaaggtaatctcaaagactacagaagtgcccccacttattcgtgattttgatttccacagtttgttacccacggtcagccgtggtctgaaaataggcaagtacagtgcagtacaataagatattttaagggggagagaccacactcacataatctttactacagtgtaattgttctattttattactagttctagttgttcatttcttactgtgcctaatttataaattaaacttcatcatagatacatatgtataggagaaaacattgcatatgtggggattggaattttctgtggtttcaggcatccactggaggtcttggaacatatctcccacggataaaggatgtgtgtgtgtgtgtgtgtgtgcagtcgcagcaggtggtcaaagtgctcaacacaccacaaactgaagcagtaaaactattttagagtagttttttagtcagatgactggagaagggaattaaaggaaacagtagaagacacaatagcaaagatggaagttccttctgtcagcctgaggtacttactcaggaggctgaaaaagcagaggccgtaaagtgataggatggttggtcagaatgaggaccaaaaagcatctgcagtatgacctcagaaagaaagaaggtatcagaaggagaagctgggagggtatacagatgagtaaattcctggtgaagtgctcagcacagtgcctgcacacaaactcgtgataaccggagctaacaactaactgtcactaagattaagggcctggaaattgcacaagaaagagtaggatagtacagtaggaaagccgccgttagttaggaagtccacttcctcagtgtggcctggattggaacacgatccagtggtgaaaagagcaagaagaaatcagatcacctcaaagtcgttttggaaaataacagctttgttcctgagatctccctgaattgacttcaggaatattgtgattctatagcaatggatcatttcaccttttggctttcccaaattatcggactgagcagctttgagtcaacctttcctatccagtttgggttgaggatcagggccctgtggtgggctcactagggatatgccctggagcatcggtgtggccaggcaaggctcattgtagtggaggtgtgtagtccagactccctggcttagggtgagaactgttaccatttgttccatcatcgcctctactttttttttttttttgagacggagtctagctctgtcgcccaggctggagtgcagtggcatgatctccactcactgaaacctccacctcctaggttcaagcgattcttctgcctcagcctcctgagtagctgggattacaaatgcacaccagtacacctggctaatttttatatttttagtagagacacggttttatcacgttgaccaggctggtctggaactcctgacctcaggtgatccacctgccttggcctcccaaagtgcagggatttataggcatgaggcactgtgcccagcccattgcctccactttatactgtctcttcctattctccctttaaaggtgaaaaaagataaatattagcaagaatgcagaaactaaacaatagtaaactagaaaatcctaatgagtcatccattaatcaagtcggattgataaaccatcatggcaaaaagagacttttaactatgttaagaagaataatttgggggccagggcctggtggctcacatctgaaatcccagcactttgggatgctgaggtgggcagattgtttgagctcaggagtttgagacaagcctggacaacatagtgaaaccccatctgcaaaaaatgcaaaaattagctaggcacggtggcacatgcctgtggtcccagctacttgggaggctgaagtgggaggatcacttgagcctgagaggcagaagttgcagtgagccgagactgcaccactgcactccagcctgggtgacagagttaccctgtctcaaaacaaaaacaaaaacaagatctccatatgaaaataaatgaagcttgacctctcacagcatatacaaatgtcaattcccaatggatcacagtcctcaatatggaaagcaaaataatgcagcttctacaagaaaacagacaatcttcctgcccctggaataggcaaagattttaaggaatcactagctccaagaataaaatgttgataaactggattttggtctgcactaagaactcttaagttgctgttgagagagtgaaaaggcaaaccatgaagtggaagacgctggtaatccacacttccaacaagactcctccagaatgtacaaataactacaaatcagtaagaaaaagataacaatatattagaaataggcaagagatttgaataggcacttcgcaagtatccagatggtttgtaggcattttgatagccacatttgttcaaaatcaatcaccaaggaaatataaattagaacattgctggcagggtgatagggtttggattcgtgtccctgcccaaatctcacgtcgaataggaggaagggcctggtgggaggtgattggatcatgggggcggatttcccccttgctgatctcatgatagtgagtcctcatgagatctgatagtttagaagtgtgtggcattcccctttggctctctctctcctgcccccatgtaagtcatgcttgcttccccttcaccttcctccatgattgtacattttcctgagtctcccagccatgcttcctgttaagcctgtggatctgtgagtcaattaaacctcttttcttcataaattagccggtctcaggtagttctttatagcagcgtgagaacggaccaatacacagggtattttaagttgtcttgaagtttcctggttctagcaggtaggaccatgtacttagcaaggacctgttttgctgttctctggggcatgggtgaaggtctggggtgtgagaggctacagtgagctgtaatcacaccactgcactccagcctgggggacagagtgagaccctgtctcaaaaaacaaaaaaaaaaattgaatcatgtatacacttatatcaaaaaccaatgtactcctgattacctcaacttattatgttgggattattgaggtctatagtatctgtatggtggaaataccgtataatgcaactcttcccaactctgtgtttagtggggtgacactggtagcttgaaatcaaccatcgttggagtactaacaccacagtcattggcaaatgctgttttgcttccctggaaaagctggtaaagcctggagttctgctggtctggtggtgctggtctggtggtgcttgatacctttctcatttcacatttgaaatggtgattcaggcactcagcaaaccctgctgggatgatttctgctgagagagctccttcccattgctctttggctagggtcctcacttcccttgccaccgcctggccttgcctggttctctgccatcctggaaaggagacactgctctctgcagcgtctctggcccagagacaggccgagtctgtcattgcattagcctcttagtggttccttgggggccactcccagcagaacctctgtccctgccacaacaggtcctgtgctacgaaacaccaaggaagtccccttcctgcctctggccaggccctgcctgagagggtgcatgtgaatgcaaagcaggtctgtttcaggagtgcccaaaaagaagccaccaggaggacacctccatgccagaggtgactcatcttacctcccagaggaaggactggggccggtcccttggccttgccaggacagcctccacaacgagcagctggtatggttacagggctcctgtggcaggcactttcaaagagacaagcttgctctctgtaacatgtgcctttgtgtcaaacagacctgtcattgttttcagcaaataccttgggacttcagtgcataaataccattctaggtatttttcagaagttgtgtataaaggcattctgcctaattccttcagtcctctatttcagtttctatttatttggtgtgatagaaagctcttaatttagatctccccaccgccagttccaagaaatctgccaccagctccaagcctcatgtcctgaagtgccacctcattcccgcggggtgagccagcagcctctgaaaagaggaagccattgaacagatcacactgtgcctcccgccgctggctgccgccccagcgccagcaggactccggctttgactggggactcactggaggccacatcgcttttgcttccagtttccaaactgccaccacctcgaaactgccagacctttgaaagctgaggcacagtgcctcaccccttccttcagaagactgtccagctccccctccttcccctcctccctcccccactggggacctctcctaggggaggggtctggtgtcctcagctggctcctctccaccttcgcttctacccgggggctccagtgcatctggctttatctctggggtgagccatgcggccctggtcatctggacgggccactgaactccacacattcacctgttcactggctcatccattcattcatctggtctcatgtgctgccctgttctaggtgcttccatacaaaggggacagaagagatgatggaaggcctcagtactgcaggaggggagacggatgtcatctacaatcacacaatacatgggaggtcacaggtgatcccgaggaaaacgaagctgggaaggggatgagggagtctctttgtctaaacttgacccaggtttagacagaagccaggaacggcgtcatctgagtgcagcctgagggacgggggaggaggtaggggcaggggcgggcagtcaggcagagaagccagtggagcgatgcccgctagggtgtttccagagcccgaggaggccagagccgctctttgcctggaggattgtacagaagtggggattcccagggggtggatgggggtgggggctggggggcagtggcctgagcctggcagctcagggattcatgcggcaggcggtgcagcttgttggtcaacctcatgaaatactagttttgcacgtggccttagactctggggacttggtctggggccaggtagggggcatttctgatgtgatgtcacctgtgttactctatccgtcagggccttacggagcccttgcttcctccaacacccccaccggctttctcctgtggcttaaaattgacctagtcagtcctgccagtgggtctaccctgcaggcccatgggagcacccatggatcccagtcctggcccaagcacctgccctcactgctacccaccccaagccatcagcctcattctcactttacctcctcacacctggtttcactgaagcctgggccagccccctcaaccccttcccaagctcccatctacccctgccacagccctgctccctgcagcaggggcctcagaagttagtctcttggagcgctggggttaaatgaatgtgccttgcacatactagctgctcagtaaacacaaaaaaactcaacccaggctccagaacaagagccacaccccacaagctggctgtggtggcctctgaatctgaattcccacctccatgtgaccttccttaagcccctcactccagccctgctcttcaccatctcccaacatgatatttactaatggtcatttcaggtactgtgttacctgtccacaaacattgcagcatttaatttccccaagtaccctatgaagaagagattactcttgcctgcattttacagacaaggaaataaacctaaaaggttaagtgatttccccaaggtcatgtaactggaaaatgtcaggatttgcacttgctaagccaactctctcctctagccattctgcttcttcctcttaatacaaaacccacttgtcccccaaggttcagctcaggttcccatgccaaaaccaaaccttcttaggcatgcaggtggcaaaagccttggaacccctgtttactactgctcaccctcacaccacggctgcagtggctttccccttcacgtttgctcatgaggctgatgcagggcaggtgagacccaaaatcggggcttagcccgggagggttcttggcttcaccctggaaagaattcaagggcaagctggtggtgttaagacagcaatttttattgaagcggccatgcatagcggcagcacaggtgctgctccctgcagagcagggctaccccataggcagtgcgtccagagtaacagctcagaggcagtgctgcagtcctatttatagccacttttaattatatgtaaattaaagggcagattatgcaggagtttctaggaaaagggtggtaacttctgggttgttgagtccttgccatgggaaggggaagtaatgtccgggtgttgccaaggcaatggtaaactgacatggcacacgagtgaatgtgtcttatggacggttgcttctttttaggactttatatattctagacacaagtcatttgtcggatgtgttttgtaatttttcttcaagtctgtggcttgcattttcattttcttaacagtattttttaacggtcttttgaaattttgaggaaaagtcttcaattttgatgaagtccaatttattatttttttcttattatttttatacttagttttttttttatttaaaaaaaatcagcaaggctgggcatggtggcttgtgcctgtaatccagtactttgggaggccaaagtgggtggattacttgagtataggagtttgagaccagcctaggcaacacagcaagatccccccctccccatctcttttttcagaagaagaaggagaaggagaagagggagagggagagggagagggagggggagggggaggaagggaaagggtggggagggggaggaggaggagagaaggaaagaagaaggaggaaacaaatctgccaaaccacccaaagtcaataagattattcttctcaaagttttttagtgttcttacatttaggtctctgatcattttctagttgatttttgtatgtgctatatcatgaggattgaggttcactttctttttgcatatagttaactggttatttcaacttggagccttgaaatcatgtagcgtaagtcctctaattttgttcttttccaattttgctgttgactattctatttattgccatattaattttacaattaacatcaatttttaccaaaaagtctgcttggattttgatctaagcatctatagatcaatatagggagacttgacacctttacatgattgaatcttccactctgtgaatatggaatatctctccatttattcaggtattctttaatttctttcaggaatattttgtagtttctggtgtacacatctttcaatcttgcacatcttttgtgaaattcatccctaagtattttctatttttgatgctgttaacaatgtttactttaattttaatttctgattgttcattgctaggatataaaaaagcaattggtttttgtatatttattttatatcctgcaaccttgctaaagccacttattggttctagtagcttctttttatggattctgtagaattttctacataaataatcatgtcatctgagaataaagatagtttaaattctttcttcccaatctggatgccttttatttcttatcttactgaactacatacaatgcaattaagtccaaatgttgaatagaagagatgagagtgggcaattttacttcattcttcatcttagactgaaagcattcagtattttactactaagtataatgttgattgtagattttttgtagatgccctttagcaggttgaggaagttcttttatagttctaatttgctgaaagttttttttaaatcagaagtcaataacagatttgtcaaattttttctgcaatttggatgattatatgtatcaaattttaagttttccttgtttaatctgttaatatgataaattatttttaaatgttaagccaactttactttcttgggataaaccccacttggccatcctttttatattattgttgaatccaatgttctaatttttgaagtgaatattattttaaattgacaaatcataagtgtatatatttatgggatacattgtgatgttttgatatgtgtatacaatgtggaatagttaaatcaagctaacaaatatatccaccaactcacttatttttttgtggtgatacatctgaaatttactcttttagctattttgaatatacaatgcattattaactgtagtcaccctgctgtgcaaatagatcttgaacacttattccttctgcctaactgaaactttttaccctttgacaacgtatttccattctctctcctgtccctactccccagcctctggtagacaccatcctattctctacttctatgagtttgacttttttagattccatatgcaagtaaaatcatgtggtatttgtctttctgtgactggcttactttttttttttttttttttttttttttttttaaatgagacagaatcttgctctgtctcccaggctggagtgcagtggcatgatctcagctcactgcaacctctgcctcccaaatagctgggactacaggcgtgcgccaccacacacggctaatttttgtatttttggtagagatggggttggtctcaaactcctgacctcaagtgatccacccaccttggtctcccagagtgctgggattacaggtgtgagccaccatgcccagcccgactggcttaacataatgccctctaggttcatccatgttgtcataaatgacagaatttccttatttttttttccataagagacagccttaaataaaaaagaaagaaagaaagggaaagaaagaaagaaggaaagaaggaaagaaaggaaggagggaaggaaggaaagaaagggaaggaagggaaggaagggcccttttttttttttttttttttttgagacagagtctcgctctgttgcccaggctggagtgcagtggcgtgatctcagctcactgcaacctctgcttcccggcttcaagcaattctctgcttcagcctcctgagtagctgggattacaggtgcccaccaccacgtcaggctaattttttgtatttttagtagagacagggtttcaccatcttggccaggctggtcttgaactcctgaccccatgatccacccacctcagcatcccaaagtgctgggattgcaggcatgagccactgtgcccagccagaatttccttctttttaaaagctgaatagtattccatggtgtctatagatgtatcatattttctttatccatccatctgttgatggtcacccaggttgatttcatatctcagctattgtgaataatgattcagtgaacatgagagtatgcccggcctctttcactatcaaaaagataatagccattgtaacaggtataaggtgatatctttgtggttttaatttgcattttcctggttgggcgtggtggctcatgcctgtaatcccagcactttgggaggctgaagcgagtgaatcacttgaggccaggagttcgagactagcctggctaacatggtgaaaccccatctctacaaaaattacaaaaattagctgggcatgtgggccgggcgcggtggctcacgcctgtaatcccagcactttgggaggcctaggtgggcggatcacctgaggttgggagtttgagatcagcctgactaacatggtgaaaccctgtctctactaaaaatagaaaattagctgggcatggtggcgcatgcctgtggtcccaactaattagaaatagttgtttccaatttctaatttttaaaagttttttgcatccatgtccatgaagaatattaatctatattttcttatattgtctttctttgactttgataacaaggtgatttggcttcatataatgaacccagacatccttccttcctccctccctctctccgtttcccttcccttcccttccctcccctcccctcccctcccctcccctcccctcccttcccttccctttccaacagggtctcgggccgggtgcagtggctcactcctctaatctcagcactttgggaagccgaggtgagtggatcacgaggtcaggagttcaagaccagcctggccaagatggtgaaaccccatctctacgaaaaatacaaaaaaattagccaggcgtggtggcaggcatctttaatcccaactacttgggaggctgcggcaggagaatctcttgaacttggagggcggaggttgcagtgagccaagattgcgccactgcactccagcctgggtgacagagtgagactctgtctcaaaaaaaaaaaaaaaaaaagacagggtctcactctgtcgcccaggctggagtgcagtggtgcaatcccagctcactgaagcctcaacttctcaggctcaagcgatcctcccacttcagcctcctgagtagttggggctaatttttttttttttttttttttgtgtgtgtacacaaagtttctctatgttgcctaggctggtctcaaactcctgggctcaagtgatcctcctgcctcagactcccaaactgctgggattgcaggcgtgagccaccacacctggtttggtattcttttctctgtgattttctgaaagagtttgtgtggaattggtattatttcttccataaattttgttaaaagtcatcactaaacccatgtgggcctgtaatgttgggttttcattttggttaagttcaaaatatttcctaattttgatcttctctttaacccatgagttatttaaaagtatgctatttagtttccaagtatttggagagttttcagatatttttctgttactaatttctaatttaattccaagagtcagagcatatactttgtataattcaaatccttttacaattattaagactttgagttgttttatagtccacagtataatctatcgtggcaaatgttcatgtgtacttaaaatatgaattctgagccgagcgtggtggctcatgcctgtaatccgagtattttgggaagccaagcagggcagattgcttgaggttgggagttcgagaccagatgttgtgcaatgtgccagacagtcccagagagcgaagtctgattctgtgctcggtaagactttccaaagtcccactgacctccacctacatccgtgctgctgcccagtgatgtgaactgcatctataattttttttttttttttttttttgagatggagtcttgttctgtcgccaaggctggagtgcagtggcacaatctcagctcattgcaacctccgcctcccaggttcaagcaattctcctgcctcagcctcccgagtagctgggataacaggagcccaccaccacgcctggctaattttttatatttttagtagagacagggtttcaccatgttgccctcctggcctcaagtgattcacctgccttggcctcccaaagtgttgggattaccggcatgagccactgtgcccggcccataattttaagatttctaagagctgaatttgaaaagtaaaaatgagctgagtgcgatggcagtcacctgtagtctcacctacttgggaggccgaggcaggaggatcccgttagcctgggagttctgggctgtagtgtgctgtgctgattgagtgtccacagtaagttcagcatcaatatggtgacctcctgggagtgggggactaccaggttgcctaaggaggtgtgaaccggcccagatcagaaatggagcaggtcaaaactcccatgctaatcagtagtgggactgcacctgtgaataggcgctgcatttcagcctgggcaacatagcgagactccctctctaaaaaaataaaaaataagtaaaaataaaaagtaaaaatgaggaaatagaattttagaaatagaatatagaattatattttgtttaatctagtatatctaaaatgtttaaaaataaaatcaatataaaattattgtcattattattattattatctgagttggagttttgctcttgttgcccaggctgcagtgcagtggcgtgatctcggctcattgcaaactctgcctcccaggttcaaacaatcatcctgcctcggcctccagagtagctgggattacgggtgcccgctaccatgcctggctaatttttttttttttttgtatttttagtagagacgggatttcaccatgttgaccaggctggtcttgaactcctgacctcaggtgatccatctgccttggcctcccaaagtgctgggattacaggcgtgagccaccacgcctggcctaatgtaaaattattaatgaggtatattacatcttttttttttctcatcccaggtctacaacatccagagcagccacattgcaagtgctcagtagccacatgtggctggcacatgtggcccatggcaactgtgctggacatggtgggtccagacctcacttcattttatgtataaacaccaagtatcttgtgagctttactgtacgtgaatttctcaggaatgctgtaactgtgcacattgaggtttgaggtttgattgcccttttgttgtttttttctgaacgttactaagggttgttcataattttggaaggtagtattatccaatagcccccgccccctccgcgtccgcagtgtgagtcccctgcacaacatgcactgaagcctctgcatttgtagctctcacattcatggtgattctacccgaggccatgcactgaatatgtcagtatcacggcttgatatcttccagtttagctgtgcctgagtgtctatgtactgaaatctgtattattttataatacatttctttgttttttgagatggggtgtcactctgtcgccctggctggagtgcactggcgtgatctaggctcacttcaacctccgccccctaggctcaagtgatcctcccacctcagcctcccgagtagctgggaccacaggcacacgccagcacgcccagctaattttttgtatttttggtacagatggggtttcgtcttgtgcccaggctggtaaaatacatttctttatatttatttatttattttgagatgcagtcactctgttgcccaggctgaagtgcagtggcgcgatctcggctcactgcaagctccgcctccctgcaagctccgcctcccgggttcacgccattctcctgtcttagcctcctgagtagctgggactacaggcgcccaccaccacgcccggctaattttttgtatttttagtagagacggagtttcaccgtgttagccaggatggtctcgatctcctgacctcgtgatctgcccgcctcggcctccgaaagtgctgggattacaggcgtgagccaccgcacccagccaattgtgatttcctttgttgctatgcatgtaactgatttttgcagtttccatggattaaaaaacatgtatttgctaccagatataaaggaaaatcgtggtaaaagtacactcacttcttaagcatatcttttttatgtatgggattttgcttttttgtttgttttgagacagagtctcactctgtcacccaagctggagtgctgtggcgtgatctcagctcactgcaacctctgcctcctgggttcaagcaattctcatgcctcagcctcccaagtacctggaattacaagtgtgtactaccatgcccagctaatttttctatctttttttaagttagagacagggtttcgccatgttggccaggctggtctcaaactcttggactcaattgatccgcctgcctcggcctcccaaagtgctgagattacaggcatgagccactgcgcccagccatgtaggggattttgaattcaactttgaacttgtgttttcttaatacatattggtgtcgaaaattgttttaaaacaaacatgaatatttaagattttagttttttgctcctttctctcacctttctgcagctaagcctgggtgcatccttttttggtgtatcatgcggcagtacatctgggctcctggcccagcctccccaggtggccccatcagaggctatacatctgtagacagaaaagctggtctccttcctttcacttaagacccagaggttgtggtctagttcttgaaggtctagtccttgacccaggtgggggacagtgacctctgagaaaggaagtgaccacaccctgctttatggggcctttgctgaccaaaccctacctctcataatgcttttcgtttgagttgctttgtccctaagtcttcatgctcagcctcctaccacagctggacgtttgtaaagggaaccagaaacatcttttggggaaatgacagttgatgcagatgacagtaaaccataaacttttggtattatcctgacccttagtcctgatcaagctggcactccccagaatgcgacaatatacagacataggcacaaattctgttttcatacttttctaagtacttaaaacctccacagcatatgtcttttgtatgttatacacaagactgtaaagagactggctggggttggacatgaaaagccctacaaagtcagaatcctgccggcctggagcggggtctatccaagggattccatcttaccagtgacattcatagaaaagcacagtaaagcacaggagatccttgctgagttttaattcctcagtctgcctttctgcatcttttgagtgatacactctaataatttgactgcattttgtgtgagtatagctggatccgctttgattctacaaattaggtgcccttctgtttcttagtaatgtcatattctctgaccactgtagccacttaagatagtctcaaatatgaataattttcagtggccatagtggagaagatgctgacccaggaggcttattctcacctccacctcttagactcacatgtatgatttttttttctccctaccaaagtggctagttttgacagcctttaggttgcagaactgtttatattcgaaagaagaccttaccttcatagagcattttcccgggcagttgttctgctttgtgtttttaatatctactcttattcggagtcccaaaatgagttagcttgggtagctctcacaatgaaaactgatttcttcgcataaaactttattctacctttttgaaaaccagctggaaatgatgaatggtggcttcaacagtaatggttcacgaagaactgatcgtgtccccatcaatgaggtcttacccatggcagggcaatggcggtctactgtaattctgtgttggttgtagtaagttgggggaatatcaggccaagaatcaacagagctacgtggcttaggcaggtcagtttctctgtgcctcagcctgctcacctgtgagatgggaataataaacacccctcagaaggtattgtgaggtcattcactaaaggacatttcagtcctttgaatgggtctggaacataccctagtatttttactctacatagaagaaatcagtcctagaatataattagatcggactttctggtcctttaatcactcgcctccttcctaaactggatccagctgcaaatgattgcgttagtctcaggacttcattttcatttgactcagctgatcaaaactgagaccattctgaggcaggagaatagggtctggaggcagtaaacctaagcccaattcacgctgacttcctagaactaaatcaaaaggaaaaccccaactttccacatccaagtaacaaaaggaccagaggctactccctctgcaacccccctttttccacgtggcagataaactctaagtacctttgattggtcccctcccacagccaatgaggctgttcacaggtcaagacttcatttgcatgggagtataactttgtaacttcagcctctgattggttgctttctgcaactaatcagatgtttgcatagggtatagctttataacttcgcttcagcctctggttggtcctctcctgcaaccaatcagactgattatggtccactacttcatttacacaaggtgtacaccaagtaaccaatgggaaacctctacagggtatttaaatcccagaaaattgtgtcaccgggcccttcagcctcatgggctgctcccaccttgtgggtgtactttcattttcaacaaatctctgcttttgttgcttccttctttccttgctttgtgtgttttgtccaattctttgttcaagaacgccagggtgacgtaacaattcaaaccatgaagaggtaacagagcccttcgcgcgtctcaacacgtggtgacgcagctaataacctgtgatgcatacatgggaacaaatgcatagaaaaacttgtcaatgacacggcaaagtaaaacccaaatgaagcgaggtgaaagaatgggctgcagcgcaggcaaaactgcaccacgttacagactgctcgcctgggatggaacggtggggaggtgcgcagacggatggacaagcgcctggcaaaatggatttcttttcctagactgctaatgctactaacagttccctcctcacagggtcgctataacgaggtaacatacagcacttagaagacggcctgacccagaataacactaatgttcacatggctgcgagtctcagaccaaaatcaatagccggtatctactgaaactgcagcaaggcgaaaccacgggaatggcgctccgttgagtagagcaacgcacagcacatcacatcgcatcctccgtagcgggaggctctggcctcaccgcagcggcacttcccggaagagcccaggatattcggggacccgcaccggacaggcggcccaggccccctggcgcccagctggccgccctgttgcagctctcatgccaagacctgcgcctaacggcagggattccggcggtcatcatttattcttggcgctaagctgccgcttctcttttttatcaccacagagtaacgcagaccccaccgtttccttccattctgagccaaccactccagcagccaccggggcgccaggttatgctggggctgcaccacccggcccgaggcttttgaagccacgcctgagcgcggaggatgggcaggatttgccccgtgaactcccgcgcacgcaggctccgcgcgaggcccgggcgcccgagcggcgattccctcccctatcaccagctccagggtggtgccccccggctgtggagcccagaccccggccgtccagcagcgtatagacgagcccatgtctgcgatgtaactgcaccgcgctggggatccacctcccgccagggtgagggcgccgtcctccagcgtatgctaggcaggcgcgccccgccctcctggtcacgtgaccacgcctacagccgaagaggatgggaaaatgcggccctgttcctgaacaggaagcggaagcaggaaggaactgagaacaccagcatctgctgccgccctgaatcagcgttagcatgtggaggcaacctcagcccccagtttttgaagaaggtgattcagattcagacacaggaattatggtgacggtagaaatggactggaaggttcgttccccttgcccaccaagactccagagcaggtgggttcttgatgtctactctgcatgaagccctgggctttccggccctccctacttttcctccgaattcacagcacagcggagccaaaatgtattcctgccaaaacgggcatttcccaaaagaaaatattgttttagattcattgttcacagcctctttttttttgttgttcatttgaagcaatttttcttttttattattatactttaagttttagggtacatgtgcacagtgtgcaggttagttacatatgtatacatgtgccatgctggtgcgctgcacccactaactcgtcatctagcattaggtatatctcccaatgctatccctccccctccccccaccccacaacagtccccagagtgtgatgttccccttcctgtgtccatgtgttctcattgttcagttcccacctatgagtgagaatatgcggtgtttggttttttgttcttgcgatagtttactgagaatgatgatttccaatttcatccatgtccctacaaaggacatgaactcatcgttttttatggctgcatagtattccatggtgtatatgtgccacattttcttaatccaatctgtcattgttggacatttgggttggttccaagtctttgctattgtgaataatgccgcaataaacatacacgtgcgtgtgtctttatagcagcatgatttatagtcctttgggtatatacccagtaatgggatggctgggtcaaatggtatttctagttctagatccctgaggaatcgccacactgtcttccacaatggttgaactagtgtacagtcctaccaacagtgtaaaagtgttcttatttctccacatcctctccagcacctgttgtttcctgacttttgaatgatcgccattctaactggtgtgagatggtatctcattgtggttttgatttgcatttctctgatggccagtgatgatgagcattttttcatgtgttttttggctgcataaatgtcttcttttgagaagtgtctgttcatatccttcacccacttgttgatggggttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgcctttggttgccattggttttggtgttttagacatgaagtccttgcccatgcctatgtcctgaatggtaatgcctaggttatggttttaggtctaacgtttaagtctttaatccatcttgaactgatttttgtataaggtgcaaggaagggatccagtttcagctttctacatatggttggccagttttcccagcaccatttattaaatagggaatcctttccccattgcttgtttttctcaggtttgtcaaagatcagatagttgtagatatgcggcgttattatttctgaggcacagcctctttctttcgtctccctttcctttcctcatctcttgctctaattggagaatttgacaactctgaacctctgactgtggataaccccaactccagcaagcctgggcaagagtgggacagttgcagcccaaggtagccaaacatctgagttttgcctagtaacagatcatggagaggtcagaccaagaagtggaaggaagtggccggcctgaggcctttgtttgggccactcagggttgaatgaaatgataaaggtagccacgttgtctggatgcgcttcaggtaataattattctctaaggaaagcagtcatatttatatccataaaatcagtttattaaattacatagcaatatacatcccaaaccttttctcaaaattgtcattagctttttaaattcgttaaatattttcatctcattaaaaatggtttcttcctttaaaatttcccagaaagtgtggcctctgttttctgctactcagtttaaacacatcatcaaggatagataattaatgtcaggtgagcataaaaggagattataaaccagaaatgtgttttctgggaaccaagtttcaagtgactcagataagttttattaatttcatgggtgaagcccctggataaagcagtgcctaaatcaggcttgtttacccttggcattatgtcaccaaacactgtttcaggatactggaagtacatacagcttgggaggtctttggcctgagcctgttttggccaagcccatccagaatgaaaagtacaaaagaaggctagtgtgtgtgcaaagcagcatggcttattttgaggtcctattagttgtgggccaacaaaacagtggcaggatttgaaggaagaaatgtattgcaatagtccatatccttcgaaccacaaagggagactgaggaaatgctggctttaggccaaaaaaccctggctcaaaacagcttcctccagtggctcagaggcagaccaaattcatcaagtcaaggaccttttcctgctaccaccttgcggagaggggccttcaccagcccaccctgcacatgggtttctgctgttcagaacctacccagtaacaacaggagcaaacatacatgttttcccctcatgtaactttgcatttaaatatattctgggaaactgctgggcacagtggctcacacctgtaatctcagcactttgggaggccaagacaggaggatcacttgagtctaggagttcaagaccagcctgggcaacatagggagaccctgtctacaaaaaatttgaaaattagctgagtgtggtggcactcacctgtagtctcagctactcaggaggctgaggggagggatcgcttgagccagggaggttgaggctgccgtgagctgtgatcctgccagtgcactcagcctgcgtgacacagtttggaaaactgtctctctctatgtatgtatctgttcagggaaatggcagcgtgagattttatggcagttcttgagacttcagaaacacttcggcaccagccaaatccccccaagagagcaaggaacacttttccagttgcttaaaaaatttaaagttataatgaaaaatgttgtaaaaagaactacagaggctgggtgtggtggctcacacctgtaatcccagcactttgggaggccaaggcgggtgggtcacgaggtcaggagttcaagaccagcctggccaagatggtgaagccccgtctctactaaaaatacaaacattagccgggcacggtggcagtcacctgtaatcccaactactcgggaggctgaggcaggagagtcgcttgaacctgggaggtggaggttgcagtgagctgagatcactccagcctgggtgacagactgagactccgtctcagaaacaaaaccaaaaaactacagaatagagtaggggtggagggaagtcatgcatttccagtggctagcactttgcgctctgccttggcgagtatctgcaaacttcctgaccatcaagtgcgcttgcagccatcctggatgtcaactggccacagaccctttgctatggggagtccctggctacatccattagcaagtcagaggtttccttttgtccccatgatgccactctccagcaagctcaaactgctgtcacaattgttttactgtacctaaaaaggaacagataaggcaagagccacagtcaatgttttctgtgaaatggtcttggcaaatagcattaagaaatcttgttgaatttcaaagaaaaggtctgattagaggtgcctgttggaagcagaagcctcaagaaatgaggaaggaaagttaatttgagggtctgtttcatttctgatacagaataatcacaaaaacaagtatatgccgctggctgtagctccccttaggatttggataaccagctggatttccagatggccactcccgttctctatgcttccctcctccgggctatatcctgcagagcttcagcgggaagttctccgtgatgaggtggtcagggtgaagcagcaccacgatgttaacctcaaattctgagaagagaagagagggtgggtttgtgctcactgttaccaagcagcgaaaccacacgccgccaccactgcagtcgcaggaagctctaacggcgaaggagcacccggtgcgggtgggtttcattgctgtcccctcagcgccaccctgacctttcagccaaactttcagtggagatgactatgctgatgtctgactacctctgtcaactttctctaagtgaatttttgtcctctcatcttggaacatgagtgatcaggcttcaccaactacactttccctgtccctttgctttcctaaaaaggatattctagaaccctttcaattcatttgtattcctttgccttatttttacatttcctacggttcttaatgaaatagcagactgtgaaccagcgcatagctgtctgggcccatgtccccaatccccaggtgagaaacagtcttcagaagcaacaatttcattgttgctccattggatactattcatccatcacctttcagcaaacaggattccttctccaccgactcttcagctgatatgggtgagccttgttgatcctaacaaaagggatgtgtgtgaagaggaagcacctgacgacaaacaagcaccatctccttccccagtgtgaggaggggtgggaagggcatcgtgtgggcagagggcaccctgtgctgagccccacactgtggcagctcagctgtggaaggggccttggagtcagtgcccacctgtggctggggtctgcaggacaacatccccgtgtgggagtgtccacctccgcccaaacatcagccacaagaagagtcggccaccagcagtggccggcctgtccttcctcactttattgtcactacattagagtcctctgggcacttcctgccaccactcccttcaatgggttctccacccctcttgttgtgccccccagaagggtggagggtgtggctggagtggacagagagggatgcccagcaggcaagatagggagctggcgggggctttcctttacagcaggaaaacagctgcactggagccgccatgatacccaggcgctgcttagagtccgagtgagttccagtctcgggcctgaccgtgcatttgaggtcactcgcacggaattggaggggaacacacagaggtgctgctcttgatgtggatgcagtgctcactcctgacttccaacctagaggtccccgagcctctctgaatcacagtcccctgctactgagaaggctcggtcccttcctactgggtctctctgttctacttcttcgtagtgtggagtgatctcccaattaacatgattcttattaagatggaggtcccattacaatatttataggaagagttaaaaacatggaaatgttcatgatacaatgttaagggaaaaaggcagaatataaaagggtgtctgtgacctgattcagatcccatggttaaaatatgaacacacaggttcatggaaactcactagaggcatctaggccgcggggctcaaggccttcctgcttctgagcgctcactctggggttttcacgggtcctggaccttcacacagagccactttctcagtatccacaccaccccccactcctgtggtgctcgttcacgggagttttcttcacggagctcagcgtcacctgcccatgtctacacagagctcagcgtcacctgcccatgtctacacggagctcagcgtcacctgcccatgtctacacagagctcagcgtcacctgcccatgtctacactgatgtgggtctgtgtgtttccccatgtgacagtggaagtcccacaagcaccaggactgcctgtgggtgtgtcccctgtgcggcacagcagctccttaacaaggttttgttgagcagccgaagggcagcaggctctgagctgtatggcctgtggcaggccctggcactgagggaccgaagggcggcaggttctgagctctgtgacccacagcaggccctggcgctgagcggcccttcccatgggcccatgagggctgggaggcgagtgccacttacccactttgaagttggtggtctccagtgtagggcaggtgaacagcctagggaagaccatgtagatggggacagagaggcccctgcacacatccccgtcggcgatctgaatgttctgaatctccgtggcgtcgcgggcatagccttctgcacaccctgcgggagggaggccacatcacgcggtcagggccagcagaggctgcggggtccacatccgcaccggcaccacccaccagtctgctccaagaatcctccagggtcccctcccctcactttccttagacacgcggctactgctaaggcacagccacgctcttacttttgcttccccgacgtcctctcgttttttagagtcagggtcatggtctgctctgctgcccaggctggagtgcaatggtgcgatctcagctcactgcagcctcaaaccaccctcccacctcagcctcctgagtagctgggattacaggggtgcgccactgtgcccagccccccagcatcctcttaaccatggaacgtgagggtggcagtcgagggggacaggcaagcgccaggcctggtggcacggccctcaccgcacgtctccacgcgcaccagctgcagctccacgcttctgatggcggcttccgagctctccaccaccagctctcccgttagtggctgcgtgatgacacagtttgttgagttgagatgtcctcgaaggagaaatttgggaagcaaagctctctaaaacaaaatgaaaacaaatacatcagaatgcaggcaaggggggaaagtgctccatactttggtgcaaataaaacctggaagcgaagttggatagtggttacacagtccaccgggaccgtctcacaaaacgggaagaaaggagcgaagtactgacgtcttggacattagccggctgaattattcaacgactctctacatatggcacctgactgacactctgtgtacagagaatgcctcagagaaccatcctaattgcctagtctcagagctagaaagctccttcttaccaaggaataagacatgaaaaagtctgagggagtcgccatggtgttcaagacaacctgacacacacacagttaaaaagaaaagtcctggccaggcacagtggctcaggcccgtaatcccagggctttgggaggcaaaggcaggaggatcacttgaggccaggagttcaagaacagcctgtgtaacacagcaagaccccatctctaaaaaatgttttaaaaattagctgggcaggctggtgcacacctgtagtctcagttacgtgggaggcagaggcaggaggattgcttgaggctccagtgagcaatgattacaccagtgcactccagtctgggtgacaagaatgagatgctgtctcttaaaaaaaaaaacattcaaagatgttcccaattgtacaatttttaaaacccaagacatttattttatttcatggaaatttgaagaaaactagtttctttgacgcttgatgagaagcctacaaacctttactctgcacacctgacgctggccaggaaggactgatgatggtctagagcaggggtgtccactcttttggcttccctgggccacgttggaagaagaagaattgtcttgggtcacacataaaatatattaacactaatgatagctgatgagctaaaaaaaaatcacagaaacaaaatctcatgttttaaggtttatgaatttgtgttgggtcacattcaaagccatcctggccggtgggctgtgggttgaatgggcttggtctagacagagacaatttttctaggaatctttacctctggctggatcccagttactgaaaggatcagatattggcatactactgtccaacagaaacataatgcaagctgcgagtggaagccacatatataatttggaattttctggtagccacattaaaaaagaaggtaaaattaacgaatatatcaaaagtgttatcacttccacatataatcaatatcaaaaatatgaatgatgttttacattcttcttttcatcctgagtctttgaaatctggtcagtatttacacatccaactcagctacttggtccagccatgtgtccagggtcaatggtgatgtgtggctggtggccacctgatcaggcagtgaagctctggacctgaaaagcccgggactctggacctggcagtccccaaaggtacagacctctgaagaagtctgcattcaagatggagcttttatttatttgtttttattataaacatttttagagacagggtcttgctctgttgcccaggctggagtacatggctcactgcagcctcacctcctgggctcaggcaatccttttgcctaagcctccctagtagctgggactacgatcgcatgccaccacacccagctaatttttacatttttcttttgtagagacaggttctatgttgcccacgctggtcttgaactcctgaccttaagtgatcctcctgccttggcctcccaaagtggtgggattccaggcatgatctactgtgcctggccaagacagagttttaaaaataactaagagaagctatttgtgtagaaaaacaaaaagcagtagcagtacacattaaaattcttttaggcgactgatgaaaaaggatagctttcaacattcagctcaagatactgactaaacaatcattttccctctcctcccactgacatgatattaacatatacaaataaaataaacctatactattttgagtctgagctccagcctagtagttcctgtaaagctgtcttatatccttccaataaatctcttttctacttaaaaatctacaagattttctacaatacatctcttttctacttaaaaagcaaaacaaaaaaccaccagtggcattttgtgaataagcaattttattttatttgctttatgtgttattttcttattttccaacaataaacctgaatggttctgtggaaagaaaagttcttcgtgtttacaaataaacctatacctagaaaagccacaaggaacgccccgtggggaccaccccagtgaagtgtttctgtccggcagaaagtggacagacaatccggctcccgggagttcggggcacccgtcctccaggtggcagggggagcggtgagagcgggtgtgctcgcagggcgtgtggtcagcctgccatcgggcgggggcctgcgaagggcagtaggcaggtatcacaggtgagctcaccagatgggggaagctgccacagactggcaccacagcttcctgcaaaggggatctcccacccggaaaagcagactcggggcaaggtaggacaagtgtcccacgtcattcacagccacaatgcagacagcgagcctctggactcaggagacaagctgcctacaaacaccccggccacgtgccacacccagggcagagcgcctctgatgagcaggtgctgaggaccaggagaacaggttctcacctgggctaaggatacagcctctacaacaccaccacacacattagatcctcatttgtaaatgtaaactgacaaccgaggatcaatacacatttaaggaaaacaaaagcaagaaaaagacacacacactcgacaaacagaaccaacccctgagaaacagaatcaatacaggaaaaggagatgaaaggccactgcgtccgtcatggaagcagcagctatcccgaagaagaaacggtgtctagaaatgaatcacattactgctgaggtcagcgcttccgaagacaggctacagaggtgggagacgggagtctgagtggcccactggggtcgcgtgccctcagagcccggagaagggagacgtgcagaacagacagaggagtggcctttcctccctcacctgtctgaaaggctccccacgacacatgtccagcctctgagggatgaggccaatgacatcccagggcccaggcctcccagcttgtccttcacttgatcctagtcagtgtggtccagacagcagaataaagaattagaggaaggatgaaaagttacatccaggaagaactacaggactccactgtttaggagaaatgcatggcagtggatgagagggcaagatcagggaggccggggccaggcagagttttggacgggcccaagttcaccgtgcagctcgagggaccagctgaggctccaccagcggctgccactgacagccagacagccctgtcctgatgcaggaggcgggggagctgggctggcactgcccaggcgtctgtgtcctcactgtacctgccctggccgtgaggcgtccaccacggagggcactgcggaatctttgaaaagcacgttgctgcccggcctctgtctgatgggaatgctggggaagaaactgcaaactaaacatccatggaggatgacaacaggccagggggccgggcgcaggccccggctaaccatgagaaatgaagggacgtggccgtgtcatgggcagcagggggtcttgggggcccatgatgcagtaaaactgagggaaaatggtgagattaatagacatggaccctccctgaggaacttttcaaaagcagtcctcttctaagctgctttactgagcttaaaaaggaaatcaaatggaaaatactgagtaatttgggtacaatcagaaatctctgccggctgatgacgtgatttccaaatgaagaccacccgggcaatagctagtccgtggggtctggctgctgggaagatacccacggcattcgcctgtgcaggacgtcttacctctttgacgttctgtaaggtttcaggtgtaatcgtgaagtccacgggactgggagtaaacttccccttctgaggctaaaacgagaggtgaaaccgaaatcagtaggtgaaggccaagagttctgcaggtcaaatagcttttccctttcaaaaataaaccaacggcagcctggcgatgcaggaaggacggggaactaagaggcgcaagcctgggtcctgaacacagttctgtcaaatttccccatcttgctgaaactcagtttcctcatctgtaaaatgaggggagagatgtcttaatctccaacgtgcctttcagattcagaattttaaaatcagatctaagaaacagaacagtgttattggcaagtacttatttgaaacctcagcacagtgaccctccaaagggctcttcacacctcccagatggtcccacttcacagacgaggcaagcggggcagagagctcagtggcctgctcagctcagtggtggagctggggggctgagcattgaacccaggaggtcaggttgctattggcctctgagctatagagctgtcacctgaagaatcatactttaaacgttaccaaaacagcagtaacagtgatcacctccatgttacataatttcagaatctacagatacagccgagcttcatgagagcctgcctggcattttttatccaggggctgggatgcaaagggccagtctaccatccagagagccagggggaggaaaggtcctgcctgatgtgccgacgtggagtccctctggcccgcggcctcagctgggggactctgggcccaggacaatgatgcacacgtgatgcgcatgccaccgactgtctctgacccagaagtcttgtgtcttctgccagcacccgtgaaacagtaagaggctaaatggtgagcttgtaaatagggtaaactctcagaccccatgggagattcctatcattaagcaccagagtccccgagtgaagcttacagcggagtgaacgataaattcacaggtctttgtcaagtccttggccaacagagaccgcttcatgtcacagcgcagtgtatactaaaggggagagttggaggaaaaaagttcattttagtgggatttgctttcatcttggaattatattcaaagagacaagtcagtcaacatattttagggaaatgttgtacaatcagtgcattatagaaaattaacatacataatataatacataataggatagttaatgttcaaaataaaggcatttctgttttaaaaatgaaccactttaaggttattcttcaatctgtttgcacagctggcctgcagttggacccactggcaaacaggtgcacggtcccacctgtagcagggagcaggctggcgagacagaaagggcagtgcgctcaggagcagacgccaggccagatcccgttgttgtctgccttactgtgcgagcccagacagataacacaacttgtctgagcttctgcttcccttctgtagaatggggctcttaagacccacctgcagcgagactccaatgagatcatgtgtgacaagcactcagcacagggctggcacaaagcaatgctggaaaacagcagctactttgtaagcgggattagaaaatccatgcagtgaggactgcaaccctgggacagcacccagcatgtcacaacccttcctcgctgggcacctgctctgagtgcatagcactgccctgggcaccagagccaagctcaaggtcacacctggtcctcagggaacttctagtttactgaatatgcagtaacccacacatccatcaaccaacttccacaagggtcaactcatggctaatcttatttctcgagacatctgaggtctctctccatctgccaacacacagatgtagcctgcacctcaaagaaaaagtgggttggaaaacaatgtagcatcgcacttgcacacttgcttttttaatgtggcagagccgcattccatttctctgctgtccctaggttagttttctgagctggttgctaccatggtgcctactgcaaggtgagctctattcccccaaggggagccccactgcagagctggtattgagcttaaagcaggctttgaacggagactgttgcttcaaatccctgtccgtgagctgagagactatttaaaaatgtaattctacagcaggaccactgttgtaatgccagtctttaaaaaaaaatcacataatccacgtttaataaagttagttgttgttttaatcgtccaggaaaaacttcagaattatgtcaaaaataattttcataactcggactctatgcataactgaatcttccaagaagctaatattcgtatgaacaacctgtccgcatgaaataagaagttactatatatatttaaggtactactgggagagtaaaacattgtttaaaagaatcatccttgtctgcaaggatctttatgtagaatatatatacaatatatatattctttttttgttttttaatacggagtctcactctgtcacccaggctgaagtgcggtggcgtgatctcggttcactgcaacctccacctcctggtttcaagtgattctcttgcctcagcctcctgagtatctggaattacaggggccgcgccaccatggctggctaatttttttttttttgagatggagtttcactcttgttgctcaggctggagtgcgatggcgtgatctcggctcactgcaaactctgcctcctgggttcaagcaattctcctgcctcagcctcccgagtagctgagattacaggcatccaccaccatgcccggctaatttttgtattttagtagagatggggtttcaccatgttagtcaggctggtcttgacctcaggtgatccacatgccttggccttccaaagtgctgggattacaggtgtgagccaccgtgcctggcctaatttttgtatttttagtagatacggggtttcaccatgttggccaggctggtctcgaactcctgaccttaggtgatctgcccacctccgcctcccaaactgctgggattacaggcgtgagccacggtgcccagccctgtccatagttttaaagtagattcctataaaaggaatttttaactttgaaaagggatgactaggatctctagaaatgagtgctgaatatacaatttcagcagacatgttttatgtgataggataaacgcttgctagcacagctacaagagtaaagcaagagtagaacaaacctaataaaacttgcctacaatttaaattattgtaaaaagaagaagtagatgcacaaagggcaactacggaagactctgatgatcatatgaagtatctagtaacaaagacaaacatgaacgcaacatgactgagaagaatgtcaagctcttcatctaaaaaatgacaagaaagccaagcctctggaagtcaggaatataatactggcatttgatacatatacatatatatgtgtgtatatgtgtgtgtatatatatatatatatatatatatatatttttttttttaattaaaaaatttttttcttaagagatgaggtattgctatgttgcccaggctggacttgaacttctgggctcaagtgattctcctacctcagcctcccaagtggctgggtttacaggtgcatgccgctgcacccagcacgtctatcttttaaatcctttattctgatttatgatttttaccgttttagattgttacaacacaattcaatttatgaatgaaaaatttcttggcacataatttaagaaagatgatattagggtttagcaacaaaagtttctatccaaagaaatgtgcctatgttaacctttagagtaagtgcggtaaacagtgcgggccgaggagtgctggtctggacccgcaggctgaggctggcctgtgtgaccacaggaagtcactgccgtctctgggcggcacttgctctactataaaactgtaagaaaaagacctgccaaataatggcatgaatgaatgaatggatggatggatgatgacagatttaaaaaaacataatcttagtttctcttaaatttattttctcaaaagacgacaaattttgatatgaatcaagaattaatcaatacttgagaatttttacaaattctgataggtgtgcaaatgttaactgtaattatagagacaaacgtccttagtttttggagatgcgcaatgaggtattttgagatgaagtatcaagactctgaaactaactttaaaatgatttagaaaaaaatctaaatttttaggtgaacaaagatggcaaaatactattaagtgctgaatgacaataagtgtgataaagtcatggaaatcagaggttaagctaagaaatctcttcattgttagaaatcggtgagatagttggggaggtactgaattccaaattgtagtactctgaggttaaccctcaaatggtaaaatctgatgatgaaaagacgagggtaggggcaattattccctttactaaggaacccaccacctgttaactctcctactatattttaagtagcctccaatgtacacacagctctgcagcaacagaagcacacaagctttttgttttgttttcttttgtagagatgagatcttgcgttgttgcccaggctggtcttgaactcctgggttcaagcaatcctcctgccatggcctcccaaagtgcagggatgacaagcgtgagccactgtgcctggccagcacacacgttttctatgtatatctgaacatctgtcttggcaacatgtggaaaaggatggggtttccaatttgactttaaacaaattcatcttcttttggtaagtcttgatgaacgcaggagttaacaaatatgatcactgaaaacgtgatcttattccagtttctaatgaacatattcttgtatttttaaatcaaccatattaaagaactgccgtgtggataaagcaagtcgatactgattctgggtagataataaaaataatttccaaaatcaatgttcaagatatcttcagtattgccaaaaaggcatttttcattcagtttctttcagggtggaaacagtcccaacctagaaagctgatcagaagactcccacccacataccagcaattggtatctgcatggctacgtacgcagcttcctctgaatccaggtactactcagtcatcactgctgcttccttggggctgtccaaagcctttggtgctaacaataaaggactagaaacacttcttttcttcacagaagatgtacatcatactacatgtgtttcctctggacagatctcttaggcaattcataaaactcccatacagatgaatctttaaacactcacaggggtttggggggcttttattttaaaggttctattattttcagcaggataatgtatctactaaggccaaattattgaccaaaacttaataaatcaaaaaaattcctgactttcatccctcttgcatataagactgaagagttgtgtctcatccagcaagggaagtgctgcgaggctgctatcacaaaagtatctttctttctgctgcataaaggaaaggctatctcaccccgcgtggactccactgctcctgagacaacaacagcagactgtcaaagacgtcccttaaccagcagaggtagacaggaagtcataatccacttcccctcattgacaaggtttgttcagtaaagaacaccagcctatgtcaaagtagtagcctttgggtgttaaacaaagagatacttgtaagtataaaacagacaagttaatgctagtgccagaaagaagttagggcatatctgttaccagacaataaaagcatcccttacaatgtgaggtggcctgaaaagagcccagaagaaacagagggaaaagaagttacagcacgagtgccttgaggctcccatcagaaataacggccatacatcaaatgcatttatcagggaaatgagaaattaacgtcgaatatacatgcgaggtctcagcaataaacacagtattaaattcttgggcccgtctactaacgttgagagaaagaccacaccgtttgtcagaagaaaacttgtgaagtcagtcgcgtaggactaggaagctctcacctgaatgttgacaaacacgccatgatacgtctcatacagaactttgttacccttcaagtgcagaggaaattcaaaagggatttctgttttgccgctgggaaatttccccggcttcaccatttctatggtgctgttgataatctggataggctgtaaacaaaaatcagttcagtccatcagcacacacttggaaatgtcctttccaattactaataacgttctgaaggacacagcaccccgaccccctggaggccaccatcctgctgtcttcggcagctctgcgctgggtctggagatgaacagtgacttggctctgctttttaagactctggcacaataatgattcatttacaacatgagacacataggtgcttgagacacatgggaactgaactgatacatccctctctcctccccaggtatctcatttaactgttttaacgaccccgatcttcaggatcaagaagcagacccagcacagtgaggctgcctggctaacagggttgacgtgtgaacccacggctccccctcaccgagccccgtgctcttctgggcagcgctgcctctgctcctgacagcccaccagcttcctcggagccttcctgctgcagccgctcagggagagcaggcctttcctccagccctgtggcctgcacagacctcctcagctgggcctccaaggaggagcaggagggtactaacatttggaacctgccttcaaggcacgtattcatgctttttaagcatttatagtttaacatcagtggctcggagaagacccatgacttaggaagtgaatctcttaagtactaatggattaaaataaagttgtagaaaacataggaagcccctaaatctgaacactgtgaatgcacctttctctgtcttcactcttttccctgcaaaacttaaagcgttaatatgtccttcaggaaaaggcaactacaagaatagagaaagagtttacattctggaacacaaaactctaccctaaatgacaaaaacaacagttacttgctctattttcatcttaccttagtgtcaaatcaacagtagcatagacacagctaataaaatgacagttttgattttggaaggcatgtaacataagccacaggcacaacttctcagaagagctgtgatcttttttttttttttttggagatggagttttgctcttattgcctcaactagagtgcaatggcgccatctcagctcactgcaacctctgcctcctgggttcaagcgattctcctgcctcagcctcccaagtagctggggcacacgccatcacaccccgctaattttttgtgtttttagtagaaacggggttttaccatgttagccaggctggtctcgaactcctgacctcaggtgatctgtctgcctcagcctcccaaagtgctgggattacaggcgtgagccactgcacccaggtgtgatctttttaatggctgaaattaatacatttatagttctcctaatcctatttatcaaataggaataaatataagcagactttcaataacaggatatacttagaaacaaagtatctccattttcgcaggttgattagtaaatatcagaagtgtaactaccaccatcccttgcaaaataacaacagataacaataaaggcacacagcaagtgaaacccaccataaacatgtctttttttaagagacatggtatcttgctctgttgctgaggctggagtagagtgctgtgatcatagctcactgcagccttgaattcctgggctcaagggatcctcctgcctcagcctcctgagtagctgggactacaggcacgcaccaccacacccggctaatttttaaagtttatttatagagatggggtcttgctatgttgcccaggctactctcaaactcctgggctcaagcgatcctcccgccttggcctcccaaattactgagattacaggcctgagccactgcgcctggccctgagccactgcgcccagcccaacatttcaatattgaactaaaaacttgcaatctaagcattctttcttaccttaacagaattataaaaagcttcaaacacacccacacttttggcactgagctggaggtttacagttccttccatggtcaaagacactccctggtgttggactgaatccttactcgatatgaccaccacgccagagagcacttcctgggagagaaaagacagccaccaatcaaattagcatgcttcctccattctaccttgtttattagcaaacgtaggtctccttcatcatcaatttgtttaaagatccagacattcactgagacacctggataccagggtggagaaggcccaggtcctggtaggggacagatgcccactgataatgacgtggcagcctggacacacctgacggggagcacccgggtgtggggatgagaaacctcgtcccgtcactgcctctcagacatgtcttcattcctggttggggaatctcaacagatgtctgaattcaagagtgcaaggagaagggccagggcaaatgtaagttcccagtgatatcacacatgggcatggatgaggtcccttcaaaaggaacagaagaaaataaaactctgttcgttaggctctttctcaatagcgctgactaaaatgacagcacaactgcaaatgcatgagtaatttaacacgatggttagcctggtgtcctttctgcccagaaatgcctactgtgagcaagactggaggttattggtgccacccacgaggcagcagcatgccactttccagaaggactgccctgtccctgtggttcctgctcacaccaggaggcatcggcgcctccattcccttggttcacacatcatcgagagacttcacaacagatcatctgtgcatttatctgaagataattactgagtaatagattacggatagtaactgcattcgctattggagagcagtttcttcctgtcaccatagaactggatggtctcaatctgttacaggggctcgagtggaagaggaaattgaggggatgaaatagtatcaagcggaacagaaagactgaatccacaatccacacagaacaacacgtctcaggctgggcgtggtggctcatgcctgcagtcccagcactttcagaggccaaggtggacaggttgcttgagcctaggagtttgagaccagcctgggtaacatagcgagactccatctctacaaataataagaaaaaaaattagctgagtgtggtggcacccacctgtggtcccagctactggggaggctgaggtgggagaattgcttgagcctgggtggttgaggctgcagcgagctgtgactacgctactgcattccagcctgggtgacagagcaaaaccctatctcaaaaataaacagtaaaaataaaaattggcctgcagatcaaaccattaaaaaacatctgtcctactggtgtttaaatctgcttatcttttatttcttctagttatccagtgaaaaatttttaccaagttcttactttaacttgaattttggaagcaagaaatattctatgtcccttaaatgtgctaagtattttgtttttgtttccactccccatcccaaagccttgaagtctaattaaaacaaacacgatcatctccattttaagcaatcttaagaataaaatgagttctccttgaattctgcttaaaatggagatgactgtgtttgtttcaatgttaatgtttaatgtttaatttaatgttcctaaaaaattcctaagcagacttaaataaaaattcctgtgaagtaacttaaattctaagtttaattaacattaattctattaattttttgtatagcccaaattcaaatggaaatttaatattaaaaattcaggccaggtaacatggctcatgcctgtaatccagcactttgggaggctaaggcaggaggatcacttgagcccaggagttcgagaccagcctgtgctgcatagtgggactccttctctacaaataaaaaaattttaaaaattagccaggcgtggtggtgtgctcaggaagctgagggcaggaggatcacttgagcctgggaggtgaaggctacagtgagccatgaatgagccactgcactccagcctgagtaatagagtgagaccctgtctcaaaaaaagaaaaaaaaatttaaatccactagtatattttttaaagtttacttgacgaatatgtcccacaaataaatgagacaaaataatttgtgagctttatcaattgaaccacacagtagcgcctgaggatggtcccgttcctatgcagtcataaccctttccgtcagtctcacgggaacaggtctctgggtctccctgatgggcatattctaactatgacatcagtaaagccttttccctccttaatccctgcagcgtaggaggaaaaaagtagtgacatacctcggaagtaagcagagtaaatattttatgactcgagacacaatatagtacagaaaatacaaaattaacatttgtggataaattagatattcttataatatacaggtttattcaactcctaccaatgaaagaaggatagggaattagcccacctgaggccgagggccaagggatttagaaacaggagacggtttaacagagaggcaagatctgtctacacaatgcttgattgatcctggcagaggaagataggatacactggtagaacagacattaaggaaaacccaagatctcaccaagaacttctccctcagattttcgtctagactttcatcaggaagacataagatttatggctccagatagtactaatacctcgtccaacatcacaagcagaggccttcaactgggggccgtgactacaaagagggaccgttcacagactggcaacgaacccagaacgtatacaccgaaatcgtgtgcagggtgctactgttttgggagaagagccgtagcttctgtctcatcatggaggaggcgcctggcctgggaaaggccatattgtcaagtgggaggaggaagaggcgcagccccgtgtggtgtgcgtgctcatcagagaagccagcacagacactgggacccactcgcgtcaccaagagccaacccctcttcagggtgagtaaaggaaagagctttcattggaggaatgtgaatacttttcagttatccagcccagagacactgaaaggagacggcagtcccgtcctccccttctctgggttgtgctcatctctcgaaactacctgcttttgccaccagcagctaagctataaattccctcaatcacaccccatccgagactacagcccgcaccctagagcttaacaatggagagccaatcgcccatcaatgccatttctgtaagcctatgagaattcctggcaaacaactttgtatcaccccactccgtgtccccctttctttgccttaacaacctacttgtaacacaggggaacggagttcatatccagggtcactgggtctgtatcttctgggcagctgtcctctctttggctcgagtcagctctttattatactttgtgcctcagctgctttgctttagatggacagaggccatgcacccaagaaccacaccactcagagcctgcttcgaggggctcctccaagtccctgccctggaggagctaagtctggagagaggcctgaagctgcccatcttcaacctcagcccaaagagccgcctggaaacaagcattccaaaggctactggccaccttgctcttctcagctttgctggctctcacagcggaaaccactggcaagtttgttcaaaggggggcaaaagcaaccacattttctaactttgtattctcttttttttcctcattcactctgtcacccaggctggagtgcagcggcacgctgcaacctccgcctcctgggttcaagcaattctcctgcctcagcctcccaagtagctgggactacaggcatgcaccaccacacccagctaattttttgtattgttagtagggtttcaccaatgttggtcaggctggtctcgaactcctgacctcaagtgatccacccatctcagcctcccaaagtgctgggattacaggtgtgagcacccagcctaactttgtattctctaaatgtaaaaggccactaccaaactatacaactctttttcttatttgttctctgtaataaaatgccaaaaccataattggaactctggatttgaaaatagtggcatcaagtccgcgacccctcttggcttcctggaaatcacccaaagaatgagaaccaaaaccacaaactgcattttcggcgaggcaaggagatagctaaataccatgaaataggtggaagagctgttaaaagaagtgaagactgagcagggggacgtgatgaaaaacggaaagaaggcccccagctctgcaaacgtgcttcttctggaaagtgagggtacacctgggaacagctgaggccacacccagagaggcatcctgtcaacccgccccatgctggaagcagtcggtctctgcagtggtggagacaatgagcccctctgcaaggtgcaaacgccctgcagctggttactgcatgggctcatgcaaagtcaagatgaaagaaactctcacgtaaatcctccggctattagaacactccagccagcctggtctaggaataaattcatctcctgcaaggagaggttaaaaggaaccagcagaggagcacatgacatctaatggattaaaaaatgagagtgggaagggaaaggaaggaggggaagtgaggaaggagagaaatacgagtggcagatgaatgcgaaagccaggtcaggtcactgttccacttagatttttcagcagctcaccatctcaagcacacagtaagagccacagcagcctacaaagggggacccgccctctccttacctgacggccctcatatggggccctctgctccctcgctcctgccctggcccccttgccattcctttcagaggcctgcacattccagccttaggcaactgcccacgttccttgctccacctgcttgttcttctcagatacctgcaggactcggttccgtgagcccacatttgaaactgtactactccctccctagcactcattatcccccctccctgactgactgcgctctgtgacacttacaccttccaaaataagacaaaagtgcctccctattttatttattgtctgtctcctgcccctgaacataaactccaccagggcagagtgattggcaacagtaggcattcaatgaacatttactaaatgaataaacgatcattcaccagaagaaaaatccataccatcaagcagatgaaaatggtgaatgtgcatttcaccatgaatttgtaaagtccgatgagacaattgcttctataaaggatgaacacaaaacagagctataagagctcagggaggaaatggtgaggcaaaaggaagagataaaaatataggaaagctcagaaaagaagtaaaaggaaaaaatcaaaccaccacagaaaataaatttaaaagggtctaaggatatatgcagggcagaaatgacaaaatccaaataaattaaatgaaaatttaagaaagaattcaaaaagaaccacaaagagataaaattggagacaggtaacaaacacacagctatgcctaattaagttccaaataagaaaactgaaataatgaagcagaacaaatatttactgtgataattcaaaaacagtcaagggcaaaggaattaggagcactcaatgaaaatactctgtagcaaaagtgttctcattcaaaaaagaaaatatccttttggagtcaggaaaaaagatcgagtcactcataagaggaaaagaaaccatatttctccatagcaaaatggaattcaaaatgcaagcagaatgatacaacaatgctcaaggcagtgaagtgtgaccctagaatttatactcacctaatctgtcattccagtgtaactgaaagttttaaatgtgcaaaaataaaaaaacccaaccaaactaaaaaaaaaaacatatcccaagcaatactatataaaagtccttcttgaggaatgtactaaatagtaaactatagctatccaagagatggctagaaaaactatgtcaaaagaaccaactgtgaggattaactccatttaattgtaagaagaagactgagataagtgatgattataatgaaagaagagaatgcaaaatataagtcctgacaatgtagaatgtaatcgacactagctgggagactaagagaactagaatctaggaagtagtataatgtacatggctttcccatctttgatggctgggatttaaaaatgtattattcaaaccatacttccatacttttaagacagggtcttattgtcacccaggctggagtacagtagtgtgatcatagctcactgcaacctccacctcccaggctccagtgatcctcctgcctcagcctcctgagtggctgggactataggcacacaccaccacacccagctaatttttgtattttttgtagagatggggttttgctgtgttgcccaggctagtcttgaactccagggctcaagcaatcctgccttggcctcccaaagtgctgggattacaggtgtgagccactgcacctggtctacacttttcagtatggtagctgtaagccatatgtgactattgaaacttaaacttatattaatagttaaaattcaggaccttccatttcaagtgtttaatagccacactatggccagtggctatcataagagacagagcagataagaagtacattcacatcatcacagagagctctactggacagtgctgatttaaagttaataagtcaaataatgtcgtacaaataaacttaacagaagtaaacaacgacgaatactataagtaactaagatcaggtagtagcgggaagaaagggaaaaggaaagaggaaatatgctaatttaccattgttcacagtaggaaattaataaataatgtctaaaatgtgaagattcaggtacaataaaaagttgcaagggtaacagttaaaacaaaaataaaactccagatgactagaaaatcatacaaacaactaaagcaaacaagacagactgtaaaaagatgtttcaaaagctacttaaaaacacattccccccaaccaagcaggaatgacagaattaatgccaaacgtatgtcatattaacaaatgagccaaattaatgcctattcaaaaacagacatgaatattccattacaaggcaaaacccaattttatgttgtatgacagagaagcacctaaaatggcaggggtggatttggagaggataaaaaagaaaggataaacaaaggcaaagaaagaaggcatggattgtcaccttaatatcagacaatgctgaattccgagaatgaaggattaaacaagacaaaggggactttacaattctaaaggagcaactcacaataaagacttgtgaggccaggtgtggtggctcatgcctgcaattctagcactttgggaggccgaggcaggaggattgtttgagcccaggagtttgagaccagcctaggcagcatagcgagaccctgtctctaaaaaaagaaaaagacgtggtattattatctgcagatcaaacagtgtccacacttgtaaagcaaaaactacagggaatagatttaaggagaaactgagtaaaacaaattcgttgtgggagacattaatttacagatcatgaccaatagagtagacagaaagaaacaaggatacagaagacctacgtcacatatcaacagggtataatgaactggcatacatagatctctataccctgaaaacagagaatatgctcttttcagtgtccatgatatacttttaaaaactggccaaactgatcccttaataagtccaataggtctttcttctgggggtggggggagggggggaacaaagcaaattattaaataatctaatcaaaaaagaaaaacacaaatatccaaaataagaaataagagcagaaatactagaaaaatggaggtaattaaaagataatattcaacactattcaactgtatataagtaaatttgaaaagctgactaagtgaattatttttctgggaaaatataatttatccaaaatcactccaagggagacatgaaatccaagcaaatcaatcatcatagaaaaaataaagttctaaataaggcccccaaacccgacagcttcacaggagatcattccctgaatttttctgtgtgaagaacagaaaattccactataaaactattagaaagcaacgaacttaaaaaaaaaaaaaaagccaacataacaatgacagcaaaataagacaaaagtctacacactcagagagagagacaggagagagaagagagaaaactagattattctcatttgtaaataccagtgcaaaggtcctaaataaaatattagcaaatgcaatccagtagcaacttaaaacaacactatacataaccaagtagaattcagtcaaggaatataagcatagtttaataatgagaaaactggtaatacaactcatattaatagctattaagagaaaaattatatatagtcatctccatagatgctgaaaaggcatttgaaaaaatttatgcattcttgataaaattcttagtaaaataatagaaggatgaccaaatatatctaccttaccccaaagccagcatcaaacttaatgagaaaacaagatatcatccatttaagtcaggaataaaagaaggatgtccactatcaccacaattaacgttctgcaagtactagttaatacaataaaactagagagagaaagaggtaattcaaaggcaggaggtaaaatgatcactacttgcacaatgagtgtatacctgaagaaacccaagggaatccactgaaaaactactatcaacatgaagagagtttcagaaaagatgacagctgggtacaaaattaacacagagaacccaataggtatcacatataaaccaacaactagtgagaagatacaatggaagaaatggccttattttcaaaaggaacaaaaagttaaaatattataagtcaatttcacaggaaatgtctaaaactcccagatgacaaaacttaaaacatgcctgaaagccacaaaagaaaatttgaagaaatggccaaccatgccagattttgaatgggaaagatttaatgcccttaacaaatctactttcccagaagttggtttataaaggcaacctaatcttaaaagaaaataacaccacaattgtttttcttttttgagggggagatggcgggagtgggagggatacactagacaagctgattctgaagtttatatgcaatgataaatctgaaaagaaggaaattggagaaactagccctgtgagatattacaacgctgctataatttacaaagtgtcatacagcacacatgttcaggctgaaagatcaacagaacaaaagtctagaaatagacccagacagtatgggaagctaatgtttgataaaggtagcatttaaaatccttagggaagagagggaatattcaataagtgatactgggaaactggccagagaactcaaccaaaaaaaattaagttgggccgggcagggtggctcacgcctgtaatcccagcactttgggaggctgaggcaggcggatcacctgagatcaggagttcaagaccaacttggccaacatggtgaaacaccttctctactaaaaatacaaaaaattagccaggcatgatgatacatgcctatagtcccagctacttgggaggctgaggcaggagaatcacttgaactcaagaggtggaggttgcagtgagctgagatcacgccactgcactcctgcctgggtgatagagtaagactctctcttaaaaaaaaaaaaaaatcaagttggaccatactgaaactttttgtgtatgacaaatgtagcaaatacttaaatgtaaaaactgaaataataaaagttttggacaaaaccatagagaataatttttttcacatctaagtgggaaaggcctttctatgaatgcctcaaaactctgaataaatatggccacaaatatgactatgaacaataccactatataaatgataaactaggtaaaatacctacaacttaatataacaaattagcaaagggctgatttccctaatattttaagaatgcctaaaagaaatcaatgaaaggctgggcgcggtgctcacgcctgtaatcccagcactttgggaggccgaggtgggtggatcaggaggtgaggagttcaagaccagcctggccaagatgttgaaaccccatctctaccaaaaatataaaaattagtcgggtgtggtggtgcacgcctgtaatcccagctactcgggaggctgaggcagaagaattacttgaacccgggaggcggagactgcagtgagccgagatcacaccactgcactccagcctgggcaacagagtgagactccatttcaaaaaaaaaaaaaaaaagacatcgatgaaaaagataactcagaagaaaaatgaaaaaaaaaagggcaaatgatctgaacaaagagctcacagaaaagggaatgcagattgttcctaaacacagaaaaatatgctcaatttcaacaaaaatatgataaatagcaattaaaacaaagataaaaaaatgtcattacattgtgttgccagaggggaggcaataagccttctctgcattgctggggataacctgaaatgttgcaacctcgtgccggctatttggcaagaccaaaaacattttacaaacacatgggcccagcagatacatttgcagatgtgagatgacttatgaacatagttattcactgcaacactgtttgtaaataacaaaagatggtcgacaaactaaattccaacaataggaaaattgtgagttttctttcaacaatgtggagatcatttacactagtacatatggggatgcagggctagtttccttcatttatcttaagaactgactccttattgcatatgaatcagcatgtccagtctacgccccctcactcccatacattctacttttttttaaaatttaagctgtatattgcaccatttgtgaaaaagaggaagaaaaagcacatttgtacatatttacttgtagatgcatacagtatctttggaaggaatcacaagaaattgatagctgtggttgccccacaggagaagcccttgatgaatagggtgggtgaggcagggggtatcgatcttgaaattcatgaatgttgaaccctgtgaattgattacctattataatgaatccatttttaaataaaacaaaatcccagagtgggtagcctttagacctcaatgtacaaagttctaagcctcttaaattttgataacctataggcctaatagtctctcctcaggaaaagatctgaagattgtgtgttaaaaagtcacatttctttgggttagttcttattttggacttgaacacaactgctagaaaagtaaaagcctctcaacgcctcagccattctctctgcaatgcttttcctttccaatggtcctggcagtgggatgcaccatgacagcccatcttcgttccccacagtcgtgtgcatatatctgaacaaggccttccctcctaaaccacctgagattctgccatcccatttggtctaaagatccggtacacctatagtgagatgcctttttatttaccaatgaggaccaaatgcactaagtagtgaactaacatgaaaacaaaacaccaaggtaagttactgagctgggtgggaaaacatgagtgagacaattaattgcttgttgaaacactctaccctttcttagtagcactgagagacccattttgattagaaagcggaaatcagaaacattaaagagatttcaatgtgttaggtatccccatctccactattttatgtaactgtttccatcttgtctgaaaaaacaggataaacaatcctcagatagttctccacatggtaagtaatggccagtattatgtgaaatttactgaagttccaggaaagagaattttgcatggaatacactatctccaaactatcatttaaactgagatactccaatgcagttcatttcctggtacagaaacaaacaaacaaacaaacaaactaagacaatgccactcagcaaccccattcctagattttaaaacccaagtgaaatgaaagctatgttcacacaaaaatcatgcccaagtgcttctgggagctttattcatcatcacccaaacgtcttctacaggtgaatagatgaacaaactgtgatacatctatgcaagggtggacaactcggccatcaaaacgaatgaactattaacacacaacctggatgaatccgaacgaaatgcattacgctaatgataaagccagattcaaaggctacaaagcacataatcatatttatgccagttacgtgacattctggaaaaagcaaactatagggactgaaaacaggggctacaaaggagcacaggggaatttggggggtgtcagatctgttccatatcttgaattgtgggtggctacagtctcaaggaactttatactgaaaagagtcatctactgtttgtaattatacctgtttttaaaaaacacagaaattatcacgtataggaggaaatagttatattactttctggacaattgagtcatattctaaaattgattaatgtttaagtaaaatctacaaaagttagttcactagcaatgaaactgtaacaaaataacaagatatcaatttacatggcttacatacatgtgctgccaatatagagaaataataccatcatttgacaacttttttggcatgcttgctgtatcagacactgttttaggcacttggacatggcagggaacacaacaggtgaagcccatgctctgggggcttatgttttagtatcacattctggggcagaaccaacatggtaaaacatagctggttccttctacgtatggtatagtatacacacaggcgtcaatactaagtaaaatgggctgacaaaaagcatactgtccaatagtgtgatgtgaaacttcaaaatctgaaactttcttgagagcctggaaaagaaactgaagccactgaacaaaagtttaaaagaaagggaaaaatactattcataaaaagtaaacattaataaaagtaagtatatgcaggatctttagcagcagagtattaaattctaatcatggtgtgttgcgtggcttcaggagttagatagcacatattaacaaaattatgttaatagagactacctgatttcagatttcaataggatggagcatccctagtctgaaaatctgaaatctgaaacgttccaaagtccaaagctttctgggcactgacatgacattcaaagaagaccctcactggagcatttcggattctggatttttggattagggatgctcaaccattaaatatctacaaatactccaaatctgaaaaaattccaaaatccaaaacacctctagtcccaagcatttcggataaggactattcaagaaataacattccaacttgtaggtttacaaagttgacattcgtttggaactactggcataagtgcatgtaaagactccagactataaaccaaacatttaggagggctccaattacaaaggagcctggaattggcataattacaggccaaagtaatgaccgtggaacacagggagtccgccaaagaaaatgctctgtagagccagcccacacttatatatgaacaaccaaagagccagcagattgaaatcccagagtgaaatcatgtatgaatcacgatagtgcagcattcaaatccaagccaggatgcaggcaaacttcagagtagaggacaagagatgagtctagcagcaaatgaggctaacagcctaaagggcccttgttagaaagcaagagcacggttaggtggggtggctcgcactgtaatcccaacccactttgggaggctaggatgggaggatcacctgaaaccaggagtttaaggctgcagtgagctatgattgtgccactgtgctccagcctgcgtaacagtgcaagaccccatctctaaaacaagtaagtaaagaaagaaagagctcaggctgggtgcggtggctcacgcctgtaatcccagcactttgggaggctggggcaggggaatcacctaaggtcacaagttcaagaccagcctggccagcatgatgaaaccccatctctactaaaaatacaaaaaatagccaggcatggtggcgggcacctgtaatcccagctacttgggaggctgcggcaggagaattgcttgaaccaggaggcagaggctgcagtgagctgagacattgcattctgcctgggtgacaagagcaaaactctgtctagaaaaaaaaaataaataaaagaaaagaaaaaaagagctcagcaaaaagagcactgtagggtagatcacgtgttaattaagcagtacggaacagggtctctgcttcaggttaatccagggtaggctctggggacagatcacctaaggctgctctatgaaactactgtgagatgcagagaatgtcatgtggttaattctgggcactgttcatggggcagcagaggagaaggggcagaagacattcttttgtattagttgcattttcttagcaagtaaaaatatatattttcaatttacaaaatggttttttaaaatctgaaacacacggtcaaactatcatgactgtattttttttagattagaaaaagcttagtttttttcctgatgattactgaagaatgggatttctgcccatcggttcctaattttccattgacaggactgcttgctgctcctttcccaaaggtgaagatttgggttttagagaaattgtcttaaataattctttctgataaaacaaaggaagagctaattttgggctgaaatcatgcctggcatgtgacagtaaaaccataaacgtaaataagacactgtcatgggggaacggtagtgaggatgaagggaccgcgaccatcactggaaagcatgtgagccaatgctactggccaccagagacctgcccaacggatcagagcacacacagcaggtgtaaccctcacagctacccagaggtcaattctgtctgagcatcagtaatccagggtcaggacagcttgttcctatcagaagcaaaagggccacaatctcatgttgtccttcccagctcaagttcccaggacaagtaagtaggacaacagtgaaggtctccagagcccaccagcttttgctgagactgctagtccaagagccccagctgagtaaattctccaggaggaaaatggcagaaactatcaaaggatagtcagtaaactggtgggtctgtacctttttggcttaaatgctccagtaaataaaggcaaaatatttaaagcctcattctatgcactgcatttttttttttttttttttttagatagaggctggagtgcagtggtgcaatctcagctcactataacctccgcctcccaggttcaagtgattctcctgcctcagcctcctgagtagctgggattacaggtgcccgccaccacactaggctaatttttgtatttttagtagagacagggtttcttcatgttgttcaggatggtcttgaactcctgacctcaggtgatctgcctgcctcggcctcccaaagtgctgggattacaggcatgagccaccgtgcccggccctaggcactgtattatatctgaaagctaacagaacttgtaagttttgacacaggaccaaattaaatgggttggcatgaaaaaacttcaactttgttgcctcttgctagtcacaacatcctataactaatactttacaagagaaccactggccgtaggcctgtgaagacacctcagcagccactttgggatgtgaggaagagtcagggaagggagggaggaaatagatattctcacttaaagtagaacagctctgcttttatctgtttataaaataaagtattttaatatgtattattaaaattgacattagaattttatataagacttcatttaataaaagggtttcattgcttttttggaaaatctttatgctaaacgatgttcattttattgacttatttataaggaaacaaccatttgtaacttaccagatgaaaggtaaaatctattttctatcaccttggaaaggcactatttctctgagcctggatttgttttctgccaacaagtgacggcacaagctctctattacagagagtaaaaagcccaggcagtctttttcatggctgctcaccatgtaaacatgtccataaagtgttctgtgtagctaagttagaggacaagaagaagtactttacaaaaattacatctttacatatttgcgtttgtatgacatacttttttcttttattcctgataataaagttttaccattttataatttaaaaatgtaaatatggagttgggcatggtggttgggaggctgagaccagaagatcgcttgagcccaggggtttgagaccagcctgggcaacatgcagaaaccctgtctctacaaataaaaaattagccaagcgtggtagcacgcacctgtaatcccagctactcgggaggctgaggcaggagaatcgcttgagcctgggaggtggaggctgcagtgagctgagactgtaccactgcactccagcctgggtgacagagtgaggctctgtctcaaaaaaacaaaacacaaaaaaacaaacaaaaaaaagcaaatatatgtaaaaataggaagtgcggtttcccaaaatgaggtctgtaaacaactgatctagaaaatgttctggaaaaagtaaaaaaggatcaggatctgaggtcaactgacctctccctgcgctctggacaggcaaacaggcaaggttccctctgaggccgtagcggcttctcgtgggcgagtccctgttcgcaggtgacgtgtggaccacgctcttccgaagcgtctggcctgtgtgctctcggggaggggacgcaggtcagcccacctagccgatggctaacaagtcagtttgttttctgaacggaagcttaaacctagaaaagtaactgggttggggtgggggtgtagccacatgcagtaaaagcactgcctgtctgtataacaacgacctgatgaaaaaaggaacgcgtgaaatggggagtgttagggcgtcacaaactccagtgtggttgaaatgaaagcagaaagcaaatggcaagctggcttccccttccagcttttcacaaccctgccttgctcatggtcagccccaagcacgggcggaagaaaggactggaggggagggaaaggggtggggagcgagggtaccagaggcgtgggaggacggggacaaaggggcagcaagggaccggcggaaaggaaagtcggcgttagctggattggaaacagtccagacagaacgatgggctctgctgcctccgggtggggcaccaagcggggagcggggccacgaggcaggggacagtgaagcaccatgcagcgcccaccagccggcagcgcccaccagcctgcgctgcgctgcacatggtacccgcggccccagctggccagtgtgtggcggagatgagaccctcgtgaagagactaagcggccacagcagggggaagggttgctcacataaccccatactgctcacactacgaggttaactgccgtgagatctgcctgcagccagcagaaacccgttctaggaaaacgttgcccagtgacttcagtgagtgccactgacccgggcgcctccgccccggcgtccggcagcagcaccgattgcgcaggaggcaccttgcaaacaacctttcctgatccgcgctgcagttcccaggccggttgcagccgtttcacagagactgcgcacacaaagcgtctccgtgccctgccattcacctttcgacacagccgcaacccctcttttcagtgttaaaacctggcgccaaaaggaacatgcgatgtgacgtgttacctctgcgcatgcgccgggcattcccagcgccccgaacctgatgaacgcgcggtggggaccccaggcttccgtgctttcgttttcctggaagctacgtgtcctcagtctacatattgttacctggaaaataaagttttctccttttttcttcctttgttaacaggcagaaggtgtaggctgcaggtttcgggcctaagagagggcatggctggcgacacggagtagactcctagatgacataacggaggcgagtctgcaccggggactcggcattaggaggaggcagaggaaaagcccaccaccgtggccgagggagatctagcaagcagcttgcagggggtgaagtgtgtgcaaagcaggctgagacctgtccagtatcgaaacacgccgcggtggtcaagcaggctttaccatgctcaggcgcaggctggtacaagatttgcagcaacaaacaccaagtggagaactacatgaacacttttgatcgcatcccagttttcagacaatctcggataattctgaaaatgcttcttatgcattatataagagtttaggttatgatttaacagacaagctttttcaggagtattaggttattggcagaagaagagacctacttaaagtttggatgactgtattcctaaaaggttcatacctctcaaaattaccttaagatctcttctggctcagagatttaaatttttataccctaagtccttacaacaagcattcactgttacaactgatcattcatttactaagaatccagcaggttaaagtagaatatttaagcttaaaaaaaaaaacaaaaaaactagcattttagctttgcaatttttcttcataataatgaactgttatgtatagggtttctcctttttttttcataagaaattacgggcatgcccaattaaggtagtattgaggttcttaaggtaacagtactcagtccacagtgtataaatttcttctcactgtaacctggctatgctggggagtaaatctcttatttatgtttttcacaaccataatatttaacaatgtcattttcatgagtacatgtgccagaatttaagaatgtaaaacattctggatttataaaaacaaatgaattatatttacactacagaaagatttactgcaggatttttctaaccaataagctcccctacagcgttccaagacacaaagtaatttacagtgcatttgagtccaactttttgatcaagaacacatctgctgcactaagcaaaggagttgcagcaacaccaaaatcacacttggctctcacggccaaaatcgccgtcacctccgtatgttctccttggtcactgactctccttcctccaagcagacatagacagtgggcacatatttgacaatctgtgaagcatctgacaagcactcattatgccatttggagggtgtactaacgtaactagcattgtggcatacaaagggcaattctaagggtgaacagacttcggagcgtggaaaagaacatgacaatgccaccacctattactgcggcccccacgaggtgttggaagctaggataagtgtcttaaaacactatctcatttaatttttaaaatacaacctttgagtaggtatcatctccattctacagatgagaattaagacccagagaaggcacaaagaatcctggatttaggaataaaaagatgcaacttcaaatatttgctatcatcagtccccctggcatgtccctgaattctctgggcctcagtcttctgaaccacaaaacggagaaaacgctacctcttaacagtatatggaggattaaagcactctgtgagctggaaaaggctatcctagtctacctagttataaaacagtattagttaggtgtttccatgggaaatttaatctttcactggaagtagggaattagggaatgtttaacacaattcctgattatctcatatcacccatgggtctttggaaacagaagtcaagtttttaggccaggtgtggtggctcatgcctgtaatcccaacacttttgtcaggccaaggcaggaggattgcttgaggccaggagtttgagaccgacctgggcaacatagcgtgatttcatctctatcttaataaaatacttaaaaaaagaagttttctacccaagtggaaggatgcttagggagaaggtgccccaacagcaatgctgcaagcttggagaaagggtctatattcacgctgagccacaggaactgggatgaagaccctggaaaatcaaaccttggacaattttctattatattccattcctgaatcagagagaaaaccatatttataggaattctggaatctctactcccaatttatttgaatcatgatcttaagaatgactattttaaagcaaatacaagtaatggtgggtgcaatgtgtagctctggggctatgtcaaaataagaataaatcttatcaacatctgtctgaaattgatacctagaatattatttataattacgaagcaaaatccataatgtgcctacaataccatagtttcccctttctgatcaatgcatttataaaattatcagtcttctgcattttgtttaaatgtttcagggcttcaactcatcatttaataaagtttttgagcacctattaagtggtgagtactgccaggcccaggaatacaaagataaacaaaaccaaatattttaattgagtggactaatagaacaaagtcactacaacagaaggtaatcagtgcaatgacagcagtatacacaaaatgtgtttgtaaactattgccagttactactaaattacagaaaacattcccatgttattctgttcactttgtttccttcgctgtgtagaagttttttagcttgatgtgatcccatctgtccatttttgcttgggttgcctgtccttttaaggtattgctcaagaaatctttgcccagaccaatgtcctggagcattccccaatgtttcttttagtagcttcatagtttcggatcttctaagtccttagtccattttgattgtcattcccatgttattttgtcttttcctgacaattagacttgacattccgttatcccatcacaatctcactttcttgttagttactctttttgtaattctgcttgtaagaaagtttctaaaatttaaatattaaaattaggaatttttgtaaggctatgggtgacaagagttgttgctataacagaaactgaagcacacatttctatacaactcatgtcaaaaaaaaaaatggaaattagaagatattttaagttgtacaatgatagaaaatactaccaatcaaatcttgtggacacaattttcagacttggcagtgaagcattatctcggggtcctctgacattcccacagtgcatgaggttaccaaaccatgaaacctcatcaaggtcctttggagcagggtcttctcccagaatctagatggagtgatcctacttccagtctcctctccagcaggatgtgggtagggttacaagggtttgccttacaataattcactcacctattaaaaagaaaaataaaacttaaggtacgaagtactacttagagtagtacttagtgggaaatgtctacatttttaaaaaggaggctacaattcaatatgctgaacagccaacttacaaagtttaaaaaaaaagaacataataaaccctaagaaaacagaaatattttggaaagacagtcaacctaagtcacattaaaaaactgctgttgctgccagattagatgaggatgagcaactataaacacctggtcaaccaagtaaaagaaacagtctaaaggactcaggttgcgtcccaaatgtctgcaaactcttcttcaccaggtttacattgtctattcctcatgactgaaaccagcagtgcatggtgggcacttagtttaacactcagttttcaaaactaggtttgatgaagctccagaagggcccccagcttctcccttttccccccagatgactataccctactttatgctccttcatacatcacagatgctcttatttgagcacttgatcatctttttaatcatcttttattttatatatttgcctatctctactaacctgtaaccctcatgagatcaacatacattggctgaatgaagctgattgattaaataatataaaaaagaatgggactgatgaaaatgttaatatgaaaaggtatccaagataaaggtacattattaagagaacaagttgcgtgtgtgtgcacacgtgtgtctggaacactacacaaatcatcagtggatacgtccaagggcagaacagggagtcaggaagagtaaggagacttcacttttcattttaccttcttctgtagcacgttaatttttttttttttttttgagacagagtcttgctctgttgcccaggctggagtgcagtggtgtgatcttggcttactgcaacctctgcctcccgggttcaagtggttctcaaacctcagcctcccaagtagctgggattacaggcgtgcaccacacccagctaatttttgtatttttagtagagatgaggtttcgccacgttggccaggctggtctcaaactcctgggctcaagtgatctgcctacctcggcctcccaaagtgctgggattacaggtgtgagtcaccgcacccagctgggatattacattttaacgtttatattttttaaatgcttcaactgtaatttttaaaaaatcattttgtcagtgagtattttttcttaaaaaaaaggtcaattttaaatctaagtataacttaggtttctctggtgtccacagaatcaagccattttcaaatgcttccacaactaagatactgaaaagcacaataacagaatcagcatatattcaaagtagaagtcatatcagtctctttttattgaaatatcacaatgttattcacagcactcctacgaaatgaataacaacatttctatattacaaattcctccattttgcataaatggccactcctagggaggcagaataatagagtgttcaatggacatgctttgaactggaactgatctgagttggaatccagactctgtccaattagtcgggtgaagttcttcaacttgtctagttgggttatgaaattcatcaacttgtctaagccaccatttcctcattagaaaaatgagagtgatactgcctggctgtcaaaccctaccccagaacctctgctggaacataagcttgccttatgtgcttacgctgacaaacacgtttcacttgaaagacaatcacttaatgacctcaagcctgggatagtactgcttaggatcaggctaaagtaggtggcagtcacctcaagcaacccataagaattgtaggcatggtgctctggcaggtccataggtaagtcaaatctttggtaactgaatctttactgtcactgttgagatgtacggagaaaagagaaaatgtgtatgctatcagctccattgcagccagctaagggtgaggaggataggagagaagggccgcttctcccacaaccacagcgcaaactagatgtgacatatgcactgtctgcagtcaatgaggcctcctcaaggaccagacagcaaggatcctgctacgtgaggcttggaaaacagccatgacagtgctggctgcctactccacctaccctgaattacagatcatggagtctagcacatgagtcatgggcacacatgtcagagatttttgtcaattgattaattagtttaataactttctcttttctgtcgccttttaaaaaaacatagcaaccatctatttggaagttatactggtttttcttttatattcaccatataaggtttcctttaaaatgcatgtaagtataaaaagtgactgaaggttgagagaagctgccttcagccatcaattgcagatgctgttccttatactagcaccaggagatgtagtctaagggacagagctgactctgtcttcaactctgtgacccgcaggaagtggtcctggctgtgtatgacttctgctggggcaactttaccattccactgcttgtgtcttttctaatgtacttttcattacttgtatcatatttaaaaccacagaaaatatctcagcatcccagctggagtaacatttctgaagagaacatgctaacttgttaatgaaataatgaatactaaagttaaatgcatatatagtctcctgtcactgccctcccattgttattttgaaacatttccaagctccagaaaagttacgagaatacaaagtagtggaaaaattggaaccgtcatacagtgctggtagactgtaaagtggtgcagacatttttggaaaataatttggcaactcttcaaaaagttaaagtagctcagcaaaatccactcctaggtatatatccaagagaaatgaaaacatcctctcacataaaaacttgtactagaatgttcataacattattaatagcgaaaaggtagaaataactccaatgtccatcaagagaccagtggttaaacaaaatatgatctatccatacaatggaatattattcagccacagaaaggaatgaggaactgactcatgctatgacaagcatgaacactgaacattactcgaagtaaaagaagcctgtcagtcaaaagggccacatagtgtacgattccatttatatgaaatgtcaagaataggcaactccagagacaaagtcaatttgtgactgccaggggtcaggagggagggggaatgaggagtgacagctaatgggttcagggtttctttttggggtgaaaatgttctagaattagatcgtggtgatgggtgtgcaactctgcaaatacactaaaaaactactgaattgtatactttcaaagggtaaatttcgtattttaaattatctttataaagctgtttttaaaaagaatacaaagtagacccatgtagcttttaacttcattcagcaattgttagtattttgccacattcactttctttctcctatacacatatgtgcataaacatatgtgcacagtctacggcttgacactttgatcctaaatacttcagcatgtggagtattctacataaccaaaatataaatattacactggagaaattcaacaccaatatacaacaattatagtccatagtcgaatttatattttatcagaaattaagcattctatttggttctcatgtccctttagtcttatagtctagaaaaattatctcgcctttattttttgacactgatatttccgaagaatccacgctacttgtttcacagaatgcccttcaatttggatattccttattgtttccttatgaactgatacggattaaacatttttggcaggaatactacataggtgagttgtggccttctctgtgcatcatgccaaggggtaccgaatgtcagtcgtctcattagttgtgatggtgaagtggtgttcattgttgtgcttggctagaggagtgtgactaccagatttctccattataaaggtagctttttctctttttttttttttttttttttttttgagacggggtctcactctgttgcccaggctggagtgcagtggcacaatctcgtctcactgcagcctccgcctcccgggttccagcgatttttctgcctcagcctccctggtagcttggattagaggcgtccgccaccacgcccggttaatttttgtatttttagtagagaccaggtttcaccatgttggccaggctggtctcgaactcctgacctcaggtgatccgcccgcctcggcctcccaaagtgctggtaatacaagcgtgagccaccgcgcgggccagatttttccctttgtaattaaccatcaaggggatgaccatttgagcttgtgtaaataagagcaggcttccctagttgtcttttgcccaaaagttttagcatccatccaagacctttgtctgaaattctgtcccttttgagattactttgcattaatatgaccaaccactgcgatcaattttattccaaagagtgttggggctgtgatttcaaccctagctgcacatatatcaccggtatcgctgggagtggaacccaagcaatcatattttaaaattctccaggatgactgattctgatgtagagtaagggttgagattccccgagttagaggaaccttacaacaccctcatttgcaaataaggacactgaggcccaaggaggttaaatgactggccaatgtcacaaaacctgttaatggcatagtcaagattttacttttttatacttgcattttaatagccattcctttgtgtcagtcgaagaataaaaccagaaaaagcagtaactttcgtagtatgttagtatgttgttaaaagtgactaccatctaatatatgctgccgccagacatacccatttctgcttccaaggtttgttttagctttcgttcattagacctttgcggtcaccttaggagagagggaaaggggagtttggtcgtcaactcctccgccctcagcgctcactgagggagctcaagcctgagaacccaacaccgccgggtgttcaaggggccagatgggaagagcgcagccccggagctgggcgcctgccctgcacgtcccgcagatgcggcggcggcgcctgccctggggcctcctcgcagggcagccagcctcgcgcgggaagcacctggcggggacgcacctggcgggaacgcacccaccttggcggagacgcacctggcgggacagccctgccccgcctagggacgcgggacgtgcgcagagcgatggagacagcggaacctgcagacccgcccaaccccacctccatccccacccccagcccccacttaccccggcgtgataaactttattcgctcttttaatcttgatgtccagggcggtccccatctccaattctccgcagcagccgccacttccggctgcgcgtgaccccagggaaacaaggggcgcctccccgcttcgttctgggccccgcccctttccctctctgccggcagtggctcacgtgacctcgcagcggcgtcgcacacactccctagctccgaggggcgaatgcccacgccttcctccttccggcacaagagccggccttagtgcgggccgaagcgctgtcacggttcaccccgccccctctgggcgtgaaagacggggccaagctagccccaccccttccgtagggacagtcttacgccggaaatgctcctttgctgtccgggttagcggagggagggaggaacggctctccccgcgtgccccgcggctggaggcggagccgagcctgtctgtcggttgcagcctgcgcaggaaggatgacgctcccgtcaggctgtgcggcgcagacggtcgcccaatggagttgtctttcaggaggttttaacttggtaatgcctgccctcctcaaatgtccttagtctcctcaactctagccctccaccgctttctccctggggttctgaagagccggcgcccccttgtctgtctgcggccaggcgccgcaccctgcccttcccgcgggagcggttccggtcaccctcaggggtgcggcccctgcgtgctagtcctgcaaagcgctgattggccggcggctcggttgcctcgcgtcccagcgccagctgggcctagggccaaggtctcgggaagcgccgggtgacctcgctcctctcggagccgcgggcgctgggtcacccgccagccgggctccgcgggccgcgagggattgtgggtgttccccaggcgcgtgtcctggaaccgggtgttaaatattcagatccgtgcgccccgcgtgaagggtggaaaggcacggcccccaggctctggggcttggagattggttgcaaatgaaagactgaaagctggagtgaatctgcctattatttttattcccagcaacagctgaccccagatacagtttgtgggggtggggggcgttactgcagggcagggcagtgcactgttaacgtacttcgtttattgagttaaaatctcttgtaaatgttataaatgaggattttgccaataagcagaaggtcaaatttcattttgacaaatgatttaattaaataatgcggtgaaaagtgctttttgtttaaattctttgctttttgtttaaattctttgattctgatcattattttttaaagtgcattgcttttgggataacatcagaaactatctgtaaaaagaattagtatcacgaatgcctccctcttaagaatataaaatgttttacaggccagcagtgatggtgctgcagctacaattgcatttgaaggttaataaatggtattttcaaatattcaggtcttggtttgcagctcctctctgccctcagggctttggtctctgtcttcaatgttttcctggcaattcaaaactcagcgattttagaacaattcattagggacttgaaaatcacagtctagtctatttgaattcaagaagtggatccctttccgctagactcacccatcattttcaagtggtaaaaaatcaatctcagtagacactgcagagaaacaggaaaagaaacacatgtatcaacattgtatacttggtttttttgttttgttttgttgttgagacggagtctcgctctgtcgcccaggctggagtgcagtggtgctatcttggttcactgcaacctccgcctcccaggttcaagcgattctcctgcctcagcctcccgagcagttgggactacaggcatgcgccaccattcccagctaatttttgtattagtagagatggggtttcaccatgttggccatgctggtctcgaactcctgacctcatgatccacccgtctcggcttcccaaagtgctgggactacaggggtgagccactgcgcccagcctccaatcgctatccttttaaatcttttccatccctcactcacaccttagatgataccttaactttctggtccatttgagttaccaaaaatcagaccgtgttaaagtgtcgatctcatgtctcaagtgggaccctaaatcccttagtgtgagtgggaaggtgcaaagcgtggttctggcatgcagacacttctcaacgtacctctgcaaggcctggcttctgtgttgagataaggaagaggagagaaaatgagacaaatatctcttaactagccactgctgaattttcttagttgattcctgcctctctggtaactgtctcgtttaaaattcctttcgtggggtacagatggggaggtcgggtggggccttctccctgccgcacagttccatgggagatcttttccatcacccgcccccgccgccgtcagcaccgggcagtacactcagcctctcaggcaagatcactcaggaccatttatcttccgcataggaagaatttgacccaggagaaatacacatctttgccacacaaaagggctggactgaagaccaccccgtggctactcctctctcccctgctatatccctcttcaattttgttgttcccccttgccatacagacagggataagtcagcaagagtgctggaggaacagatctgcaggcaacagatagaataccagactccccttccagcaggccctctgataccttggagagattgtcctatgtccttcccagctacatcacttcccaccagaaacaccgtcctccgcaataccgactgcctcctttcattccttcccctgccttcctgtatagattgaggagaggactggggaagtatttggtggaagcggggccagatctgcagctttttattaagccctgggggaagtggccccaattataggcatctttcattaggagatggagtactatgcctgtagttttccattgtgagcctagtgccaattctgggacaatagtagaggtcccactaaacatctttaagtgggtgctatgattctctgcgcagactcttcctgcaggactggaggacatgttccctgagctgctaggagtattggtctcaacagttttcagctaagtcactcttcaaagcttggctttaatgaagaaaactgccttgcccaaggtcattcccccttctagggggcagcccacacttgacaattaatccatttaggatatagaggcctctccgttgttccagtttaggacaactctgaaggaccattccatattcaaaactcccagtattagttaaatactgatgtgtagcaaattactccaatctgtagtagctttaaataacaaacgtctcattatgtctgcgagttgggaactcaggagcagcttccctgggtgttcctggctcaaggtgtcagattcttgcagttgtctgaaggcctgttgtcggctggaagatccagttccaagatggctccctcacatggctgaggttgggagcactcacttccactccacaggctgcttgagaagcctcacagtatggcagctagcttctcccagaccagtcaatcaagagagagtgcaattagggagctgcaatgccctgtgaggccaagtatctgaaggacatctacttttcttctcttcatcagaagacagtcactaaatcccactaattccatttgggaaggggaatttagctctacctatggaagggagggtcaaagaatttgaggacatattttaaaccactacgctccgcattgaatcctgcttcctacacccaaaccctgtgcgcctgttgatcctgagagcatctccccaataaacttcctgcatgttaaatctccatctcgtattctgccttctggcaacctaacctcaacaatccagttatgctagtttcataataaccctcataataaccctcaagacactcttgtgatacaggaaaaattactatttcctcaccttacaaaagggaagacaggcacagaaagattaatgtacttgcccaaggtcatagagcaactaagtggcagccaccaattctgactccagagttcatataggcaattgctgatcaatgcgctacatacatgcacacaacaaacgcctgggtgcataacaatggggggctcatgatcttaatcaaaagactggacaaaagactgccaatcaaatgggaaaatccagcagaggtgcaatgtcatagtcaaaggcaatcttaaagagaggaatggggggtcattgtatcaactgatggtgaagatagaatattaaaactattgcagaatagtataatgctttagtttgctacggctgccacaacgaagtaccacaaactgggtggcttcaaacaacagaaatttattctttcactcttctggaggctgcaagttcaaaatcaagatgtcagcagggttgttcttctgaggacggtgaggaaagaatctgttccagttctctctccttggcttttaggtggccctcttatgtctcctcactctatctttaaaaaatgtgtcttcatggctgggcacagtggctcacacctgtaatcccagcactttgggaggtcaaggcaggaggatcccttgagcccaggagttcgagactagcctgggcaacatggcgaaaccccccatctctacaaaaatataaaaattagctggatgtggtgacgcatgcctgtagtcccagctacttgggaagctgaggtgggaggatcgcttgagcctgggaggcagaggttgcagtgagccaagatcatgtcactgcactctggcctgggcgacagagcgagaccctgtctcaaaaaataaaataaaatgtatcttcatgttcacgtgatgttctttctgtatcaatgtctgactccaaacttgccctttttctaaatacaccagtcatcttgtattaaggtccactaatgacccccttttaacttgattacctttgtaaagaccctacttccaaataccgtcacattctgaagtaccaagggctaggaccttaatttggcagggaaacaattcaacccagaacaccatcctcatagatgggattagtgccctataaaaggaatggaagggagctagctagtccttttgcccttctgtcccttctgccaagagaggacatggcatttgtcccttctggaggactcagcattcaaggcgccatcttggaagcagagtggaaccagacacaacgtgctggtaccttgttcttaaacttcccagtcttcggaactatgagaaatgaacttctattgtttagaaattacccactctgtggtattttgttataacagcatgaatggactgagacaattgcatgtatggccactaagaacatctcaatgttgattatgtacaagtttgattaaggatgtcctggataccttaactaccacaacttacaccacttggcagttaagacacactttctcaaataacaaaatgtgaagcattctttgtaaacaaacacataaaaatacaatatttgttttttataaacaatatatatgaaatttatatataaataaagaaaaataaaattttaaaataaaatttaaattaaagataaattagccaggtgtggtggctcacacctgtaatcccagcactttgggaggccaaggagtgtggatcatctgaggtcaggagttcgacattagcctagccaaaatggtgaaacctcatcggtactaaaaatacaaaaattagccaggcgtggtggcgcaggcctgtaatcccaggtccccgggaagctgaggctagaggatcacttgaacctgggaggcagaggttgtagtgagctgagatcacgtcactgtactccagcctgggtgacagagtgagatttcatctaaaaaaaaaattaattaaaataaaataaaataaataaaattagaaaataaaatagaattttaaaatgtaaacatacataaaaatttatataaaaatgtttaatgaattttataaaaataaaatttatatataaattttatattttatataaattttttattaaaatgtgattaaaatacaatatttgtttcttatttgtcaagaaacaagtaaaaatatgataccagactaaaaataacaaagtatgaatgcttcacaccaaaacctatgggatacaggtaaaaaaagaatcctctgaaaaattattggaaaaagtttggaaatttggtcagagtgaaatgatatgctatctgggatttgcttctaaataactctaggaggaggaagagggagaaggaggaggagggggaggggagaaagaggaggatgaggaggggtggagaaggaggaggggggaggggagaaagtaggatggggaggggcggagaaggaggggaggaaatggaggaagagggaaggggtacaggaggaggaggaggaaaggttttattcactcattcactctgcctttgtatacacttgagttccataacaaaagaagagaagataaatttacaaagtaggataatatttttgaaatattaagctgaagtatttttaaaattccttgtcattcccagcaggtgcccctcaactctctctccatcaagtttataccctgaagcaaaaaatgtgtgttgaagagcactttgccaaagatctgaaacatggtttggtctagaggaaggggaatagaatgagaagagcagaagtagctcctggggtgggatccagctgtatttcatgcttggagtcaacgtcccagttggggttagaaatgcgcagggcaatagaaaacatgacaggaaactcggagctcgagagagaagaatcaaatgattaaaataacccaaaagttagaggtatgggctgagtcagccaagggggagtcccggctctttctagcggtccctctagtgtgctattgcctgtgcagagatgggattttgagacactccagctgggacgttggcagataggcaagggacatggcatttttgaaccatatgcctctctccatcccaagtagaatgcttttggggaaaggtaagaaggagactgaggatgtgaaaagagaattctaaaacactggctatcagctgggttccaactgaataatgagactgattttcttctcccctgtcctcagcagaaatggttactggggagctaaactgggttaatttatagagaaatgaagactggtacttttttggtcatctatatgtatgcctgtaaattttgaaacagcctacgtatgcaaaaatcaataggcattacgatttaacagcaacaaccagttagaaaataaaatgaagatacagactgtattctcaatagcaatcaaaatataaaatatttggagtaatttgaatgtgatctatgttttagttacatgagaaaagctataaggctgaattaagaaatgtgaaatatggcaaaatagagatttacagtatttctgaatagaaaatctattttaaaatgtccagttgtatacaattaatttttagagctaattactctcaatatcctaataaaatttttcatgaggaaattcaatgaaattctgttaaaattcttctgaaaaaataaagaagtattttgaaatgacatctctttaaagagctaattgtaggagaaaggtttttactaggcataaaatatagtataactgtaagaattaaaagagcatcatcctgacataagagcaattggataggacagatcattcagaacagatcccaacatattatgtataggattatttatttatttatttatttatttatttatttatttatttatttttgagacggagtctcactctgtcacccaggctggagtgcagtggcacgatctcggctcactgcaacctcggcctcccgggttcaagggattctcctgcctcagcctcccgagtagctgggactacaggcgcagccaccacgcccggctaattttttgtatttttagtacagacggggtttcaccgtgttagccaggatagtctctatcttctgaccttgtgatgatctgcccgcctcatcctcccaaagtgctgggattacaggtgtgagccaccacgcccggcctatttattttttattgtatatattcaagttgtatatgaaatttcaataaatgataaaagaggcattgcaaatctataaagaacaggggattactcagtaaatgatattacactaaatgctatttagaagaaaaattcatttagattttaccataacagcatatatcaaaaaaaaggaagagagagaagaaaagacctagttggattaaagagttcaggaaataataaaacaagttaaggcacagacttaatgaaaagtatggaaaacttatatgagaaaaactactaaagtcttgcatgagacgtcacagtagatttgaacagaaggcaaacataccattatcttggataggaaagtgtaacatcataaaaatgttaagtctcctctgcttaatttatatatttaaattaacactaacaaaaatattaatttatttatggagccaggcaggttgattataaaatttatttggaataataaataagggagaatagccagaacaaatctcaaaagagatgaaccggtggggggcagggggaggaggaggagcctaggacgtgtcatacagagagtggcacctgggactcattttagccagtggaaggcagtgagagttctgcacctaaatcttttttttttttaaacagagttttgctcttgtcgcccaggctggagtgcaatggcgtgatctcagctcaccgcaacctccacctcccgggttcaagcaattctcttgcctcagcctcccgagtggctaggattataggcatgcaccccatgctctgctgcttttgtatttttagtagagatggggtttctccatgttggtcgggctggtctcgaactcccaatctgaggttatccccctgcctcagcctcccaaagtgctgggattacaggcatgagccaccgcacccagcctctgcacctaaatcttaaaaaggcctggcaacaggcctggcacagtggctcatgcctgtagtcccaaaactatgagccaaggtgggaggatcgcttgaggtcaggattttgagaccagcatgggcaacccagtgagacctatctctacaacaacaacaacaaaatttttttaattagctggtcacagtggcatgcgcctgtaatcccagctactcaggaggctgaggtgggaggattgcttgagcccaggagtttgaggctgcagtgacctatgattacaccactacattccagcctggatgacagagcaagaccctatttcgaaaaaaaaaaaggcctgacctggcaacttctgcttttacatgctgggagggctgagtatgatgtaaggagcccagtgaccctgatggagacactgttgaaggaccacaaagaggagaggccctgaacaatatggagaaagaaggggtgggagagagagagaaaaccccagctcccccagcgtagccaccaagaatggccctcctgccatgtccacaaggacccaacatacacatgaagccatctcgggatttccactccactgccataaaactgcagtcacgtgaacgacacaaagtgagactggcaaaaggaccactcagctgagccacagtccaccagtagaattgtgaaaaataatacagtggccattgtcctaagccactgagttttgaggtggtttgtgatgcggcagtaggtgaccagatcaaatgattaccgaaggggaaaagacagaatagggcagggagacaggaagagaagcaagacatctctgcatgttatgtcatagaattttgactctgtatccatgtaaatgttttagctaatttaaaaaaattttaatttaaaaaattaaaccacacagaaaagagaaatacaatggaattgttaaaacttcagtggggtagaggtaggaagactttctacatgactgatagaaacatcacaaaggaggccaggtgcagtggctcacgcctgtaattccagcactttggaaggccgaggcgggcggatcacaaggtcaggagtttgagaccagcctggccaagatggtgaaaccccatctctactgaaaaatacaaaaatcagctgggcgtggcggcatgtgcctgtaatcccagctacttgggaggttgaggtaggagaattgcttgaacccgggaggcggaggttgcagtgagccgagatcgtgccagtgcactccagcccgggtgacagtgcgagactgcgtctcaaaacaaaaacaaaaacaaaaaacaaacaaacaaaaaagaaacatcacaaaggaaaaacatagccacagctggatgcagtggctcatgcctgtaatcccagcactttgggatgctgaggtgggaggatcacttgagcccaggagttgggcaacatagtgagacccctatgtaaaaaatacaaaaattagccaggcatggcggcgtgtgcctgtagtctcagctatgcagaaagctgaggccagaggatcacttgagtcggggaggtcgaggctgcagtgaaccgtgatcgcatcactgcattccagcctgggccacaaagcaagatcatgtctcaaaaaaaaaaaaaagaaaaagaaaaaaagtcaatttattatatagaaaattttcctatacatcagtggggaaacccataataagaaggaaagaactgctgggcgcagtggctcatgcctataatcccagcactttgggaggccaaggcaggtgggtcacctgaggttgggagtttgagaccagcctgaccaacatggagaaaccctgtctctaccaaaaatacaaaattagccggatgtggtggcacatgcctgtaaccccagctactcgggaggctgagaggggagaatcacttgaacccgggaggtggaggctgcggtgagtcgagatcgcgccattgcattccagcctgggcaacaagagtgaaacgctggcccccccccgcccccccagaaaaaaggaaagaacattttgggaaatatatacaacaaacatgacaagaaaagttcacattttgaccacagaggatgtgttagttttctacagccgtgtaataaataactataaatgtagagatgcgaaacaacacccactgattagctcacagctctgtgggttcaactggattctctgcttagggtcaaacagggttgagatcaaggtgtctgcctggctgggctattacctggaggctctgggaagcacctacttgaaagctcattgaggtgacgggcagaattcagttccttgtggttgtaggactccagtcacgtgccctcgctgactgtcagcagggaccactctcagcttttaaagacgtctctctgatcagtgggcagagcccctccatcatcaaagccagccatggtgcatcaaatccttcttgtgctttgaatctctttgactgccctttctgcggccagacagagaacattttctgcttttaaaaggctaatgatattagattaggcccacctagaaaatctccctatttgaagattaaccatgccaggtaacataatcttgggagtgatatttcatcatatccacagcttccaccctcactcaaagggaggggattatagaaagaagaaggtcattgggggtcattcttagaattttgactaccagaggggataacattcacatctataataagaactctaagacacaggacatgaataacagtttgcaaaagaggaaatcaagtagttagcagacatatgggaaaatgtttcacttcaattgaaataaaagaaattctagtagaaatcttctactcacagattaaattagcaaaaaatactaaatattggcagctatgtggtgaaacaggcatttcattcattgatgatagcaatgtgaatggtacaacacatgtagaaataaatttggaaatatataccaacgcctttaaaatgtttatattctttggcccagtaatttgactgctgggaatctatgtaaagattaatcctaaatttggaaaaaaaatttcccagcaatcaagtaatcctaaatttgagaaaaaaacatttttaaacactgatatggtttggctctgtgtccccacccaaatctcactttgacttgtaataatccccacgtgtcatgggagggacccggtgggaggtaactgaatcatgagggcaggtttttcctgtgctgttctcatgatagtgaataagtctcacaagatctgatggctttataaagcagagttcccctacacagatctcttgcctgccgccatgtaagacatgactttgttcttcatttgtcttctgccatgattatgaggcctcccaagccatgcagaaccgtgagtccactaaacctctttcttttataaattacccagtctcaggtatgtctttattatcagcatgaggacagactaataaaaacaccatggtattcacggcaaattattaataatgaaaaagtggaaacaatctaattggcaaaatggacattgttggatacattacaccttcaaatcaacaagatattaggcagtcactgaaaacatggttatgctgaaagaaaatacaagaaggtctgataaatggagaagaaacattccatgtttatggagtacaagactcaagatgccatctctccctcaatgcaattgcattctataatcccagtttttggtttaaaaatttaaacacttgtatgataatgcaaagatcctataacagccaacacattttgaaaaagtagagcacagcaggaggatttacactgcctgactttaagacctggcataaaacaacaaggatcgatgcttaaagagagataagcagatcaatggaacagattagggagtccagaaataaaaccgtatacatatggtcaacaaaaatcatatatgactttcaacaaaggtgccaaggcaattccacagggacaggaaagccttttcaacaactggtgctggaacaactggatatccatacgggaaaaaaatgaaccttgcctgttacttgacaccatatacaaacattaacttgaaatggatcatagacctaaaagctaatactataaagtttcttttttttttctaatcttatattttttattttttttgagatgaagtctcactctgtcatccatgctggtgtgcaatagagccatctcggctcactgcaacctccgcctcccaggttcatgcaattctcctgcctcagcctcccaagtagctggaactacaggtgcctgccaccacacccagctaatttttgtatttttagtagagatgggatttcaccatcttggccaggctggttttgaactcccatagtgctgggattacaggcatgagccaccacgcctggcccttatgtttggtttttgctcttctcacagatatgcattatttcaaaactatttgccagtaaatgaaagtatttactattcaagttaaaaatatttcctattgaatttaaaaaaagtgaaaggaaattgacaagagcagcattagcattatttcaactgcaagagccagaaaccaatttattttttattttattttgttattactattatttttgagacagggtctttctctgtcacccaggctggagtgcattggcacaaacaaggctcaatgcagcctcagcctcctgggctcaagtgatcctcctgcttcagtctcccaagcagctgggactataggagtacactatcatggttgtctgattttttgattatttgtagacacagggctctgctatgttgcccaggctattttttttttttgagatggagtcttgctctgttgcccaggctgtagtgcagtggcacaatctcagctcactgcaaactccacctcccgggttcacgccattctcctgcctcagcctcctgagtagctgggactacaggcgcctgctaccatgcccggctgattttttgtatttttagtagagatggggtttcaccgtgttagccaggatggtgttgatctcctgacctcatgatccgcctgcctcagcctcccaaagtgctgggattaccggcgtgagcacagcgcccagcctgcccaggctagtctttaacttctgggctcaacaattttcccaccttagcctcccaaagtgctgggattacaagcatgagccaccatgcccagtccagaaatcaaagtaaataaccttaaaccaaacacagatgaattggctttcctaactcaacccaggtatggagttgttttcagttgagttacatatacaaagtcaatttaccagtttcctaatagtcttcttaccatttataggggagacatctaagttatgtcaataggcaaatcaacgaatactacatcacaaacagtttcaatatttaagaggcaataagagaaggaaagcttgtggaaaccacacattttatttattaccttcatttcattctcacagcctagcaataattcagagctaacgtgtggcaacacatctccactttcctggtttgtgcgtttgcttcctccttgcctgtcccagtgcggggcgtcgtttgcgatgggggtcctgccctgtgctgactgtaaacctcttgaagcacatcaacaatgcgccagcacgtcctgagagtttgtggactgaagttattccaaattctaaaatgtaaatccactaaaagaaagtataagaactgtagcctgaactcgccaaaaacaagtcccccaaatgtgtgtaatggcaggggtccccacccctcccgcccccctgggccccctttgaatcccccctacagacgccgacttgttaggaaccggcggcacagcaggaggtgagcagctgagcagcaggtgggccggcaaagcttcatctatacttacagccactccccatcgctggcgttaggcctgagctctgcctcctgtcagatcagcgtcggccgtagagtctcataggagcatgaaccctattgtgaactgcacgtgtgagggatctaggatgcacgctccttatgagaatctagtgcctgatgatctgtctctgtctctgccacccccagatggtgtgtccggaattggtgggttcttggtctcactgacttcaagaatgaagccgcggaccctcaaggtgttacagctcttaaggttgcgcgtctggagtttgttccttctgatgttcggatgtgtttggagtttcttccttctggtgggttcgtagtctcgctggctcaggagtgaagctgcagaccttcacggtgagtgttacagctcttaaggcggcgcgtctggagttgttcgttcctcctggtgggctcgtgggctcgctggcttcaggagtgaagctgcagatcttcgtgctgagtgttacagcttataaaagcagtgtggacccaaagagtgagcagtatcaagatttattgcaaagagcgagagaacaaagcttccacagtgtggaaagggacccgagcgggttgccactgctggcgcgggcagcctgcttttattcttatctggccccacccacatcctgctgatgggtagagccaagtggcctgttttgacagggcgctgactggtgcgtgtacaatccctgagctagatacaaaggttctccacgtccccatcagattagttagatacagagtatggacacaaaggttcttcaaggccccaccagagcagctagatacagagtgtcgattggtgcactcacaaaccctgagctagacacagggtgctgattggtgtgtttacaaaccttgagctagatacagagtgctgattggtgtatttacaatccctgagctagacataaagattctccacgtccccaccagactcaggagcctagctggcttcacccagtggatcccacaccggggctgcagctggagctgcctgccagtctcgcgccatgcactcgcactcctcaggccttgggtggtcgataggactggccgtggtggagcagggggcggcgctcgtcggggaggctcgggctgcacaggaacccacggaggcggggtaaggctcaggcatggcgggttgcagtcccgaggcctgccccgcgggaaggcagctaaggcccggcgagaaatcgagcgcagcaccggtgggctggcactgctgggggacccagtacacccttcacagccgctggcccgggtgctaagtcccttattgcccggggccagcagggccagccagctgcttccgagtgcggggcccgccaagcccacgcccacccggaactccagctggcccgcaggcgccgcacgcagccccggttcccgctcgcgtttctccctccacacctccctgcaagctgagggagtgggctccggccttggccagcccagaaaggggctcccacagtgcagcggtgggctgaagggctcctcaggtgctgccaaagtgggagcccaggcagaggaggcaccgagagcgagcgagggcggtgcggacttccagcacgctgtcacctctcaatgggaccatctagtttcaggaaaacaagctcagggctcccactgattctacattatagtgagttgtgtaattatttcattatatattattacaatgtaataataatagaagtaaagtgcccaataaatgtaatccacttgaatcattccaaacccattcccctgccctgtccatggaaaaaaatgtctcccatgaaaccagtccctcgtgccaaaaaggttggggaccactgttatggggtaaagctaataactctgcaaagaatagggcaagcctttgtaaaatacatcaacattcacttgatttcctgccactgcaggaatgcctaagaacgtttcagggagtggagctaaccgtggttgaaccatgacagtggccaggtccccactctggcgcccgtatcagctgcaggagccgcagtgcatagcgtgtgcgctggccctgcaggaagaagaggcaggcccatctaggcagcagacaccatgatggagcatggtggactcctcagcaaccagctcttggtggctgccaggattcatcagttgtggctgcaccaaatctctttcttccaccactcccaacggcccgttatcctgggcttctgtttattgggatttcctggaattccaggagtcccatgtggcaataagatgtcaagtgatgccacaggcccttagggaaggtcctcattttggctccagatccagccaggcttactccctgatcctgactgagtgggccaaggcgtgggccctagggacgggtcctccaggtgaggtatccttagttcatgtcagttatggtcccattgatttattttctttctttctttctttctttctttcttttttttttttttttttttgagatggagtctcactttgtcacccaggctggagtgtagtggcgcaatctcggctcaccgaaacctctgcctcctgggttcaagcgacacccctccgccacccacctcagcctcccgagtggctgggattacaggcgcatgccaccatgcctggctagtttttgtattttttgtagagacggagtttcaccatgttggccaggctagtcttgaactcctgacctcaggtgatctgccctcctctgcctcccaaactgttgggattacaggcgtgagccaccatgcccggccccattggtttattttctgtattatcatggagctcttcttggtttacctgaggtgtttcgatattaaccctaactgagggcaaaatgttttattagatagattggtggataggtagatatgtgatacagcaaacatagcaaaacatttattctagaatctggttggtgcctgttcattgtacattttttccagctcctatctacgtttgaaatttaaaataaaagttggggctggaaattgtgatagaggtgcttattatacaatttacagggatttaaaaaaggtatttttcaagccggacatggtggctcacgcctgtaatcctagcacttagaaaggctgaggtgggtggatcatttgaggtcaggagtttgagaccagcctggccaatatggtgaaaccctttctctactaaaaagacaataaattatccggacgtggtagcacacacctgtagttccagctacttgggaggctgaggcaggaaaatcgcttgaacccgggaggcggaggctgcagtgagccgagaccacgccactgcactccagcctgggcagcagagcaagacttggtctaacaacaacaacaaaagatatgatacatttctttggtcagtcattgcacatctatttgctgggtgtcaattatatatggtactgaatcctgaagactcaccagggaacaaaacaggtgcaatcttcccctcatgtagtttacagcccagaagggaagagagatgaccgaacaagtaattccagtagagtgtgaagagttgctgtaagcatcaaagtgttggggggagttagtctcttactagcccctcccaagaccctgcacccctcctacttgtgcacagagtcccagccctggccttcctagggtgttgacatcactgctgcttgcagtacaccctgcaccagctaggccttagctggctccagagtgtggcaggggtgggtgattgcagagatactttcattccaacaatggtcaagtctagttttctccttagttactttagggtgctgtactggcttcctagaactgctgtaacaaattatcacaaaattggtggcttacagcaatagaaatttatactgttacaatcctgggaaccagaagagtccaattttaaggtgttggcagggccgcttccccctggtgtgtctgcaggagaatccatcccatgcctctgtgctggcttctgctggctgccggcagcccttggcgtcctttagctcgttgatacatcagtacaatctcgacttcggttatcacatctgcttctcctctgtgtgtcttctcctttttcctcctcttctttttttttttttttttttttgagacggagtctcgcactgtcacccaggctggagtacaatggcaccatctcggctcactgcagcctctgcctcctgggttcaagcgattctcctgccttagcctcccgagtagctggcattacaggcgcccaccaacatgcccgtctaattttttgtatttttggtaaagacggggtttcactatgttggccagtctggtctcaaactcccgacctcatgatctgcccatctcggcctcccaaagtgctgggtttacaagtgtgagccactgcgcctggctctttttttccctcttatgagaacacttgccattggattttggatccacccagataatcgaggatgatctcatctcaaaatccttaattacacctgcagagaacttttttcaaatgaggtcacatgcacaggttctaagaggacgtatcttttggggaggccaacactcagcccgctatgagtacacctatctcataactaagagactcatagagcacatggtctctctcctctttttaacatgtcgtgggcttattttgtcataggatattttcctctgtcttgggtctgatttcttcactcattatttaaaaaatttctctcggtctgaaccatgatgaatgaattctgagtgggttattgccattctccaaagttttcctcctgtgcccaaatttctcctcgatagtggttcattcctctacatacagagagctatggaggtacatggaaggtgctatggtttgaatgtggcctctccaacattcgaatgttggaaacttaatgcccagtgcaacagtgttgggaggtggggcttgatgggcccgatgctgctataacaagggctttggggcatgggtctgcttgcctctgctcttctgccatgtgaggacatgacgcttctccactccagaggatgcagcattcgagaccatctcagaagcacagagaccaggccccaacctgccagtgccaggatctgggacttcccagcctctaaaactgtgagaaattaatttctattgtttatttatttatttacttatttttgagacagagtctcactctgtcacctaggctggagtgcagtggcacgatcacagctcactgcagcctcgaactcctgggctcaagcgatcctcctgcgtcagcctcccaaaaagctgcgaccacaggcacgagccaccatgcccagctaatttttgtatttttgtaggtggggttttgccatgttgcctgggctagtctcaaactcctgagcttaatcgatccttctgcctcagcctcccaaagtgctaggattacaggcatgggccaccatgcctggccccaacatgtgttttttaagggaacacaaaacacaatgcaacccataacattaaatgatcacctttgcgtttagaaagaccctgcacattgcctgcagtgtgcagcgtgtggtagagggtagcagctcaccacacattccagttggcaaatgtttgtagtaatctcaacaacagaccatggtgagtgggcaatgcccatagtggcaaagtaggataaaaagaagtgggacaatagaaaacaacgtagcggctagccccagtgtgactcagtcactgaatggacctgtgctgggacagcgagagaggctccacctgtagatgaggggtcagggttccatgtcccacgcaaatccccattcccgtcagatacactcacagggccttcatgaagcttaatggtcagtgtaggaaagagtccccgcttcctggttccccgcgccctggagcctcactccactctgggatacaccccagccatcacacccaaattatccattcgctgatcggcggtagataatttggtgtattctgagcttcaggaggaaaaacccctctgtttacttttggaattagtaaacttccatttcatgtttttccctgaagggtgtttaatgtgaggtccttttttctctctctccctacttttttaagggaacagcattagtctgagggctacacaaaggatgcttgttgaattctgtcaaagatctgcacaagatgagtgacagttaggtagacctgtctgctttctgaaatttcacatgtttgcattgaatccccgcctgaaaatgtacatataattttagagatcaggtcagggactctagacattctgttagatgtctccccctatatgtcctccccttcctctgtgatagcagaaacctcaactttttttttgagacagagtttcattctttgttgcccaggctggagtgcagtggtgacatcttggctcactgcaacctccacctcccgggttcaagagattctcctgtcttagcctcccaagcagctgggttacaggtgcctgccactacgcctggctaatttttgtatttctaatacttttagtagagacggagtttcactatgttggccaggctggcctcgaactcctgacctcaggtgatccatccaccttagcctcccaaagtgctgggattacatgcgtgagccaccacgcccgacctaaacctcaactttttagctggacggacatgtgactgccctgaagaaaccttgcgtttcttcaccacctatgcagctagaggtgaccatgtgggctgttaatggaaacctagtgtgcaactcttgggaggtgcccttcaagagagggtgcaaaccgggcggtggctcacacttgcaatcccagcactttgagaggccgaggcaggcggatcacctgaggtcaggagttcgagaccagcctgaccaacatggtgaaaccccgtctctactaaaaatacaaaaattagctgggcgtggtggtctgcaactgtaatcccagatacttgggaggctaaggcaggagaatctcttgaacctgggaggcggaggttacatgagctgagatttcgccactgcactccagcctgggtgacagagcaagactccatctcaaaaaaaaaaaaaaaaaaagagggtgtgcaagttcttctttcctcccattcttcccacttgctggttagtatttggatgcactggcctgagtctgcgtagtcttctggggccttgaggcagaagctacttactaggattgtagagggatgagggacaaggcagaaggaggccgagcacttccaggtaccctccgtcctggccccagctgcctatatttatttaagagagaaacaaacagctatcttgaggggtagacagaataatacttccctccttccccgaaaaagatgcccacatccttgcccctagaaatagttgatatattgcttgacctggggaaagggactttgcagatgtgcttgaggaccttgagatgggggcgggggttagcctggatgatcctagttattctgggtgggctcaaagtcatcataagggtccttatatgagataagcaggaagatcagagacagaaaaacaacctgtgatgacaggagtggccaaggttgaagtgaggcaccttgaatatggaggcaggcccagaggtcaagaaagaatgcaggcactgcaacaccctggaaaaggcaaggaaacacgctctcccctggagcctccagaaagaactcagcttggcccacaccttgattttagttcctcaactctcattttagagttctgaactctagagctgaaggataatacatttgtgttgttttaagctagtaggtttgtggtcattggctacagcagcaattggcaacttatacacttcatcttgcttgagcgactgttattttgtaatttcagacacttgcagctacctccagtcctaaccaggacaaaatctggtatctggaagtgggaaaatgtatgttgcagaacgtaggttgtggcactgacttagcaatgacatgcccgggactcatatattgcaggttcggaaaaatgatggtcattaggacatggcaatgggacacttggtggcatgtttccagggttactttagaaggcatactatatgctgaccaaggctgagagtcaggaggaaatggttggaagatcagaattttgggcacagtcagcttcttcctgccacgtcctgcaaaatccaaaagaaaggtgaacttgaggaaagccagccagtctgtcaaccgaatgaaaaacatcgttttggcaaaggagccctctctgcctgccacttgcaagcaaatttgagtgataagctggtaatttggggccttgctggactgaaaaacccaatggcttctgtattccaagtaaaggttttaccgaggtctcaatgttttgcaaagggctttacatgtccaattctctgctagacattgagagccagtccagaggcaaacatgttggggaaggtaacttttctttcagttcgtgggtttccagcctacaaagagcccttctagacttatggagagctctgaacaccaccccagggtgcaggacttggagctggaggaagtgcattggtgggactctgaagttgttgcccttggtaaggctatgaatatgtaccacgtgtgggaggagagatgtgtatggatatcaggcggctaagagggcaagctgtggcagtttgcttttctcctcctcttctatagcagaatcctggcatgtcttgaatgagttatgtgtgtattcagatactggggtcctcaatttccagggcagacaagtaagccctggaacagcgtcgagcctctggccacgatcagctttgtcctttcgccccagtgtactgttataaggaaatggttggggcattatgaagttaaggtgagcatagtctacacatgctcaccctcactcctgagaacaattaaaagtatgggggattccggccgggcgcggtggctcatgcctgtaatcccagcactttgggaggccgaggcaggtagatcacgaggtcaggagatcgagaccatcctggctaacacggtgaaaccccatctctactaaaaatagaaaaaattagccgggcatggtagcaggcgtctgtagtcccagctactagggaggatgaggcaggagaatggcatgaacctgggaggcggagcttgcagtgagccgagaccacgccactggactccagcctggacaacggagcaagactccgtctcaaaaaaaaaaaaaagtatgggggattcccaaaaccactctcagttttgataattcactagaaagactcacagaactctctgaaacctggtgtacttatggttacagtttattacagcaaaaggatacagattaaaatcagccgagggggctgggcgcggtggctcatgcctgtaatcccagcactttgggaggccgaggctggcggatcacgaggtcaggagttcgagaccagcctgaccaacatggtgaaacctcgtctctactaaaaatacaaaaattagtcaggcgtggtgttgcgcatctgtaatcccagctacttaggtgtctgaggcaggagaatcgcttgaacccaggaggtggaggttgcagtgagccaagatcctgctacttcactccagcctgggtgacagagcgagactccatctcaaaaaagaaaaaaaaagagaagaagaacatagggtagagtccaggaaagaacccatcacagagcttccattgttttctccctgggaagccatggatagtgccactttcctggcattaacgtggacaacacacatggagtttgcccaccagggaagcccacccaagcttagagtttttattggggttccattgtgtagtaatgattgatttcccatgtggttgatcgcagcctccagcccctctggatgttgaactaatacgacgtgaccccaaccccctccctaaatcacactgttagacttcctggtgtggccagctcccaatctaaacaaagatactcctatcgagcatgattttccaagggctgagagattacctaccagaagctgaaggcaaaggatggacctctctttgggcaaggtcaaattctttattacccagatgcattgttctacaataatggaacctcaatttctaactgagcacaaagcagccacaatcaagaatcccaacctctgccagaattccagccttttgtgcatctacttacatcccattgtaaccatgtgactaaattctagtcaatgggatgtaagtgggggttgtatttgccacttctgggaagtgtccttaaatagaggggccttcttttcctctgccttctgtctttttgcttcctatacgggacttgaggagccttcttggcccataggtaatgcttaggggtgcaacaaggtggaaagagcctgggttcctgttgattgaggcaccctttatacctgcaccaggctgcttggagaaaccacttctatcatgtttaagctgctgtcattttgggttttctgccatttgcagccagatatagtctcaacaccttgcttgaaacttacatttatattggttacatccagatttgtaaaactctgctcatcaaattgacgatctcatctttaatccagctcacactcatgctgccaaattgtagcctgtcactggaacactagacagggtactggacagttgcttctctggaacactggcctttattcccaagccttcatcacattcagaagggactgttttctttttctttttcttaagaaactcacagtctaccttttccaagtaaataatcatcacactttctgtggctaaccagttggagatttgactgaacacctaaactttactaatgttatatctaaactttaagtgaatttttgctacacctttaaaaaactgactaaaagatattttttaaatcaaaacgaacatttacagatctttccaagacctgatatttgaattttgttcatattttatcaaagtgggccagagtttcctatgtgcaatggcttggcatcgtgcctagagaaagcaggataaacactgaatctctgccttttattttttgtttttggtgtcttgccatcctttgttcttcataaagaccttatggtagcttttatgaatatctctaagaaattaatctttaaaatatagaaggtggacaaaaaaccctttgcacattgtgaagacagggattttatccttcgttcattgaagagcagcaagatattgggacttggatatggtgcaacctctgtcatcacctttcctgtttgtagtcttgggattggaggttgaaagagaatggaagaaatggcactagaaccccaaattccatttctttctttcttctttttttttttttttttttgagacagagtcttgctctgtcgcccaggctggagtgcagtggtgcgatctaggctcactgcaacctctgcctcccgggttcacaccattctcctgcctcagcctcctgagtagctgggactacaggcacccgccactacacccagttaattttttgtatttttaatagagaaggggtttcaccgtgttagccaggatagtcttgatctcctgacctcgtgatccacctgcctcggcctcccaaagtgctgggattacacacgtgagccactgcacccagcccaaaagttccatttctaatttgcctaccttaatgacttgattttcttattttcatagtaaataggaatatgtatgttgaagaaatatgaacattaattttctcataactgcacagtcaaaaacaatgttttaaactttaataaatatcaatgacttgtttcatactttgctccattacaaacacaaggaaagaaaagatgtacaatgcctgaggaatagaaacaccatcaatcctcaacagggtcacctaactgtcattatgaagcaagggactcttgccagagatttgtgtcctcagtgaaaaaggcctcatggaattttcttgctaaaaggaacctgagacttattgacacacgcgtcctccttttccagacgaaacactcaaggcttagggaagtcaaagtgtacagaaggtccccgctaattagcaacaaagccagactcagcacccaggttgttctcgctcctggatcagggttatttgtgaacatcccatgtcctctttatgatggttacagatgtttcatatcatcaaggttaagatgaaagatctcagaagctgcagaagtgcttagatgcacccacagaaaaccaccggatccagctaactcactcttgtgattggaaagaagcatattctggtgaagcaaaagatttctatctccagaataatgcagaaagcatttttacctaccaagccacaacaaaccagtgaaagaacatttagatttccagagtccatcggcaatacaaaagtcacctaaagaataatgccagaggcatatcttctcttgtaggttgtaaattccttgaaaacgagaactgctcaacttcccatctcctacgacacccagcacacagttgatgctggaatttctttttaatgaatgaaacacacaaatcattgctttaaaccctggaattgtgcccttttcaaaagaagcacttaatagacatgtgtctaatttcctgtgctgtcacaaatattatttaatcacactgttaaaaataaagaactctggggcccatgaactacattctccaggccattagctgctctttccactttgggcctctcagctgtgcagccggaaatggatcgtggggagaggagctgccactcttctgcaaatatcctggaatcttggctatgtcaggaagtgtttggagaatgccttggaagctgagaaagtgtttccaaagcagcatgcacacgaagatatttgaaccagagaacgtccactctgaaatagatgcatggagtgcattcacagaatatcacgtttttctgaagtttaaaagctacagcccagtactctgaacccaagaattaaggtaagtgtaaaaagtgagtgcctcagatagttgttatgtttgcaacaggtcacttggttttacatcaatctcatggtaaaatacatataaagtcgttatgaagctcataggcatattataatggttccctggtaaatgacactagcatgttgcataaacaactatatcttttaggctgggcgtggtggctcatacctgtaatcccaacactttgggaggccgaggctggtggatcacctgacatcaggagttggagaccagcctggccaatgtggtgaaatctcgtctctactagtggcagagattagaggcaggagccactgagcccggcctcttttaattgcttttttttaaaaaacggctttattggctgggcgcagtggctcacacctgtaatcccagcattttgggaggccaaggtgggcggatcacctaaggtcaggagttcgagaccagcctgaccaacatggtgaaaccccgtctctactaaaaatagaaaaattagctgggtgtggtggcacatgcctgtaatctcagctactcgggaggctgaggcaggagaatcgcttgaacccaggaagcagaggttgtagtaagccgagatcatgccattgcactccaggctgggcaacaagagagaaactccatctcaaaaacaaacaagcaagcaaacaaaaaaaccccaacaaaacaaacaaacagaaaaaactatatcttttaaaaatgatagtcaatgatttttcactgaaaaataggtattattcattaaaatctaagaatacaaaccagccacagtaagaaaactgtcctctcctctttgccagcagcctacacaattgagatgctgtgcagttttcccctcagctcgtaacactgaaacagcaagaaattgtctaaggttagaatttctagtcataggaaacttccagcgatgccaatgtaaaaacattttgtttcatttcagagagttaagagagcaaatcaagacatgaaaatgatccccccgtggaatatgcccctgctattgagagaataaactactgatctacgcaacagcatggatgaatctcagagacattttgctaactgagagaagtcagacacagaagacatagtcaatgattccatgtgtatgaaatttctagaaaaggcaaaactatagagacagaatggctgatcaatgttgtggctgatcaaatcgaggcacagaatgatcaatggttgcctggagctgcgggtgggaacaggagtgacctcaaaggagcaaggggaacttttgggggtggatgggaatattgggaaactggactgtgatggttgctaagtgcgtcagttcacggaaacctatcacactgtaccctcacaatgagtgacgtttatggtttgtaagttagacctcaataaagctgtttgtaatcattttatttattctttttttttttttttgagacaaagtctcactccatcacccaggctggagtgcaatggcacgatctcggctcactgcaacctccgcctccaaggttcaagcgattctcatgcctcagcctcccaagtagctgagattacaggcgtgtgccaccacactcagctaatttttttgtatttttcgtagagacggggtttcaccatattggtcaggctggtctcaaactcctgacctcaggtgatccgcccaccttggcctcccaaaatgctgggattacaggtatgagccactgcgcccagccaataaagccatttttaaaaaaaagcaattaaaagaggccgggcgcagtggctcgtgcctgtaatcccagcactttgggaggccaaggcaggcagatcacctgaggtcaggagttcaagactagcctggccaacatggtgaaatcccgtctctacgaaaaatacaaaaattagccaggcatggtggcaggcacctgtaatcccagctgcttaggaggctgaggctggagaatcgcttgaacccaggaggcggaggttgcagtgagcagagatcgcaccattgcactccagcctgggtgacgagcgaaactccatctcaaaaaataaaacaaacaaacaaaaaaaaaaacaaaaggcaattaaaagaaaggattctttcaaggccagtgcaaaactgctttgcagaaacaggtgacctcccttgtaatattcatggtagccatcacacttcccaagtgtgggacactttgtcctgagcaggggttctctgaggtgcacatccagatgctgtcacaccaaacccggcttggtgatctttcaaactccagaatttacaatttctaaacataatgattatgatattagtcaactcatagagtccaagaacatgaatacatggaactgagcaaaacaaacagcatttccctaatgtcgggggatggtggtatgactgggagccaaagagagctttgtgggcttttgctgaactacgcagctgttcggggcagctcctggaacgaggaaaggtatttcgggtatagactgaaataccttcactaacaactgtggaatgctggctatacacatcaccatcactgcagaaatgtggggaaattattttaggaaaatccatcttgctcagaggcaaaagaataaatcgaacattctgtagtccacctcaccagtgtttctatccacagcgaggggttttcaaacttgagtgtgagtcaaaatctcctgacctgttgagaaggcagattccctggcagggccccaaggccatacaactgaatgcctgggaccaagtgccggagtctgaatctttaactagccctcgaagtgatgagggtcctcaaaacacggcgtaaggaacgctggcctccagcaatgaagaaggtgaagacactcagtcagtctgtgctgtttgggcacctctgctgattttagttctgcttctttccattcctctctgtctcatctgcacatctcacgttgtgccttggtccttacctgccccatagccttgctctcagggacagaagtcccacccgtggtgaactggagacaaataattgttaaaaggttttctcttgcctgccccccttcccctccatgggacaagactataaccagaggctgattaagcctgtgcccattggcttctataccggttctcacttaatcactggagaggaagctgcagcaggttctaggttctaacaccctgctggggttttagattggtggctcatgcctataatcctgaagctttgggaagccaaggtgggaggatggcttgagtccagggatcggagataatgtctctacaaaaaaagtttaaaaaaaaattagccagaagtggtggcacacgcctgtagtcccagctactcaggaggctgaggtgggaggctgaccccaggagttagaggctgcagtgagccgtgatcccaccacagcacttcagcctgggcaatagagtgagaccctgtctctaaaatcaatccatcaatcaaaccgtgttgaaggggagggaagcatagacttggttgaattggacaaccgagcccaggacagagctctagtgaggccccctgttctgctgtcccctgggaagggagggatggcccctgcatgagagcacctgcacatggtggtccactatgctcttgattcctgggcttcagggaggccttgacttcccaccctcttctgcagcagcccagcctttgagtggtgacccttggctttctctgcaagattctccccacccacccagacccttgggggaagccttaggcagccagatccataacacgtgaccccagcccctaatgctcagaccaggagtagacttaaccaaaactggccaatcagagccccttttcctggaaacttaaacttctaagatattcccatcttggtgtgtgctggtttctcatacagagtaggcaaaatgctggggctggagcattgctgagtgagtggcatagaaagcttagatgaaagggaagcaggtcgtgagatggagagggcatcctgggtgactgcattcagcacccctcgggagtcagtcccctcccgaggcccagctgaggtcctgagctcagttccgtgagacaccccagtgttattggaataaagagcctttactgtggcagcgctccctaacgcaggaaggatcacatttcccttgccatctctgtccttgttttaacccgtactctctttccgtagacaggatggcaaaccatgttgtcctccttatagtgcaaaacgggaattttcccaaaaaactgatttggtttgaatgaactgtctttggcgatagtatgaaattattatttataggtgcaaaaatagaactgtgaacatgttttatcttaaaaagggttcttgtctattagagtaactttgaaatatttacacctgaaatgatgtcaggaatagcttcaaaacaatgccagggccaggtgtggtggctcacgcctgtaatcccagcactttgggaggctgaggcgggcggatcacaaggtcaggagttcaagactatcctggccaacatggtgaaaccccatctctactaaaaatacaaaaattagctgggcatggtggtgcgcacctgtagtcccagctactcgggaggctgaggcaggagaaacacttgaaccctgagatggaggttgcagtgagccaagatcgcgccactgtactccagcctggcgacagagcaagactccatctcaaaaaacaaaaacaaaaacaaaaaaaaaacaatgccagggaggccgggcgtgttggctcacgtctgtaatcccagcactttgggaggccaaggtgggcagatcacttgacttcaggaattcaagaccagcctgaccaacatggtgaaaccctgtctctactaaaaagacaaaattagccatgcgtggtggtgcatgcctgtaatcccagctacctgggaggctgaggcagcagaattgtttgatcccgggaggcggaggttgcagtgagctgagatcacgccattgtactccagcctgggcaacacagcgagactccatctcaaaaacaaacaaacaaaaacaaactaacaaacaaaaaaaacaatgccagaggacaggaagtgggtgaggatgtaaatgaaacaaggtcgaccttgagctgataattattgaatctgggtgacgagggttcattgcccaagtctgtcttcttctgtgtatgtttcaaattgtccatagtgagaagttttaaaaaatgctgatttaggggtatacctatgaaatatcacaaaaccaccagccttccaaagtgagaagaagctttttaaatgggagatctaagtgtggctccaaaggcagctacccctaatgggactgggtgtggtactgtgagtgtacaggtgtgtgaacaaaaacatatggggaaatgtccctctttcccttagaggaaaataggaacttgggcttcgtgttcaatacatctctgatgatgcaatccaaaaagaaatatgctaagctctatggcttgcttttaaattaataaaaggcacatttaactatatactttgtagattgtattaaaagttatttggtagatttaagggtaagaagcattgcctccaactagaacattttcctaataggttgaaagcatatgtgtcgaaagtaaagcattttgggagttctccagcagctataaaaaactcaatgtatctatgcataccttctaatttagaggagcgagtgggaggtaggaggtggccgatgcttgttggatattcaagagcatctgtattcacttttttataaattcattatggttaagagtggtcttttgtaggggtttggatttcgggagaaatcattcataatacaagttttcctttaaagttgtgactgtccattgtacccttacgctcgccccgttttcaaggaggccaagttctgttttctgtatgaggactcaagggggcctgctactcgaatgccccgtcgctgtctaattctgtggttaatctcatagtgtggacacacttgggggcccagctctgagaccaggagtccccaaccactctgttcatgtctgaatgtctgtcccttttcatttcccccttctttccatctactccataatgtctgcagtggaggtgcttgcatacttcacttgtactttgcaatatttctctttcttttttattgtcattatattttttgagaggcaatcttcgctctgttgcacaggctggagtgcagtggcaccatcttggctcactgcaactttctcctcctcggtttaagcgattctcctgcctcagcctcctgagtagctgagattacaggcgcccaccaccacatgtggctaatttttgtattttaatatagagacggggtttcaccatgttggtcatgttggtctcgaactcctgacttcaaatgatccacttgccttggtctcctaaagagctgggattacaggcatgagccaccgtgcctggtcatcttttaactgatctttccactgtagccttctgcttttataatatatgtgtattcagagaaatgcatcctactctctaagttattggccctttgggtccaacaataaaagactcactctctacttcatggaaacaagagttcattgtaagaacacttttcattaagacacattgagaccaaaaataaaaccgtgtttctccactcaggagccaggtacccctcgtcatcacatctccacgtattcatgagctgaatgagactaaaggtttaaagttacaagggcggtattttaaaatgtttctgttggccaggtacagtggctcatgcctgtaatcccaacactttgggaggccgaagtaggaggattgcttgacctcaagagttcaagaccagcctgggcaatatggtgaaaccctgtctctacaaaaaatacaaaaaagtagctgggtgtggtggcactcaggtacctgggaggctgatgtgggaggatcccttgagctggggagatggaggctgcagtgagccatcatagtgccattgcattccagcctgagtgatagagtaagatcctgcctcaagaaaacaagtttttgttgaaataaaatatttacactaaacaaaaaataaagcaaataatattctagctaagtcatggaccaattaatagttgacattattttttccgagagaataatattaaccagaagtaaaacctagagcaggcctctcatcactacattccaaacccaagctaaattttagttaaattgtacatttcagattttgaaataatgcatcatttaaaatattttaaagaaaaatgcaaaggcctttcaaaccacaatttcttctatggattatatctctgtagatgtgcctgactatgaaacaaactactataatatcaattattaggccaggtactgtggctcatgcctgtaatcgaaacactattttttttttttatttgagacagagtctcgttccattgcccaggctggagtgcagtggtgtgatctcagctcactgcaacttccacctcccaggctcaagcgattctcatgcctcagccttccaagtagctgggattacaggtgcacaacaccacgcccagctaatttttttcatttttagtagagacagggttttaccttgttggccaggctggtctcaaactcctggcctcaagtgatccatccgccttgtcctcccagagtgctggcattacaggagccaccatgcccagtccatacttgctttagatcattttttcgagatcatagtggaaggcacctgtgtacccctctcacgtcaaatgcatctttctatctcccagaggcaagaactattctgaatttgatgattacgctccccatgtgtgttgttatataattgctctaagtgtatgaacccataggggatatgtaacattggttttaatgttcacaaatttaaaacaaatgctatattactctgcagcttatttttttctgtgtattatgatgttttcaagatatattcatatcgggctgggcatggtggctcatgcctgtaatcccagcactttgggaggcgggtggatcacgaggtctagagatcgagaccatcctggccaacatggtgaaaccctgtctctactaaaagtacaaaaaaaattagctgggcctggtggagtgcacctgtagttccagctactcgggaggctgaggcaggagaatcacttgaacccgggaggcggaggttgcagtgagccaagatcatgccactgcacttcagcctggctacggattgagactccgtttcaaaaaaaaaaaaaaagatatatccatattgacattttgttttgttttgttttgttttgtttgagacaggatcttgctctgtagcttatgctgtagtgaagtggtgcaattatagctcactgcagcctcgaactcctgggctcaatccatcctcccaccttggcctcctgaagctgggactataggcatgaaccactatgcctgggtaaatttttcttttttcttttccttttttttttgtagggacagagtctcactatgttgcccagggtgttcttaacctcctgggcacaagcagtcctccttccttggcttcccaaagtgctggaattacagctgtgagccaccacatccagctgatgtattgttctagttcatgcttttttttttttttgagacagagtctcactctgttgcccaagctggagtgcagtggcacaaactcagctcactgcaacctctgcttcccaggttcaagcaattctcctccctcagcctcccgagtagctgggactacaggtgtgttccaccacacctgactactttttgtatttttagtagagatggagtttcaccatgttggccaggctggtctcgaactcctgacctcaggtgatccacccacctcagcctcccaaagtgctgggattacaggtgactgcagggtattccactgtgtaaatgttctgtgctcttatgatccattctcctgttaatgggtctttaagttgtttatcatattttattattgccaccaatgttgcaaaaacgttcttgggcacctctcattctgcacttaagctaacatctctgtagaatatgcacaggagctgagagggctggataatgagctttaccacctattgacacaaattgttctgtaaagggacttctgctcctactggctgtgtatgaaatttgctgcttgtctacaccttgaacagtgacacagaggctgtccttccagtcattgtatcagctgtgtcttcgaggagccattgcaattttctgtcaagccgactgcatctacatggggtggtatgtggttctatcattggaccccagggtcacaggcccactctgtaccttcttggctctgaaatgggtacctggtcacttctatgtcatataggattccttgtctgtggattaggcattctgtgaacccccagagagtggtgtgtgcaggaaagataaatccagaatagacttggtgcgtgtgtggaaggatcatttggcatggaaggggctcagtgtagacaggtgctaccaagggattggttggtctcgttgaggaacactgtcttatcgggagctcgacatcggtctctgttgctggcagttggacatttagaagcggcagtagctagattggccttggtaagtgggagtccacgctgttgctcctcccgtagcctccatatatgccaaggggaatcctattcagttctccttgctatggactgaagcttgtgtccttagattcatgtgtgaaagcctgatctccagtgcgatggtattaggagttgaggcctttggccagtgattggctcgtggtgggggagccctcctgaatgtaattggtgcctttgtaagagacaggagagagcttccattctctctctctcttcaccatgtgaggaaacaatgaaacaactgcattctgcaaaccaggaagagaagcaaattggccagcaccttgaccttggccttcccagcttccataactgtgagaagtaaattactgttgtttaagccacccagtccatatgaatttgttgcagctgaactgactaagacacctgtcatgccagttccctagcagccagtgagaaagactggctcatgtgaacttggctgttgagtgtcccttctataggggatactttctccttctcccccccacccagccccccatagctttattgagacataatggatataaaataagctgcaaatacttaacgtttacaaaatgagttttaacataagtatgtatctatgaagccatcacacaatcaatacaatgaacatatccatcactcctaaaaatgtccctttgtccttttgtaatccctccccaaaaactttttaagggacacttggaatgtgcttatctcagtggaaactgacttaggtaaatagttcagagaaaccacctgcttctccatacccctgacttctataaataaggatcaccataagaacacagaattaccagaaggtatatttttctttaaaaaaatttttgttggggccagggtcggtggctcatgcctgtaatcccagcactttgggaggctgagacaggaggatcacttgagtccaggcgtttgagaccagcctgggcaacacagtgacaccccgtctctacaaaataatttaaaaataagccgagtgtggtggcactcacctatagtcccagctactcaggaggctcaggtgggaggatcacttgagcctgggaggttgaggctgcagtgagccatgacggcaccactgcattccagcctgtttcaaagaaaaaaaaaactgcattataactcatataccataaaatttacccctttaaagcataaattcagtgtatagtcacaaagttatgcaagtcttgctactatttaattccagaacctttttatcgtccccagagggaaactttgtattccttagcagtcactcctcaatcccttttctccccagcctctggccaccacagagcagctttctgtctgcttggatttgtcagttctgagcattttatgtaaatggaatcatacatatgtggcctttttgactgacaggcttctttcacttagcataatcttttcaagtttcacccatgttgtggcatgtatcagtacttcattcctttttgtggacaaacaatattccattgcatggatatagccatattttgtttatccactcatcggttgatggacatttgagtggtttctatcttttggctgtgataaataacactgctataaacatttgtacacaagtttttgtatggacatgttttccactctcttggatgtcaacctaggagtagaattactaactcattttgtaaaatatacgtttaactttttgaggaactgtcagactcagactgtttttcaaagcagctacactactttatattcccatgttccaatttctccatgtcctagccaacatttattacctttttttttttttttttttttttttggtggtggggcagaaggacagggtctcactctattgcccaggctggagtgcagtggtgccatcttggctcactgcaaccttcacctcccgggttcaagcgatcttcccctctcagcctcccaagttgctgggactataggcacacgctgccatgccagccaactgttttgtaattacctcactttttaatgatgtccatccaatgatgtcaagtggtatctaattgtgttctgatttgcatttccctaataactaatgatgttgtatatgttttcatatgctcactgaccttttgtgtattttctttggagaaatgtttatcaaagtcctttgcccattaaaaattgggttatttatcttttattattgagttgtaagacttatttacacattgtatatacagcccttctatcagatatgtaatatgcatgttttcccctcattctgtgtgttatcttttgactttcttgacaatgtgtttggaagcacaaaagatcttaattttgatgaagttcaatttatttctattttttcttttgttgcttttgcttttggtagcgtatctaataatcattaccaaatccaaagtcataaagttttacttctatattttttctaaaagttttataatttagctcctaaatttagtttttcaatcatttttagttaatttttatatatagtgtgaggtaggactataacttcattcttctgcatatggatatccacagtcccagcactgtttgttgaaaaaactattctttgttcttttgtgaaatttttttagttattctgagtctcttgcatttccatatgcattttaggatcagctgatcaatttcaataaaaaagacagaggaagctaggatttggatagagatcacattcaatcttagatcagcttggggagtattgctatcttaatattaaatctctcaatcaatgaaactgggaaatatttccatttgtagatgacttctctaattttttccaatgatattttctagttttcagtgtacaagtgtaatctttctttggttaaattttttttctagtgttttatttcttttgatgctaaagtaaataaatgtttttcttaattttaattcagaaatttaatttttaatttagattgttctttactagtatatagaaactcaattgcttttttgtatattgatgttctatcctgtaattttgctgaattcatttattagttttggtgaatttcttagaatttttgatatgtaagaaatatttgatatttttgcaaataaaaatatttattcttcttcctttctgatgccttttatttctgtttgttgcctaattggtctgactacaacctccaatacaatgttgaatagaatggcaagaggaacgattcttgtgttgttccttatctagggggaaagtattccatttttcactgttaggtatgacattggctttgagtttttcattgatacccttatcaggttgaggaagttccccgctattcttagtttgctgattgttttttttatcatcaaagtgtgttagattttgttaaatgctttttctgcatcattgagataatcttgtgttgtttcccctttttacattaatatggtatattacattaattaattttcaagtattaatttaaccttgcattcctgggataaatctcacttgataatgctctataatctttttgtacattggtagatttggttttttagtattttttttgaagattttcatattaacatttataaaggaggctacatgtggtggctcatacctacaatcccaacatttttggaggccaaggctggaggatcacttgagcctaggagttcaagaccagcctaggcaacatagtgagatcctatctctaaaaaaaaaaaaaaaaatatatatatatatatatatatatatatatatatatatatatacatatatatatatatatagacatgtcataagaaaaatcactgaagaactaaaaagttagtggggaattttctggccaaattcctgagaaaaacttgaaccagagaggtaagaggaatattagtacacctaagatattttttaactctggatatttatgatgctacaaatttgagctttgattctctggcttcaagcgggagacagaagtcaaggatcaggactccctagaatacccacatttggctgaaaccccgaagtactccactttcaacattagagtacaataccatcaccacttcccctggtaaagcatttgagatattacatgaattttagaagaagcaagttcaaatcttctctaagtgaaagcattctcatgctaggtattatagaaactgctcaagtgatttttgaacagcaataatcagcaagcaggaatacaaaaaactttagctaaatacaacagaaaaaaagacagtaaaaacagatctaaaaaacctgcaaatattggaattatccaacagattattcaaccatgattaccatgttggaagaaataaaggataaacctaaacaaatgttcagagaataagaacctattaaaaacaacacagtaaaactaattacaacatctaaactaaaaataatataaatacaattaaaattaaaaagaggtgcttggcaaagtattggacagtgaaggaagtaagaattgatgaaagttagatgagaagaaatttgcaatgtgtaatgcacactttttaaatatttatttatttatttatttatttatttattatttttttgagatggagtttcactcttgttgcctaggctggcgtgcagtggcgtgattttggctcactgcaatctccacctcctgggttcaagtgattctcctgcctcagcctcccaagtagctgggattacaggcacctgccaccacgcccaactaattttttgtatttttggtagagacaaggtttcactatgttggccaggctggtctcaaactcctgatttcgggagatccacccacctcggcctcccaaagtgctgggattacaggcatgagccaccacgcctggcagactttttttaaaaatgaaaaataaagaagagaggttaggacatatacgtaggataatgtcataaatctaacacatgttagatggaaattacataacaagaaaacatgagagactggggaataattaatatttaaaggaatagaataagattttctagatatgatgaaagacaccaatccattaattcaaaataaccaacagtttccaggtagaataaataaaaggagatccatatctggatatatcctaatgaaatttcagaatactttggtaaatgaaatcttaaaagccaagggggataagaggtagcctttttaaaaatgaaagtatttagattaacagctgactttttaatttttgtgggtacatagtagatgtctatatttatgggttacatgagctattttgataaaggcatgcaatatgtaataatcacatcagagtaagtgggatatccatcccctcaagtatttatcctttgctttttgtttttgtttttctgagagggagtctcgtcctgtcacccaggctggagtgcaatggtgcgatcttggctcactgcaacctctgcctcccgggttcaagcgattctcctgcctcggcctcctgagtagctgggattacaggcacatgccgccatgttcagctaatttttgtatttttagtagaaacggggtttcaccatgttggccaggctggtctcaaactcctgacctcagttgatccgcctgcctcagcctcccaaagtgctgggattacaggcgtgagctaccgcacccagccaagcatttttcctttgtattacaaacaatgcaattatactcttttagttattttcaactttcagtcatttaaaaatgacaattaaatggctgagcgtggtgctcacgcctgtaatcccagcactttgggaggccgaggtgagtggatcacccgaggtcaggagttcaaggccagcctggccaacatggcgagaccctgtctctactaaaaatacaaaaattagctgggtgtggtggcgcatgcctgtaatcccagctactcgggaggctgaggcaggagaatcgcttgaacccaggaggcagaggttgcggtgagctgagatcgtgccattggacttcagcctgggcaacaagagcgaaactccgtctaaaaaaaaaaaagacaattaaattattttttactatactcaccctgtcatgctaacaaatactaggtctcattcattctgtttaacatttttggtacccattaaacatccccacttctcctgccttccattacacttcctagcctctggtaaccatctttttacctccatttccatgagttcaattgttttaatttttagctcccacaaataagtgagaacatgccatatatgtctttctgtgcctggcttatttcacttaacataatgatctccagttctatgcacgttgttgcaaatgacgagatctcattcttttttgtggctgaatagcactccacgtgtctattatataccacattttctttatccattcagctgttggtagacacttaggttgcttccaaatctagattattgtgaatagtgctgcaataaatgtgggagtgcagatacctctttgatatacagatttcctttcttttgggtgtatacccagcagtggggttgctagatcatatggtagatctatttttagttttttgaggaacctccaaactgttctccatagtggttgtactaagttacattcgcaccaacagtatacaagagttcccttttctccacatcctcaccagcatttgttactgcctgtcttttggatacaagccattttagctggaataagatgatatcgggccaggtgcggtggctcagcctgtaatcccagcactttgggaggccgaggcgggcggatcacgaggtcaggagatcaagaccatcctggctaacatggtgaaacctcgtctctactaaaaatacaaaaaattagccgggcgtggtggcgcgtgcctgtagtcctagttactcgggaggctgtggcaggagaatcacttgaacccgggaggcggaggttgcagtgagccgagatcacaccattgcactccagcctgggcgacagagtgagacttcgtctcaaaaaaaaaaaaaaaaaaaaaaaaaaaaaaaaaaaaaaaaaaagagatatcttactgtagttttgatttgcatttatctgatgattaatgatgttgagcaccttttctatacgtgtttgccattcgtatgtcttcttttgagaaacgtctatttagatctttgcccaccttttaatcagattagaattttttcccatacaggtgtttgagctccttatatattctggttactaatcccttgtcagatgggtagtttgcaaatattttctcccattctgtgggttgtcccttcactttgttgattgtttcctttgttttgctgaagctttttaacttgatgtcatcccatttgtccatttttgcttaggttgcctgtgcttgtaaggtattactcgagaaatctttgcccagttgaatgtcctggaaagtttccccaatgttttgttttggtagtgtcatagtttgaagtcttaggtttaagtttttaattcattttgatttgatttttgtatatggcaagagatagggatctagattcattcttctgcatatggatgtccagttttcccagcaccatttattgaagagactcttctttccccagtgtaggtccttggcacttttgtcaaaaatgaattcactgtatatgtatggatttatttctgggttctctattctgttccactgtctgtgtgtctgtttttatgccagtaccatgcctttctggtttctacagctctgcagtataatttgaagtcaggtaatgtgattcctccagttttgttctttttggttaagatagttttggcttttctgggtgttttgtgatcccatatgaattataggattgttttttctatttctgtgaagaatgtcatttgtattttgatagggattgcattgaatttgtagattgctttgggtagatgaacatcttaaacaatattgattcttccaatcaatgaacatgaaatatctttccttttggtatgtgtatcctcttcagtttcttacatcaatgttttatagttttcattgtagagatcttttacctttttaattaattcccaggtatcttattttattcataactattgtaaacataattactttcttgattttttttcagattgttcactgttagcatattttttgtatgttgattttgaatcctgcaactttactgaacttgtttatcagttctaatagttttttggtggagtctttaggtttttccaaatataagatcgtatcatcagtaaacaaggataatttgacttcttcctttccattttggattcccttcatttctttccttgtctgattgctctagctaggacttccagtactatgttatataaaagtggtgaaagtgggcatccttgttgtaactgacttgtttttttgagacagagtcatgctctgtcgcccaggctggagtgcagcgccgcaatctcggctcactgcaagctccgcctcctgggttcatgcctttctctggcttcagcttcccgagtagctgggactacaggcacccaccaccacgcccagctaatttttttgtatttttagtagagatggggtttcactgtgttagccaggatggtctcgatctcctgacctcgtgatccgcctgcctcggcctcccaaagtgctgggattataggcgtgagacatcacgcctggccaacagctaaattttaacagcaatagtggtaactagaagagagtggcttgataactacattgtgctgaaaaatttaaaaaataactgctaaccagtaactctacaccaagaaaatttatctttctatattgagggcaaaataaataatttcagacttcaaataattttcaaataaaagctgagaaaatttattatcagtattaaggagaatctaaaacatatacataagccaataacaagcaaaaatggtaggccaggtgcggtggctcacacctgtaatcccagtactttgggaggctgaggcgggcagatcacgaggtcaggagtttgagaccaacctggccaatatggtgaaaccccgtctctactaaaaatacaaaaattagccgggcgtggtggtgcgtgcctgtagtcccagctactggggaagctgaggcagaagaatcgcttgaacccaggaggtggaagttgcagtgagccaagatcgtgccactgcactccagcctgggtgacagagcgagattctgtctcaaaaacaaacaaacaaacaaacaaaaaaacaagcaaaattgttgctagatacgtggggaaatggaagtaaatattaaatgtataaaacagaataataaagtctagtggaattagaaaataaagaattaaaatatttatataccataccacgtaggttgagtaagcaggtcagtggatggagtaagaggggtctaagatctttgttttacctagaagcaaggtaaaggtttttattatttttcataagttaagtaatacatactgtaatttataagtgaacaactaaaaacaatagaaacaaagtgtatgactttcaaactagtagaggagaaaaatcatatgctaaaaaatactcagtaaaaaatagacaataaaggataaaagggatatcatcaagaaacaaccataaaaatgggcaaccagcagccttcagggctgctctgtctatggagtagccattcttttgttcttttactttcttaataaacttgctttcactttaaaaaacaaaaaaggataaaagagaaaccaaagatgggaaaattatgatttagtggcaaattaaactataaatttatcaggagttacattaaacgtatgcacaaaaattgccatagttaaaagacaaagattgttgaactaggtaaaagtataaaatgcaactatatgcttttgataagacatacctaaaatgtaaaactatagaaaggtgaaaacaaaagcttgtagaaaggtatactatataaatactaagcaaaagaaaattgattagtaagacaaagagaatttaagacaaaaataattgttagagagattcccttcataaggttaatggttaaattcaccttaaaaattgttttcggctgggtgtggtagctcacacctgtaattccaacatgctgggaggctgaggtgggaggatggatcacttgagcccaggaggtctaggctatagggagccgtgttcacaccactgcactccagcctggggaacagaataagaccctgtctcaacaaaaaaatatttttttaaatttttgtgggcttagaaatataacttcaaaatacataatgcaatatttacagaattataaggagaattaaacaatctataatcacagcaagagattttaagacacatatctcagtaattaataaaacaagcagacaaaaaagtcagtattgatatagaacatttgaacaatagaataaatgaactaaagctggaggcatcacgctacctgacttcaaactatactacaaggctatagtaaccaaaacagcatggtactggtaccaaaacagaggtatagaccaatggaacagaatggagccctcagaattaataccacacatctacaaccatctgatctttgacaaacctgacaaaaacaagaaagggggaaaggattccctatttaataaatggtgctgggaaaactgactagccatatgtagaaagctaacacttgattctttccttacaccttatacaaaaattaattcaagatggattaaagacttaaatgttagacctaaaaccataaagaccctagaagaaaacctaggcaattccattcaggacataagcatgggcaaggacttcatgattaaaacaccaaaagcaatggtaacaaaagccaaaattgacaaatgggatctaattaaactaaagagcttctgcacagcaaaagaaactaccatcagagtgaacaggcaacctatagaatgggagaaaatttttgcagtccactcatctgacaaaaggctaatatccagaatctacaaagaacttaaacaaatttacaagaaaaaaatcaaacaaccccatcaaaaagtgggcaaagtatatgaagagacacttctcaaaagaagacatttatgcagccaacagatgcatgaaaaaaatgctcatcatcactggccatcagagaaatgcaaatcaaaaccacaatgagataccatctcataccagttagaatggcgatcattcaaaagtcaggaaacaacaggtgctggagaggatgtggagaaataggaatgcttttacactgtcggtcggactgtaaactagttcaaccattgtggaagacagtgtggcaattcctcaaggatctagaactagaaataccatttgatccagccatctcattactgggcatatacccaaaggattataaatcatgctgctataaagacacatgcatacgtatgtttattgctgcactatttacaatagcaaagacttggaaccaacccaaatgtccctcagtgatagactggattaagaaaatgtggcacatatacaatatggaatactatgcagccataaaaaaggatgagttcatgtcctttgtagggacatggatgaagctggaaaccatcattctgagcaaactatggcaaggacagaaaaccaaacacggcatgttctcactcataggtaggaatttaataaacaacaattagaatatccacaatttaaaaaattgagaagtgtagtttatataatttataaaaaagtaatctttagagatattagaattaaaagattcataaaggattgcgtcctaagagttggtgattgtggctaaaatgctaatttagggaaatttatagccttggatgaaaacattagaagtgaaaaaaaacactcaaattattttttcttttactttttcttttagactgtgcctcacatgatcatggcttactgtagcctcaaactcctgggctcacaagatccccctgcttcaacctcccaagtagctgcaactatgggcacgtgccaccatgcctgggtagttttcttattttttataaagatgggatctcactgtgctgctcaaggtggtctcaaactcctgggctcaaatgatctgcccacctcagcctctgaaagtgctgagattacaggcatgagccaccacacccagcctaaaaagctgaaaatcaaattaaatatctttcttcagaagtaagaaaacaaaaagcaaaataactcccaaataaatagaattataaaaattaaatataagcaaagatattataaaatagaaagcaagggccagcctgtaataccagcactttgagtggctaaagtggaaggatcacttgagcccaggagttcaagaccagcttggcaacatagcaaaatctcatctgtacaaaaattagacgggcatggtgacatggacctgtagtcacagttactcaggaggatgaagtggaaggatcagttgagctcaggaggtcaaagctgcagcaatccacgattggggcactgcattccagccagtccagcacagtaagaccctgtctaaaaacaaaacaaacaaacaaacaaaaaagaaaagaaagcagggggcaaataaagagaacctaaaagttggttctttgaaaagacaaacctctggtgacaatgatattaaaaagagaaagaaagaatatattagaagtgaggtaagaggatactactacagacagggtgtacattaaataaataataaagttgtattttgcaacactgtgttcaataaatgtttaaaattagacacaatggaaacaaatcagaaaaaaatgtataaaactgacataaatagaaatagaaaaaatgaatagtcctataacctttaaagaaatcaaatcaatgccaggcatggtgcctcacacttgcaatcccagcactttgggaggctgaggcaggaggattgtttgaagctaggagcttgagactgagttaggcaacatagcaagaccctgtctctacaaaaaaaaaaaaaaaaaaatttcttaatgtcctgggcatagtggtacatgcctgcagtccccacaacttgggaggctaaggtgagaagattgcttgagcctaggaggttgagactgcagtgagacaggatcactccactgcactccagcctggatgacagagcaagactcctcttcaaagagaaaagaaaagaaatcaaatcaaatcaacagtttaaaatattcccacaacaaaagctccatggctgatatgaattcgtttgtgagttatatcaaacattcaaaaaagaaattattatcatcttatgaaaaaccatttagaaaataggaaaagactcctcaatctattttagaagactttaataataatgataccaaattctggcagggatgacataagaaatccaaaactggccgggcgcggtggctcatgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcctagctactcgggaggctgaggcaggagaatggcgtgaacccgggaagcggagcttgcagtgagccgagattgcgccactgcagtccacagtctggcctgggcaacagagcgagactccgtctcaaaaaaaaaaaaaaaaaaaagaaatccaaaactaaacaaaatattggcaaacccaaaccagaaataaagtataatacatatggcgatgtgcagtggctcacacttgtaatcctaacactttggaggctgaggcagtaggattgcttgagccgaggagattgagaccagcctgggcaacatggctttaaacattaagaaaatacttcattttttctttaaagaaataaagaacaagtacaatgaatacagaaaagttacaaacatggtcaatattaattcaactatattgaaaactactttaaaagtgaatggtctttgggaggctgaggcaggtggatcatctgaggtcaggagttcaaaaccagcctggccaacatggtgaaaccccatctctactaaaaatacaaaagttagctgagcatggtggctcatgcctgtaatcccagctaactgggaggctgaggcaggagaatcgcttgaacccagaggcagaggttgtggtgagccaagattgtgctactgcactccagcctgagcaacacagtgagactccgtcaaaaaaaaaaaaaaagcaaatggtctaaatacaccaatcaaaagacagaagcagtggcttatacctgtaatcccagcagtttgagaggctgaagtgggccagaagtttgagaccagtcagggcaagatagtgagactctgtctctataaaaaataaaaaattagctaggcatggtggggcatgactgtagttccagctactcaggaggctgaggctggaggattgcttgaccctggcaaatcaaggcttcagtgaaccatgatcatgccactgcactccagcctgggtgacagaatgagaccttgtctcaaataataataatagtaataataataatagcagagatcaccttttaataattaaaaaaagacccaaaattcacacccattagaatggctactatcaataatacagaaaataacaaatattggcagggatgtggaaaagttggaatcctgtgcactgttgatgggaatgtaaaatgttgtagccactatagaaaatagtatggcaattctacaaaaaacttaaaatagagttttatatgattgagcaattccccttctaggtatagatataaaagaattgaatgtagaagcttgaagagatatttgtacatgtgtgttcatagcgttgttattcacaaaaacttaaaaagatggaagcaatccaaatatccatcaatggatgaatggataaacaaaatgtggcatatacatacaatagaatattattcaaccttacaaaggaaggaaatcctgacatatgctatgacatgaatgaacactgagaacattatgctgagtaaaacaggccagtcacaaaaagacaaatatgataggattccacttatttaaggtattgtgagtagtcaagctcatggaaacagaaaacagaatgataattgctggcgctaaggggagggggaaatggagagtggtttaatgggtatatagctttgtttttgcaaaatgaaaaagctctgaggattggttgcacaataatgtgaatatatacttcacactactaacctgtacacttaaaaatggttaagatgtaaattttgtgttttgtgtcttttactacaattaagaaaagcacacccaaaactatgacccaactacatgtcatcaacaaaaagcccaatttaaccataaagacatagactggttaaaagtaaagagatggggaagaatatgccatattaacactagttagaagaaagttgaagtaactatgttaatttcagacagagcaaacttcagggaaaggaaaacattcagggataaataggactttacatgattcttcaggaagatgtggcaatccttaaaatgtatgcaaccaccaacagagcaccaaaatagctaagacgaaaatggatagaactgcaaggaaaaatagacaaattaagatctattgtgatagatcaagcaggcagaaaatcagtaaggatatggctgaactgtgtattaatcaaccatcagtcaactgcaccattaatctactggatctaattgatgtttatagactatttcatccaaaaacagcagaatacccattcttctcaagttcacatggaatattcaccaacagagatcatattcttggtcataaagcataccttaacaaatttaaaaggatagaaatcatacaaaggatattctcacaacacaatagaattaaactagaaaccaataacagaagacagctggaaattcccaaatatttggacattaaacaaaaacacttctaaatagcatatgagtcaaagaagaaggtttaagagaaaatttacactattttgaactaaatgaaaaacgaaatacaatttattaaaatttgtgagctgcaagaaaatttatagcatgaaatgcacatattagggaaaaaaagaacctaaaataaaaaatctaagattctactgcaggaaactagagaagagaagagcctaaagcaagcaggaaagaactagtaaaaattagaggagaaaccaatgcaatcaaaaacaacagagaaaattaacaaaaccaaaagctgattctttgaaaagatcaatacaaatgattaacttctagccaaactaagaataaaagaaagaatatacaaatggctaatactagaaatgagaaagaggtcatcactgttgattccatggacagtaaaaagataataaagagggccaggcgaggcagctcacggctgtaatctcagcactttgggaatccaaggcaggtggatcacttgaggtcaagactggccaacatggtgaaaccctgtctctactgaaaacacaaaaaattagctgggcgtggtggtggacacctgtaatcccagctacttgggaggctaaggcaggagaatggcttgaacccaggaggcagagaatgcagtgagccgaaatcaggccattacactccagcctgggcgacagagcgaggctctgtcttaaaaataaataaataaataaataaataaataaataaataaataataataattaaaaaaatttatgaacaattccatgcaacaaatatgataactcagatgatgtcagtgaattccatgaaacacacaagttaccaacgctcatgcaaggagaaagaataatctgagtagaccaataagtaataaccttctcaaaaaatgttccatgtccagttggttttgctggtgagttctatcaaatattcgagagagaaatgatacccattctccacaatatcttccagaaaacagaatatactgttcatttcttttttctattttattttttaaattaaatctacagaaaagtgccaaaaaaaaccttattggcaaactaagaatagaaggacaaaattataaaactttattaagaaacatttaagagatcctaagtttatggaaagatacattgtgttcatgagttggaagattcaattttaagaagttgtcatttccttctgaatgggtttatgcactcaatgcgatgtcaaattcctaacggtgtgtatatttggggtgtgcgtgtgtgtgtgtgtgtgtgtgtgtgtgtgaatttgacaagctaattctaaaatgttaatgaaactataaagggataatagtagagggatttagttttgttcatttagtggtggtcacatagctccaaaagcagaaagagagggcaagccccattgccctgagcagtgcgagtctctgcttgtatcacatttgctatagttcaactgaacaaagcaagaccaagccacgggtttatgtggaggaggcaactcaaagatcttcatacatggagtgggagaatttcacaatacatggagtgtggacaatttcacaatctgccacgacaaggtgccacaatctgccacatcactagcaagtgatggaggctgtcccagtatgtcccaggcaatctgtctccggggttaatgtatggccttatctaccagagctgcaccgtccaatatggtagccactagccacatgtgtttatttaaatttaagttaattaaagtttcattactaacttaattattaccccaaattataaaattctgcttgtagccactagccacatgctagtagtggcttgtacaagccactcaatactacacgcatagaatattaccattattacagaaacttctattggatggcactgttttaaaatatactgcctctcttaataatattgacaatttttatattagaaatcaaacagtagattagttggattctcaaccatgttccgtgaagcctaaaagttctttaaaaacctaaggggtcttaggaaggatgggtccttatggtagacagctctaactgacaagtgtgccaacatggatgtgaatatcacaattttgcaacataaaagcaatatgtaagtatgctctaacctaaaaaaaagaaaaaaaattcttactacatcttaaagagtcatgttaaagctttttcaaacagaaaaatacatagctaagaaaccaataattatttgaacagttaactacaagataattaacttaatgggaaaaaaatgggttcaactgttgctcatgtttgcttcaaagaaatgccattcaactgcgaactttgcgcattcatcttataagtgaaagttctgatgtctgggggctgtaacccacatgctacagaaagtcatcagctccaagcattggtgggatgtgacagacaccgtacaggctatctgactcaacctccaatcccagtcttttccccttacttcctgtgattattgtagagtgaaactgaatgtttcactttcccagcctcgattgcatttatggatgggcatgacacacagttctggccagtgaatggaagtagcaggcttctgggggccttatttctggaaaaagtcaaagaatcttgaactcccgttgtctcccttccaatcctctctgcagttaacgttagatattttagtgccacatatgtaagtaactccacaatatgttgttgttattatcatttttgttagcccatgcattctagcagaaatgatattgctcccctgtcaccaggggtggggaagattctattaaaatgccttaaaaagctgcttgggaggatgttaatacaaaagtgacaaacattgctctagagagtcaattatctcttaaagaaaagttaaatatacaagaaaactacatttaattcatacccacatatttacaatttcccagtgcttatttacttattttatattttattttattttttgagacagagtcttgcttgttgctccaactagagtgcagtggcacgatcatggctcactgcagcctcgaactcccaggctcaggccttcctcccacctcagcctcttgagtagctgggactacaggtgcatgccaccaggcatggccagctaattttttatttgtagtttttgtagagacaaggtctcactatgttgctcagtctggtcttgaactcctgggctcaagagatcctcctgccttggtctcacaaagtgctgggattatgggcatggaccaccacccctggctttattttattttatttttttatatagagatgggttctcactatgttgtccaagctggtcttaaactcctggcctcaagcaatcctcctgcctcaccctcccaaaagtgctgagattacaggcgtgagccaccatgcccggctttattttattttatttttttacttatttattattattactattattattattattattattttgagacagagtcttgctctgttgccaggctggagtacagtggcacaatcttggctcactgcaccctctgcctcctgggttcaagcgattcccctgcttcagcctcccaagtagctgggactacaggtgtgtgccgccacgcccggctaattttttgtatttttagtagagatggggtctcaccatgttggccaggatggtctcgatctcttgaccttctgatctgcctgtctcggcctctcaaagtgccaggattacaggcgcgagccactgtgcctggcccccactgctttttattcctttgtgtggatccatgtttgcatctggtatcattttccttcagctttaagaactttctttaatatttcctctagtgcagacttgctgctgacaggcttggtcagcttttattcatctgaaacagttttttttcaccttcatttttgagggatgtttttgctggatataaaattctaaattgacaggtttaaaaacaaatttaaagactttaaaggtgtcctccaattccttctggctttcatagtttctgataagaagtccactgtagaggctaaggacatgaacctctgcaaagaagacatccgagtggcccacaaacacatgaaaagatgctcatcatcactaatcatcagaaagatgcagctcaaaaccacagtgcgacaccatctcacacagtcagaatgcctttgatcaaaaagtcaaaaaataacatgttggcaaggctgaggggaaaagggaatgcttacacactgttagtgaaaatgtacattaatccagccactgtggagaacagtttggagatttctctctctctctctctctctttttttttttttgagacagggtgtcacgctgtcccccaggctggaatgcagtggtgtcaacatggctcactgaaacctcaacctcctgggctcaagcaatcctcccacctcagctttccaagtagctgaaactacaggcgtgtaccaccatggttggctaattttttttgggtctcactatgttgcccaggttgatcctaaactcctgggctcaagccatcctcctgcctcagccgcccaaagtgctggaattacaggcgtaagccactgtgcccacccgagctttctgaaagaagtaagagttgaactatcattctgcccaataatcccattactaggaatatacccaaaggaaaataaatttttctacccaaaggacacacgcttcccgtatgttcatcacagtgctattcacaatagcagagacacagagtcaacccaggtgctcatcaataatggattggggccagacgcggtggctcatgcctgtagtcccagcattttgggaggcctaagcgggtggatcacctgaggtcaggaattcgagaccagcctggccaacatgacaaaacccctactaaaaatacaaaaattagccgggcatgatgacgggtgcctataattccagctactcaggaggctgaggcaagagaatcaattgaacccaggaggcagaggttgcagtgagccgagatcgcgccacttcactccagcttgggcaaaagactgaaactccatctcgaagaaaaaaaaatagtggattggataaagaaaacacggtacaaatacaccatggaatactatgtagccattaaaaagagggaaatcatgtcctttgcagcaatgtgtttgcagctggaggccattatcctaaaaaaactaatacagaaacagaaaactaaatactgcatgttttcacttacaagtgggagctaaatttgagtacgcatggacataaagatgacaaaaatagacaatggagcctactagataagggagagaaggagcggggcaagggctgaagaactacctattgggtgctcactaccgggtgataggtttagtcataccccaaacttcagcattatgcaatataccttcataacaaacacgcacatgtatccctgattctaaaataaaagttggaaaaggaacaaaaaaggggctgggcatagtggcttatacatgtaaccccagcacgttgggtggccaaagcgggaggatggcttgagcccctgagttcaataccagcctgggcaatatagtgagaactgtctctacagttaatttaaaaaattagctgggcgcagtgctgcatgcttgtagtcccagctacctgggaggctgaggtgggagggccgcctgaacctgggaggtcgaggctacagtgagctgtgattgtgccactgaatttcatcctgggtaacagagcgagaccccatttccaaaaaaaaaaagaaaaaagaaaaacagtttactgtaatgttttttgtgctttgtatataatgtgtcttttttcccctagagctgcatttaaaatctttcttctaatattagttttcagtaactggattataatgtatttagattggtggatgttgtgtgtatgttgggtgttgggtctatgtatttattgttttcaaatttagaaaaaaattttagccattattttttcaaacccattttctgttcttcgctccttcctctctttttaggtctccaattaaatgtctgttaaactagcttatactttctaaaggtcacaaaatctgttcggttttttttcccgttttttttctctatatgttttattgcagatgtatctcatttccttttttctgatgggaaatttatttcttaattttacattgatacataataattgtacgtatttatggggtgaattctatgtctatgtcttcgagctgcctgatatttttttattctgcaaggtctaattttgtttagttctagccagtaaaatttttatttcgtatattgtattttcatctctagcagtttcatttggttctttttttactttctaaaattgctcatttcgttatgtacatgttttcactaacttttctaaacatagttgtattatctgttttaaggtctttgtctactagtttcttcatagctgtcattccagggtctcttccattgaccaattttctcctgggtataggtcacatattcctgcatattcctgattttttatatatctagaatttgcagttgaatggtggacattgtgtgtgttacaatgcaggtgtctggactgagttctcatcttttttttttttttttgagacaaggtggagtgcaatggtgtgatcacagctcactgcagcctcaatctcccaggctcaagtgatcctcccgtctcagcctcccaagtagctgggatcacaggcacacgccaccaaatctggctaatgttttgatttttttgtagaaatgaggtctcattatgttgcccaggctggtctcaaatgcctgggctcaagtcatcgtcctaccttggcctcccaaagtgctgagattacaggtgtgggccaccacgcctggtcgagttgtcatcttttaaagactttgtttcaataggcagttaatttacttgaagttatcagcttgataccttcaacctctgggaagtggaatggagaacacagcaagggaaagcttttctttatatatttttgtacatgatattttttcaatgaatatgcaataatttttgtaaaagttattttaaaatctttcatgaacatgtgtggtcatacattcttgcctcggctgaatctactaagcatagattgagtatccctaatccaaaatgcttgagaccagcaagtgtttcagatttgggaatttcttcagattttagaacatttgcatacacacaatgagatatcttaggaatgagatccaagtctaaacaaaaaagaattcatttatgtttcatatacaccttctccacatagcctgaaagtaattttatacaatattttaaataatgatgtgtatgaaacaaacttttttttttttttagagacagggtcttgctctgtcatctcggatcactgcagcctccacctcctagattcaagcgattctcctgcctcagcttcctgagtagctgaaattacaggcacatgccaccatgcctggctaatttttgtgtttttagtagagacgaggtttcaccatgttggtcaggctggtctcaaactcctggtctcaggtgatccacccgcctgggcctcccaaattgctgggattacaggcgcgagccaccgcgcctggcctgaaacaaacttttgactgtgctgtgactgtaacccatcaggatggtcaggtgtgggatttccctcttgtggtgtcatgtcagtggctcaaagagttttggattttagagcatttgggattttggatttttcagattatgaagcctcaacctgtataaattaatcttcatttgatgcattgtcatcatctgctcttcagggtttcactatttgcacaataaatacttagatatgtgactggactgaaactattctaatctattcagagtgttttggaatcaaaccctttataatgtttattaatttcccacttgcctttttctaaacatacaatgtattgtttttttaaagtttatgtaaaagctttccaaaaatgttatgagaagatatgcacattccctactactgggattatttgaaattattttggaggttccaatcaatgctatagatatatataaaacatatatctatagcattgattgattaatatattatatattaatatattatatataaatatatatattaaataatatatttaatataatatatataatataatatataatataatatatattatattatatattatataatataatatacaatataatataatatataatataatataatataaaatataatatataatatattatatattataatatataatatattatataatataatatataatatattatattatatataatatatcatatgatatatattatatgtattatatatattatacaatatattatatttaatatatatattatataatatattatattttatatatattatattatatatataatataatatatataataatatatattatataatatatattatattatatatattatataaattatattatggtattatattatatatataatataatatattttatattatatattatatattatatattatatatataatatatatataatatataaaatataatatatataatatatttatatattatataaatatatatttatatactatatttatatttataataatatatttatatttataatttatatttatatttatattataaaatattataacttaatatttatatttataaatttatatttataataatatacaattatatgtataattatatattatatgtattatacattaacatatattttatatatatatttcacatatgtatgtgaaagaaattatttgtgcatgacagtgttgtctacccagaaaatctgaaaaaataaactgaaaacctattggaaccagcagtagaggtcattaaggtaaccagctaccagataaacacctccccataccaactaagaggaaacaaatttcaattttattaaaaataatatttctatataccagcagaaaccaatcagaaaatagttcctaaacggaaaaaattccattcccaacagcaaccaaaagctaaaaaatagtccaagtttaataaatgtttgagacctatatgaagaaaactgctgacattattgaaagacattctgaacatatggccaagggctgtctgttcttggataggagggttacatttatggtgcattattatgtggcaggcattttaaatgcattattccactgaattctcatcataaccccatgacatgagtattgttattacttctgctttagagataaataaattaaagattcctgagttgcgctaacttgtcagagcagaaagactgagtttctggtgcctgtctcctgtctttttaaccatggctgcatcatactgcatcatttctccctaaacagttatagatttggccaagcacggtggctcacgcctgtaatcccagcactctgggaggccagggaaggtggatcacctgaggtcaggagtttgagactagcctaaccaacatggtgaaaccccgtctctattaaaaatacaaaaattagctgggcgcggtggcaggtgcctgtaatcccagctacttgggaggctgaggcgggagaatcgcttgaacttgggaggcggaggttgcagtgagccaagattgcaccatttccctccagcctgggagacagagcaagactctgtctcaaaaacaaaacaaaacaaaagttatagattcaatgcaattcctatcaaaaccttaacaggaatttttttaacttaaaagttcagctgggagagtaaatactaaatattgtcaagatgtttttgaaaagaatgacaaggtggaaattgccctattaggtataaaaagagactaccaaagtaatggaattaaaagtgttaatagaaaaaaattagcagggcatggtggcatgggcctgtagtcccagctactcgggagtctgagatgggaggttcgcttgagcctgggaggcagagattgcagtgagctatgattatgccactgtactctagcctgggcaatagagcaagaccctgctgatttaaaaaaaaaaaagaaaagaaatgaaaagaaaaggaagagttatggttgtacgggtatttcaactttggggtaaagtaaattcagtaaatggtttggagataaatggctattcagttgtaaactgtggaatagatagccacttcaaacaaaaaataaaagtaaaatgaatcatagttccaaacgaaacaacaagagcaccaagagaaaatcaaagagactatgcccagggatagtctaagtaagacactaaactcaaaaacaatacagacacaaaatattaacatttctggcaaatgtgattaggagaaaaagtttaacatcactggtgaataggaaaatgcaaagaaaatcaagaaaccattttcctcctatcaatttaacaattgcttttttaaaaatgatactatccaagctaggtgcggtggcttacgtttataatccctgcactttgggaagcctaggcaggcagatctctggagcccaggagttcaagaccagcctgggcaacatagcgagtctcagtctctacaaaaaatacaaaaattagccagtgtagtggctcacacttggggtcccagctatttgagaggttgaggcaggaagatcactggagcccaggaggctgaggctgcagtgagacgtaattacaccattgtaccccagcacgggtggcaaagtgagaccctgtctcaagaaaaaaaaaaaaggatattatctagtgtcagtgaagacttggagaaaaatccttatcattggtggaaatattaactgatacagcatttttggaggacaaattaacatatctatcaaacgttaagactagatcctttttgacaaatgagcgcttatttagagtggtagattgaccataaaatatggatccaatactgacacagaggttaaaaagaaaaagctctctctcttactttatcccagaagaatttttaaattttgtattttgataatatattgttttataaagattcagagctaccatctttttggtgcattggatcttttatcaatgtatatattctctttagctctctctcttaaggtgctttatcataaaattatattttgtctgatattcatattgccacctatatttcttttagtttgcatttgctgttgttcatccattattttcttattctctttctttcttttctttgtttaaattgagacagagtcttactctgttgcccaagctggagtgcagtggcatgatcatggctcactgcagcctcgacccctcggctccagtgatcctcctatctcagcctcccaagtagctggtactacaggcatgttccaccatacccagctaatttttttttttttttttttttttgcatttttttgtagagacagggtttcaacattttggccaggctggtctccagctcctggactcaagccatctgcccgtctgagcttcccaaagtggtggggttataggtgcgagccattgcccccagctatttattcttcttcttctttttttttttttaagatggagtttccctgttgttgcgcaggctggagtgcaatggcgagatctcagctcactgcaacctctgcctccctggttcaagcgattctcctgcctcagtctccctagtagctgggattacaggcggatgccacagtgcccagctaatttttgtatttgtagtagagatggtgtttcaccatgttgatcaaggctgctttcaaactcctgacctcaggtgatctgcccgccttggcctcccaaaatgctgggattacaggcgagagccactgcgcctggcctgcccctagctatttcttattttcaaaaactgttttggttactgtgtatctgatgaacatcatattgttggctttaaaaataattttaatagactatttttaagagcagttttaggttcatagcaaagtttaatggaaagtacagagagttcccatacacactcctcacccccacatgcataggctctccactctcaacattccctacaatagtggtatagctgttacaatcgatgaactaacactgatgcatgaatatcaccccaagttcacagtttacattaaggcttcttcttggcattgtacattccatgggtttgggcaaatgtagaatgaaatgcaccatcattacagtattgaacaggagagtttcactgccctaaaaatcccccgtgttcatctatttattcctctctctccccaagtccctgacaatccctaatctttttactgtctccataattttgccttttccagaatgtcatagagttggaatcacagagtatatcgcgtttccagattggcttctttcacttagtaatttgcctttatgtttcttccatgccttatttatttttatttttaatttaattaatgtttgtgggtacatagtaggtgtatatatttatgggatacatgaaacattttgatacaggcatgcaatgtgaaataagcacatcacagggaatggggtatccatcccctccaacatttatccttcgagtgagttacaaacaatccaattacactctaagttattttaagatgtacaattaagttattattgactatactcaccgtattgtgctaccgaatagtagataacattcattctttctattcttttgtacccattacccttgcccacctccccaccctccatgtcttctcatgccttgataattcctttctttttagctccggataatattcctttgtctggatgtaccacagtgtatttatccatttacttacccaaagacagtttgtttgcttccaagttttggcaattatgaataaagttactatagacatccatgtacaggtttttatgtagacacgagttttcagctaatttgggaaaaactaaggagtgtgattgctgggtcatttggtaagagcatgtttagttttgtaagaaactgtcaaaatgttctacactactggtgggaatgtaaagtggtacaactgctatggagaacagtgtggagattccttaaagaactaaaagtggaactaacatttgatccagcaatccccctactggatgttaacccagaggaaaagaagtcattatacgaaaaagatacttgcccacgcatgtttatagcagcacaattcacaatggcaaaaaatgtggaaccaacccaaatgcccatcaatcaatgagtggataaagaaactgtgattgagatatatgtatatataaaacagaatactactcagccataaaaaggaatgaattaatagcatttgcagcaacctggatgagattggaaactattattcaagtgaggtaactcaggaatggaaaaccaaacattgtatattctcactcataagtgagagttaagctatgagttaagcattgagcataagaatgacacaatggactttggggactcagggcggaaagggtgcaaagaggatcagagataaaagactagaaatatggtgcagtgtatactgctcgcatgatgggtgcacccagatctcacaaatcaccactaaagaacttacttgtgtaacccaataccacctgttccccaataacctatggaaataaaaaaataaaataaaatatttgagaagagaaactgaaattcttctacttaaagaagaatagcattttaagaagttgccttgatactaaaatctgcaggtattaaaaaaaaaggaactgacaaaatgtcttccaaaggggctcttgattctgctttcctaccagcaatgaatgagagtccctgttgctgcatgtccttgccagcatttactgttggtgtgtattagtctgttctcacactgttctaaataactttccaaaactgagtaatttatgaaaaaacgaggtttaattggctcacagttccttaggctgcacagaaagcatggctggggaggcctcaggaaactttcaatgatggcagaaggcaaagaggaagcaggcaagtcctacatggctggagcaggagaaagagagcaaagcgggaggtgccacacacttttaaacaaccaaattttggccagcatggtggctcacacctgtaatcccagcactttgggaggctgaggcaggcagaccacttgaagtcaggagttctagatcagcctggccaatatggtgaaaccctgtctctactaaaaatacagaaaaattagctgggggtggtattgggcacctgtaattccagctacttgggaggctgaagcaggagaatcgcttgaacctgggaggtgaggttgcagtgagctgagattgtgccactgtactccagcctcagcgacagtgcgagactccatctcagaaacaaaacaaaacaaaacaaaaacacacaaaaacctcccccagctttcatgagaatgaactcactatcacgagaacagtgagggggtcatgatccaatcaccttccaccaggtccctcctccaacactgaggatcacaattcgacatgagatgtgggtggggacacaagtccaaaccatatcagtgttttcagtgtctgacattctgataggtatgtagtggtatctcattgttgttttaatttgcatttcccttatgacaattatgttattgctggatgtttatgttttcattcagcctaagagtatttaaaagttttttaactatggtaaatgacacatgaaatttaccatctttatcatgtttaaacatactgtttagtagcattaactatactcacattgttgtgcaactgtcgcaatccatctttagaggtttttcattttgcaaaactgaaactctgtacccattaaacaactccccattgccccctacccttagctgctgagagccgccattctactttctgtttctatgattttgcctattctaggcatcgcatgtacatggaatcatacagcattatttgtctttttgtgactggtttatttcatttaggataatgtcctcaatgttcatccatgccatacatttgtcagaatctgcttcctttttaagtttgaataatactccactgcatgtgtaaactacgttttttttttcttttgagacagagtcttgctctgttgccaaggctggagtgcagtggctcgatcttggctcactgcaagctctgcctcccgggttcaagtgattctcctacctcagcctcccgagtagctgggattacaagtgcctatcactaattttctgtatttttaagtagagaaaggtttcaccatgttggccaggctggtcttgaactcctgacctcaagttatccacctgcctcagtctcccaaagtgctgggattacaggagtgagctgccactgcgcccagccttttttttttttttttttttttttttttgagacagggtctcactctgtcgctcaggctggagtacagtggcactatcgcagctcattgcagccttgatctcccagcttaagtgatcctctcacctcagtctcccaaggactacagaggtgcaccatcaggcctggctaatttttaaatatttttgtaaattccaggtctcgctatgttgcccaggctggtctccaatgcctgggctcaagtgatcctcccaccttggcctcccaaagtgctgagattacaggcatgagtcacctcgcctgccttatattttgtttatccatttatttgcttctaccttttggctctcgtgaacaatgctacaatggacatagatatgtaaatatcccttcaagatcttgcttgcaaatctttgaggtatatacccagaagttgagttactggatctcatagtaattctgtttaatttttccagggactgccatactgttttcaatagtggcttcaccattttactttcccatcaactgtgcacaagcgttctaattacttcacattctgccaacatttgttatttttgtggagtttttggttttatttttattttttatagtagacgtcttaaggggtgtgaaatgtttccctttaacagagttgaggctgagtgtggtggctcacacctgtaaccccagcactttgggaggctgaggtgtgtggatggcttaagcccaggtgttcgagagcagcctggacaacatggcgaaaccccgtctctaccaaaaatacaaagattaactgggcgtggtggcacatgcctgtagtcccagctactcaggtgacaggcgggagggtcacctgagcttgggaggtcgaggctgcagtgagccatgattgtgcctctgcactacagtctgggtgacagagtgagaccctgtcataaataaataaataaatagtgagttgaacccattcacatttaatatagttactgatttctgatattttatgttttttattacattgttctctttattatttcttttactttcttatttcctaggattttttttttatacactgaattttctttttttaaaactctcttctggttgtttgaaaagttatacgtactatttctttttttttctttttttttttttttagagatgggatcttgctatgttgcccaggttggcctttgaactcctggcctcaagggatcctactccgtcagcctccagagtagctgagactacaggtgcaccccacggagctgggctttcttcctatttgtctattttcaggtaaaggctcatgttccttgaacacctgctatgttccagcccctatgcagacctttttatattgatgatctcatttaatccttacgacagccctatgaggttgctcctatttttaaaaataaactttatattttagaataaattaattttaaattagaattaacttagaattatttagaataaatatttttactttagagtaatgtttttaggacttagattctaaaaagaaaaaggaaagtgctgtaggcagtacagagagtttctgtttactctacacctagtacacccagtttcctttagtattcatagcttccatggatatggtatgcttgccaaaattaatgaaccaatagtgacacattttattagctaaaatctgtagtttatgcacatttcccaggtttttgtcaaaattttacaatctgtgtcaacataccacacgacatcagcctcctgtctcccttaggttcttgttggctatgacagtttctttgtttcgatgaccttggcagtttagaggagatggcctttaatttaataagaccttttaaacatctttctccataaacatttagaatgaatcagtatccataatttttccctctggaataagataagatcttaaacatctcatgctttgtaggaataatctaaaatttcagttccaattgagcaataaaattctttctacatttctctttctctttaaaatagtttcttaaatgtcttaatcttaagatctcagtataaattttatcagtttatttatatttgttaccactttttcatgttttgaatttaattatctttcttgaattactttttcccccccgaaggaaatattttcagaaaggatggttgggtgataaactttctgagccc

SEQ ID NO: 35 - DNA, 166536 bp, Homo sapiens
gcttcatgctgctaaagtccagtcattactaagaaacttacttctttctttgatagaaatgtctcccaatgagtgagggtaagagccgcctaattctggcatcagtaaggaagaaatcaaaactgctcagaaggcggagcttggcttcataggatttatattccttctttagagtttggagggagataatctaggaagtatagagaagaataaaaacaagaagttaggaatctaaacaaggagaagaaatacttaggcaacaatttggatttggatttaaaaatgtcctagagccatgcctctatactttaatgaacacttgagggcctaaaatgtgccaggcactacgctacatgctgggaacactgagacaaatgagaaaagaccccagctaaagcaacttagatctaggtgggcaacatatatatattattatacatatgttgctgtatgtgcttacgcctgtaatactagccctttgggaggccgaggtgggtggatcacctgagctcaggaattcaagaccagcctggccaacatggtgaaacctcgtctctataaaaatataaaaattagccgggcatgatggcaggtgcctgtaatcccagctattcggtaggctgaggtgggagaatagcttgaacctgggaggtggaggttgcagtgagccgaggtcctgccattgaattccagcctgggcgacagagcgagactccaaacaaacaaaaaaacttagataccttagatccagagggtaataaagacaagtacaccaactacaaaacagcaaatcagagaaaaacaagatgctgtggaagtacagaggaatgacacgagccacctcttttataatttgcaagatataaaagctactgatgtacacgccaccacaaattaaattaaaaagagaaaagtagaagaaaaatactaggaaatatagcaatgtatttgtgataccatttcgcctgaattaaatcctctaaataacttgaaaatattaaccaggcttcctacctgagaaacggttttaattccatgcttgtttaaaagctttctataaaactgttctgtcttttcaggagttgaattgggttcatccttcgtaaataaacagatatcttctgaatctgatcgaatactatgaggcaaggtcctacaaaatacgtgaaaagaaaccgaggaaagcattattacacacattatgcatgtttgtatcacacagaatacgcgataaacttagtgttatttaaataacttttagtcatgctagttaagcaaataatgcaccaagaacaacacttaaaaatacatttcatggccggtagtagtggctcaagcctgtaatcccacactttagggaggccaaggcagatggatcacctgaggtcaggagttcaagaccagcctggccaacatggtgaaaccctgtttctactaaaattataaaaaattagccaggcacggtggtaggtgcctgtaatcccagctacttgagagtctgaggcaggataatcgcttcaacccggaaggtggaggttgcagtgagccaagatcgcaccactggactccagcctgggtaacaagaggcaaactccgtctcaaaacacaaaaacaaaaaacaaaactcactttcaatggcaagtaaatcacaaaaacacacaggcccaaatatcaattaacacttgggatacaacaagaattaaaatatacttaaagacttccaaatgcttgcatatataattattatacatatgttgctgtatgtgcacacgtactgtaatgcgctataaaaacctagcttaatcaggacaagcctggttcagaattttaccttctttaaaactcttagctccataaacataataactctttcttcttttcctttttttgagacagggttttgctcagtacccaaggctgcagtgcagtggtgtgatcatagctcacgatagcctccagcatagctgagactccaggcacgtaccagttgggtgtaggcccagctaatttttgtatttttcgtagagacagggtttcgccacatagcctgggctggtcttgaatttgtgggctcaagcaatccacctgcctcagcctcccaaactgctgagattacagtgtgagccaccacactcagccaacataacttttttttttttttttgagatgggagtctcactgtcgcccaggctggagtctctgcaacctctgcctcctgggttcaaatgattcttgcacttcagcctcccaaacagctgggattacagacgcccaccatcatgtctggctaatttttgtatttttaggagacatgggatttcgccatgttgggtcaggatgatctcaaactcccaggcctcaaatgatccacccacctcacctcccaaagtgctgagattacagggatgagtcaccatgcccagcataacataacttttaagaattgaaacagcccaggcatggaggctcatgcctgtaatcccaacactttgggagactgagagggaggactgcttgagcctgagttcgagaccagcctggagaacacagtgaaacctcatctccacaaagatttcaaaattagctaggcatggtggtgtgcacctgtagtcccagctacttggaaggctgaggtgggaggatcacttgagtcaggtcagggaggttgaggttgcagtgaacacagatctcactattgtactccagctgggcaacagcgcaagatctcgtctcttaaaaaaaaaaaaaaaaggagagataaaagaatcgaaaccaaaaacatggactaaaccaagagggaccagcaaacacaattatgccacatcttacagaaaataaaatacaagggtttaactcatttcttatgcttacaacctatgttctgaagaagcattctgtataatcaccatggatttcttttccatagacagaaattcactgcagtttttaatagtctctgtacaaaggaataaattgtagccccaaagaatttttgcttgacatggaaagataacagtttctaataaaaaaataaaataaaataaagctgtttaacttattccacctttattctttcgaacaccacgttttcgattcaacagacctgattacgttagctgtccaccaagctctaagaaaactggtgaaatttctagaaaattttagcacatctgaatttctacggttcttttattttttattattttttatttttttgagacagagtcttgctctgtcgcctaggctggagtgcaatggagacatctccgctcactgccactctcctgcctcagcctcccgagtagctgagattacaggcacccgccatcatgcctggctaatttttgtatttttggagagacagggttttaccatgttggccaggctggttttgaactcccgacctcaggtgatccgtccacctcggcctcccaaagtgctgggattacaggtgtgagccaccacatcaagcctctatggttcttttggacatagttgttttacttcacgtcagatttttattataagtttgcaaagtttccattagtaaccatgatgcaattgttcgagttacaaagaataaacacacagataaaaacagcaaaggtagaaaatcacaacttacaatctgaccctcagttctttacttggaattttccataataccaccattaaaaataaactttcattctcattcaaaagcaacccataattgtttttcctggacttgcaatgcgtcaagagagcgtccactgcctttctaacctgcaaagtggaaattagacaaataagtgaaatgttttcacaataacttacacaaataaatgaaatgttctcaatctaatttagcatttgccccctcccacaccttctattttttcccttccaacttctatttcaaggggtaacctccataaccgtatctattaggatcctgcagtttatattcacagaaatctaagaatccatcaaacatgcctaagtacccacttccagtactgtgtgcagaagggcacctcttctacttaaagagattgggctagagggaaacgtgcccctcctgccctcaatgatgaaagcagtaatcccaggaaaaacgcaaagcaaaatgcatttagcatttactgagaactcctggcaattctcctgcctcagcttcccgagtagctgagattacaggcgcccgccaccacgcccacctaatttttgtatttttagtagagacggggtttcaccatgttggccaggctggtatcgaactcctgacctcaggtgatccacccgcctcggcctccaaaagtgctgggattacaggcgtgagccaccgcgcccggcctactgagcaccttcttaccatgtaccaggccaaagcgctttacactcattacctctcccgatcctggataacggggagccgaagggcccactttaaataacgggtaacagacctgcaaaactaagcgattcggtcaagcgctaatgatagggaagctaagccaggtcgccaggtctatctcatctagctccacagcacacttgcaacccaattcactagcgccaggccgcaggaccagggaaagcaggcgcccacccacgtgtgtaaaggggagagacagctgaggcacacggcccgccagcgaccgtcccacagccccggggaagtccgccgagcacgcactcgggttccggcaccctgcgcctcacgaggtaaccgccacactgcttccaagccaccctccccaggaaccactcacctgttctttatccagctgcttccgtgctgtcggggccgctggagtcgaggtggaggttccagtagcggctgcagaagacagcgaggccgaggccgaatcctccatcttgtttccacctcgtgaagaggcgcgtgtgcaaccccactgctggcttctggtgcgcacgcgcgagcaagcccggccccggaagcgagggggcgggaaccgagcctctgtgcgtcatttccgggagagcgtggggtttcgctctccggggcagtggctgctgtcagaatcccttctttgaggaggcacctgctcttccgcttttctccagctttccatgagctgtggggagtagcttgggtgtcctctcactcttactagatagaaatcaagaaagcgccttgaggcgagagaagagtcccgtcaggaggcccagtggggtcctccacactccacggtccccgcctccgggaaggccgcgcgtggcatgggcagagcgcggaatcctggctccactgcccacctgcccgttgactttaggcgacgccaaccccaggctggtgaggagtccctgaaatataaggcacgggagccacccggagccacccgacctgccacgttaagcagcatgagggaccgaaagatgagtctgggccagtctcttaggagcttctggtctcgcagagaggcgggaggtaagatcctgtacaaataagcgtggctggtcgtgcgcgtggctggcgtctggaatcccagcgctctgggaggccgaggcggagggattccaggagttggagaccagtccgtgcatatacgagactccgtctctccaaaaattataaacattagccggcgtggtggtgcgcgcctgtagtcccggctacttgggaggcggaggatggaggatcttgaggaattcgaggctcggtgagttctgatccgcgccactgcactccagcgtaggcagtagagtgagaccttgtcgctaaacaaacaggttaggagtggaggctggataactgacaaatggaataccttagaacaggggagtccaatcttttggcttccgtgggccacactggaagaagaattgcctgggcccatatataaaactaatactaatgatagccgacgagctttaaaaaaaaaatctaaaaaaaatctcgtaatgctttaaggaagtttacgaattcgtgttgggctgtattcaaagcctggcctccagggccgcacgcggcccttgggtaggacaggtttgctttgtaatgtcttcctcccactccacccgcctccccagaggtacccttaccagtgtctcctggaaccttccagagatgttctaggcatgtttaggagatacttctcctttctcttgttggatgggtttaattaatttttttccttttttttttttttttttttgtaatggagtctcgctctgtcgcacaggctggagtgcagtggcacgatctgggctcactgtatccttcgcttcccgggttcaagcagttctctgcctcagcctcccgagtaactaggattacaggcacgcgccacaacgcccggctaatttttgtatttttagtaaagatggggtttcaccatcctggccaggctggtcttgaactcctggacttcatgatccacctgcctcggcctcccaaagtgctaggattataggcgtgaaccaccacggccaatttttttttaaagagggagtcttgccctgacgcccaggctggagtgcagtgatcttgtctcactgcagtctctccctttcgggttcaagcagttctcctgtctcagcctcccgagtagctgaaactacaggcggacgccaccatgcccggctacttttttttttttttttgagacagagtttcgctcttgttgcccaggctggagtgcaatggcgagatctcagcccaccgcaacctccgcctcctgagctcaagctattctcctgcctcagcctccccagtagctgagattacgggtatgcaccaccatgcctggctaattttttttttttttttttttgagacggagtcttgctctgtcgcccaggctggagtgcagtggcgcgatcttggctcactgcaagcttcgcctcctgggttcacgccattctcctgcctcagcctcccgagtagctgggactacaggcgcccgccaccacgcccggctaattttttttttttgtatttttagtagagacaaggtttcaccgtgttagccaggatggtctcgatctgacctctgccctcgtgatgcgcccgcctcggactcccaaagtgctgggattacaggcctgagccaccgcgcccggcgttaattttgtatttttagtagagacggggtttgtccatgttggccaggctggtctggaactcctgacctcaggtgatccaccttggcctcccaaaatgctgggattacatgtgtgagccactgtgcccagccttttttttttttttttttttttttttttttaagaaacggagtctggctctgtcactcaggttggagtgtagtgtcatgactatagcttactgcagtttggaactgctgggttcaacagatcctccggcttcagcttcccgagtaggtaggactaaaggttcaggtcaccacgtcctgctaacttttacaatttttttgtagagatgaggacagggaggggtctcaccatgttgcccaggttggtctcgaactcctggcctcaagggatcctcccacctcagcctcccaaagtgctggggtaatatgcataaaccactggacctggtcaaacttttactttttagaaaaagacatatagtagcctagtatacccattgttccgcaccttgctttttcttcttaatataccttggagattgttccaagtcagtacacaaagctctgcctcatctttttaaacggctctgtggtgttccaccatgcaacaacactacagtttatttaggaacttttttaggcgccttcaggttggtttcagactttttgcaactagttatataaagttttgagagatggaggaatgagagtaataggctttccttcaattgctttcaaaaggtgttccttccatgaaaggatgttctgctaatctctagtaatagccttgtgtttaatcaagttgtagaagaaatgttctgaaatcattggcacctgcttccctttgtgtattctagaatctattagtaagagtggtttccttttagcacagcttaatgaattgttacactgggctttgttgatccatgttttgtagtattcttgagaatatggaggctatcagatgttctttcacctgaacttaagtttgagaaccatacttgtaggccaaggacacagcatgaatgctggtgaaagtgtatggaagtgtttggaagcagtacatagctagagcaggaatgtgcagaggggaggaatgggagatgcagtttggaaagtaggtaaaggaatgaattcattatcaagctgagggtttatactcactttggagaaattgtaaagataaaaggtttttgaactggcagtagagaagaaaaggtagtgatgatttatgcgttaggtaagttaataatctggttgtgatattgtggttttaaagatgtgtcctatctatggattctttgatacctctcccctcaactaatgaggcttcgtttccctccccttgagtatacactgaacttagtggcttgcttctatgaaacaatatggcagaagtgatgctatatcacttctgagattaggttataaaacgactgtagtttcatggcccggggaaggtggttcatgcctgtaatcccagcactttgggaggccaaggcgggcggatcacaaggttaggagatcgagatcatcctggctaacatggtgaaaccctgtctctactaaaaatacaaaaagaaattagccgggcttggtggcgggcacctgtagtcccagctactcgggagaccgaggcaggagaatggcgtgaacgggggaggcagagcttgcagtgagccgagatctcaccacagtactccagctgggtgacagagcgagactccgtctcaaaaaaaaaaaaagaccgtagtttcatctttgatgttctttctctccctgtttccctctctcatttactccctccctcattacttgtaaggcagccctggagagagggaagccagctgccatgttgtgaggacacttgggcagccacacaagtgaggttggaagtggatcctccccgggtccaaccttgagatgattgcaaactcaagaggccctgagccagaaccactcagctaggttgctcccagattcctgacccataaaaactgtaatatcataaatgtgtgttcttttaaggcactaaattggggtaatttgttatccatcagtagataactagtacagattagtatacctcctgtcttcagactcatagacatattcacctgtcttggaaaagtcctattaggaccttatcctcggcaagtcccgtcgtgaatcatcatcttctcaaacctgcttctcttcttgtgtgtgtgtgtgtttttttttttttttttttttttttttttttttttgagatggagtcttgctctgtcgctcaggctggagtgtagtgcagtggcacagtctcggctcactgcaacccctccctcccaggttcaagcgattctcatgcctcaacctcccgagtagctgggattacaggcacgcgccacggtgcctggcaaatttttgtatttttagtagagacggggtttcaccatgttggccaggctgggctcgagcccctgacctcaagtgatccacccacctccggctcccaaagtgctgggattacaggcatgaaccaccgctcccggcccctcttgtgttttctgtttccatcattggtaccaccaagccaaatatgagagttattcttaactctttccttctcatcccccaaacatagtcaataacaaagtcttgcttgttccttttttttttttttttgagatggagtctcactctgtagcccaggctggagtgcactggcgcaatctcatctcactgcagcctccacctcatgggttcaagcaattctcctgcctcagcctcccaagtaactgggattacaagcgtgtgccaccatgctccgctaatttttgtatttttagtagtgatggggtttcaccgtgttggccaggctggtcttgaactcctgacctcaagtgattctcctgcctctgccctccaaagtgctgggattacaggcatgagccactgcaccgagcccttgtttattctttttaaatgtctcttgcatgtatccaattctttttattcctgccacgttgtggtagaggacattatcatgtatttgttttttgttttttgcttagattactgcaacaacctcttaacttgtcttcccacatctacttttgcatcttttatttttatttattttagttttgggacaaggtctcactctgtcgcgcaggctggagtgtggtggggtgatcacagctcactgcagcctcaacctcctggactcaagtgatcctcccacctcagactcccaagtagctgaaattacaggtgtgtgccaccatgtccgcctaattttttaacttttttgtagagatggggttctccctatgttacccaggctgatctcgaactcctgggctcaagtgatcctcccacctaggcctcccagagtgttgggattacaggtgtgagccatcacttccagcctaattttgcatcttacagtccattctctacccgtcggatggcgtaatctttttaaaattgaaatctgatcatatcaaactgtgctgcatcaccttcattggattcttgtcattaggatgaggcatattccttaatttgccttgtatgtatcacagtttgcatctcttgtctggcatcctgtgtagtttagtatttgtccaagaaaatagtgttgcagtttgaaagataaatcatatggactgggcatggtgactcatgcctgtaatcctagcactttgggaggccgaggtaggatttcttgagcttaggagttcaaagctgcagttagctatgcttgtgctactgtactccagcttgggtgacagagtgagaccctgtctaaaaaaaaataagtaaaaatttttaaaagataagtaacatggtcactctcaacatggtaggcactcttcatctggtccctttctttttatctctctaacttcataccctgccactcaacccttcaatctttaagtcctagtttcaactctgcaggttctacttttcttcataccttccaatgtactgtcacttcttcctggaacactatcaccttgtacctccatatcccatccccacatatattaactcatccttctaatttctgcttcagattacttctggagaattgtagcttagataatcctgtccttttaccccaaaatatttatagttttcctactataattggctctcccccatttgacgataagctttgagagggtagaagagagccagttaatggtaggaaaactacaaatggtatcttcactatttttccttatttatttattataagtgacataaatagtatttctttagaatgaataatgcattagaatggcctgagacagggcttaaggggatgaacataggaaactattgtggtatcaagatctgatggtagggtgatagtgaggacagggtacttatactgcttgacctgagcttggacatagaaggagagaaatgtagattactccctaattctaagagcctgaaaagctgggcaaatgggtggtattaatagaactggggaagaaaggaggagcagcagatttagagggaaaacataagattccttttcagtagagtgctgtaccacataatgatgtttctttcaacaacagacccacatacatggtcacgtaagatcataatggagctgaaaaattcctgtcacctagtgatgtcatagccatcataatgtcagcgcattcctcacgtttgtggtgatgctggtataaacaaacctgcactgcccccaagtatggcaaatataattatgtacagtacataattacttgataataataaacaactatgttactggtttatgtatgtactatactgtatttttttttttagggatgggatcttactacattgcccaggctgttcttgaactcctgagctcaagtggtcctcctgccttagcctcctgaagtgttgggcatgagattacaggggtgagccaccatgccctgctatactgtacttttttttttttttttttttttttttgagacagagtctcactctgtcacccaaggtggagtgcagtggcacaatctcagctcactgcaacttccacctcctgggctcaagcgattctcctgcctcagcctcccgagtagctgggattacaggcgtctgctgccatacccagctaatttttgtatttttaatagagatggagtttcgccatgttggccaggctggtcttgaactcctggcctcaggtgatctgcctgcctcagactcccgaggtgctgggattacaggcgtgagccaccacacccggcctatactatactttttatagttattttagagtgtatcccttctacttataaaaaaaaagttaactgtaaaacagcctcagagaggtccttcaggagatattccagaagaaggcattgttaccataggagatgacaactccatgtgtcagtgtcagtgtccttgaacaccttctaatgggacagataagatgtggaagtagaagacagttgatattgatgatcctgactctgtgtagtcataggcctaggtgtgtgtttgtgtcttctttttattttattttattttattttattttagcttgctttctctctctctctccgccaaccccccccctcccaccgcccgccttctttctttcttttctttcttttttagtagagacaagttctcgctctgttgcccaggctggtctcaaactcctgggctcaagcgatcctaccgcctcgacctcccaaagtgctgggattacaggtgtgagccactgtgcccagcctgtgtttacttttttttttttttttttttttttttttttgagacagagtcttgctctgtggcccaggctggagtgtaatggagcgatcttggctcactgcaacctccacctcccgggttcaagcgattctcctgcttcagcctcctgcgtagctgggattacaggcacatgctaccacgcctggctaatttttgtatttttagtggagacagggtttcactgtgttagctgggatggtctcaatctcctgacctcgtgatctgcccacctccgcctctcaaaatgctgggattacaggcgtgaactactgcgcccagcctttcatttttaataaaaacgctttaaaaggggcaggtgcggtggctcacacctgtaatcccagcactttgggaggctgaggcgggcagatcacctaaggtcaggagttccgagaccagtctggccaacatgatgaaaccccatctctactaaaaatacaaaacttagccgggagtagtggcaggtgcctgtaatcccagctactggggaggctgaggcaggagaatagcttgaacccgggaggcggaggttgcagcaagccgagatcaccccattgcactccagcctgggtgacagagcgagattccatctaaaaaaaaaaagtttaaaaacgaaaaaaaggccgggcatggatcacgcctgtaatcccagcactttgggaggctgaggcgggtggatcacgaggtcaggagattgagaccatcctggctaatatggtgaaaccccgtctctactaaaaataaaaataaaaaaattagccgggtgtggtggcatgcacctgtagcccagctacttgggaggctgaagcaggagaatcgcttgaacccgggaggtggaggttgcagtgagcagagattgcgccactgcactccagcctgggcgatagagtgagactccgtctcaataaagaaaaaaaaggaaaaaaaaattaaaaatttcaaaaatagagaaaagcttacagagtaaggatataaagaaaaatatttttgtgcagctgtacaaagtgtttgtgttttaagcaaagtgttaactacaaaagagtcacaaagttaaaaatgtaagtttataaagtaaaaatgttacagtaagccaaggttaatttattattgaagaaagaaaaaatttttaaagccaggctcagtggtgtgtgcctgttgtcgtaactactcaggaggctgaggcaggaggatcgcttgagcctgggagttcaagttcagtctagacaatatagtgagacccctgtctcaaaaaaaaaagaaaaataaatctagtgtacgtaagtgtacagtgtttgtaagtctatagtggtgtacagtaatgtcctaggccttcgcattcactcacttattcacccagagcaacttccagtcctgcaagcgccattcatgataagtgccctatacaggtgtgccatttttaatgttttatactgtatttttgctgtatattttagatacagttgcctacagtatttagtacagtaacatgctgtacaggtttgtagcccaggagcaataggctgtatcacatagcataggtgtgtagcaagccataccatttaggtttgtgtgagtacaccgatattcccacaactataaagtcatccaaagacgcatgtctaaggatgtatcctcattaagcaacccatgactgtattttgagtttgaagttccaatggtacatctaaatggatctggaatgtggaagagaatattcctgaactaaaaagaaggaaattagaagtcattttcatggaggtgatgattaaagctttgttaataggtgagattgcaaaaaaaaagtctagacgaataatagagttgtaaagaaaccttcaataacaaacaaggaggaaacagagaaatagttgaagatgtaaaagaaaaccaatttaggaggctgatgcagccggattacttgagctcaggagttcaagactgccctgggcaacataatgagatcctgtctctacaaaaaatagaaaaattagatgggtacggtggcatatgcctgtgtcccaaatactcgtgatgctgaaatgggaggattgcttgagcccagggggttgacgctacattgagccatgattgcgccgctgcactccagcctaggcaacagagcaagactttgtctcaaaaaaaaaaagaaagaaagaatgaaggccgggcgcagtggctcaggcctgtaatcccagcactctgggaggccaaggtgggcagatcacgaggtcaggagattgagatcatcctggctaacacgacgaaaccctgtctctactaaaaatacaaaaaattagccggggatggtggcacgcgcctgtagtcccagctactcaggaggctgaggcaggagaatggcttgaacacgggaggcagaggttgcagtgagctgagattgcgccactgcactcccactccagcctgggcgacagatcgagactccatctcaaaaaaaaaaaaaaaaagaatgcaaaccaagagggtgccaagttacagaagccatgagggagtggagatatctgaagatgtgttaacactgttaaatattgaaggtgagaagaatacataataataaaagaccatattgtcagcaccacaagacagggtgaaaaaattaaaaaataaataaataggccaggcgtggtggctcacacctgtaatcccagcactttgggaggctgaggaaggaggattgcttgaggccaggagttctagactagtctggataacatagtgaatcctcatttctacaaaaaccaatgtaattaatttcaacattcgagtacccaggtctcactgataccatgaatactattaagttgtttctcttggaaagtactgagatatctctcttcaaacttcttgaaaatcttttttggaggtacataaagttaattttattagggatttggtaaatcaactaattgtaaagaacattcgaatatgttgctgaatgctaaacataaagtttaagaaacttcacccttaataatggaactcatattctagttcaaaataaatattacaatcaactagtaaccttagaaaactattagacatcgttttttatatagcactattaaatcagtggtaacacatggccaactaacaaaagaaacgccacatagtcaattggtgatgtctggattatctgaaagcaatttaatactcagcatattcttggtactgaaatctgctaagtaatattaacctaaacataattgaatcaaaggtaaaacaatattgcccaaatgtagaatgtgacattttaaggaaggtacaaaggacatggtgttttgggtcagaaagatcagtctgaatcccaactccatgatttactaattgtttagccttgggcaaggtggcttaatctcccaagcctcaatgtcttcatctgttaaatgaagctggttccctcggatttaagagaatctatcttcacagtgtctgtcatgttcatgatagcacaaggttagttctcttcttccctttgctgaaaataatacaatcattattaaatggattggaaaatgaaattgttcatcttaggggccaaaagagcttaactgcattcaagcagggaagaaatagccaatcagtaaagaaactgatatttgattctgatttgggggcgagggggtggaaggctggggaagagaaacaagagaaatatgatattgccagagaaagaaatgtaaagaggttttctgtagaaaacctgactttattaacttaggtttgctgtttatttttaactctttgtcctcatacaatctatgtgggtatcacaagtacaccattttgctgctaggtatcatagtgtacaccaaccccacttaatacatgattaacaaacaggctttttttttttttttttgagacggagtctcactctgtcgcccaggctggagcgcagtggcgcagtctcggctcactgcaagctctgcctgctgggttcacgccattctcctgcctcaacctcccaagtagctgggaatacaggtgcccgccactatgctcggctaattttttttttttcgtatatttagtagagacggggtttcaccgtgttagccaggatggtctcgatctcctcaccttgtgatccacccgcctcggcctcccaaagtgctgggattacaggcgtgagccaccgcgcccggccaggaatggaatattaaggccactcttagaagtgatttctacatttaaaaaaaataggttaaatagcacaaggttagttctcttctcctgccctttgctgaaagggatgccattagtctctttttatcattgacgcgaaccagctgacaacttgcaggactgtgttcttttaaccagtaccagtatataactggtaaatgttatgacaactcaaagtgcatctttgttcaaactaggaaagttttttttttttttttttgagatggagcctctctctgttgcccaggctggagtgcagtggcgcgatctcagctcactgcaacctctgcctcctggggtcaagcaattctcctacctcagcctccgagtagctgggattacaggcaagtgccaccatgcctggctaatttttgtatttttagtagagacggagtttcactttgctgaccaggctggtctagaactcccaacctcaggcgatccacctgcctcggcctcccaaagtgctgtgattacaggggtgagccaccgtgcctggcaggaaagttttaaatagctactatgctataaagtattatgctacgtcatcaatcagggatctataaaaggacttagagaagttattcatgcacagaattgaataaatctaccaaaaaagaaaaagaaaaggacttagaggagttattcatgcacagaattgaataaatctaccaaaaaagaaaaagaaaaggacttagccctgaagtttaaaacagttatttagtagaggtgcaagtcaggttagttctgcaagttagccctagcaacatgaaagtcacagggacaatccagttttagaattggcacatcatttagaaatggcacctcaggccaggcgcagtggctcatgcctgtaatcacagcacttttgaggccaaggccggtggatcacctgaggtcaggagttagagaccagcctggccaacatggcaaaaccctgtctctactaaaaaaaaatacaaaaattagctgggcatggtggcacatgcctgtcatcccagctactcgggaggctgaggcaagagaattgtttgaacctgggaggtggaggttgcagtgagccaagatcccaccactgcactccagcctaggcgacagagcgagactggaaaggaaaggaaagaaatggtacctcacaggcaatacagggaagaccctctttaagattggaaagggagataagggagctcatgttatttcactacctattaggatcactacattatctgtttatccttgttaagttttataaaagtagatgaagaagaggtgagacttttctctctggttttacttccttgcattagagaaattcagaagaaaggtatttgcatttgcaactaacctgtcaaagaatgctaattggaaagcaaaatcaaatctcccttcaaggatagatcatttgaattagagaatattcataaaatggagtattagcaaaaaaaaaaaaaaaaaatgagctgctgatacacacaacataatctctgaaacgtaatgtgccaaagatgacaaagttgagttcaagctatgtgattccatttatgcagagttcaaaaacagacaaaactgttataatagatggcaaaacagtgaatgccttggcaagaggggattggttggaaagtagcaggagagctttctggggtgatgtgttctgcatgttgatggggtgtttacacagttgtatacacttgacaaactcattgtaaacttaagatctgtacttcttactgtatgcaaattttaccttaataaaaaatcctctcctttgtcatacaacatctgtcttccggaacttctttacaaatcatactcctaagaatctaaatcttgaagatttattttttatcctaaaacctgatgtatttgccagggaattaacaaagatagtgataccgactgcttttaagtaacttctgtagttttaaaaaattaattcataatagaggtacagattttcagggtacatgtgataattgacacattcatacaatgtgtaccaatcaaatcagggtaattgggatatccatcacctatttatctccatgtggaaacgttcaaattattttcttgtatttggaaatgtggaacttgtgtagttgataagcaaatacaaagtcctttgggagtactgtgcccagttaagtgggaggaaatcctcattaaaaatttcaaactaaatatacaaggtacaaaacaagttaaatatggtttttttttccattatgccctctgaattatttttaccagttgagttattaccagtagcttgactcctgactaagctcaaaccagagaacagaacttttagtgaaaatgctttaaacatgtaaactaatattactgtttgatgatcatcatttccattgaaggcaaatgttaagggatcaaatgtgggcaatgggatgttaagaaaatgtgcagctaacaaacattaaatgtgactcattgcagatagaggaaatttttggcctttttttttttttttttttttttgagatggagtctcactgccattgcgcaggctggagtgcagtggtgccatcttggctcactgcaacctccacctcccgggttcaaacgattctcttgcttcagcctcccaagtagctgggattacaggcttgcactaccatgcctggcttattttagtatttttagtagagacggtgtttcaccctgttggccaggctggtcttgaactcctgacctcaggtgatccacccaccttggcctcccaaagtgccaggattacaggcgtgagccactgtgcctggcctggcctaatatttaacagaaggatcatattccaaataattcaaaaagtacacccatcagctaaaggaattttacttgttataggcagtctcttattcctagcagaaaacatacgaaaatatttcttgcaagtaatgtgggtgcacaaagccttcagaaacaatttgaaggaaagattgacagtaacaagaatttcacttaaaaaaaaaaaaaaaaagacagcatctcactatgttgcccaggctagagtgcagtggcaattcacacgtgtaaccataacccactgcagcctccaactcctaggctcaggtgatcttgccaactcaggagtagctgggactacaggtttgtgccactgcatctagcaaatttcattttttttttttaaagactgttaacaggctggagtgcagtggcacgatctcagctcactgcaacctctgcctcccgggttcaagtgattctcctgcctcagcctcccaagtagctgggattacaggcgcacgccaccacactcagctaatttttgtatttttagtagagatggggtttcactatattggccaggatggtctcgatctcttttttttttttttttttttttgagacggagtctcactctgtcgcccaggctggagtgctgtggcgcaatctcggctcactgcaggctccgcctcccaggttcacgccattgtcctgcctcagcctcccaagtagctgggactacaggccacgcccggctaattttttgtatttttagtagagacggggtttcaccgtgttagccaggatggtctcgatctcctgacaccgtgatccacccacctcggcctcccaaaaagtgctggcattacaggcacacgcctccacgcccagctaatttttgtgttttttagcagagactgggtttcaccacgttggccaggctggtctggaactcctgacctcaagtgatctgcccgcctcagcctcccaaagtgctgggattacaggcatgagtcaccgtgcctggcctgaacccctactttaatagcaagcttggtcccaagttttaagctatgattggtttaatgccaaatacctagaggctgactgccaaaacctcaaagcgattcacctaaagacagttcaaacaggaacttagtacacaggaatgaactgctgtcattcaagtagccactgtgtatgttacctttatcattaacttcttcttgcccttgcacattgaatgaaaagggcaagcactatttggtctcttgatctttattaaaaatcctgaatgtagaggttcatagttctaataataattgacgtttcccccaactctactgttcacataaaaccacataactgtgatctagttatttattattcagcatccctaacttcctatagggttcttatttttgtttcctaaggttgtcgtatacattatacaaaagacttgcatgccatatgcaagcagatgacgtttgtgaatcccttatgtgacagagcttattagatccatccaacaaaccttttggtagatggttccagtacctgatacaaaaataaaaggattgtacaaaaaagggcatggtttttgcttgttacaacacaggtaattacaaacgacaaatccttcaaaagggaagatgacaacttttattgttattacaaaagcaaatttaatttgtcatttgaataattgcaagagcagactaagggcttaatcctcacacaggcaccaagtcaggcacagtaggtagctacaaatcgtaagaaaaagctttctttcctacctagagcactcttccatgctttggaattaggctaaaaaactcaacaaacctgatcagttccctttaatcctgttttttttttttttttttaaatgagatctaggtattaacctgctgtctagcgaaaactagtcactaagtcctggcctgagagatacccacatttcctttagaacaaacagaactaatacctgtgtacatttctgagagcctgatgtgtgagtccttaaaatgtagaccttgcaggaggcttagacctcagtttcacctaatgcatgtggaggaaatggaggtgagaatagtcacctgaagagtgcaagcgctccagctccagcacacacactcttccctgggcagcaggaaaaggaggtaacaaggacttgggctgacatctgaagcactaagctaatgtgcctggtagaggggagcctcaggaagcacaagatgtcattccacctgtgctgtccacaaacctgaggtttccacatcgttttaaagggcacagtggcaaatgtgacaaggcagaaaacaataaccatttcaaggatcacttaaggaatcctggtgttttctgcctaatcagaagtagtaccaacctgcttttcccttatattggagaacataaaggttttaattaatctccactcccacaccttcaggcccttataataatccttagtaaacaactcagctagcattattgtttcaaggaagcataggattagaggtatgtgagaagtgtatttattgaagggaagactcagtaagttctaggatattaaagtcaagaatatcctagagccaaaaaccaccaaaagttgaaccaaatctacctgaactgaactgatagtaaactgggtcaaatggaatccacggaattactactggaaaataaaaacacttcctattctttctattcctattcatttactatgaaacctaatctaaccaactgactgctaaatgtaaagctagttaagtcttttgtgcatgtgcaattacacttacttaacaagatgctgccatggcgagatctctcacgaaagaaacaagatcaaggatgtactagatggcatctgctagaatcactgaaaaagttagctgcaagaaataaaagcctattatttggagatagataattgtcccctgaatccactggttgttctcttccttacctatgtctgtgaaaggattaatggcacagtttgataaggtaagccaacaatgaatataacatttaaccatcctaaaatcagagctatagtgctataaccacatttttcacaaagggttttaaagttgaaagttgcctgatgttaagacctgtaataaaactgcgtattttccccttgactaccttaaatccctacccaaagcaatgaagctatcatccatgaagtagcagtccatgaggaagtccatgccagtaagaaaaggtgctagagtgctgttatgtgtaatagtcatcaaagatcacggagtaattccagtcattactagtgttcctgcagatcgccaagggagcttagctgatttttttccaggttcatcttgggagcagtttttgatcataggttcaacttttttcttgggttgcaaaactgcatctggctgcaagtctaacccaaaatattcgcagcgtatcagctgagaggatgccggcaactgttgaactacatcacagttcaaagtcccatattgtgagagcagtacttgtagtttatgtaaccagcaaatatgagttacctcgttacagtgaacaacctgcactgttagagtttaggaacttttgacattcggttatcacatatttcaaagattttcaactcacaaaaaaaaaatacatgggcttaattactcagtaacactttactatttgtcacttaatctcaagacaatacacactcagtccaactcttttggtttgattttacatagattttcacttacttctgcaaattaaaaacaagaaatgagtgctgtatttccccctctcccacagtaagaaacaagggtttaaaatggcaattacttagatgtttatttcaatatttcttaaattcactttattaatttaaaaaactaaataatcgcatgaaagttatataaagaacatcattaatgtgaaaagatgcaagaaaaaaatcattctagtagagcaacgttagagaacaaatgcttaggtaataccctaaatatgcagccaactaccctatttttgcactgttgaccatataagcacgtttgcatttgcagaaaacagaatgacagcataggaatttgtattgctctataacggtccaacatctccacataatgccaagttcaccttagacattttatttacttatccaaatgaacagcctgtgtaagcaggattgaaaatgcatcaactttaaaaagatgagaacaattttcaaagcccatagaacttatgttgctggttaattttagcactgaaatttcttttgaataatctaatcttgcaaatatgcaagaatccagtggaatttttacagttacatttgtatttgtatgacctgttactttttagaggtaggcccttcacagttgatatccaagttacttaagagtcttggcaacatgcacataatagtctaacagtgtaaatgttttagtagcaaacataacttattttttaaaaatgtgttctatttagaaagggaactcttatctctggaagtgatttccgtggctcttgaacttttaaatattcattaaaattcaagcaattgctagtatttgtttttattaacatggaattacaaaaagaactattatgttttgattaaagctcctatattttccagaaaaataaaagcccagagatttgcagacataataaaatctatttaaatttcatgcaatagccataattatagttttaagaatctgtaggacaataactttgctctgtccataagatgtagcctcattcaagaaatgaatgggaatttcacagttaagaaaacactaggccaagtgcggcgcctcatgcctgtaatcccagcacttttgagaggctgaggcgagtggatcacttgaggtcagaagtttgagaccagcctgaccaatagggggaaacctcgtctccactaaagatacaaaaattaactgggcctcgtggagggctcctgtaatcccagctactcaagaggctgaggcaggaaattgcttgaatccgggaggtggaggctgcagtgagctgagatcgagccactgcactccagcctaggtgacagagtgagcctctgtctcaaaacaaaacaaaacacccattagattaagttttatgttctgtgactggaaatacagtctgtctaggcttttcttttctgaggagcaaaattatagggaagagacttgtcattaaatatacaaagtatcttatttagagagaaatcacaatctaaaagaggctatctttgatcaatggcaacactcaacatcaagggggctttggataaacccacaaattgcctccattcctcatttattctcatgaaaaatttcaaagtcatgataattatagcagagagtcattcaatctaaaacccacacaatgctgcactgtggttcatcaaaaacatggttagcaaatttcagctttacacttaagaaaactcagtcaatttcaaataattgagataaaacttataccctgcttgattctgcttatcgctgataattttagtctgttcagattctgatgattctaaatattttcatttagttgctaggttgagatttagctttaaccagcaaggatcatccaacctttaaagttactgatacaaagagtaaactgagtaacttgtagaagtggcacttgcaactgatacggttttcatactagaggcatgcagctctatttataaatactaccagaggaatttttgccaggtctcaaacatgctttatttgttgttaattccactaatttaacaagttaatggaattttctctaggggtacaatttcattacgctttacttataaaaactacagtatgctgttcttttattttaaaacaacttactgtgttcaagaaatcatgttacaatataaattggcaaaaaaaaaaaaaataaataaataactaaaagacctagtaaagcagtgtcacatttgcataaagggatttaactgcatgtatgcattaaccatcaaaagaaggggtcaaactaatcctttcctttaatacaaacttgaacgctgtgaatgtctcatttatagtgggtagggaaagagtttataaaagtccaagtaataaaatgtattcaattacttgggaaagttaaaaagctaatgcaacaatgttacatccagataaaaaacattattcaaaagcaattcaaataccgaaaaggatttcaaattgaatattttattaacatggtagttgcctttgtaacatgtgcacacacactcgcacactcagaatgatctgcctgggggaaaaatactaaatatgcctaaggggaaaatgaaaaataaaaaaattcctgtaggttttcattattgtaggcaattatgtccacatcacttacaaagctattgccaaatctgtccaaggaagcagagtttgaagtgagggctagggacaggaatcttgggaaaaattcaacagtggcatagcagagctctcaatatgagaaagctgacataatgtggacttttgctgtgaatttcctctttgcaaaatatggggagaggtttatcaatgggcagaaaataagagaaggcggtgtgaagtaggcttctgcagtcaattttcctcacagtattgtgcagggtcatcaagaaaatgcttagtctttctctggaaccagtttcagaacttttccaattgcaatggtcttacctagaaatgaaattttaaaaaaatctttcagtagttaacagcaagtctatataagatattaaaacttattattttaaatcacaaaaatattttttacaatgtaagttactaattaactagctttactgccaaacccatgatacttctatttaggtagtcttaataagagggtcttatttgggggggctggtaaagagatggttccctgtatcaaaaacctatctccccccgtaccccccaaacaattctcctgcctcatcctccccagtagctgagatacagatgcctgccaccacgcccagctaatttttgtatttttagttgagacgggatttcaccatgttggccaggctggtcttgaactcctgacctcaggtgatccacccgcctcagcctcccaaagtgctgggattacaggcatgagccactgcataaagacagagtcttactctgtcacccaggctggagtgcagtggtgcgacttcagctgactgcaacctcctccttctgggttcaagtgattctcctgcctcagcctcctgagtagctgggagtataggtgcttgccaccatgcccattctaatttttatatttttagtagaggcagggtttcaccatgttggccaggctggtcttgaactcttggcctcaggtgatccgcctgcctcggcctcccaaagtgctgggattacaggggtgagccaccacactgggccaaaaaacctctttggattaaaaataagaaaagggaatatccgtatttgtggaatatccacccagtggagtactattcagtgatacaaaggaataaataacatgttacatggttgaacctcaaaatcacactaagtaaaataaactagacaaaggaccacataatttataattctatttatggagtgtctataaaagacaaattgaaaaatggttgcctggggtggaggtgggaataaggggtgattatgaacaggtgtaaggtttctttttaggtgttctaaatgttctaatattagtatatggtgatggttgtacaattctgtaaacatactaaaattcattgaattacatacttaaaacaggtcaatttcatattatggaaattgtatctcaataaagctgctaaaaaaaaaaatcccaaaacctatccttaagtaactgtgaaaaggcacagcaatcaccactgactacagtgcagtgaacacgtccttctggtagtaatcctgtggactgaaaggatacaaaacccattgggtcttgtggaaaacctaaaagccaagttagcttttttttttttttttttttttttttttttaaagccaagttagcttttaggaaaaaataattctagggttaagaattcctgctacattaattgcttttcttctgtcttcctgattttatcaggttctgagtggtaaactaaaactatcattttgttatattaataagataaacccaataaccagttttactatcaaccagaagagttctgggcctttaaagtaaaataaacactgtctttatacaatttcatccaatgtaaagttcaggaactgtattcatcaccagggcttagcacagttcctgacactttgtagatacaaagtagtttttgctaaatggaattggaatgaacatgtgaaatgactattctgtatttcaatggaactataaagttttatgtaaagtcttctatagtcttaaaatggttatctaagttagaaatattaacagctgggccgggcacggtggctcacgcctgtaatcccagcactttgggaggccaaggcgggcggatcacgaggtcaggagatcaagaccatcctggctaacgtggtgaaaccccgtctctacaaaaatacaaaaaattagccaggcatggtggcagcacctatagtcccagctactcgggaggctgaggcaggagaatggcgtgaacctgggaggtggagcttgcagtgagccaagatggtgccactgcactccagcctgggtgacagatcgagactccatctcaaaaaaaggaaaggaaagggaagaggaaagggaaagggaaagggaaaggaaaaggacaggaatattaaaagctcataaggaaacgtttcataacaatcattttgtttttatgccaaagaacttcatgaccccaagatgggaatgttagttgttctgcgtcacccagaggtaggcagaaatggatgcacacaaaaggtcacaaagattagacctctgaaaaattaggtgtaaaaaaaaaaatcaatctctatgttccttttaatcgctagacatattacaaaggattacatcatagaaatatcttagtaaacaaaatagccctccaaatccactactcacaaaacatcaaaattaagattcttcacgtagagcattactagatttggcattactactaaagcacgtggtcaattctgttcaatacattcaactcataaaacactcatacgaataagaatgtgaatcgaagttttctgtgaacctgttgcaatgtgtactgtactgagatgatgaagatgaccaaagctaggtatcctggatatactactagacgtcagtttaaaagctcttaccctcatctcttaaggtgaaacgacccatctgagggaagtctttaaaggtctcaaggcagatggttcctgctgtccttaagcgagcaatgcatacttgatcttgtttgacaaaacggggtcgggtcttacttttttctcctgattttttgtctaccaagcagattaaggcctaaccaagaaaagagtatgagaaaatcagaataatgccaaataaaataatctttaagaacaggtgtagaaataaaagtgcatcactgttgctgattagaaattatgaagataaaacagtattaaaacagaaataaaccaattatcttaaactcactgttatttccacctcctcaatacaggtatgaatatgcagcaccgcattatagcctgggcagatgatggatttgtgctctataatcactatctgtcaaacaaacacacacattcttatctttagccttagggtaaataagaattcaatgttctcaagcgccatataaatcccaagaattagtgttaccatctcactaggacatcaacttaagtgatttttgtgttagaggtgataggtttgtcttactaattttgttcacaggatgggtcaggctgcttgaactcaaagcatgaatttcagtatcttatcctgtatttatcttcttggcaagtccctggtcaactttcaaaatacggcaggctggctgggcgcagtggttcacgcctgtaatctcagcactttgggaggccgaggcggcaggggggccggggggatcacctgaggccaggagttcaggaccagcctggacaacatggtgaaaccctgtctctactaaaaatacaaaacaatcagccaggcgtggtggtgggcgcctaaatcccagctactcaggaggctgaggcaggacaatcgcttgaatcccggaggtggaggttgcagtgagccaagatcgcgccactgcactccagcctgggtgacagagcaagaccccatctccaaacaaaacaaaagacagcaggccaactttcttatctgggaagactttccttatattccccaaggaactaagctaatttttaccgctcagaagctacctagatgtaaacttatccagctttatccatttctcaatatccaaggtccagtaaagtaaacaaccttacatctggcatcaaaatctaacttgattagttgtcataccttagaaaagaactttaaaaaattctgttattcacaccagtcacttactctgtcattctcccagggaggttagattgttaataacagggaaacctgtgtgatttcttgtctggaaagctatgtgctgtcaatgagcacataaaccatgacttccacagtaactgtgctctggtcaaagtgaatattagatactgtagaatgtatcatcaggagatcaaacataaaaaggaacttacaaagaatactccttatccagtaagcacttgtaccagcttgaagaccttgtatgaggtgcctattgtggttatgatatataagtggcttataatatttccattccccttctctacactaagatgggttaactggcatgtcacaaataatcaggacaaaaggcactgatattctaatttcatttagacattaaaacccactatgacaacaacaataatttgtttacctgggcatcaaatgtgcgtccagaatgacaaagattattaggatcacaaagtataaaccctggaagaatctcctcttcttcaattcctttcagtctgattttgaggttttcacctggggctacggtatcagtctctacatcatcggaaagtattccaagaacttccacgttgtgctttaaaagaaaacaagactggaggttttctgacacattcactgcattacgcaacataaaatgatctgaatgtctgtctgctcaataaagagttgcaagatttgactgtaaacacttatgtttgtatgacataaaatcttagcctagatatgatcagcaaaaatcatatcctagaagtataactgccaattaaagtattaacgtgtcaccttttaaatatcacattctaatcatttccaactagaacactgtatacactagcatttgcctttttttaccttttcaaaatcgaaaacacaatttaatatttggatttcagttttatggatataatttttattattatggaattctatgaaggatttaataaacctgtcttctattacctatcaatctccaaatatcggaattatgcactacttaaaaattattgaactaagctttaaaagtctatcaactatttaatgaatacatcatttccttttggtgtaatgaaatggtctggaattagatagtgatgatggctgcatagcattgttatttttttattttgagacagagttttgctcttgttgcccaggctggagtgcagtggtgcgatcttggctcactgcaacctctgcctcctgggttcaagccattctcctgcctcagcctcccaagtagctgggattacaggcacccaccaccatgcctggctaattttttgtatttttagtagagacgaggtttcaccatgttggccaggctggtctcaaactcctgacctcaggtgatccacccaccttggcctcccaaagtgctcagattacaggcgtgagccactgtgcccggcctaaactctttgtttctaacaaaatagtccacggagctgggtagtccacatgcctttagccccgctacttggaaggctgaggcatgaggactgcttgagcccaggtgttttaaggctgcagtgagctatgatcacactaccgcactgtagcctgagtgacacagcgagaccctgtctttaaaaaaaaaaaaaaaaaaagtttttaatgtaaaaataaaatagttatggagcctccagttctgatgccagtattgctcctcagtactgccagtgctggctgtggcagcaaggtgaagcaaaagaacaagtgacctgagaggagatacacgggaaatttaccatcagtgacatttactacatcaataatgctatgcaggccaggtgcagtggctcacgcctcagcattttgggaggccgaggcgggtgatcacctgagatcaggagtttgagaccagcctggccaacatggtgaaaccctgtctctactaaaaatacaaaagaaaaaaaacaattagcttggcgtggtggcaggcacctgtaatcccagctactcaggaggcttgggcaggagaatcgcttgaacccaggaggcagaggatgcagtgagccgagatcgtgccactatactccagcctgggcaataagagcgaaactccatctccaaaaaataaaaaataataataataataataaaaaaaaggccgggcacagtggctcacacctgtaatcccagcactttgggaggccaaggtgggtggatcacaaggtcaggagttcaaggccagcctagccaagatggtgaaaccctgtctcgactaaaaatacaaaaattagccaggcgtggtggcaggcacctgtaatcccagctactcgggaggctgaggcagagaactgcttgaaccctggaggtggaggttgcagtgagctgagatggcgccactgtactccagcctgggccacagaaggagactccgtctcaaaaaaaaaagaaagaaacaagagtttagaagtcactcacctaaaaaacaatctgtatcggctgggcgcagtggctcacgcctgtaaccccagcactttgggaggccaaggcaggtggatcacgaggtcagaagttcaagaccagcctggccaacacggtgaaatcctgtctccattaaaaatacaaaaatgagctgggcatggtggcacgttcctgtaatcccagctacttgggaggctgaggcaggagcattgcttgaaccgggacctgggaggtggaggtcgcagtgagccgagatcacaccactgcactccagcctgggctacagagcgagactccgtctcaaaaaaaaaaaaaaaaacaaaacaaaaaacaaaaaacaatctgtatctcagaacagtttcataaaatatcaaagtaaaaaataaccaatttttaatttaacccattaattacttactgtggtaaaatacatgtaacaaaatttaccatcataaccattttaggtgtacatttcaatagtacacctaaattaaatacatttaaaatattgtacaaccaatattcagaactctgaaatcttgttatcttgcaaaactgaaactccccgttcacccgaaccctggcaaccaccatcctactttcaggtgacaaatgtgactattccaggtacctcatttaagtagaatcatacggtatttgtctttttgtgactgttttatttcacatagcataatgtcctcaaggttcattcatgttgtggcctgtgtcagaacttcctttttaaggctgtgcaatattctattacgtgtatgtaacacgctttctttatccatcatcctttatggacaccagggttgcttccaccttctggctactgtgaataatacatgtatgaacatgtttatacagatatctgagactcttttgggtatatactcagaaagagtattgctggattatgtgggaaatctatgtttaattttttgaggaactgctatattttttcacggcacttggcacaattttacatgaccaacagtgcacaagggttccaaattctccacatccttgccaacacgtgttactctgctttccaaaaaaaagtttttaattgagatgggatctcacacatagtgagagacccagcctggtctcaaaactcaagtgatcctcctgcctcagcttttccgaaagtgcagggattataggcataagccaccatgtccagccctgtggatttgatttttatttccctaatagttagcagtgctaggcatttcttcatgtactttttggctgtttgtacatcttctctggaaaaatgtctattgcagtcctttgcccatttttgaattgggttgttcaggttttctgttgacttgtaggagttcttcatatattctagatattaaccccatatttagatacatgattggcaaatgttttctctcattccgtaggttgccaaccccatgaattttttattgtaaaagtctggcctcttttttatttgatatttgagacggagtctcgcactgtcgcctgtgctggtgtgcagtggcgtgatctcagctcactgcaacctccgcctcccgggttcaagcgattctcctgtctcagcctcctgggtagctaggattacaggcacccgctgacacacttggctaattttttgtatttttagtagagacggggtttcactatgttggccaagctggtctcgaactcctgacctcgtgatccacccaccttggcctcccaaagtgctgggattacaggcatggcccacccaccagctgcctctatgtcttttaaactattctagctctgttccactgagattcaggaggactaaactgaagtgagtttttgaggcttgctcaactctaggacattctatacctgcctagtgattagtatcaagtgatagcttccacagagaacagctactttctctatactagttactaaggcccctcacttgcaaatatgtctgggcactaacttcacttatgtttagagaatcatacttttttctattctggtaaaatataagtaataacattcaacttttaaaccattttagtttgcaattcagtgccatctagtgtattcaccatgttgtacaatcaataccactatctaattctaaaacttcattgtcccaaaaaggaaatcctacacccgttaagcagtcactccttactttccctccttcagccccttgcaaccaccaagctgccttacacttccatagcttttttttttttttttttagtaaaggtctcgttctgttgcccagcctggagtgcagtggtgtgatcagagctcataaatcatagcaaccttgacttcctgggctcaagcaatcctcctgcctcaacctcccaaatagctacgaccacaggcacgtatcaccacaagtggctaattttatttttcacagagacagggtctccctatgttgcccagtgtggtctccaactcctgggctcaagcaatcggtccacctcaaacttcgaaagtgctaggtgttagccaccatgcctggctcatctccataatttttgggacaactctacagacaaaactgagtaagtaagggctgggtgtggtggctcaagcctgtaatcccagcactttgggaggcccaggcgggcaaatcacgaggttaggagttcgagaccagcctggccaacaaggtgaaaccctgtctctactaaaaccacaaaaattagccagatatggtgatgcatgcctgtaatcccagctacccgggaggcggaggttgcagtgagccaagaatgtgccactgcactccagcctggcgacagggtgagactccatctcaaaacaacaacagcagcaacaactaactaagaactcaacctgagaattattttcactcatatgttagcctccaagttgcaaagataataggaaaaagtaggctttaaaatgtaaacattttagaagatactatatattctcatctccaatgcacaaggcatcaagaaaccagataatacaatttgtaaggtgccaattatgtctaaatattacatttgataatggattctttttctaatttactctgcctggagttagcatggtaaataaattctcactgaaatctagcaaaatctccatctgaaggtactgatgactcaagtctgtggtcctgcataagcaacatctttggagctgttagagaagccctgcctcaggttatctgcaaatctcagcaactgaacagtcaaaaatgacacaaaggaggccaggcatgatggctcacgcccgtaatcctagcactttgggaggccaagatgggaggattgtttgaggccaggagttagagactagtctggtcaacatagtgagaccccatctcaatttttatttaaaaaaaaaaaaaattagccaggcagagtggcacaagcctatagtcccagctacttgggaggctcaggtggcaggattgcttgaaagtttgaggctgcaataagctatgaatgcgccactgtactcctgcctcggtgacagaagaagaccctatctcttaaagaaaaagaaaaaaaatcaataaatagataggaaacagcataaccgattcttaccttgtttggcatcatcacaagctgctggcctttacaaatagatcctgattccagctttcccaggaccacagtgcccatatcctgatcaaatgtaaaataaaatccagtttcagacttcttggtgctgtataacagctcaatagcccaaagtgaaattctacactgcttattcataaaggaaaatcatttgcttaagtagaaggcttaggttcatcttaaactcagtaacaaatactctataataatttgtgtcataagcatatgtatgatcatattaataattcagtatgcctataatttaaaaagaaaatggcacaagctggatgtggtggctcaagcctataatcccaacactttgggaggtggaggtgggtggaccacctgaggtcaggagttggagaccagcctggccaatatggcgaaaccccatctctactaaaaatacaaaaaaaaaaaaaattgccaggcacggtggaatgcctgtaatcccagctactccagaggctgaagcagaagaatcgcttgaactcaggaggcagaggttacagtgagccgagactgaaccactcgactccagcttgggtaaaagagcaagactctgtctcaaaaaaaaaaaaaggctgggctcagtggctcacgcctgtaatcccagcactttgggaggccgaagcgggtggatcacaagatcaggaaatcgagcccatcctggccaacatggtgaaaccccgtctttactaaaaatacaaaaattagctgggtgtggtggtacctgcctataatcccagctactcggaaggctgaggcatgagaatcgcttgaacccaggaggcggaggttgcagtgagccgagatcatgccactgcactccagcctggtgaaacagcgagactccatctcaaaaaaaaaaaaaaaggtgcagaaaacaacacagaagtttatgttggaagatctgaactgtttgtacaaattcaggttctcctgatctctaggcctgtttcctcatatataaaattggaaaaagcaatacttgttaaagaaatttagaacggagctaattaaagaataatgtatttgaggaggggaaaacattacatacattgataccgcaaaacttaaaaattcaagttggaaatccagttaaaaacaaggaagtttattttttttaagacgaacatccagtgctggtgaggctgtggtaaaactaacactcatgctgctagtggtgacagaagttagcacagtatttttgcgatgctatttaccaatatgcatcaactttaataagaaaatcctttgagcccagcagttacatctatgagtttatcactaagatatgatccctggctcatcgggaaacagctaaaataaactaaacttgttgaataaattatggtctatctataccactaatataaagccattaagaaaaagacatcaatgttatgttgttaataaagtttttggaccgggcatggtggctcatgcctgtaagcccagcactttgggaagccaaggcgggcggatcacctgaggttaggagttcgagaccagcctggccaacatggtgaaaaccggtctctactaaaaatacaaaaaacaattagctggatgcggtggcacacgcctgtagtcccagctactcaggaggctgaggctggagaatctcttgaacctgggaggcagaggttgcagtgagctgacatcacaccactgcactctagcctgggtgacagagtgagactccgtctcaaaaaaaaaaaaaaaaaagaaggccaggtacggtggctcacgcctgtaatcccagcaccttgggggaggccgaggcaggtggatcacaaggtcaggagatcgagaccatcctggctgacacagtgaaaccccgtctctactaaaaatataaaaaattagctgggcgtggtggcgggagcctgtagtcctagctactcaggaggctgaggcaggagaatcacttgaaccaaggaggcagagcttgcagtgagctgagatcgcgccactgcactccagcctgggggacagagtgcaagattctgtcaaaaaaaaaacaagaaagaaaagaaaagaaaaaaagttttcaaaactagaaacaaaatgcacaacaatgatttcccctcccaggaaacccaatttctttaacattttgggtaccttgtacttatccacaattggcagcctgattggtccatcaactgatctattgaagttcggcaaattatccagatatggaataaacggtaatccactgagaacataacaacaaagccattaaaggaagtcaacataaatatcaaaatgttaagttacatgactataaacagcttctaataatattttcattctactcatgtattcttcccattcaaccactttattatccatttcatctcacttattccacagaaaactattataaaactgctcagtataaggcttcctcataaacttattaaaatttagagaaatattttatagcaaatagcctacatgtaataaattgactatattactttttatggacttttccagctatgaaaccaagattctataaaataatttcccctttaaacatacagtattggctgcgtgcagtggctcatgcctataatcccagcactttgggaggccgaaaggcaggtgcatctcttgagcccaggagttcgacaccagcctgggcaacatggtgaatctgtctctactaaaaatacaaaaatcagccgggtgcggtggcatgtgcctacagtccctacgacttgggaggctgaggtgggaggatctcttgagctgggaggcagaggttgcagtgagccgagatcatgccactgcactccagcctggttaacagagtgaaaacctgtttcaaaaaaacaaaccaaaaaaaagaaacacggagttcaagaataaactcgtatttatggtcatttgattttcaaagagggagccaaatcaattcaatgaaaaaagaatagtcttttcaacaaattgtgtgtaaacaattaatatacaaaaacaaaacaaacctacacatagaccttacatcttacacaaaagttaactcaaaatcaaatacatatctaaatgtaaaaaacttcaaaaataaaaccttttgtgcttcaaaggacaccatcgagaagtgaaaaaaggcaatccataaagtgggagaaaatacttgctataatcatattgtagctgataagggactggtagccagtattaaaaagaactcttaggactcagtaacaaaatgacaacccagtttaaaaatgggcaaagatcttagtatttttaaagccaaggttacatttaatattttcttaaattacttataaagatatatgctcaaaagcatatgttaacatgttactcagcatatgtctttataagtaatttaagtaataacatccttttcctttttaaaaaaaggaaaaaacagttacttacatgtaccaaggacagaaatccgactgctctttgagatttgctccagtaagtcctgagcagggcataaagtgaatgtcctttttgggattgaagccaacttttttcaaaaatggcactagtttctccttacattcttcatatctgcaattataatgtaaccaaaataactcaattataatgtaaaccaagaactctagtttcctaagtaaacagattaaggtttagaaaaaccctagagaaaaagtcgtacaataacaaaaccatccttaatcccactaacataaaataccagacatctacgctcacctctcattgctccaatttactgttggatcatccatcttattaattagcacaattaggtgttttacacctgctgtctttgccaacattgcatgttctcttgtctgtcctcctttttcaaatccagtttcaaactctcctttcctggctgagattacctaattccaagaaaggaaacagtttactccttcgccttcaggcatacccttatggcagtaaaacatctttcctttcagttatatcacgagtttttttttttttttttgcaagaaaatagaagcaaacgagttatgacgtacctgcttttgaatgtcacaaatcaaacaatgtctagatgcttccaatcccccacattcccaaaatctagtatacctgcatattttaaaattccaacatttactttctagctattgtaactacaaaggaaaaaaaattgtgatctactaccagtacattgtgaaaagcgcaaaatgactgaagaccgtatgaaacagatggtttcctattcattttttacccatggtgcctaacggtgggcttggcatttaatggagactaagttctgacatggtaatagataatagcaacaggagagaaaaggtgaaacgtattttcagaagtaaatcaaattttgaagatttcttgaagagagattagtatgatgaaaactgtgaccgtgtacatcattatatttcactgcaacctgaatttgagcttttagaagataaattcaaatttaaagatataagcggggctactaacaaatatacagatggactggaaatgtctttcttaccagcacagccaaatcagcttgagaggcaccaccaatcatatttgggacaaaactcttgtggccaggggcatctagaattgtgaaatgcttcttttcggtttcaaaataggcacgacccacttctactgttttacccttgtctcgttcttcctgatttgtgtctaaggcccaagacaagtacctgaaataatttttaaaaaaagaacaatattcctaagaacatcagagtttttaggatattcttcaccattaaagatataatggatgacacacaacacctaaatcacgaacaagattggtgaaatgaaaattgagccgggtgcggtggctcacatctgtaatctgagcactttgggaggccaaggcggcggatcacaaggtcaggggttcgacaccagcctgaccaacatggtgaagccctgtctctaccgaaaatacaaaaattagctgggtgtggaggagcccacctgtagtacttaggagactgaggcaggagaatcgcttgaacctgggaggaggaggttgcagcgagccaagaccgtgccattgcactccagcctgggcgacagagcaaggctccgtctcaaaagaaaacaaagaaattgaaagaatagggctgggcgcagtggctcacgcctgtaatcccagcactttgggaggccgaggctggcagatcacctgaggtcaggagttcgagactagcctggctaatatgatgaaacctcatctctactaaaaatacaaaagttgggcatagtggtgcacacctgtagtcacagctatttcgaaagctgaggcaggacaatcgcttgaagctgggaggtagaggttgcagtgagccaagatcgtgccatcgcactccaggctgggcaacagagggagactctgtctctcaaaaaaaaaaaaaaagggctaggtgcagtggctcatgcttgtaatccaagcactttgggaggccaaggcaggcggatcacctgaggtcaagagattgagaccatcctggccaacatggtgagaccccatctctactaaaaatacaaaaattagctgggcatggtggcgggcgcctgtagtcccagctactcgggaggctgaggcaggagaatcgcttgaacccaggaggcggaggttgcagtgagctgagatcgcgccactgcactccagcctggtgacacagtgagactccgtctcaaaaaaataaataaataaaataaaactgaaagaatgtattattttgattcaaacccttagagcttttatataaacgcagtcaattataccatctagaactttatggcaagttgactacacagaaagactaactacaaatgccaatatcactgtgtgttaagtgataatgagctcccttattacttcatttttatactcacatggcacaaaatacaacacaaataatggctgtcttgagagttaaagggtaataataaaacttttttggatggatgctgtggctcacgcctgtaatttcagcattctaggaggctgaggcaggcagatcacaaggtcaggagattgagaccatcgtagctaacacggtgaaaccctgtctctactaaaaatacaaaaaattagccaggcgtggtggcgggtgcctgtagtcccagctacttgggaggctgaagcaggagaatggtgtgaacccaggaggtggagcttgcagtgagtggagatggagccactacactccagcctgggcaacagagcctaggtcgtgcccggcacccccacccctcttcttctttttttttttttttttttttttttttggagatgggagtcttgctctggccaggttggagtgcagtggcaccatctcggctcactgcaacctctgcttcccaggttccagctattctcctgcctcagcctcccaagtagctgggattacaggtgcccaccaccacgcccggctactttttgtatatatattttttgagatggagtttagctcttgttgcccaggctggagtgcagcagcaccatctcggctcaccgcaacctccgcctcccaggttcaagtgattctcctgcctcagccccccgagtagctgggattagagcatgcgccaccatgcccagctaattttgtatttttagtagagacagggtttctccatgttggtcaggctggtctcgaactcctgacctcaggtgatccgcctgcctcggcctcccaaagcgctgggattacaggcgtgagacactgtgcccggccatttttgtagttttagtagagacagggtttcaccatattggccagggtggtctcgaactcctgacctcaggtgtgatctgcctgccttgcctcccaaagtgctgagattacaggcttgagtcaccgcgcctggcccaataaaagttgttttccttttttctttttttttttttgacatggtgtctcactctgttgcccaggctggagtgcagtggtgcaatctcggctcactgcaacctccgcctcccgggttcacgccattctcctgcctcagccttccaagtagctgggactacaggtgcctgccaccttgcccagctaattttttgtatttttagtagagacggggtttcaccatgttagccaggatggtctcgatctcctgacctcgtgatccgcccgtcttggcctcccaaagtgctgagattacaggcttaagccactgtgccaggactaaaactttttaataaaataaaaaataactgtcctcagatatttttgaaaactgaaagccactaacgcaccatgtgggagcaatggttacttgctaaaaattgcttcaatatcacactgccaggcaaaaattcatataaattcaaaccatccgtaatagtgggcattaatttagcttacctcatcatcttcacagcatgtcctcaattttttataacaacactgactagcatttctcccgcttattttagaggaatataattttattttaaaaaaatgactgtcaatatcccattgaggtaaggcttgctaactttttaaaaataaaagtaacaaggttagaaaacaaaaaagttgactgtctcaccattcaaaggcaaccactgtcaataattccattccattttatttccagcatttatttatataatggtcatatcttaagtacagggatgtttcctgcttccccccaactgccaccacaacgcaagttctattcatggttactataaattatgtaaatgtaagttttcagtggttgcaaaatcacccaattaaatggatggtttatagtattttcaacaagtctatcaccagatatatggattgtttccaaatttctctgtgtaagttattaaagcattaggaactcatctactgtgtattatgaggagaggggaaatttcctttgttgtgatacgattttagacttcaacaatttatattttaacaggctccaaaagcactaagtgggcatcgtctccttaaaagtaatttataagtgtcataaaagtttactataccaagtttctctgtttttctctttagcttctctttcatacttttcaagcgtccttttgtcaaccattccagtcaaatacctgaaaacatttaaagaaaaaaaaaagtaaacaattactcacaaattactcagtggaattaggaaaacgtgaaaattgtcgaaaatttcaacgtcagaaaatagttattttatatgtgtgtgtctgtctaaaaaaatataaaatatatatataacatatataacatatttttatataaaatatattacacatttttatataaaatatatatattacatatatatatatatttttttttttgagacagagtttcgctcttgtcatccacctggagtgcaatggcacaatctcggctcactgcaacctctgcctcctgggttcaagtgattctcctgcctcagcctcctgagtagctgggattacaggcacccaccaccaaacccggctaatttttgtacttgtagtaaagatggggtttcattacgttggccaggctggtctcgaactcctgaccttgggtgatccacctgccgcagcctcccaaagtgctgggattacaggcgtgagccaccacgcctggccatattttttttttttttttgagacagggtctcgctctgtcgcctagggtggagtgcagtggcgtgatctcagctcactgcaacttcctcctcctgggttcaagcgattctcctgtctcagcctctcaagtagctgggattacaggcgtgtgccaccatgcctggctaagtttttgtatttttagtagagactgggtttcaccatggtcaggctggtctcgaactcctgacctcaagtgatctgccagcctcagcctcccaaagtgctgggaatactggcatgagaaccaccacgcctggccagaaaatagttaaagtaaaggaaccactggtggatgctaaaattatggaaagtgtaagtggaaaaaggatatttacagtctcgaattaacagacaaagtggcctggtgtgatggctcatgcccgtaatcccagcactttgggaggctgaggtgggaggatcccttgaggccaggagtttgagaccagccagtgcaacacagtgagaccatctccacataaatattaaaaaattggcctggtgtggtgatgcatgcctgtattcctagctacttgggaggctgaagtgagaggatcacctgagcccaggagtgtgaggttacagtaagctatgattccaccactgcactctagcctgtgtttaagagcaagaccctgtctctaaaaaaaacaaaaaatcaggccaggtgtgatggctcatgcctgtaatctcagcactttgggaagctgagttgggaggactgcctgagtccatgaggttgaggctgcagtgagccatgattacacaactgccctccagcctaaacaacagggagaccctttctcaaaaaaacaaaaaaaacaaaaaaaacaaaaaataaaaaatggccgggcacggtggctcaggcctataatcccagcactttgcgaggccaaagcaggcggatcacaaggtcaggagttcaagaccagcctgaccaacatggtgaaacctcatctctactaaaaatacaaaaaaattagccagacgtggtggtgcatgcctgtaatcccagctacttgggaggctgaggcaggagaatcatttgaacccaggaggcggaggttgcagtgagccaagatcacaccactgcactgcactccagcctgggcgatagagattctgtctcaaaaaaaaaaaaaaaaaaaaaaaaaagaaaagaaaagggaaaacaataaccttatagtggacaatcttgacagatgacaccttaaccaagtaatcatgactaatttcaccagtaataaggaagttttgatgaatgactatggttataagatgtcaacatcagggcaggatgaatgaagggaacttcccgtactgtttttgcaaccattccgtaaatctaaaattatttcagaatatagtaggttttgttttttgtttttgtttgttttttttaagtaaatataaggtgggcatggtggtgcaagcgtgtagtcccagctacttgggaggctgaggtaggaggatcagttgagcacaggaatttgaagctatagtgcgctatcatcctcccccctataaatagccactaccctccggcctgggcaacacagcgagaccctgtctcttaaaataaatatagttttatttttattttttatagaaatgagggtctcactatattgtcctggctcttcttgaagcctgggctcaaatgatccttccgccttggcctcccaaaatgctaggattacagatatgagccaccatgcccagccaagtaaatttaaaaataaaataacaagtaaatgtaaatgtaggtactatagaaaagaaaaaaaaattgcaacaatgttgtctaggcaagtaagtcttattacttgtcaaaatgagataataatttcaaaatagttcgttagtaatgcatacttccttgactcaatccaattcaaagctctcctttccctatagctttcatctgtgttctccacgtagacatctatagtgcagtgcacctaagcatttgcatgtagaaacccagtgtgacgccaccaaaacttacagcccatcagcaaaaaatatacactgtcctgaaacataacatcatatggctgtgacacttcaaccacagagacctggggaaggacccctgtttaacagcctgtcttagagtctctgttgtggaaatgttcaaaagtaactggcaagattaccaatgatgattagccaggtgtggttaatcacacctgtatgccagcactttgggaggcagtagaggtgggcagaccacttgaccccaagaggtcaagaccagcctgggcaatatgatgaaacaccacctctacaaaaaaacacaaaaattagccaggcttggttgcatgcacctgtgatcccacctgcttgggaggctgaggtggaaggattgcttgagtccaggaggtcgaggctgcagtgagccaaaatcatgccactgcactccagccttggtgacagaatgagaccctatctcaaaaaaaaaaaaaaaaaaaaaaaaaaaaaaaaaaaaaaaatttaactaggcaagatgatggcaagccctctaggtcctctgatgacacagttcaaagaaatgggtctaatttagagaagcaattaaaaatttaggactttttagttatcaagatttgtcaatactaaaatgcattactaaaggccagccacggtcatttcatacctaggaaatttctataatacgatcaaaaaattatcttagcattttagctagtctacctgtcttttattaaatccatatacatttaaggagctgatgaatgaggaaaaaacagttcccccattcaccagattcaagagctggttgtcattattcccatgtatgttatatgcaaaggagaccaagtttcccataatctagagttctgtgttcattttttatttttaaaaaatgtaaaaagctttcagaaacacatttaacactagtaataatcacattacaaaaactactacttttaaaaaaattaaagtagagacagagtctcattgtcttgcccaggctggtttcaaactccagacctcaagtccagtgatcctcccaccttagcctctcaaaatgctgggattataggtgtgttccaccacaccaggccaaaaatcacttcttaacatcagtattgtgtcccagtaattttatttttaatttttctttgggggacctgttttatctcctttgtgtgactgtatgaaggtttacaatgcctaaaattcattacatcaatttaactctgttatttaacaaaagatacagacttacattatttgtcctccaatggttgacttgccagcatctaaaagtaacatcaacatgcaaaccataggttaaaaccaaaaaccaatggctaaatatgcaaacaacagcaccctttaacatacataattaaatcttccatatgaatttggggcataaatcctagttcattacccttctccttttgaaaatgagcctcaaggctgggctcggtggctcacgcctgtaattccagcactttgggaggccagcgagggcggatgacctcaggtcaggagttcgagaccagcctggccaacatggtgaaaccccgtttctactaaaaatacaaaaattagctaggcgtggtggcggccgcctgtaatcccagctacttgggaagctgaggcaggagaatcgcgtgaactcgggaagcagaggttgcactaagctgaaatcacgccattgcactccagcctgggcgacaagagtgaaactccatctcaaaaaaaaaaaaaaaaaccacttaaaaacactttactgataaagaattttttaacagattactccgaaagcacagcggcaacagactataaattccccaagagaagtttccaagagcaaaagcagctgaagaactgtgaactagattcaggtgcttttcctttcacttacagcaaatgaggtatgtgctcctttacacctttttttccccacgagacggaatcttgctccgttgcccagagctggagtgcagtggtgcgatctcacctcactgcaacctccaccttctgggttcaagcaattctcctgcctcagcctccggagtagctgggattacaggctcatgccaccacacctggctaatttttgtatttttagtagagacggggtttcaccatgttggccaggctggtcttgaactcctgacctcgtgatgtgcccgccttggcctcccaaagtgctgggattacaggcgccagccacagtgcccagccgctcctttacactttcaaaagagttcttgctactaaaagaaggggtacagtgtttcatatctggggggaaggcagagatagctgaaatgaaagacacataattctgtattttttttctcacaattctggggataggccagataattagagaatatctgagtaaattaaataaatttgttcttttgttttttgctaaaccagcaacctggcaagcatccagaagttactccaaattattgatttcctgcttcacacaaaattatctggtaaggtcaatcccattaaaattaacaagttaactgaggttcacataaaaaagggcacattttctaagatactgatatataatactatgctgaactaccatcaatggtcaatagactaattatatgttacgtacaatatactgaagtttttcttccagcatctatgccgttacagaattattcatttgcctaaacttcaggaaaaaagtacttgcaattttttgccagctaaaaaaaatcagcaagttaaaaatcaagacattttcaattaatttccttcagtttcactaaacatctccaggtagctaaaaaggatgttctatgttttatgtatccagtaactttaattgctatgagagcagcttacctacgtgcccaatgaatactacatttacatgctctttcttaggagcacctggcggtgcaaccacagacttaggttttgggatttcctcttcctcctccatcatttcatgggcactttcctctggcggccttccatctcccaaggaaccaccccctggctctgcttcacttatttcttctttgtgctcccatgattcttctggagacatttctgtctctccattttctactgaagaaagacattttaacttagtattctgaaaaagacttacaatctatactttaaaatacactagctttaaaacaacaaatggaagtttgcatatgtagttccatttcctaatgcctagtgacacataagcaggaaaacctctttcatagcagaaatgggtgacagctttcaaggcagactcactgctggtatcacatcagagggcactgactcacaggctgagattgctattttagcaaagcttcattttcataatggcaaacaaaatgcaaacaagagttctaacattcccaacagcctagttattccagtgttgagacaccctgatagtaagaaaaaaaggaaagtttaaaatcgtgacacacgagaaatatgaaaggatttaggaaatattttctttttcctcttaaactaataaaactttggcatcaactttaatcacgctgagaacgtgaaacccttaagaataaagttataaaaaggaagaacatttttcaccaagaaaacagaacgtgtggccgagcatggtggctcacacctgtaatcccagcactttcggaggccgaggtgggtggatcacgaggtcaggagttcgagaccatcctgatcaacatggtgaaaccccgcctctactaaaaatacaaaaatttgccagttgtggtggtgtgcgcctgtaatcccagctactcaagaagctgaggcaggagaagcgcttgaacctgggaggcggaggttgcagtgacccaagattgcaccactacactccagcctgggcgacagagcaagactccgtctcaaaaaaagaaaacagaacaggtacaggtatttaaattgacttgaccattcctccactcaattttatttgcaatcattaagtttatcaaggcagtgttagtgcctagtttgttctactttctaaatactaatagcaaagactcaatgtgtcttaaatgtaggcattacaataatcgtaacttacataatgcaccttaaatcttgagagtgaaagagtttcatattactgtattaatatggtcagaaattttcttaccaataggttctgaaagttccatgctaacagctgaatttgaacctagacaagagattgaaatataatatatatttaccaaacagtatctagctttacacaccatatagacaacctaatgttttctcaagtagactttcaaagagtacatcattaccttcacacaatgactgttcctcttgagaggattccacaggtgctgtttaacagaaagaagttctattaaaaattgatacttatccatccatttcacttatcttttaatatgcagtaaaaacagaagttcaataacacgacacaagcctcaatcaataaccccagatcaatggcagctaactcaggccttcaagttagaagtctctgcttaacctacttttcaaaattctactaattacagccaattttgaaacattttcagtagtttcaatgtattcataaaaacatgcttattcttttgatttgctttataaaccttttcttcacagatactgtcaaagtaatttgcagctcagcacagatcaaattagagatgtgctcaacaaatacacatctacttcccgtgattctctctaggtaacccagcccaagaaagctgtgattagccctttttttttttttttttttttgagactgagtttcactcttgttgcccaggctggagttggagtgcaatggcacgatcttggcttaccgcaacctccatctccccggttcaagcgattctcctgcctcagcctcctgagtacctgggatcacaggtgcatgccaccatgcccggctaattttgtatttttagtagagatggggtttcgccacgttggtcaggctggttttgaactacgacctcaggtgttctgcccacctcggcctcccaaagtgctgggattacaggcttgagccaccgcatccagcctgtgattagccctttttaatattccatactcatgttatcaaaatccctgaataaattagatacctataagataaatgacatgtgtataaagtcctgaaacatatataagccattaaaaatatctgcagaaaaggtgattccaatgatgccagttttttcctatactagaactctaaaaccaagcaacaatccagtttccagttgccacactgcaaatttacttatgacattactggaagagatgtaggagaaatacatactaataaccaaatatctaagtctgctttttggattttagtttgtcagatacagacaaacctaaattatactccaatatgaacgtgcccctgctttaaagaatctccacgacagaaaacgatactaaagaattaaatcatatgaatcatgcacagcaagtatgaaaaaataatgaatttgtaacctgtaaaatcattgcccggaaaggatcaatacctgtaagagtcaagagaaagtgttttgggcccaaccttcaatagcatcaaatgttgagtaaagtaatttcctgtccctgataggtaaaggacaaccaaattgttttctttttttttttaagtgacaggctcagactgtcacttaggaagatctttttcttgcagcttaaactacatgaactagagtgggcaagaccccacaggcaggaagacccacatcaccactgcaagaaagcatgccatggagacaaccaagcaatacaactaggaggggatgggggctacacctgacaggagttgggagaaagggagagtaaaaggtctaagatgaccccaagctgtgggatgagcaggacattaacaaacaggggggaaacgcatttgaacctggtttggaaggaggcagaaactgtacttcaacacaatacagattaacttttttttgcttttccattttcaagaaaagtttaaggataaggtaaggaaaaattactcagttttcagaggaagccaggtagtactgagagtatcaagttcacaggccaccctaagaaggaggtgactgcatggggtacttctcagagcctggaactgagctgactcctaggtttaactcctggcttattacaagctgtgcctgcacttattccactgaaattgtggaaatgatataccatctacctgagaggattgttgaggagtttatgggaggaaatgggagaataatttgtttagtgtcagttaaagaactcctggcgtattcaacaaatgtgtctccatctgctatgtaactactccaactcaatcctatcaatatgtattgagtatcagccaggcacggtggctcacacctgtaatcccaacactttgggaggcggaagcggggggatcatttgagttcgggagttcaagaccaacccggccaacatggcaaaaccctgtctctactgaaaatacaaaacaattagctgggtgtggcatacacctgtaatcccagctactcgggaggccaaggcaggagaatcgcttgaacccgggaggtggaggttgcagtgagccaagatcacgtcactgcactccagcttggacaagaatgaaactccgtctcaaaaaaaaaaaaattaataaaaatgaatacatatatatatgtattgagtatctattatgggccagacaaggataaaagtactcacaaatccatattgtgtagggagtgggggatggagggggtagcaatttgctttaactaatttttattgagccctaagtgccgactgctagctcattcccaccaaaagccttaggaaacagatcctgtaatcactaccatctaacatacaggcacatcagaatcaactgcaggcatttccaagttatgcaagtgccatcttccccttcctcagatagtccctgctgaaaatcagtgtacaagtaaactaagctctgacggacacacagttatgatgtactgcgtatcttaaggcaggaaaatgacgggtgtggtgggcttcctcaccactctcaagtgtatcactaactgtaacagcttttcaaaacaaaacagtacttacacctgaccacttagttcctggcaccaactattagatttacaatacagatggctcctcaacttacaatggattgtaagttgcaaatgggttgggcatggtggctcacacctgtagtcctaaacctctgggagtccaaggtgggaggatggcaagagtttgagaccagcctgggcaacatggcaaaaccccacctgtaccaaaaaaagaaaaacaaaaaacaaaaaacaaaaaactgtcgggaatggcggcatgcgcctgcagtcccagctgctccgggggctgagcctgggagggtcaaggttgcaatgagacctgactacaccactgcactccagcctgggcgagagagtgacaccctgtctcaaaaaataaaaataaaaccgatatatttctaccctatcttcatacatacacagtaaacctttacttgttcattctactctggtcttattcatgactcacataacatccagattttactggctactaatgagcctgggcttagaattttccgaggttgaactgttcatggctaggaaatagatgattagggtgtaatttctcacatcctacatggttcacagctgctagtaaaggaagttagaaccctctcaaggaatgaaattacagtttcaaattttccagtgttatctctatgtttagaaacacacctttattaactatttaaaaatggaacaattttttctaagtgggaaagctttcagggtttaccactgagtgcaactgccatgccccaaattacaaggaaaaactaagtttgagaccagcctgggcaacatggtgaaaccccatctccacacacaaaaatatatatatatatatatgaattaggctagacatggtggctcatgcttgtagtcccagctactcaggaaactgaggcaggagaatcgcttgagcccaggtagcagaggtcgcagtgagccaagattgcaccaccgcactctagcctgggtgaaagagtgagaccctgtctcaaaaaaaaaagaggaaaaactaggctgggcatggtggctcacatctgtaatcccagcacttctggaggtggaggcgggcggatcacctgaggtcaggagtttgagaccagtctgactaatatgaggaaaccccaactctactaaaaacacaaaaatttgccgggcacggtgtcttgtgcctgtaatcccagctacttgggaggctgaggcaggaagctacccgggaggcagaggttgcagtgagctgagattgcaccatcgcactccagcctgggcaacaagagcgaaactccatcttaaaaaaaaaaaagccaggcacggtggctcatgcctataatcccagcactttgggaggccgaggcgggtggatcacaaggtcaggagatcgagaccatcctggctaacatggtgaaaccctgtctctactaaaaatacaaaaaattagccgggcttggtggcgggcacctgtaatcccagctactcgggaggccaaggcaggagaatggcatgaacccgggaggtggagctggcagtgagccgagatcgcaccactgcactccagcctgggtgacacgactctgtctcaaaaacagacagagcaggactctgtctcaaaaaaaaaaaaaaaaaaaaaagaggcaaaactaatagtataatttataataaaggaagattaatgacttgactgtggtacttggtacattaccacaaattttaaaacatgaagtgaagactttaccagagaacagcagaacaccagtactgcctgtgatacacatgataaactggaactggatcttttttttttttttaagagatggagtctcgctctgtcgcccaggttggagtgcactatcgcagtctcggctcactgcaacctccacctcctgggttcaagcgattctcctgctttaagtcccgagtagctgggactataggcgtgtgccaccacacccagctaatttttgtagttttagtagagacgggggtttcacgatgttgccaggctggtctcaaactcctgacctcatgtgatctgcctgcctcagcctcccaaagtcccgggattacagtcatgagccaccacacctggccttaaattttttatagagatggtgtttcaataggttccccagactggtctccaactcctgagctcaagcaatccacccacctcagcctcccaaagtgctgggattacacgtgtgagccaccgcgcccggcttccaagacattttaatcaccccaaaaggaaacccgtattcatttagcagttactgcccatactctctcctagcttctggcagccaacagtatgtctgttttctgtctctgtggatttacctcttctgaatacttcatgtcaatggaatcatagaatatgtggtgtttgtgttgcttcaccataatcaaattttaactatcaatccagtttcaagccaggcacggtggctcatgactataatcccagcactttgggaggctgaggcagacggaccacatgaggtcaggagtttgagaccagcctggccaacatggtgaaaccccgtctctactaaaatacaagaattagccagggtgatgacaggtgcctataatcccagatactcaggaggctgagccaggagaatctggcaatcttgaacctgcgaggcggaggttgcagtgagccgagattgcaccactgcactccagcctgggcataacagtgagactctgtctcaaaaaaattaaataaaataaaaattagctgggtgtggtagcacatgtctgtagtgccagctacttgggaggctgaggtgggaggatcacttgaacccgggaggtggagggaggctgcagtgaaccaagatcgcaccactgcactccaacctggaccacggtgtgagaccctgtctccaaaaaaaaggaaatgttttagaactacatagaattgctggttgtacaacacagtgtgaatgtactaaatgccactgaattgttcactttaaaatggctttatttatttgtttgttaattgtttatcaagacgaactattagcccacatattcatgtgtcgtagttcaggaacacgagtcagtgacaaacttctaggtaattcaacctgaagaaattctttatattccaagattactttaaactgaaagataccagccttcctcatctgctcaaaatctcataatttctgcagaaatctgcatatgccttctttcttggttcacccacaccaaactcatacaaagctgcaacccccagggacaccatgaatgctccaaacattgaaatcgcagacgcttggccagaaggccacacatctgaggttttggcaacacttcgggagccatggtagttactgtccttgatacgtatgccaacctcaacaccaacatcattcctgactcattttattttattttattttatttatttattttgagtcttgctctgttgccaggctggagtgcagtggtgcaatctcggcttactgcaacctccgactcctgggttcaagcgattcccctgcctcagcctcccgagtagctgggactacaggcgcgcgccaccacgcctgggtaattttttgtatttttagtagagatggggtttcaccatgttggccaggatggtctcgatctcctgaccttgtgatccgcccgccttggcctcctaaagtgctgggattacaagcgtgagccactgcgcccagccagttttatgttatgtggattttgcttcaattttttaaaagagtgtacaatttttttttaaagctatgatcatgggtcaaaggacttgaatatggagaatcctacttggccagcatatcctcacagcatacgtcagtcaaggccacagacatcatggcaggtaaaaaaaaaaagctacgttttgattcaagttacatgttttaaacacaaatgtttggctaagtcttaaaaagtgcttgatgcatgtatttcataaatcagcaatttaaattcatactgctttagatacaaaactaatcttcaagccgggtgtagtggctcatgcctgtaaaaccaacactctgggaagcaaggcaggaggatcacttgaggccaggagtttgagaccagcctgggaaacacaaggagacttcgtccttacaaaaaatttaaaaatcagccgggtatagtggcacaggcctgtagtcccacgcaggagaatcactggaacctgggaggtggaggctgcagtgagcggtgatcacaccactgcactccagcctgggtgacagagtaagaccctgtatcaaacaataacaacaaaacacaggcatcctgagtgaaactgtagttttgttagccaaatgggtgttcattaaagaaaaatacaacttcggatctgtcacagaagtgtctcacattgcatgaaagtaagaaatatgtgtgacaaaattctgtccaagtttctgtagtgatggaaatgttttatatctgtgctgtgacatgatagtcaccagccacatgtggttattaagcgctggaaacatggctattatgactgaggaattgaattttaaatttaattttaataaatttaaatagccacatgtggttctcgattacactttggataacagttctagctcaaggattctccttaattgtagtacacacttgcctacctaatcccccatttctatcccattccctgtccatcccctaccctgaagggctaatgatcactcccctaggacatgacacctctttaaattagaggcacacatggggaccaggtgcagtggctcacacctgtacctgtaatcccagcactttgggaggccaaggcgggcagataacttgaggtcaggaatttgagaccagcctggccaacgtggtgaaaccccgtctctactaaaaaattaaaaattagctgggtctgctggcacacacctgtaatcccagctactcaggaggctgtggcgggagaatggcttgaaccggggaggtggaggttgcagtgagctgagatcactgagtcactgcactccagcctgggcgacaagagcgagactctgtctcaaaaataagtaagtaaataaataaataaattataggtacacatgtatcttagttcttgttccctagattgtagacttccagaatgaactgtgggtggatgacttttttctctacttcagtagtctcaacaagttggcatgatgtattgtatagaataaatacacaatcaatttttactgaattactgtgttttcctttgattttcacactggttccttccagtcacatcacttcattttttcacttttcttttttctttttgaaatggagtctcactctgtcgcccaggctggagtgcagtggcacaatctgggctcactgcaacctccacctcctgggttcaggcatgagccaccacaactggcctcacttcccttttctgaccaggacccctagcctccatctgtacattcattgcatttccattagggctcaagagagtgaaaacaattttaaatgtgccaactttctaagaaggggttagggaaacactacactcaggagatgttgggccagctgtggtggttcccgcctataaacccagcactttgggaggccaagctaagagggttgcttgaggccaagagttcaagaccagccagggcaacacagtgatgctctgtctctacaaaaaaaaatgtaaaaatgagccaggcgtggaggcatacaactgtagtcccagctatttaggaggctgaggcagaagaatcacttaagcccaggaggttgaggccacagtgagctatgattgtgccaatgaactccagcctgggcaacaatgtgagaccctgtctcaaaaaacaaaattaaagaaagaaaattttaaattaactatgtggttcatactatattcccattggattatgccagggtggtaacgataaaaaagcaagattcatttaactcagaaagaaaattaggctaagataataaatccagcagccaacaagtcttaataataggcacttatctggtaagatcacatgagacaatatttcttgaatttttttaatgtaaatccctccaacaacaaagaacgatcccatctctgaacaaaaatttgcaagctgaggtttttctttttttctcctgtagacaatactgaaaaacagtaaaagcaaacaccagaaagaagtctacagaacacataaaacaatgtggatggttttgccttaattacctaacactctaaaaataaaaaggctcggtacagacagtggtgaacagagctgttttaaagtattttacatcaacacttgctaaaatgtaaaaagaagtaatttcaaaatattgctttaaatcagagcactgcctacttatgacaaatgtcattctgctactactgagacagaacacagagaaatgccatggtccaagctcacaggtccagtttctggagagtctcagtctactttaatacaaaatcacaaggaaagcactagcagtcactactagaataaactttgaaatgacctcgattccaagcctcactcctctcatggatatgactgacctaagttatttagctttactgagcctttattttctcatctgtaaaatgggtcaacagtacctaacctcaagagaatgttgtgaagactaaataactgataaggggtggtaaatgctcaataaatttattacagcaagcacttcaaagccccaaaataatttcaaaaacctttaagaatgaaacattaggcaaatgccagggccactctcagaaaactacacgctagttgtagtaattagctccaggcatgcccttcccgccccctgttattaaacagcatgatgtggcagatcaagcactaaactagcaggtagcaaatctgcattctagactcaatggtgtcattaactctgtgagtgaccttaggcatttacttagcatttctaaggctccagttcctttatctgaaaatgaagaggctgtacaactgctagggtcgtatccagcgctaacattctaagaacctctttattcggacacaaaagcaatgccacattatcaacctgatcagactttgcatagagtaactaaaattccattatgtttttcaaacaaccctgaaagacagtcttatgagctacaacctaactacttcaaaaacaatttgaggccaggcgcggtggctcacacatgtaatcccagcactttgggaggctgaagtgggcagatcacttgaggtcaggagtgcgagaccagcctggccagcatggcaaagccccgtctctactaaaaatacaaaaattagctggggatggtggtgcacacgtgtaatcccagctacctgggaggctgaggcaggagaatcgcttgaaccaggaaggcagaggttgcagtgagccaagatcgtgccagtgcactccagcctgggcgacatagagagattcatctcaaaaacaaaaaagaaacaaaaaaccatttaaataacatttaaaatacacaaaccaaaaccatttcagataccctcaaaaaagtacaaaaataacagaaacagccgggtgcggtggctcacacctgtaatcccagcactttgggaggccgaggtgggtggctcacttgaggtcagtagccaccaagaccatcctggccaacatggtgaaaccctgtctctactaaaaatacaaaaattaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggagactgaggcgggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaatacaaaaattagccaggcatggcggtgcgcacctgtcatcccagctactcaggagactgaggcaggagaatcgcttgaacccgggaggtggaggttgcagtgagccgagatcacgccattgcactgcagccggggcaacaaagggagactccatgtcaaaaataaaaaaataaccgaaacatttttctgctaccaaaattaaccacctaaaggcaatggacaagtagtatggtaacatactggagttctacagaaatattcaaccaggaaattacccagtgacattctgcagaatgcgctttttttttttcaagtgaagcgacatacaattacctagtgggaatgtggtttggaagtgagtgtcaccactgttaggtcaggtgctcgggaaagccttattaagtgttcttctctctttgaaagtagaattatgatgggaaactggttcaacttagagtactgtaacaactaggtttccttagaacaaagccatttacgaaggagccatataaatctacagtctcggctcactttgttaaactctactgaaaacaaggcagaaacttctaagccttgaaatgaatcaacaatcaacagctaaaaactgtcagttttcttgattgttctgaggacctcagatccttcaactagtagccaaattcttgtctcccgaagatattttaaaaccaagggtagaatgatgaaattctaaacatgccccaatagacacactagccagactcatagtaactgaactcactgctgtttaatacgaaatagacaagtactgtaaaaagataaccagtgctctaccttcagcactctcgacaaacttaaaaatacaaaacttggccaggcacagtggctctcgcctgtaatcccagcattttgggaggccgagacgggtggatcacttgaggtcaagagttcgagaccagcctgggcaacatggtgaaacctcatctctactaaaaatacaaaaattagctgggcgtggtggcgggcacctgtaatctcagctacttgggaagctgaggcagaacaatcgcttgaacctggggaggcagaggttacggtgagccgagttagggccactgcactccagcctgtgacagagcgaaactccatctcaaaaaacaaaaacaaacaaaaaaacttagccaggcgtcatggtgggtgcctatagtcctagctactcaggaagctgaggtgaaagatcacttgagcccagggatttgaagttacgatgagctataatcacacaattatactccagcttgggtgacaaagtaagatcccgtctctaaaaaataataagtaaaaagttttttaaaatacacacaaccttggtgatcaggctttggctgcaactctggcccaggaggccagaaaaaaaaatacacacaaggcattcgcaaagaacagtgagcagataatagataaatctttagttttatgagagtgacaagactgagaggttttacgtaagggattgctgttctcggctttgaaagccttctctacactctctgcagggctcacttaccacactgtgacttccactagagtacactgggcatctgatccctttctagattccttcaggaccacaatttattcatcttggtgttatttcaagtgcctagcatagcatctttcattcagtggactggtaaatgtttgttaatgagtcgctagtacatatatctgagcaaaaccagaaattcgcatttctggaaaaaaattccattccaatactgctaactcaacccagaaggttatcaaatctctttttcattcctttctcttcaaccagaaagaaaatactatctgaacactttcagacatttcttccccagcaaaccaaagcaagcaaatcaaggcttaaactttgtcgtctacattacttccttaacttgttcaaactgaaattgctgtcttttcacgctgtgcaacttcagaaaaggtaaaaaataaagaacagaagaatgcaataagatatgtactgacagcactacgtaatacctgctccaaagagggtttttacaccagtcaaaaattctaacagtttaaacaactgctcaacttggcacagcacagccctagatgatgccttcgcttcttccctaaatcctcagtctcaagccattcatacgtgtaaaaccatgaaacaagagacaaaaaggtcagccatggcaggagaagtaacgaaaggcagtgtttactactgtgatactccagggatactgtggggcctctcctctaccccatctgctgtcccactgaagcctaaaaacacctttatatgagcactgttcttgcaggcacttcagtctcaaaaacacattctcaaatacagaatcttacctattatctacctcaacagatagaatttaacatattaataaagtgtaagggcctttctggattaaacaaccattactttgatttggaatcctctctactctggtggccctgaagaggtcacttctgagatgttccagcttaaaactgagaatattctaaaaagcatctgccaagtggtgatggttgcataaccttacaaatatattaaaagccactgaactgtatgtacactttacttttctttttggacagtgtctcatttggtcacccaggctgagtgcaatggtgccatcatagctcactgcagcctccagctcctgggctcaagagatcctcccacctcaacctcccaagtagctgggactacaggtttgtgccaccacacccagctatttttttttttttttttttttgagacagagtgtcaatgtcgcccaggctagagtgcagtggtgtgatctcggctcactgcaacctccgcctcccagattcaagtgattctcctgcctcagcctccccagtagctgggactacgggcgcgcaccaccatgcctggctaatttttatatttttaatagagacaggtttcgccacgttggccaggctggtctcgaactcctgacctcaggtgatccgtccacctcggcctcccaaagtgctgggattacaggcatgagccactgcacccagctgtatttttttttttttttttttttttttttttgtggagacagggtctcagtctcactatgttttatggaggcctcaggcaatcctctcacctcagcctcccagagtgttgggtttataagtgtgagccaatgcgcccagcttgtacagttgaaaagggtgaattttacagtgtgtaagttaaatgtcaatcatttaaaaaaaaaaaaaaaaaaggccaggcgcggtcacacctgtaatcccggcactttgggaggccaaggcgggcagatcacctgaggtcaagagttcaagaccagcctagccaacatggtgaaaccccatccctgcaaaaacacacacacacaaaatagctgggcatgatggcaggtgcctgtaatcccagctactcgggaggctgaggcaggagaattgcttgaacctgggaggaggaggttgtagtcagccgagatcgtgccattgcactccagcctgggcaacagagcaagactccgtctcaaaaaaaaaaaaaaacaaaaaaaaaacctcctcttccaataaataaggcattcagcaaatacggaacactacaaaacagaatgtttctctttaaaattcaagttccacaatacaatctgctaagttttggagacagtgcctcctccaagtaagtactgagggctgctggttttattccatgcttgtttcttaatggcagtgagttctgagaagcattaaaggtgggatgatgcaaagaacaccacatcattactttagaagctctggctgttctaaaaagttcaagtaaccctaaaattactaaaccagtttcttatctaacaataaaaaaaactaggtgcaaattgcaacttaaatacatcctatcagataaaatgcttgttctaatatacattaagccttgtcttctatatttttattcacttggggacctcactttttaaggagaatctcttggccaatttacttggctctagagaactgtgcttaaatgaattacacttaattacacttaaatgggttccacttaattatttcttaaggaacctatattctttagttttcaaagagatccaaggtcaatactgaatcccaaggtctgactctccaggctccttcaacagctttcccggcatgcagtttaaaaacacacccagcacaaatttcggctatggcttaactaaagaacagaacatgctagccctattgtccacttcctcgctatcaaaaaaaccttgcaaactttttggttccccctttgtaagttccaatccaggtgttatttcctatttatccccctgctttttataagcactgattgttctccgatgctggctttttatggacttaatagtctggaacatgcaatccaacagtctcaatataaccctggacctcaacttagaaaatcagttcttttccaaatagacatcctacataggataattttttaaaaacatgaactggcattttggtacaagcaattggtaaagtcggtaacaccaaaatagttttttgattaaaaacaagaaagttgaccatgctgtacggattctcttactgacagctacttccctacaggttttcgcatctccaatttctagcactgtcaaagagaaaaagattaggtgtaactacaaattagcaactatcaggaagagagaaagcccgcataagaggtaatacctagtcaccaacagtgaccattctagaccaaggttggttatccccggatgactcgctggacaggctgtaaatggagtcctgagtctagtcagagtggtgctggtggctccacagaaaggaggaagagccaagaaagaaaatggctggataaacggaatctgcaaagtaaggtagggaatgggcacttttaggagctgagaagtgaactaggttaggcagtcaaaatggcttgatgtaagtcaagaattacaagctaagcttccttattcaagaggaaaacattgtctagagccgtaccaccctgaaagtgctcgatctcctcaaaagaaaacatcaaccacccacacaaataaatgccactgtcaacaaaaccaccaaatcaaccgtgctgacgtacatacgtcatcagagtgtttctccagacactatccctttaccacgaaagagcaaacggtgacaaaagtttctgtagaaaccaaactcctggagcacttttataatgtccacttatctaagaaccaccacaatacagaactttaaagagagaaatcaacaatatgttctcacttaaaatgcgctggatgtcatgacccaccccactaacgtcctggctaaatgatgaaaggacgttcagccttttccttcctttttcattttctctttaaggaaacactgatagttcctaaaataagcaccattaggaagagaatacttaagttcactcatttgacattcccacaaaatcagtacctgaaagcaagctacctaccacaaaataagcaccattatgagaatacataagttcactcaccggatattcctacaacgtcagcacctgcaagcatgctacctacgacttaagcaacccctaagtacgggaagatgtttaaaaaccaaagttaactcgaaattttatggattagaaaatgtatgtctactagctacggtcagaaagacacgtgagaactattaaattataacaaatgctcaagtgtctgaagaaatagactgaactactgatgcacgaacacagtgagttattccaagcaatctgaataaggtcaacgattttacagcaatgaaaattctctaaacgtgtcgctgacaaaggataaaagtgtaagcttcactttaaaaagacacaaatcaatatagtctcctatcacacattaagtgaggaatcctaactttgtggcactttgtaaactttagaagcgtacacaatgctaagggtaaaacagatcttggtattgatagccaagtttctgcccgatcacaaggctgcaatgcatcttgggattccttcaggacggttgggggccacggacagtttaaaccgtaattacagtttcaatagtagaaaacgcagcagaagacgctctctcggctgggcctaaggtgaaaggaaaactcggccattcgtcctccccaactcctgggatctctaaacgcccacccaaatgactcctggctccatctgtcctcattctgcgcctcgtggcagggatccgccgcggcccccactccgttccatacggttcccatctcaagtgggtaactgcggactccagagcagggcaggggcgcggaggggcggcactcgggtccgggtctttgggcgcgctgcccgctgtccgctccccgcccggccaccgccgcgggccgccccgcgaaggccggctcccgggctcggggcgccccacccaggcagacggcgccactgtcagcgccccacgtgccgaccgggccccagggccgcgcgcccccggaccgcacccctacgccatgtgggctccggcgcccggccggacttcctcccgcgtcccgggcctttacccgcacggcctcccgcgccgctgccggctccgtggttattggcggcgccgccaactgggggtggcggcgctgccgggccccgcaggaaggacggcacgaactcggcggcgtggacgttgggcacgaagggcttggcgttgacgttgagttgccggctgaaggccgcgctgaggttctcccgctgggcctcggccgccgccgccagggagccgccgccgccgcaagggcccggcccgggggcttccatgtccgcctggtcccagcagtcaggcgccgagtcgctgctgctgctgccgctgctgctcccgccgccgccgccgccgccgccgccgccgccactgcccggatccatgatcgggggggccgtgtgtgtggtggacagagagcgggaaatggaggcaggggcgcccggccggagaggagtgggcaacgctgactgagggaaggcggcggggcagaagggccgggagctagcgacaaagatccccggcgtcgccgcggcagcagctccagtcccgactccacactcgcgacgacgacagaggcggcggcggcggcagctcaaccctcctcctcgtgtgtgtgagcggatctcctcccacccaaccacctccgacggcctcacagccaaccccacccccggcgcggattgacccctcgccgccacccgtaccttcgcctcggtagttctctgttctggccgcccccgtttccggctatttagcgcggcgggaggtggaactacaagttccggcagcgcccgcgctaccccgctgcggttttcccgggggccgacgggagtcgaagttcagggacagggcgcaaccggaagcggctccggctcccggcaggcaacgcgaggaggcggaggtctggtggccgctcggcggccccacctgtcacctggtgggggggcagcggcaggccctggttggtgcagctctgtgctgggccgaagaccgagagtattttagcccataggaggggtccactctggcctgctggacacaggctgggggaaaacggacagcatctataacatggggaagaaaaatacactcagctcccgaaaattcttgtactctcttttcaccacctttcctgcgttctctgcctcacagtctccgtaccttattctctctccaccttctttctcctcacccccagccagattttgcccttcatttcaaagccggtgcagattgcaaagctgatttcattttatgtaatcatttcgtggaagaaacaataaaaccgtgagatattccggcttaaaactgcagtgtggctcataaagcgctggggcccaggctctgcccaggcagaagggattgttaactggaaaatttcaatgactcaccgtttgtttgactagtcatataaagccttcacccaaatttttccatcctttcctcctccccgccaaagggtttgcaaattaaacagaggattgccgtattccatggtgtatccggcttacctaacagggttattttggtgagtctagcttccttatgcaccattacgtgaagtggtttccttttgaatggtctgatttgctcaagaattcccatagtacttttcatcgactgcatcttacacttacagattaggtaaacctgggaaaagaacaaaagcaaacgagaaatacttaagagttcgcatttaggcccttcatgaagtaggaaaaaatgttgctctgagtacctgttaagctttcctgtaattcacccatgtggagcccaagacagagaaaaacatattgttagtatttttctgaaaggagtctagacagggtgcaactaatctgcctagaaattacagactaaagaagcacatacatagaatagatgtttctgaacaaccttaggttgttaaaaaaaaaaaaaacctaacaaaatccagatctagatctgtattttaattttcttttttcttttttttgagacggagtcttgctctgtagcccaggctggagtgcagtggcgcgatgtcggctcgctgcaagcccgcctcccgggttcacaacattctcctgcctcagtctccggagtagctgggactagaggcgcccgccatcacgcccggctaattttttttgtattgttattagagacgaggtttacaccgtgttagacaggatggtctggatctcctgacctcgtgatccgctcgtctcggcctcccaaagtgctgggattacaggcgtgagccaccgcgcccggccgatctgtattttaattttaaacatctgtattgtaaagataaaagagaactcagcctaatgagataggtcaaaaacgaagctgtcaagtatttttcaaaagagtcctaggctacagtaatttgaatttaatattaaactaccaagctttagggattaaaaaaacacataccggccaggcgcagtggctcacacctgtaatctcagcaatttgggaggccgaggcagatggatcacgtgaggtcaggagttcgagaccagcctggccaacgtggtggaacccccgtctctactaaaaatacaagttaggccgggcgcggtggctcacgcctgtaatcccagcactttgggaggccaaggtgggcggatcacgagatcaggagattgagaccatcctggctaacacggtgaaaccctgtctctactgaaaatacaaaaaattagccgggcgtggtgtgcgggcgtctgtattgccagctactcaggaggctgaggcaggagaatggcgtgaaaccaggaggcggagcctgcagtgagccgagatcgcgccactgcactccagcttgagcgacaaagcgagactctgtctcaaaaaacaaacaaaaaaagcgatccacctgcctcagcttcccaaagtgctgggcttatcggtgtgagccaccacacccggcagagtttgcctctgcttaataggaagttttggttatagcctattattatacctgaagacctcactgaatcatacttaacaatgtccattttaaagttggtattaagtgactgtcagatttacagagaacttaacaactgttatgaaaattagaacttcatttatgcgagacctgtattgctattgaataaaagattttcatcttatattcacaagaaaaaatacaatgtgttctaaatgaaatgccttctctttccagattttcactccccacccacccacccctaagaaaatgtcaacacaatcagctgactcaaataatgaactacacatccttctctaagcattttgtctttgaatactactctcctccatgtagcactcctacagcactgaatgatcactttctcataggttagttcttcacatctaattgaattagcagagtttccttctgcctggtactttttctagggacaaaggcagaaactgctcagactgctgcttagaaaagcagttgatgtcattaatttccttgtctctgaataggataattatggatattcaggaaaaaatccactccattggttttccaaagctttgacctgccaaacagagctccagcggaaaagggaaaagtctttcttgttagttgtgctaagttgtgtgtaagttgtgcgacttgagggcagggtcttaccttaatcttctttacatttccactgcctagtgtaatgcccggtgtataaaaggtgcttaatcaatttagctgggatgatactgtcctttgatactcatttaagactgctgacacatagggctaataattttatttatttatttattttttaaataacttgagactcttgagacagagtctcgctctgtcgcccaggctagagtgcagtggtatgatctcagctcactgcaacttccacctcccaggttcaagcgattctcccacctcagcctcctgagtagctgggattacaggtgtgcaccaccacgcccagctaatttttgtatttttaacagagacggggtttcaccatgttggccaggatggtctcaatttcttgaccttgtgatctgccctccttggcctcccaaactgttgggattacaggcgtgagccaccacgcctggcctgtatttttttttagtagagacagggtttcaccttgttggccaggctggtttcaaactcctgatctcaagtgatctgcctgccttgggctcctaaagtgctaggattacagatgtgagccaccgcacttagctattttaatttaatttaattttattttttgagatggagtcttgctctgttgcccaggctggagtgcagtggagcaatcttcacgcactgcaacctctacctcccaagttcaagcaattctcctgcctcagcctcctgagtagctgggattataggtgcccgccaccccccctccccaaccccctggtaatttttctatttttagtagagacagggtttcaccatattgcccaggctgatctggaactactgacctcaagtgatcctcctgcctcagcctcccaacgtgctaggattacaggcatgagccaccacaccccaccccaggactaataatttagaaaacttaggaaaaatcagagtttttcctactctcacacacaagtcaccgctcaacacagagtacagtcctctctgggtagaggaaggggattagttccaggagcccttcagatacaaaaatccaaccatactaaaatcccacaatctatactgtgtgtatgaaaggtcagccctccctacacttgagttcctgcatcctgagaatcccgtctttttgatcctcatttgattgaaaaaaaaaatccatgtgtaagtgggaccctcgcagttcaggctcacattgtttaagggccagttgtactccaccagtaagtgagggagtttctacccaccaccaaccaattcttcaacagacaccaacaggataagcaatcatttcactcaattctgacattaaccagagttaggacagatcccacaagttaagggatcagtcccacaagactgcccccacttccaatgccaataacaggttccacattgtgacctgtgcttctgaccaactggctatgaattgggggttcccatgaccccctccatgggttcagggaatttgccagagtggctcacagaactcaaggaaacagggcaaacacggtggctcatgcctgtaatcccagcactttgggaggccgaggcaggcgaatcacctgaggtcaggagtttgagaccagcctggccaacatggtgaaaccctgtctctaccaaaaaaatacaaaaattagccggttgtggtggtgggtgcctgtattcccagctactcaggaagctgaaggcaggagaatcgctcgaacatgggaggcagaggttgtagtgagccaagtgctccaccacactctagcctgggcaacagagcaagactccgtctcaaaaaaaagaactcaaggaaacactttacttacagttacccataaaggacattacaaaggatacagaggaacagccacgtggaagagatgcacagggctgggaaggggcatacagttcctattctgtctccaggtgtgccatcctcaagggtcctccacgtgttcagcaacccagaagctctctgaaccctgtccttctgggtttctatggaggcttccctacatagccatgactgattgtatcattgcccgttgctgattaactcaaccttcagcccctctgcccaccgagaggttggatgtggggctaaaagttccaagcttctaatcatgacttggcctttctggtgaccagtcgtcttctaggagcccatcaagagttgcatcattaggcagggtgcggtggctgatgcccagcactttgggaggccgaggcaggcagatcacctgaggtcaggagttcgagaacagcctggtcaacatggcaaaaccctgtctctactaaaaatacaaaaattagctgggcgtggtggcacacgcctgtaatcccagctacttggaaggctgaggcaggagaatcgcttgaacctgggagatggagtttgcagtaagttgacatcaccccacagcgctccagcctgagtaacagagtgagatttcgtgtcaaaaaaaaaaaaaaaaaaaaaaaaaaacagaaacaaaaaccaaaacaaaacatatacaaaagaaacaaaatacatgtaggccagatgctattacctgctgaagccctccctgttcaaaatgcggatgaggaaagcttggagatgtgttaaagatataatagccagctgggcgctgtggctcatgcctgtaatcccagcgctttggaaggttgaggagaggggatcacctgaggtcgggagttcgagaccagcctggccaacatggtgaaaccccgtctctcctaaaagtacaaaaattaggccgggcacagtggctctcacctgtaatcccagcacttcgggaggccgaggcgggcggatcacttgaggtcagcagtctgagaccagcctggccaacatggtgaaaccctgtctctactaaaaatacaaaaaaattagacagccatggtgatgcacacctgtaaccccagctactcaggaggttgaggcacaagaatcacttgaacctgggaggtggaggttgcagtgagccaagatcattccactgcactccagcctgggcgacagagtgagaccctgtctcaaaaaaaaaaaaaaaaaaaaaatcagcggggcatagtggcacctacctgtaatcccagctacttgggaggctgaggcaggagaatcacttgaacccgggaggtggaggttgcagtgagccgagatcgtgccactgcactccagcctgggcaacaagagtgagactacatcacacacacacaaaaaaagagttgtatgattagaacaaaagacactcctttcacctaggaaatgccaagggattaggagctctgtgtcaggaacccgggtcaaataccaaatattagaacaaatgatgcacctagcacctctattgctcaggaaatgtcaagagttttagaacctctgtgccagaaactgggggcagagcccaagtatatatctcttactatatcacaatagcactatgaccttttttggcaggcttctttcacttagcataatgttttcaaggttcatccatgttgaagcaggcatcagtacttcatcccatttttttttttttgaaacagagtctcgctctgtcgcccaggctgctgtgcagtggtgcgaccttggctcaccacaacctctgcttcccggattcaagagattctcctgcctcagcctcccgagtagctgggactacaggcatgagccaccatacctggctaatttttgtatttttagtagagagggggtttccctatgttggccaggctggtctcgaactcctgaccttgtgatctgcctgccttggcctcccagagtgttgggattacaggtgtgagccaccccgcccggccacttactcccttttaatggctgactaatattttattgtatggattttaccacaatttgtttatccgttgatggacaaattgcttttgtaacttaaagaagtcaaaaataaaaggttaaacaagtgagatcacagtaaagtgtgtagtctagttagttgtgctgtcttaatgtcaatgtcctgaattttgatagtgtactatagttatggtagattttactgttgggagaagctaggtgaagggtacttgggacctctctaccatttctgcaacttttcgtgagtctgtaattatttcaaagtaaaaagttaacgcagggtgcaacggcttatgcccgtagtcccaactactcaggaggcggaggtgggaggatcgcttgagtacaggaggctgaggctgcagcagccctgttcataccactgcactctagcttggatgacagagcaagaccctgtctcagaaaaaaaaaaaaaaaaaagatcccatgtgaaattattcagactttcagacttcagcctgggttcccaagtctttaccaaaatattttttctgtcttccttgattcaatttgtttggggcaggagtacagttgggaaagggggaatttttttcagctttgagaatttaaggctgggtatggtggctcatgcctgtaattgcaacactctgggaaactgaggcaggaggagtgcttgaggccaggagttcaagaccagcctgggcaatatagcaaaaccctgtctctacaaaagataaattaaaaaataaaaaatataattttgtccgggagcagtggctcacgcctgtaatcccagcactttgggaggctgaggcaggcagatcacgaggtcaggagatcgagaccatcctggctaacacagtgaaaccccgtctctaccaaaaaaatacaaaaaattagccgggtgtggtggcacgcacctgtagccccagctactagggaggctgaggcgggagaatcgcttgaacctgggaggtggaggttgcagtgagccaagattgcatcactgcactccagcctgggcaatagagtgagactccatctcaaaaaaaaaatatatatatacaattttataaatatacaacagtataaatatagaacagtaaaaagaatcaccatcactcacaaacttacctggaatctcaagattgccttttttttttctttttctgaaacagggtgctgctctgtcatgcaggctgcagtgcagtggcatgaacttgactcactgcaacctccacctcctaagctcaagcaatcctcccacttcagccccccgagtagctgggattacaggcacgagctaccacacctggctagtttttttgtattttttgtagagatgggattttgccatgttcgctgatctctaactcctaggtcaagccatccgcccaccctagcttcccaaagtactgggattacaggcgtgagccactgcgcctggccgattgccaattgccaatgcctcaacaccttctttcatgttttaaataaacaatttttttatttaaataaataaatgagaaataaaacaatcttttttcttttgagatggcgtctcactctgtcgcccaggctggagtgcagtggcacaatctcagctcactgcaacctccacctcccgggttcaagtgattctcctgtctcagcctcctgagtagctggcattacaggtgcacgccaccaagcccggctcatttttgtacttttagtagagatggggtttcaccatgttgaccaggctggtctcgaactcctgacctcaggtgatctgcctgcctcggcctctcaaagtgttgggattacaggcatgaaccactgagcctggtctggtgagccaatttttatatttgttatagagacaagagagacaagagtctccttatgttgcccaggctggtctcgaccccctggcctcaagtgatcctcccacctcagcctcccaagtagctaggactataggcatgtgccatcatggcgagttaattttttgtgtgtttttattgtctcgagagagagtcttgctctgttgctcaggctggactgcaatggcgtgatcttggctcaccgcaacctccacctcctgggttcaagcgattctcctgcctcagcctcccgagtagctgggattagaggtgtgtgccaccatgcctggctaattttgtatttttagtagagacagggtttcgccatgttggtcaggctgctctcgaactcctgacctcgtgatccacctgcctcggcctctcaaagtgttgggattacaggcatgagccactgagcctggcctggtgagctaatttttaaatttgttatagagacaagagtctctcttatgttgcccaggctggtctcgaccccctggcctcaagtgatcctcccacctcagcctcccaaagtgctgggattacagatgggtgtcaccgcacctggcctctgaggaggatttcattataaacctgccatgaagggagggaatccaattttacgagagggtgtagcctggtgaggcctggatgacctccggaggcaggggcttgtgcctgggctgaggcctaagggacaatgggcagacatgaagttgccccaggcagagggtacagtgtgggcaaagtcaggaagtggcagggcttggatcactccaggaagagagaggagtcatgtgtcacaggagctcgagacccagagagggaggcaggcaggcaggcagggaccaagcttgggcacagccaggaaggcaggacagggcatggtggggccaatggaatcattacccaagacggggattttcagggaaacagcttagataaggccaggtgtacagtagctcccacctgtaatcccagcatttggggaggctgaggtaggaggactgcttgagcctgggagttcgagaccagcctaggcaacatagtgagaccccatatccacaaaaaatttaaaaaaggagtttgtgttcctgtagtagcagacttgggaggttgaggtggcagtatcacttgagcccaggagttcaaggctaaagtgagctgattgagccattgcactccagcctgagcaacagagagatatgctgtctcaaaggaaatacaaattaaaaaaccagccgggcatgctggcgtgtgcctgtagtctcagctacttgggacactgaagtgggaggatcgcttgagcccaggagttcaaggctgccgtgagctatgattgtgcctctgcagtacagcctgggcgacagagaaagaccctgtctcttaaaaaaaaaaaaaaaaaaacttagataagaggatgctgtgcctccctgggggtcttcagtcacccatggtcctggcaagagaggagggccaggagagagcttcacccacctgctgtcctgcccatgtgacatccgcaggtgctgccatggccacgactgttgttacactcgagctgaggaggccggctgcagccccaagacagagcgctactcctggcagtgcgtcaatcagagcgtcctgtgcggtgagtccccagcagcaccatgccacccaccccgagtatcccctgggcaccctggcatagccagatgacttccgtgcccctgttgcaataaccactgcctccaagtctccatagaccaccccttgggtatatctaatgtaagtgatatttattttatttattttttgagtcagtctcgctctgtcacccaggctagagtgtgctgatgtgatcttggctcactacaacctctgcctcctgggttcaagcgattctcatgcctcagcctcccaagtggctaggactacaggcatgcaccatcacgcccagctaatttttgtattttttcagtagaggtggggtttcaccaagttggccgggctggtctcaaactccccacctcaagtgctctgcccgcctcggcctcccaaagtgctgggattacaggcatgagccgtggtgtctggccctaatgtgagtgatctttaacactgagcacttgaaaaagaaaaccctgaagaaacctaattctttgatgtctggacgacaaggaagaagatagaaatggcatcagataataaacagtgtaaatgtttatcagaaaggggctggtggtcgggacaagtaggaggatcgcttgagtccaggagtgcatctctacaaaaaagttaaaggattttttaacattggccaggcgtggtggcacacatctgtgatcccagctacttgggaggctgaggcaggaggattgcttaaagcccaggaggttgaggctgcagtgagctgtgatcgagccactgcactccagcctgggtgacacagcaaaatccagtctcaaaaaaaaaaaaaaaaataatattttacataaccaaccacttctaaagattaaaaaaaccccctatgattaacaacctcaggtccctcaggcaatcataccagatatcaaaacaaagcaataacataaggactgcagtatttattttatttttatattatttatttattctttgttagtttgtttttggagtgtgggttttgttttgttttttgatttttttattttgttctactcagttttattcttattgctcaggcttgagtgcaatggcctgttctcagcttactcaacctccgcctcttgggctcgggtgatgatggttccacctcagcggccctccgcctcttgggttcgggtggtgattccacctcagcggccctccgcctcttgggttcgggtggtgattccatctcagccgctctccacctcttgggtttgggtggtttttctgcctcagcctcctgagtagctaagggaggtgtcttgagattatcatccgctgagggtggagctgagggtggaaggggagtgagcagacactcgggaggtgtcttgagattatcatccgctgagggtggaaggggagtgagcagacactcgggaggtgtcttgaggctcagggagttatcagttatagaatgttgttgagttggaggaggtggctggtggcccatcctgttttttaaagtttcagctgtgaggtagggccagtagggcaatcctgaagaatgacgatgctccgctgccgccattctgacctgtagggccaaaggagggaatgttttcacacatattcatttgatggacaaaattaccgccaccaacacagtctgcaccttctgttgctggtgatagatttttgcacctttccatcctccaggtttcaaaatagcagtatcagtgtcataatatcacccttccactgagtactgccaacagctggagggtaaagaaaagtcactgggacacactgttgtctccacatgccactgtgtctgtctgcaaatgtaggcaggctggggtcctgccccagggaagacagagtcataacagagtaataaagaagcatgtttgagacacaggagtgtctatgtctatcctcattcctccctcacagccatcaccagagcatgtttcttgcaccaggtcaacagacagtaagagacagtaagagaggcatgaaaagcccattgtccacacatgttgcagcttctttttggagaatgttttccaggccttttatgttctgtctctgattctcagaactctgcaaggtcagtgtgaccaccctgctccaaatctaagaaaacagaggtttccagaggaaggagaaattgtgcccagggtcacacagcttgcaagaggcagagtggaagttgattccagctctgcctgcaggaccctctcatttcccctctgtttcccttcttgacaaaggatcttcttcactctggaggtgccacccatgagaacaaagagctctggagagatgtggattcctgaagagctgcaggggaactgggagagggttttctgacagaacaatctcacctcaagaagtcagttaggcatggctgtaatatttcttttcactcccaggtaataccaaattgtaagtgcactaggacataaagaatacttttgtccatggaaaaatgaggtgggaattctaaacaaagcaagttttaaaactgtgtttcacttcaagtgtacaagtcccatcacgtgtaatcataggactcggcagcttttgaaggtacagaggccacacaagaaccagcttagctgagcatcatttaaggccttcatttggaattgtccctgtgggtaataagttacattcactcttcactagtttacagtcagggcccatctgctattacaaatacggaacctctgacacttagaatattagatcaggggccccactgggtggggatgaaggtgtttttgcgcaacacggttaccaacagggatgggactgtgatgcttgtaggcagcctttctctctgccatctccctctgcagggcttgagcacagagctgtagggagaaaaatgtatccatgtcctgacctggcagactatgtccaaaagcaaggaaaacaagcaaacttacccagttgcaaagagcctttcttgcagaaggggggatctgaaaaagccaacacatgagaaattgaatgttgagagagtctaagggccgtggcatcatctgcatcagcactgaactatcctgcaactgcagggaggaagctccttactttgcatttgtggtagtcctctgcccgccgccgcaactcttgcgcacgttgaaacattttcctatggattacaatcactttcatcagataaagcaccactttcaggatgattttaaataatctgccatgtttctgttatcctcacaactgtacccttacacaatctatctctacctagaaaacgtatttcagatggctataagagtacagtctgagccggtcacggtggctgacgcctgtaatcccagcactctgggagggcggggcggatggatcacgaggtcaggagattgagaccatcctggctaatacggtgaaaccccgtctctactaaaaatacaaaaaattagccaggcgtggtggcaggcacctgtaatcccagctactcgggaggctgaggcaggggaatcacttgaacctgggaggcggaggttgcagtgagccaagatcacgtcattgcactccagcctgggtgacacagcaagactccatctcagaaaaacaaaaacaaaaaactgtacagtctgatccaaactgttgctgtattgattcctcctcttgcttactgcctgctgacttctgagatgatagtttccttccccattctcagtacatccctaattcatccttcattgagcatcttttatcataaagctgtattctctttgtattaatatctttaccgtgtttcacagggcagaaacagctgggcttataaacaggcatagtccttttgaaggatgtggttgatcctacaacaacacactttcctaaggatgacaacaactcaccccacccctagaatggctggtatgaaccgagtttccacacagtctagctggcaatggggtcaggagccgttttgctacttcacatcttttggtcactggtaaatattaaggtactttgttttctgttttgtgaactctctctctctctcacgatatgtcttctgaccatttgtttctatttctgcatttactgggtctaaacattgtacaaaggttaaaaacaacactccaatgggcgtttcccaagagggtggggttcagtttctgaactcacatgtaggtgtgtatttctttcatatccaatttcccattttcctctgcctctgacacctgcctctccttttctgcatgctcacattctttcacgcttagtttcctcagattagaagggagagaaatgcacacacatgatccaccagcccgtgtgggattccctctgcccttctggcatctgaaggctgtgattcaaagatcccccctgcaaccttcccacaaatgaaccaactgattctcacaaccgaagggagaattgacacctcccattgagggacaaaaaaaagtcacactctggcctgctggcaagtcacctgtcatttccagctcatcttcatagttccatagttagtcctattctttagtaaatataaagactattaaaagcttctatgaggtgcactatgtgtgtctctggggtcagtcttgtgcttgacacagcgaaagctcattttagttcagtgtgaaaaaccagacctcaccaattcatcacaactaactccatcggaagcagaggattgctcctcatctgactcctcctgtgtgagacctgattctcagtcagaggctgatgccggaactgagaccatcagccatagagagatccttccagaataaccccgcagttcactactgcactttgccatgattcaggactggaacttttgtcatcgactttaaagatcctggttgagagaaaaggcaatctgaatgctgggcgcatctattgaattagaaatgatcggaatggctcctaagtcagggtgttatgtcctgaaaataggtgacaacggcaaaccatccaccctggtgttgactgactttaacaaggttcagttcacagagattgagggcagaaaaaggaaacggcctaaaaagggtaagtttgctgtgttgccctcacaccacttgattcatggtcctgatcctaaggatctcacctgatacttggttttataggaaggatgtgtaaaattcccagaacgctaggaaacaggggcgaaaacacttcaaagagaaagttaatgaacttgtttctgaccacaaggcatccttcagcacatgctgtctggagtggcctcaaacaaggtgtgtgtggtgaggtgctgagaatgcaatgggagcagggtcctgtccccacgctaaagaagctcacagcttaatgcaaatgagaagccagtgaggacatcactactcctgctgtgcacttgggaactagaaacacaaaacctgactctggagggaagctaaggaagcattctactcttgagttgacataagtgcatctgaagcttctgatctccgatgagaacaatgggggacaccaaacagaatataaaacccatgattgaatacatcaaattgctaacatggcagtaaacagacaagaggtgaagatggagaagaaggaaacccaggacgaaagtcagcttcgcatttggaacccatttccctgagtttcattgctgaattccagaaggaactactgagatgcaaagaagcacagcagcttttgcacacatgcgtgggattagatggaaaacaagtggattgagggtctgccaatgaaagcgacccatactgaagtccactggctctggttgagacccagaagagtcatgcatcagaatagaggtggacaggaaataccctggcctttgtagggactgagcctgcaccgacgacctcaattgcagcctgtatggaggacccctgaccatcccccagaagtagactcccatctcttctgcagcaagataacatgctactaggcctcaattcattgctaaatattttttaacaagtatctcacatttaacaaaaaaagatcagtcatatggcagcaaaatacaatgtaatatgaccaaaacatgaaagactgtgaaaatgaatctggaggtgacccaagcattgaattcaacaatccaggctgggtgcggtggctcacactgggaggctgaggtaggcagatcacctgaggtcaggagttcaagactagcctggccaacatggtgaacccctgtctctactaaaaatgcaaaaattgggctgggaacggtggctcatgcctgtaatctcagcacattgggaggccgaggtgtgcggatcatgatgtcaggagttctagaccagcttggccaatatggtgaaaccccgcctctactaaaaatacaaaaattatccgggcatggtggcatatgcctgtagtcccagctactcaagaggctgtgggataagaatcgcttgaacctgggaggtggaggttgcagtgagccaagatcatgccactgcactctagcctgggtgacagagtgagactctgtctcaaaaaaaaaaaaaaaaaaaaaaaaaaaaaaaaaaaattggccaaatgtggtggcacacacctgtaatccaagctactcaggaagctgaggcagaattgcttcaaattgggaggcagaggttgcagtgagccaagattgcaccatagcactccagcctgggcgacagagcgagactctatctcaaaattaaaaaaaaaaaaaaaggctggctgtggtggctcatgcctctaatcccagcactttgggaggctgaggcaggtggattacctgaggtcagaagttcgagaccagcctggacaacatggtgaaaccccatctctagtaaaaatacaaaaattagctgggcgtggtggtgggcacctgtaatcccagctacgtgggaggctgaggcaggagaattgcttgaacccaaaaggcagtgagctgacattgtgccattgcactacagcctgggcaacaagagcaaagctccatctcaggaaaaaaaaaaaaagagacagagaaaggaaaaccaatgccagtactagcaactcctcttcccctgaaaaaatgacaaacaagaatgtaggaagggaaaggaattatacagcttaaactaatgaagcagaaaggacaaactcaattttgaacccactgaatttgccacaaatattgtagaaaatattctcaaggactttacagttgtctactttgattggcacatggttcatacaacaatatttgtgtcaaggcacatcttactgttttttggcggtcttcctctttccattgattttgtcatgatggttgattttcgttgtcaccttcatcttacggattttagctctaccttttgtttccacatgtctccgtagagtaatgacgtctttcaggccaattttatttcctggaaaggaagaaactcttttctttgtgtgcatacaaatggacctcagcccttggtgagagtgaggagaggagaaggtgagaaacctgagggcaagaagctgttctttccctttccagggcaaactcatttccacactatggggactccaacagagccataccttcctgtctacggcggttggacctcctggctctctgctgtacatctgtggatacatcatgtccattttcagactggaagatagtcttcaggaaagacaactaggaaataataatataagaatgacggctgggcacggtggttcatgcgtataatcccagtactttgggaggccgaggcaggtggatcacggggtcaggagttcaagaccagcctggccaagatggtgaaaccccgtctctactaaaaatacaaaaattagccgggcatggcagcgggcgcctgtaatccgagctactcgggaggctgaggcagagaaccgtttgaagctgggaggcggaggttgcagtgagccgagatcacaccactgcactccagcctgagagacagaatgagactctgtcacacacacacacacacacacacacacacacataagaatgacatgaggctggcacggtggctcactcctgtaatcccagcactttgggaggccgaggcaggcggatcacctgaggtcgggagtttgagaccagcctcaccaacatggagaaacgctgtctctgctaaaaatacaaaattagccaggcatggtggtgcatgcctgtaatcccagctagtcaggaggctgaggcaggagaatcacttgaacccagcaggaaaaggttgtggtgagctgagattgtgccattgcactccaacctgggcaacaaaattgaaactctgtctcaaaaaaaaaaaaaaaaaaaaaaataggccaggtgcggtagctcacgcctgtaatcccagcactttgggaggctgaggtgggtgaatcacaaggtcaagagatggacaccatcttgggcaacatggtgaaaccccgtctctactaaaaatacaaaaattagctgagcatggtgatgcacgcctgtagccccagctacttgggaggctgaggcaggagaactgcttgaacccaggaggcagaggttgcagtgagccaagatcccaccactgcactccagcctggtgacagagtgagactctgtctcaaaaaaaaaaaaaaaaaatgacctgaatatacttcacacaactgaactgtacacttcaacacggttagatggtaattatcatcttataagtattttaccacaggttaacatgtttcacaacttgaaaaggaagtaattaccttcagctctctgagttctagaatttgtaacatttcaccccctgctccttcctgatctgcactggagcatcttccttctgtccctgctctactcagagttcactttcccttccctcacatcagcttcattgaggctggtttgaacttaacgcaaaacattctcactaatgactgaattcccaccaagatttccatattatcacagtatgcttttaatcttctaagatattaaatatttgttctcatcatagctaaaatgcaatgcaaatcccatctcagatgtgggtcagatacctatgaatctcctgaggtagtcattgaaatgacttttttcttgagacggagtgtcactctcaaccatgctgaagtgcagtggcgctaccttggctcacggcaacctccacctcccagattcaagcgattcttgtgcctcagcctcccaagtagctgggattacaggtgtctgctaccatgcctggctaatttttgtctttttagtagagatggggttttaccatgttggcccatctggtcttgaactcctgacctcagatgatccatctgcttcagcctcccaaagtgctgggattacaggcatgagccaccacatctggcctgaaataatatctttcaaattctttgtagaatttgttttttcctgatttctgcacataggataaaaaaaaatcatgtactaggatttcgagagaagcaatgggtaatctaaaaagatgaaaagagcaaccacgtcaatcccacagctactgctagatttcataggaaaggtagctggcccagtttggagctaggggaaatttcaaacacatgaagaaatgagaagccaagaaatgccatcacgcatgaatgcttcatggcacccatgatatccctgcttaggaggtaatggtatagatgactagatgacaaggacaaagatgagaggtgcgaagttgtccaagtccaacagctcaactgaactttcctaagtggaattgttaaaaagtggtaaatttaaaaacttcccctggctcacgtggtggctcacgcttgtaatcccagcacttggggaggctgaggtgggtggatcatttgaggtcgggttttgagactagcctggccaacatggtaaaaccccgactctactaaaaatacaaaaattagctgggcatggtggtgggcacctgtaatcccagctacttgagaggctgaggcaggggaatcacttgaagccaggaggtggaggttgcagtgagccgaggtcacaccattatactccagcctgggcaacagagggagactcgtcttgagggtgagaaaagaaaaaaaaaagaaaaaagcttcctccaatttataccgaaaattctctgttcaggactaagtggcatagagaatgttaaatgtgcctagatatcttcataactcatatattttctgttttctacatatcttgaaaggcagtgccaaatgacgtgtaattatctaggtggtaaaactgaaacatacttcctcttcccttgaatatcaaaaagcattgtggtattagtacttttatcttggatcattgttcagaaggaggttcagcccccagacaaccacatttttactgtcatgaatggcaagacaaaatgtagagctcaacttacccaaaggaaaaaaggctcaaaagacaaattatggcacaacttagcagccaaattcttaccaagtacagacttttgacatactgatctctctccagttgcaagtgggaacatgcactttgaatgatgtcattcaaaattaccctgcccagacacacttttcattgattctcttggagggcagttctaagagattctctggggctttctctgcatcatgagacgcagtgcagttgtgcccttcaccttctggcagtttgtcacctcgtccctatgacctcagaggaactttgtctcaggccaattgtttgttccttgggctctttcatttcccctaaaaatcatttgctgcccctctaaatggcctacatctccatctatctccctctcccctcagaagagggtgctctttaagcatcaaccatccagcccttctagcagtctcatttttcagctggttcccatgtttatgcctgttctatgtttttcttttcctgttaagctgtcttttcagctcatttctgcagtgaatcttcagagacgagactggaagctttccttccacccatacgatagaactataaagcagaagagtttagaaagaatttcctatttaagtgacgaaacctcatactccatttgtgacaaatagcacaaaggttaaaaaaacttatttttgaccaaaagctctgttgacattctattaaacaaacactgacctatttaattttcataatgtaaatggcagatattttcataattcttatgctaataaatcatttccctgattttttgggtaaaaccacatattcataatgaagtccagaaatgtgaattgttttatataatttattcttatttgtgattacaagtatacctctacagaaagttagtacactcacccaaaggtaaactgtccagagggtaaggacaactttataacttctcggaaatgcaataatgatacgtaaccaaggacttccaccaaagtcagtcccacgatgatgatggtcagccagagtattgataacctggaataataatagttgaaataatgaaaaggtcaatgacactgacaatatttcactcagaaagaatcatccttagaaaccgtcaacctcctccaaaaggtaaccacatccctcagatatcaccgtgggattccactgttacaaaaaagaacagaagttagaagtcacatgtttttcagatggctggtagtgtttttaggcattgcaaatgtggggtgttgtctttcttggtataaagcagggatatccaatcttttgacttccctgcctatattaaaagaagcaaagttgtcttgagccacacataacatacactaacactaacaatagctgatgatctaaaaaaaacctctttttgtttttgagacagagttccgctccactcagtcgcccaggctggagtgcagtggtgcaatctcggctcactgcaacctccagctcctgggctcaagccattctcctccctcagcctcccgagtagctgagattacaggtctctgccaccatgcccgactaatttttgtatttttagtagagatgaggtttcaccatgttggccagtctggccttgaactcctgacaggtgatctgcctgcctcagcctcccaaagtgctgggattacaggtgtgagccaccgtgcccggccatttttttgtttttgtttttgtttgttgtttttgagatggggtctcactctgtcacccaggctggagtgcagtggtgtgctctcggctcactgcaacctctgcctctcaggttcaagtgattcttctgcctcagcctcctgagtagctgggagtacaggtgcctgacagtgcactcagcaaatttttgtattttctgtggagatggggttttgccatgttggccagggtggtctcaaactcctgacctcaggtaatctgcccgcctcagcctcccaaagtgctgggattacaggcatgagccactgtacctggccaaaatctcctaatgttttaagaaagtttacaaatttgtgttgaactgcattcaaaactgtcctgggccacatgcagcccgtcactcatgggtaagacaagctaagtataaagtaattatcttttcttttttgttttgagacaaagttttgctctgtcacccaggctagattgcagtggcatgatctcagctcactgcaacctccgcctcccgggttcaagcgattctcctgcctcagctactgagtaactgggattacaggcgcctgccaccacgctcggctaatttttgtatttttagtagaaacagggtttcaccatcttggccaggctggtctccaactcctgacctcgtgatccacctgccttggcctcccaaagtgctgggaatacaggtgtgagccactgcacctggccagtagttatcttttctttaaagttatttacttgttttttaaattgatgtataacattggatgcatttattatatatcatatggtaaaagaatccctctaaataatacttctctcttggattatatgaatctttgtcatttaaatctcagcataagtaaaaaaaaaaatacaatgaagagattacttcattcacaaataagtatcaaattttagtgcttaaaaattaacaaggtgggccgggcgtggtggctcacgcctgcaatcccagcactttgggaagccaaggtgggtggaccacgagatcaggagattgagaccatcctagctaacacggtgaaacccatctctactaaaaatacaaaaaattagcagggcatggtggcacgcgcctatagttccagctacttgggaggctgaggcagaagaatcacttgaacccgggaggcagaggttgcagtgagccgagattgcaccactgcacttcagcctgggtgacagagcgagactctgtctcaaaaaaaaaaaaaaaaaaaaaaattaccaaggtggagatcatgaaaatggcatgaatagtgtgggatttctctaagattgttgatattaattccattagactcttatgtgagtgaagacgaagacttcccctgagtaagttcagacagcttgtgataacatttctacatcgattcctcaggatttaactatatattcttgaaaacatctcaattttaaatgtttctttcaagatggtgaattaaacagagatagcccttcaacaggttgaactcagcatatgctgagtctgaaatggaaatgatggagttagagaaccatacaacaatggtaatgatttcagaaacatggtgttgagcagaacaaagcagacacaaaagagtacctatggcatggcatgcatctgtatacgcgaaattccagaataagcaagctaacctatgataagaaagagactggctgggaagagtgagagttcactttctggggtgacataatagtgtagatcttggctgggcacggtggttcacgcctgtaatcccaacgctttgggaggccgaggcaggcggatcacctgaggtcgggagttcaaaaccagcctgaccaacatggagaaaccttatctctactaaaaatacaaaattagctgggagtggtggcacatgtctgtaatcccagccactcgggaggctgaggcaggagaatcgctcgaacctgggaagcagaggttgcggtgagctgatattgccccattgcactccagcctcagcaacaagggagaaactgtctcaaataaataaataaataaataaaataatgtagatcttgaaagggggttggtttatgctggtgtatgtactttccaaagttagtaaacttacacttaaggttatatattttggccaggcgcggtggctcacgcctgtaatcccagcactgggaggctgaggcaggcggatcacgaggtcaagagatggagactatcctggcgaacatggtgaaaccccgtctctactaaaaatacaaaaattagccaggcgtggtggtctactaaaaatacaaaaattagccaggcgttgtaatctgagctattcaggaggctgaggcaggacaattgcttgaaccccggaagcggaggttgcagtgagccgagatcttgccactgcactccagcctgggcgacagagtgagactctgtctaaaaaaaaaaaaaaaaaaaaaaaaaagtcatcaaaccagatgacacaaatcaaatgacatttcactttgttttggtccattttgtttgttagagacaagagtgcagcggggccatctcggctcactgcaacgtccagctcctgggcccaagcgatcctcccacctcagcctctccagtaactgggataacaggtacgcaccaccaggcccgactaatcttttttggaattttttgtagagatggggtttcgctatgatgccctggctagtcttcaactcctggactcaagtgatctgcccacctcggccccctaaagtgctgggattacaggcctgagctgtgtaatttcatgccgcgtgacacagcccagtaaaaaggaagaaaccccgcgggtccagcgtctactcacacaggtggactgatggctgataaattccagcaggagccaaaagaggagccaaaagagcatccacagcacccgcatgtcctggtcctttcagggcgccctgaggcggccaggacagaggtggaggtggcttagggcagggggagggaaggggacagggaccgggccggatctgagttggggagggggaggggagggggaggggaaggggagaggaaggggggaagtaagggaagggaaaggaggagaagggggctgttgggcacctggaggaggtggaggaggaggaggagaagaagaaaggggtctgggaaaggatccggttcaaattaagttctcaagcgctggtggaaggtttagctacaggtcacggagaagatcagggaagcaacaggacacgcggggcaagggagcgtgaggcttaggggcaattagagggagacaaaggttctgctatccaccaaaccttcttcggtctgggccctcccttaccaaccctggggctttatactccctctccaccaatccctgatgaccccggtggtgcctcacaatggacgtgcctcacaatggacatgccaagtagcgcccgcatcattccaatgacccctcccccatctcagtctcccactctcctcccaaggacaggtcctctctggaaccttcacaaacctgatttctggtcctccccaaccagctccctgtccctgcttctgggcgctccttccttcctgagctcccagggttcctcaaggtcacttttggcgacaaaacataaaaaacaaatgatggcaggatggcaggaagaacctcatacccaagcagagtgccaggttttacagcctccgctcagccattcatatcctaagcaacaaaacatcagcaggatgcggaaggtcccgatagtaaaccatctccatcacatccatgtagccatctgtccatcaacctgtatctcaggaacaaatgtacgtacattcattttaagcatgcatggtacatttacaaaaattaacctgacttattttgttccagcaaatctcaatatatttgagagcaatcaaatcacacagcatgtttctgatcatataactgtgctagaagtcaatgattaaaagctaattcaaaattattatttgcttggaaattcaaagtgcccttataagacataaacataagaaagaatccaaaatgaaacaagattgcctttcaactcaatgatgagatcataacatggcaataaaatgtctccctctggcctgggaattcctctttgtggcacaaggttgcatgatctcaaatcacccctaacccacctagacattttaacatccgaaaccgagtgatgatgtccttatctatatcatcttactgcccgtgtgtgtggactttaaattctgaacccaaatgagggggagaaaaccaagttgaccttcatgaatggcctctcagggacgtccaaggaatctgtgcatttcaagaaacaaagttcatcagcttctctcctaaggtatttgcccacaatacccagagggcttggcagcatcatgtgtgatgggtggggagctccaagcaggtgggcaggacccaggggcctggtgaccaggacagacccccactgtccatcacctttcctggccctgtcctcagctaaacttcccacaggccttctgcccgatcacacagagtgtgcccaaactcactcaggcctctggcagctgaaaaccactgctttaaatccctttaccatttactatgacataaggttattgtaaacaggaaatattctattgatgctacaaatggaaagccaatgcctttaccataaatagaaaaacaaccctaagaaacaagcaaaacaaaaacaaaacaggggctgggtgtgatggctcacgcctgtaatcccagcactttgggaggccgaggtgggcggatcacaaggtcaggagttccagaccagcctggccaatatggtgaaaccctgtctctaataaaatacaaaaattagctgggtgtggtggtgggcgcctgtagtcccacctacttgggaggctgaggcaggagaatagtttgaacccgggaggcagagtttgcagtgagccgagattgcaccactgcactccagcctaggcgacagagcgagactctgtctcaaaaacagcaacaactacaaacaaacaaacaaaaaacagggttaacaaaactatggaattcaattctatttgtatgctgcagccatgttccagccctagatttggctgggcatggtggctcacgcctgtaatcccagcactttgggaggctgaggcaggcggatcacgaggttaggagttcgagaccagactgaccaacatggtgaaaccccgtctctactaaaaatacaaaaattagccaggcatggtggcacacgcctgtaatcccagctactcagaaggctgaggcaggacaatcccttgaacctgggaggcagagggtgcagtgagctgagatcgcgccattgtactccagcctgggcaacaagagcaaaactccgtcttaaaataaaaaaaaaagccaggcacggtggctcatgcctgtaatcccagcactttgggaggccgagacgggtggatcacaaggtcaggagatcgagaccatcctggctaacatggtgaaaccccgtctctactaaaaatacaaaaaattagctggccgtggtggcgggcgcctgtaatcccagctatttgggaggccgaggcaggagaatggcgtgaacctgggaggtggagctggcagtgagccgagatcgcgccactgcactccagcctgggtgacagagcaagactctgtctcaaaaaaaaaaaaaaaaaagaggcaaaactaatagtataatttataagagaggaagattaacaaattggctgtgatactcggtacattaccacaaattttaaaacatgaggtgaagattttaccagaaaacagcagaacaccagtactgcctgtgatacagatgataaactggattttttttttttttttggagatggagtcttgctctgtcgcccaggttggaatgcactattgcggtctcggctcactgaaacctccacctcccaggtaagagattctcctgctttaagtcccaagtagctgggactataggcgcgtgccaccacacccagctaatttttgtagttttagtagagacgggggtttcacgatgttgccaggctggtctcaaactcctgacctcgtgtgatctgcccacctcagcctcccaaagtcccgggattacagtcatgagccaccacacctggccttaaattttttataggcagagtgcggtagctcacgcctgtaatcccagcactttgggaggccgaggcgggtggatcacctgaggtcaggagtttaagaccagcctgaccaacatggcaaaaccctgtctctactaaaaatacaaaaattagctgggcgtggtggtgcgcacctgtaatcccagctacttggaaggctgaggcaggagaatcgcttgaacctgggagatggagtttgcagtaagcagagatgacacagactccgtgtcaaaaaaaaaaaaaaaaaaaaaaaaaaactggaacagaaaacaaaacaaaacatatacaaaagaaataaaatacatttaggccagatgctgttacctgctgaagccctctctgttcaaaatggagatgaggaaaccttggagatgtgttaaagatataatagccagccgggcacggtggctcatgcctgtaatcccagcactttggaaggttgaggtgggtggatcacctgaggtcgggagttcaaggccagcctgaccaacatggagaaaccccatctctactaaaaataaaaaaaaaaaaaaattagccaggcatggtggagcatgcctgtaatcccagctactcaggaggctgaggcagaagaatcgcttgaacccgggaggcagaggttgcggtggccgagatcacgccattgcactccagcctgggcaataaaagcaaaactctgtctgaaaaaataaacaaactaacaaataaataaatatataaaaagatataatagccaatgagatagtgtgtgcttatagtcccagctacttggaaggctgaggcagggacatcccttgaggccaggagttcgaggctgcagtgagctctgatggcaccactgcagtccagcctgggcaacatagtgagaccgtgtttcaaaaataaataagcagggtgcagtaactcacacctgtaatctcagcactttgggaggctggggtgggtggatcacttgaggccaggaatttgagaccaggctgaccacgaaggtaaaacccccatctctactaaaaatacaaaaaaaattagccaggtgtggtggtacgtccctgtagtcctagctactcaggaggctgaagcaggagaaacgcttgaacccgggaggtggatgcttcactgagctgaaatcgtgccagtgcaatccagcctgggtgacagagtgagactctgtcttaaaaaaaaaacaaaaacaaaaacaaaatgctggagtcatgctgagcatagggaatgtgaaggccctggattaagacaggctgagggaaggacagctgtgccctctcctccttctattcagcccatgggttctatgttcttacagagtggaaggcagaaacccctgcattatttaaagcattattctttctgtctgtctcatttctgtctctttctttctctgtctctctcacattcaaacatgcatagttggatttaccaagttaaatacaggtatattatgactccagtgtttgtagcttgtcaaaccatcccctcatgatttgtttcttcctgtggcttctacaaaaaaaaaaaaaagaaaagaaaaaaagaaagaatgaaagaagaaagaaagaaaggaaggaaggaaggaaagaacccagagagctgggcatggtggcttatacctgtaatcccagcactttgggaggccagagcgggcagatcgcctgaggtcaggagttcaagaccagcctgaccaacatgtagaaaccctgtctctactaaaaatgcaaaattagccaggcatggtggcacatgcctataatcccagctacttgggaggctgaggcaggagaattgcttgaacccgggaggtggaggttgtggtgagccgagatcgtaccgttgcactccagcctgggcaataaaagctaaactctatctcaaaaaaaaaaaaaaaaaaaaaaaggtaaaaaattagccaggcgcagtggtgtgtgcctttagtcctagccactaaggaggctgaggctgaggtggggggatagttttagcccagaagtttgaggctactgtgagctatgattgtgccactgtactccagcctgggcaacggagtgagaccatatctttaagaaaagcaatgcataatgagatactacttcatatccactaggatgactaatactcaaaaagagaataataagtggtgaggctatggagaaacagaaactctcccacattgccggtaggaaagtaaaatggggcctgccactttggaaagcagttggaaagtttaataaaaatgtaaagataaattgatccagcaatcttattcgtaggtatctctgactgagaggaatgaaagcatatgtttacacaaagtaacataaactcgcctcctgagtagctgagattacaggcgcccgccaccacacccggctaatttttgtatttttagtagagatggggtttcatcatgttggccaggctgatctcgaactcctgacctgaggtgtgatccacctgcctcaatctcccaaagtgctgggattacaggtgtgacccaccttgaccagcctaaattcaactatttgaattatatatatatatatatatggtatatatataaacatatatataatatataaaataaaattcaattatatatattttaattaaacaattttttttgttctgatggagtctcactatgatgctcaggcaggtctcaaactcctgggctcaggatatcctcctgcctcagcctcccaaactgctggaaggtgtgagccaccatgcccagccaatggttgaatggtgtgtgtgtgtgtgtacataggtacatacacatattttatttatttatttatttatttatttatatatatatatatttatttatttattatttatttttgagagatggagtctcgctctgtcgcccaggctggagtgcagtggcgcgatctcggctcactgcaagctccacctcccaggttcacgccattctcctgcctcagcctcccgagtagctaggactacaggcgcacgatgccacgccccgctaattttttgtacttttagtagagacggggtttcaccgtattagccaggagggtctcaatctcctgacctcgtgatctgcccacctcggcctcccaaaatgctgggattacaggcgtgagccaccgctcctggccacatatacatattttaaagagtgatcttcatcagaaattctagatgaaaaaaataaaagtaaatataattttttaaaaaaagaataaggaaatgttttcccaaatgcctctgacaaattaccccttgtgatttattggcccaaggtgtggcatggggactggcttgcactgaccggcttcgtcctgggttctggaagggagcagctggtcatggaagctggggctagcatcagtgcccgtgaagcatgtgggctgtgggtagggaccattacctaatcaaaaaatcaggggattgcaagaaggtgaaagcggatactaggtggacaactactaaggtgtcaattacacccaagactggccactagatacagacccctccccctgcattctccagcccgttatccacatcctgtctcctacttctctgcccactatggcaaagggaggcagagtgggggtgggaagagtcactgcctaaaacatggctttcctgcagggtgaccagctgtcctgggactgagtggtttcctgggccatgggactgaaggtgccaaaacgggggaagttccaggtgaactgggaagggttggtgacctggtcacctcaccaaacagaaataaagaagcactcctaatgaactgtggatcctgtcatcaagcaccaatggctgccgataccacaaagagacaattggtcattgtgcgtctgtgaggaaagcacgctcaacaccatttttgaaatattttttggcaaaaagactgaacataaatacaaacaagtctgtagatccaagtaccaattcataggaaatacagactgtggagtgtgtaaaatggaaacttactgggcgcagtggctcacacctgtaatcccagcactttgggagcccgaggcggatggatcacgaggtcaggagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcagagcttgcagtgagccgagatcccgccactgcactccagcctgggtgacagagcgagactccgtctcaaaaaaaaaaaaaaaaaaaaaaaaaaagaaagaaaagaaatattagctacttcagaggtttgctgtgagcattgaaaaaggcagtgatttgttgggtgtggtggctcatgtcggtaatcctagcacttcgggaggctgaagtgggtggattgcttgaggccaggacttggagaccagcctgggcaacatagcaagacactgtctctacaaaaaatttgaaaattagctgggtgtggtgcctgccgcatgcctgtaatcccagcttcttgtaagggaggcggctgagatgggaggattgcttgagcccaggaggttgaggctgctgtgagccatgatgctgtgatcgggccactctactccagcctgggcaacagagctagaccctgtctcaaaaaaagaaaaagagagagaaaggctttggtaagggcttagtaaatgtcagccacagtagtaatgacagcaatacttgcgaagccttttctattttattactgtgcacgtcggtgatctcatgcaatcaactcagcaaccttgcaaaataggtatcatcatctccatttaaaaagcaagaaactgaggcttagcaaggtgaagttgtgtgaccagcgctacatagctggtaggaggcaaagcagattcccacccaggctcatgtgacaccagggtcctcctgagatgttagcctcagtgaagtttttagcccagatcttcatctcctcttgccaggatttctgctattcaaatgcagccacaggaatccgagaagaacccggataactaaatcagcagcagcttattcaggctgagaaaatatacagcagccctgagaatgcagcttatcttgctttgggcttacttttgagtgacaggctcttttagccaagccctggccagtctcctcacttgagccctggctcacctgagccagcctctcagagccttatggagctggctggacagcattggaagtaaagggcagccttgctccctcttctttaacaccgtttaggatttctgtgtagttacccagagcgacattgggtgtcacctttgagtcacttgaagccagtttcccccagaggttgatgaatgcggcctttccccagagattctggttgtctaagatctatctgctttggagatacagtatattcattgccaacacttgtgcccccgacttaacaggaatatctggttctcatttgtcctcaaagaagagtgttctctgcaaccacataagccttgaatttgttttttaattattattttttatgttttattttttccgagatggagtctcgctctgtcacccaggctgcagtgcagtggcatgatcttggctcattgtagccacctcccgggttcaagggattctcctgcctcagcctactgagtaggtgggattacagacacctgccaccacccctggctaatttttatatttttagtagtagtgatggggtttcgtcctgttggctgggcttgtcttgaactcctgacctcaggtgatctgcccacctcagcctcccaaggtgctgggattacaggcatgagccaccacgcctagcctaattaatttttttctaagagatagggtcttattatgttgcccagactggtctcgaactcatgggctcaagcaatcctcttgctgcagccccccaaaatgctgaggttataggcctgaaccaccatgcccgctaagccttgaatttgaagatgggcttcatgcctgatgactttgcaaatgacttctcttctgaggaaaggaggacgctaacataaggacgagagagagtttatgcaaagtccctaccaactcagagcccttttctcccaatgttctttgcactctgcccacacatctgtttccaagcctggctgtgaataacagtgaacaacttgggggccaggactcttttctaccgctccctccctcctctcatcctcccttccttccttctcccttccagcccataaatatttaccaagtagatatcatgtgtcagacactgggaacataacagagaacaaaacaaaagttctctttcttcgtggaatttacattaaaacttcttatttctctgtatgttctcagcatctaactgagaaggtgctgagaacatacagagaagtaagacattggatggcttggctaacactcttctttctagtttttcctatgcatatactaacatatatacatgatttttttgcatgtaaaatatgttttattgttctttaaaaggattcagggtttagttttaaatcaggctgcacacctttcaaatcaatttgacatctctctcactatgtcaaactggcttcagttagcaatacctcattaaatctaaaagaaaaaaaattcttttaagaaaattcagtttcgagaaaaattaacattactcggccgggcgcagtggctcatgcctgtaatcccagcactttgagaggccgaggcgggtggatcacaaggtcaggagatcgagaccatcctggctaacacggtgaaaccccgtctctactaaaaaatatataaaaaaaaaaattagccgggcatagtggcgggcacctgtagtcccagctactcgggaggctgaggcaggagaatggcgtgaacctgggaagcggagcttgcagtgagccgagatcatgccactgcactccagcctgggcgacagacaagactgtctcaaaaaaaaaaaaaaaaagaaagaaaagaaaaattaacattactcagaattcaaaacaaagtgagggctaatatttcatggttctttatacatccttctcctcaatacagaaccaggaatgtagcaggcactggcactgatacagatggacactgcacatacacatacacacacacacacacacacacacacacacacacacacacacccagcccccaaacaacaaaattcagagtatgtcaaagggaaaaggttttttatggtattgatagaaacccctggagtaggccaggtgcggtggctcacgcctgtaatcccagcactttgggaggccgaggcgggcggatgatgaggtcaggagatcaagaccatcctggctaacaggttgaaaccccgtctctactaaaaaatacaaagaggctgggcgcggtggctcacgcctgtaatcccagcactttgggaggccgaggcgggcggaccacaaggtcaggagatcgagaccattctgattaacacggtgaaaccccgactctactaaaaatacgaaaaattagccgggcgtagtggcgggcgcctgtagtcccagctacttgggaggctgaggcaggagaatggcgtgaacccaggaggcggcgcttgcagtgagccaagccattgcactccagcctgggcgacagagtgagactctgcctcaaaaaaaaaaacaaaaacaaaacaaaaaaaaaaacaaagaaaaaaattagctgggtgtggtggcgggcgtctgtagtcccagctactcgggaggctaaggcaggagaatggtgtgaaccggggaggtggagcttgaagtgagcagagatcgcgccactgcactccagcctggatgatagagcaagactccgtctcaaaaataaaaaataaaaataaataaaaaaagaaacccctggagtcaacagtctatcttagcaggtatgccgttttgatcttgaatctatatgaaagaatctgttgtcatgtacatgatatttacatttcaaatggaaataggacccaccttaacaatattcgatgactaacccctacacccgaaacttagtagtgtactacggccatctttctttctctttttttttttttttttgagacagagtcttgctctgtcacccaggctgaagtgcagtggcacaatctcggctcactgcaacctctgcctccaggattcaagcgattctccttcctcagcctcctgagtagttgggactacaggcacgtgccaccatgcctggctaatttttgcattttttagtagagatagggttttgcaatgttggccaggctggtctcgaatgcctgacctcaggtaatccacccgcctcggcctcccaaagtgctgggattacaggtgtcagccaccgtgcctggcccttatcgccatctttctttgttagaacataaaaatctacttcaatgtttacatgtgcccagatgctatttgggatctctctgccccttggattctaaaaagactgacttgaaccccaagtgtattccctgtggattctcaaggtcaagagcactagagtgctcatgttctcatggtcgcttctggtccctgttcaggtctctgctgaattcattccatcaaatttatttaaccatttgacggacttggaggacttcagtgctgcattgaaaaccctaattcattctgtattttttttcaaggtggagtctcactttgttgctcagcctggagtgcagtggcgcaatgttggctcactgcaacctccgcttcctgggttcaagtgattctcctgcctcagcctcacaagtagctgggattacaggcacctgccaccacgcccggctaatttttgggttttttgtttgtttgtttttggttttgtttttgttttcttgagacggagtcttgctctgttgctcagggtggagtgcagtggagcaatcttggctcactgcaacctccgcctcccaggttcccaggttcaagcgattctcctgcctcagcctctcgagtagctgagactacaggtgcatgccaccatgcctggttaactttttgtatttttaatagagacggagtttccccatgttagccaggatggtctcaatctcctgacctcgtgattcacccaccttggcttctcaaagtgccaggattacaggcatgagccactgtgcctggcctgagatacaactatttttcttagtttattttttgctttcagatcatccttttatttactttaatttttttttttttttttttttgagacggagcctttctctgtggtctgggctggaatgcagtggcacgattctcctgcctcaacctcctgagtagctgggattacaggcgcacactaacatgcctggctaatttttgtatttttagtagagacgggatttcaccacgttggccaggctagtctccaactcctgacctcaagtgatttgcccgccttggcctcccaaagtcctgggattacaggcatgagccaccacgcccagcctcatatcatctttttttggtaaacagtgcctagcattctattgaataggcatactataattttaaaattatagtataaatgttaagcagtcttttattaataggcattttggttatttccaatttttttttgcagttaaaaacccagctctttctagtaatctgctttgtatctctttcatgcaaaattcctaaacgtggaattgcttggttaaaaaatattaattttaggccaggcatggtggctaatgcctgtaatcccaacagtttgggagagtgaggtgggaggatcacttgagaccagaagtttgagaccagcctgggcaatgtagcgagaccccatctctgaaaaaaaattagccggtcgtggttgcaagcctataatcccagctactggggaggctgaggcagaagaatcacttgaacccaggagtttaaggttacagtgagttatgattgcaccactgcactccagcctgggtgacagagtaagactctgtctttaaaaaaaaaaaaaagaaagaaaaaaaagaatgttaactttaaaaagacgcttttatgtataattgagaaataaaattttttttaagaagaaaaaagactcgatacatattgagtattggatattatatttaaaataactttttgctaggctggctgtggtggctcacgcctctaatcccagcactttgggaggccgaggcggtaggatcacgaggtcaggagatcaagaccatcctggctaacacggtgaaaccctatctctactaaaaatacaaaaaaattagccaggtgtggtggcaggagcctgtagtcccagctactcgggaggctgaggcaggagaatggtgtgaacccgggaggcagagcttgcagtgagctgagatcacaccactgcactccagcctgggcaacagagcaagactctgtctcaaaaaaaaaaaaatactttttgctatttaaaaacaacaaacttttattgattaaaaataaatccctcacatatccatcacccatcaaatcaggctgacctggtataatctatacacgtacctacatctgcctctcctgtattattttgaagtaatccatttcatctataaagatttcagaatttaggctgggcgcggtggctcacacctataatcccagcatggtggattgaggccaggagtccgagaccagcctggccaacgtggtgaaaccccatctctactaaaaatacaaaaattagctggccgtcgtggcacatgcctataatcccagctactctggagggtgaggcatgagaatcacttgaacctgggaggcggggtttgcagtgaaccaagatggtaccactgtactctagcctaggtgaccgagtgaaactctgtgtcaaaaaaaaaaaaaaaaaaaaaaaggtttcgggatttagagagagactatctttggataagaaatttgccattctggccaggcgtggtggctcacgcctgtaatcccagcactttgggaggctgaggcaggtggatcataaggtcagaagatcgaaaccaccctggccaacatggtgaaaccctgtctctactaaaaatacaaaaaaacctaaaaatagccaggcatggtggcacgcccctttattcccagctagctacttgggtggctgaggcaggagaattgcttgaacctgagaggcagaggttgcagtgagctgagatcgtaccactggactccaacctgggtgacagagcaagacactgtctcaaaaaaaaaaaaagaaaagaaaaaagaaatttgccactcctcctcccacctcttgcagatagtggcaatggaaagttacccaatgatgcttcttgggaagccttccactgggaggatgcttggagagaaacgtttaatcccactccacgtatcccctctggaacttgactctcgttttgcaaacaggaaaaaaccggtcacccacttagatgactcagccagccccaggcctcctctggtccactgcagagttcccgaagacccaaatgttttgcctcagccacacgttttcacttatttttgattcattccaaaggcaggcaggaaattgccgccagtcattaatcatgcatgaatctttcctctgcgcctcttccatgaacaagacccatgttgatgggcacctccctcttgtgatcttaccttgatgggctctgacagcaggtcgtaggtgtctctctctatttcacagcacaggtcaccaacactcaggcagggaaactgaattgctcaagccctgtaagtgggagaaccaagccttgaacctggctctgtgggctcttagtggaaagcccacagggtgggttaaaggcctggttcccacattgcactaaaaaatgaacactctctggagtcccgctctcagtagccatctggatgagaaatgatctcttgccgggagcagtggctcacgcctgtaatttcagcgctttgggaggctgaggcgggcagatcacctgaggtcaggagtttgagaccagcctgaccaacatggtgaaaccccatctctattaaaaatacaaaaattagctgggcgtggtggcaggcacctgtagtcctagctacttaggaggctgaggcaggagaatcgcttgaactcaggaggtggaggttgcagtgagctgagatcgcaccactgcactccagcctggggaacacagtgagactctgtctcaaaagaaaagaaaagaaaagaaatgatctcctgcagaatgcccaggaggaacactgactgagaaccagatgctcatgctggcattggaaccaggcttcttgaggtcccctcctgaaaacctcttttgctcttggcaggctctcactctccatgctcagttggcttcaccccaggggtaccaggcactagggggtggaggacaggtaccctgctgaccaggcccccaggagggctccacagctggccctgcctcctcatttaggcagcaccaattgttgccaagatggctattatttttatttttaattaattaattaattcttcttcttcttttgagatggagtctcactctgtcaccgaggctggagtgcattggtgcgatctcagcttactgtagtctccactgcttggggttcaagcgattctcctgcctcagcctccaagtggctgggattacaggtatgtgccaccacacctgtctaactttttctttttttttttttttttgagatggagtctcactctgtcgcccaggctggagtgcagtggtgtgatctcggttcactgcaacctccgcctcttgggttcaagcgattctcctgcctcagcctcccgagtagctgggactacaggcgtgtgacaccacgcccggctaagttttatacttttagtagagacagggtttcaccacgttagccaggatggtctccatctcctgacctcgtgacccacctgcctcggcctcccaaagtgctgggaccttgtgaaccaccgtgccctaccaacttttgtattttttgtacagacggggtttcaccatgttggccaggctggtcttgaactcctaacctcaaatggtctgcccgcctcagcctcccaaagtgctgggattacagacctgagccaccgtgcctggcccttaaatcagtagactttgaataaaggacactgcccttcataatgtgcgtgggcttcatccaatcagttgaaggcctaaaaagcaaagaccaagatttcctgaaaaagaaggaattcagcctcaagactgaaacacagacaccctctctgagtgtctggcctgcctggcttgccctgtggatttcaaactcagtactgcaacatccactcttacgtggattttcagtctgctggcctgccctgcggagtttggacttgccagctcctacaattgcatgaagcaattccttaaagtaaatctctgtctctagctctgtatctccttttggttctatttctctggagaattctactgatacttagatattccccaattacagaatcccccacacatcctgccaacatcagctaagccgtgtttttgcaaactctccccaaataacctgacacaaatccaaatcctatgatgagaactttctaacattgtctttattgagtcactcaggactgactacttaacttgtggggcccagtacacagtgaaaatgctggctgggtgcggtggctcactcctgtaattccaacactttgggagactgtggcgggcagatcacctgaggtcaggagttcaagactagcctggccaacatagcaaaacctcacctctactaaaaatacaaaattaagctgggcgtggtgggtgggtgcctgtaatcccagctactcaggaaggctgaggcaggagacgtgcttgaacccaggaggcggaggttgcagtgagcccagatcacgccactacagtccagcctggatgacagagcgagactccgttaaaaaaaaaaaaaaaaatcctaggccaggcatggtggctcatgcctataatcctagcactttgggaggccaagtggggtggatggcttgagtctaggagtttgagaccagcctgggcaacacagcaagacccccatctttgcaaaaaataaagttaaataaaaaacctagccaggcaagatggcatgtgcctgcagtcccggctactcaggggactgaagtgggatgatcacttgggccggggaggttgaggctgcagtgagctttgatctcaccactgcactcctgcctgggtaacagagtgagaccctgtctcaaaaacaaagtaaaataagaaagcctgtaggttgaaaatattaaggttaaagaggtggtaacaatcagggttggtttggggagctgagctaccatgggtgagtgttacgggataagggaaggaatgagactttgcacaattattgcaggatctcgggaggtgaagatctgggagtgggaccagaggagtcaccaaccagtggatctagaagtcaggaatgtctgtttgccaaagtggggctctgcagggggagctcgtagaggggtttagtttgcccctgtatggctcttgcctctgtgaatgggcagccaagcatttggtgctggggctcgggccgtggcagaagcagctttaatggctttgggagtttccagcaccactttgcttccttagagctgtgagtgacaagtgaagcttgaggctggtgtgagtactggattcctcactgttccttctatgtcacgcaagggcaaacacagcactcttttggtgatgtgattacatcagcacctgtctcataaaacttaaaaaaaaatctttgtttcaaaatcatgctcctagccaggcacagtggctcacacctgtaatcccagcactttgggaggctgaagtgggagaatagcttgaggccaggaattcaagacttgtctgggcagcagagcaagaccctgcccttacaaaaaattaaaaaggaaaaaaaattgctatgcatggtggcgtactatcgtagtcctagctacctgagaggctgaggcgggaggattgtttgagcctaggaattccaggctgcagtgagctgtgatcacccaactacctctaaccgggtgacagagggagaccccgtctcaaaaaaaaaaatcatattattaaaaaaaaatattcaaacactgctaaagatttttcaatgaaaagtgagtctttttctttctttagattttgtctattgccagagacagtccatcagtcttctttctagctttgcaaaaaaagtctccgtttatgtctgtctattcagacactacctattttatttttttaaattttattttatttgagacagtcttgctctgttgcccaggctgaagtgcagtagcacacaaccatggttcactgtagcctcaacctcctaggttcaggtgatcctcctgcctcagcctcctgagcagctgggaccacaagcacgcactaccacacctggctaatttttaaattatttgtagagatagggtttccctgtgttgcccaggctgtctcgaactactgggctcaagtgatccttctacctcagcctaccaaaatgctggcattacaggtgtgagccaccgtgcccagtctgtactttgtgtttttcacttagtgatttatctttcatatgagaccacatctgtctcattctttctgatggccatagtcttccattgtgaggctcccagtgacgaacagttctgttgctctaggctcttatgaatagatgtgatgtcacagtaaactacattgtacctgagattttaagtacctgagcaagtatatctgtcagacacaatagtgttttctttccaaagagttagcaaagctttcttcccctggcttctggcttcccaggtatggttccctttttttttttttttttttgagacagagtctccctctgtcgcccacgctggagtgtgcagtggcatgatctcagctcactgcaacctctgcctcccaggttcaagcaattgccctgcctcaggctcccacgtagctaggattacaggtgtgcgccaccatgcccggctaattttttgtatttttggtggagacggggtttcaccatgttggccaggctggtctcaaactcctgacctcaggttatccgccctcctcagcctcccaaagtgctgggattacaggcatgagccatggcgcctggcctcaggcatggctcctattggctgcctcctcttcctcaccactccttaaatatctaccatctggcttgcatcagggacacactcaaaggccatcaatgacctgcttctttagtgcatcgcccctgatcttcctgtagaatttgactccactccctaactcaggctaaaatctctccttgcttgactgttatgggagatttttttttctttcttttcttttttttttttgagacacggtctcactccgtagcccagactgcagtgcagtggcgcaatcttggctcactgcaacctctgcctcccaggttcaaacgatcctcctgcctcagcctcccaagtagctgggattatgcacgccaccacgcttggctaatttttgtatttttagtagagactgggtttcaccatgttggccagattggcctcaaactcctgacttcaggtgatccacctgcttcagcctcccaaagtgctgggattacaggtgtgagccactgcacccagcctgggagataatttttgttctctccctatttctctaatcatgtttgtcctgtctcctttgcctgtcttccaaaggtcagcaatctggcagaggctgagggagtggagcctcctgggccagctgcttcagcttctccctgtcctgcctaggcagcctctcccacttacctcaccacctggaccccagaggaatttgacgttttgatcaatatctaagttcaaaatctttcctaggctcaagtcctgcatttaaaaaaaaaagtatttttttaaatttctgcattttattttcatgattttagcatttattatggactactttaaaaatacaaaaagaggccaggcgcagtggctcacgcctataatcctagcactttgggaggccgaggcgggcgaatcacttgaggtcaggagttcgagaccagcctggccaacatactgaaaccccgtctctactaaaaatacaaaaattagccaggcctggaggcacgcacctgtaatcccagctactagggaggctgaggcaagagaatggcttgaacctgggagacggaggttgcagtgagctgaaattttgccaccacactccagcctgggtgacagagtgagaccctgtttaaaaaaaaaaaaaaaaaaggtatgagcagttgtataatatgctctatctgcctcctgggtggatacaaataaaataggtagggtctgaatagacagacataaacagaggctctatttggaaagacagaagactgacagtggctgggcactgtggcttacacatgtaatctcagtactttgggaggctgaggcaggaagatcacttgagcccaggagttcaagaccagcctgggcaacatgatgaaatctcatctctacaaaaaatacaaaaattagctgggcatggtggcatgtgcgtagtcctagctactcaggaggctgaggtgggaggatcgcttaagcccagaaggtggaggctgcagtgagccctgatggtgccactgcactccagcctgggcaatagagcaacaccctgtcttaaaaaaaaaaaaaaaaaaaaaggctgggtgcggtggcttgcacctgtaatcccagcactttgggaggccgaggcgggtcgatcacgaggtgaggggattgagaccattctgcccaacatggtgaaaccctgtctctactaaaaatacaaatattagctgggcatggtggcgcatgcctgtaatcccggatcatgaggtcaggagatcgagaccatcctggctaagatggtgaaaccccatctctactaaaaatacaaaaacaaaattagccagacatggtggtgggtgcctgtagtcccagctactctggaggctgaggcaggagaatggcatgaacctgggagtcggagcttgcagtgagctgagatagcgcccctgcactccagcctgggtgacagagcaagattctgtctcaaaaaaaaaaaaaaaaaaccaaaaaaaaagaggaagactgacagtaattactgcctctggcaagagagaggaaatccagggtaggaaaaagacttacttttcattgaaaaatctttggcactgtttgaatacttattttttaataatatgaattttaaaaacaagaattatcagtggctgggcgcggtggctcacacctgtaatctcagcactttgggaggccaaggcaggtggatcacgaggtcaggagactgagaccattctgcccaatatggtgaaatcctgtctgtactaaaaatacaaatatttgctgggcatgatggcgcatgcctgtaatcccagctattccggaagctgaggcaggagaatcacttgaacccgggaggcagaggttgcagatcgcactactgtaccccagcctggcaacagagggagactccatctcaaaacaaacaaacaaacaaacaaacaaataaataaaaaatcatccaggctaggtggctcatgcctgtaatcccagcagtttgagaggccaaggccggtgggtcacctgaggtcaggagttcgaaaccagcctgaccaacacggtgaaaccccgtctctaccaaaaatacaaaaactagccaggcgtggtggcatgcacctgtcatcccagctactcaggaggctgaggccagagaatcgcttgaacctgggaggtggaggttgcagtgagccgagatcgcgccattgcactccagcctgggcaataacagtgaaactccagctcaaaaaaaaaaaaaaaaagaataagtttttaaaggttggggtgcttggaggatgaaataaagtagaagggatggcaggtttccttggcacactccttgggccttaagaaagtgtaaagaataagaaaaatacaacaaaaggaaaacaacaaatatcaatgtatccaccactcagcttaataaagaaaatataataaacacaggtgaagccttttttgtgctccccttcttccccaccacttacctcagagataatcactatactgaattaggagtttgccatttcctcaaattttaattgagtcctgcatttttgacaaacatctggacgtctctatatgggtatttcactcagtatggttaaaagcaaattcaagctgggcttagtggctcacacctgtaatcccagcgctttgggaggccgaggtgggtggatcacttgaccccaagtgtttgagagcaacctgggcaacacggcaaaaacccatctctacaaaaaatacaaaacttaccaggcgtgctggcgcatgtctgtagtcccagctacttggaaggctgaggtgggcagatcacctgaacccaggaggtggaggctgcagtgagctgtgattgtgtcactgcactcagcctgggagacagagtgagactctgtcaaaaaaaaaaaaaaaggcaaattcaagtgatccatttatgtaaacagaaaaatgcactatataaatgtatctatctagaattcagggatcggtgaaacaaaagacatcgcatcggcaggtctgtttgcaacttctgggatacaccaggtgttagcggtgatgacttctggatgcttggactgtggatttttaaaatggttttatctgctcatctgtatttctaaattttcaacaatggaacatagattattgtattattattataataccccaaacctatcttcctctcagccctctttccacgagctcttaccctaaatgtctctttttctgtcagtggcattgtgcgtcttccttagtgcatcacctctgatcttcctgtagaattttttttttttttgagatagagtcttgctttgtcacccaggctggagcgcagtggcctgatcttggcttactgcaaactccgcctcctgggttcaagcacgtctccctgcctcagcctcctgagtagctgggatcataggtgcctgccaccatgcctgactaatttttgtatttttagtagagacggggtttcaccatgttggccaggctgttctggaactcctgacctcaagtgatccacctgcctcggcctcccaaagtgctgggattacaggagagcgccacggcgcccagcttacaccagactactttttaaaatgtttttgtaaagtcagggtttcgccatgttgcccaggctgattttgaactcctgggctcaagcaatccttttgccttttgactcccaaagtcctgggattacaggtgtgaacccctgcagctggcctcaatgttaagatcttaaggggcacagcacagaccttgtcttgtctatctccctggcacctctcacagagtacagcttattaacagatgttccagaaactgttactgaacattcggcttgatgctgtgggcttgtctgcatcttgcaactgtcacctggctgagaaatttcttctataaataagcagtttctgtttcagatgtgatatgccctgatatttacaccctgtctcttaccccatccaagactcaaacttagaaacttgaattagatgtggtattcaaatccttagctgccgcgaagacacagacagcccccgtaagaacccacgaagcaggcgaagttcattgttctcaacattctagctgctcttgctgcatttgctctggaattcttgtagagatattacttgtccttccaggctgttctttctgtagctcccttgttttctttttgtgatcatgttgcagatggctgggcagtgctcccaaaatgaatattttgacagtttgttgcatgcttgcataccttgtcaacttcgatgttcttctaatactcctcctctaacatgtcagcgttattgtaatgcaagtaagtaatattgcttgaacgattattcattggtgtgaactattctgtctatatggactgcttattcagagaatcaacataatgggcatgatggtgagttttcttgaatcaaaaagagaaaggaagcaaggcagtgattttaatgtttatggaaacaaagtaattatttggaactgaacttgatatgattcagcactattagcaacatagattttttttaaaaatcagctcttctaattaagtgatatttagaatttaaaagtcaatgttcattaattaaggtgattgaatggaaataatccatacttgattattttgctatcaaaacaatccataattcattattttagcaaaataatcaagtatgacagccgggtgcggtggatggctcacacctgtaatcccagcactttgggaggccgaggtgggtgaatcacctgaggtcggcagtttgaggccagcctggccaacctggtgaaaccctgtctctactaaaaatacaaaaaattagctgggcatggtggcacaggtctgtaatcccagctactcgggaggctgaggcaggagaattgtttgaacttgggaggtggaggttgcagtgagccgagatcgcgccactgcactctagcctgggcaacagagcaagactttgtctcaaaataaataaataaataataacaataaagtatgtgaatattatgttatcagctcattatctgtctgatgttcttttcataaaggtgtgaccaattcagtgaaaggaacgaatgcgattctctggacctgtttgggactgagcttaataatttctttggcagttttcgtgctaatgtttttgctaaggaagataaactctgaaccattaaaggacgagtttaaaaacacaggttggtttgatggtgaatctttgaaatctatttccaggggatggctattgtgagtttcagttccttttctttttttagcgttgactatttcacttcgttacagccctttcgaatgtgttagaacattgttacattaaatgaacttggtagaggtgagccatcttcattctgattttgacaccttggcagattttctacaatgtcagtcttctccaggattcttccactgttaattactctattgaaagtactaaggctttcttgggaaacatcagtctctttgactaaagttagcacatcgattaaatgccacattatcagaaactcctagccaggtctgctactgtcaggaaaagcatatttgtcaagatctatggtcatgtttttatacaaatataggtgttctttgcttgagtgaacattttactactgaaaaatgttagaaatgaataaccagttgctcctgaattatttgaggaatcatctaaaaaataattatttttaagcaatagagaaccagtcccagaaaaatgaatgttctacttaagtgcctcttaagataaaaatacttctgcagcacctttgctcatgattggattcccaagcatgtacagccactgccctatttctgtatgcatttatttatttatttatttatttatttatttatttatttagagatggagtctcgctctgtggcccaggctggagtgcagtggcgtgatctcaactcactgcagcctctgcctcttgggttcaaacaattctcccatctcagcctcctgagtaactgggactataggtatgtgccatcacctccgactaatttttgtactttttggtagagacagggtttcatcatgttggccaggatggtctcaagctcctgaccacaagtgatctgcccgcctcagcttcccaaagtgctgggattacaggcgtgagccacagggcccagcacatactcattcttttttactgaaaagatctgtttcaagctgggtgtggtggcatggagctgtagtcccgactgctctgtaggctaacgtgggaggattgcttgagcccaggagtttgaatgcagcctgggcaacacagtaagaccccacctctaaaaaatgaaaaaatctctctcacattgctttgagtcccgatgtgtactgctaagactctcatgaccacattctctgtgaagtttgggttaatgtttccgtttctacataattaggatcaggtctcctgggcatggctaacattgacctggaaaagagcaggactggtgatgaaattattcttccgagaggcctcgagtacacggtggaagaatgcacctgtgaagactgcatcaagagcaaaccgaaggtcgactctgaccattgctttccactcccagctatggaggaaggcgcaaccattcttgtcaccacgaaaacgaatgactattgcaagagcctgccagctgctttgagtgctacggagatagagaaatcaatttctgctaggtaattaaccatttcgactcgagcagtgccactttaaaaatcttttgtcagaatagatgatgtgtcagatctctttaggatgactgtatttttcagttgccgatacagctttttgtcctctaactgtggaaactctttatgttagatatatttctctaggttactgttgggagcttaatggtagaaacttccttggtttcatgattaaactcttttttttcctgacatctaagtttttattaacgtgagtttttaaaaacaagcatgtataccagtgtggggggtgagggtgggagagaaaggtgggagggggaaagaattctaacctattgataataaagctccagttttggccaggcgcggtggctcatgcctgtaatcccagcactttgaaaggccgaggcgggcagattacctgaggtcaggaatttgagaccagcctggccaacatggtgaaaccctgtctttactaaaaatacaaaaattagctgggcatggtggtaggcacctgtaatcccagctactcaggaggctgaggcaggagaatcgcttgaacctgggaggtggaggttgcaatgagctgagatagcatccctgcactccagcctgggcaagagggtgagactccgtctcaaaacaaaacaacacaaacaaacaaaaagacctccagcttcatcttctgctggattttatagtgccccaaagatatgtggtccttaaaaattgtataccacttattcaggagtcttgttcctgaaagggttgttcttgttacagccctagtctgggctgtaatcagcttcttaaggtccacaatggtgttatctgtgtagcatttaacacagaccttctccacactatccactctccactgaggttgttgcaaacaacctcaatcatcctagctgatgctcatcaccttgaacatgctgacatgacaatcttctcactagagacctctaaacgcttgacttactgaaaaaaacagcattctgtagatctcagtaaccaatttctttttcttttcttttttttttttttgaaacggagtcctgctctgttgcccaggctggagtgcagtggcatgatcacagctcactacaacctccacctctcaggttcaagcgattctcttgcctcagcctcccgagtagctgggattacaggcacgtggcaccatgccctgctgatttttgtatttttagtagagatggggtttcactgtgttggtcaggctggtcttgaactcctgacctcaggtgattcacctgccttggcctcccaaagtgttgggattaccggtgtgagctatcgcgcccggccccagtcatacgcttctatggttagggcgcttctctccgatatacatacatacagatttcaggaaggatcggatgtttctcttgatttttgaattttatttatttattttttgagacagtctcgctctgtcgttgacacgggagtgcagtggtgcgatctcagctcactgcaacctctgcctcccgggttcaagcaattctctgcctcagccacccgagtagctgggattacaggtgcccgccactgcgcctggctaatttttgtatttttagtagagacagggtttcaccatcttcgccagactggtcttgaactcctgacctcgtgatccacctgtcttggcctcccaatgtgctgggattacaggcgtgagccactgtgcctggccttttctctttattgttaaaggaaagctaacttatgtacttctgcaaacaggagaagcctagaatcaaccagacgaattcagtgtgcagtgcacaggtggttcttggccttgtgagcttccagcttaatgaaagcatcaggcattactataattacacaagtaaatgtgtaatcgcaaactgtgataacggtgcacgacatactgttttcagcccaaaatgtgagtggtgctataataatcatatctaacccttatatagtcttactaacgtgccagggactgttctaagtgcttcacctgtactagctcattttatttttttgagacggggtcttgctctgttgcccaggctggactgcactggcatcatcttggctcactgcaacctctacctcaagaggtaggttcaagagtctcctacctcagcctcccaagtagctgggattacaggtgcccgccaccacacccggcctatactaactcattttaagcacacaaaaactcctgggtatggccgggtgtggtggctcatgcctgtaatcccagcactttgggaggccgagacaggcagatcacctgaggtcaggagttagagaccagcctgaccaacatggtgaaaacctgtcttgtcccacatttccagtctttatttttattcatttatttatttatttttgagatgaagtctcactctgtcgcccaggctggaatgcagttgtgctatctgagctcactacaacctctgcttcctgggttcaaacaattcccctgtctcagcctcctgagtagctgggactacagtcgcatgccaccatgctcagctagttttggtatttttactacagatggggtttcaccatattggtcaggctggtctcggactcctgacctcaggtgatccacccactttggcctgccaaagtgctagaattataggtgtgggccactgcacctggccttccagtgtttaaaatcagcattttttttttctttcttttgagacacagtttcactcttgttgcccaggttagagtgcagtggtacgatcttggctcactgcaacctccaacttctggtttcaagcgattctcctgcctcagcctcccgtgtaactgggattacaggcacctgccaccacgcctggctaatttttgtatttttaatatagacggggtttcaccttgttggacacggtggtcttgaactcctgacctcgtgatctacctgccttggcctcccaaagtgctggcattacaggcatgagccaccgcgcctggcctaaaatcagcattttcttactcgtttcttttttttttttgagatagggtcttactccaatgcccaggctgagtgcagtggcataatcttggctcactgcagcctcgacctctggggctcaggtgaccctcccacctcaggctcctgtgtagctgggactacaggcatgtaccaccattctcggctaattttttttattcttttagtagagatggagtttcgccatgttgccaaggctggtcttgaactcctgggctcaagcgatcctccgaccttggcctcccaaagtgctgggattacaggcataagccaccacgcctggcctaaaatcagcattttcatctgctacattgttgtgtgctaggtcagtcatgttaaagaaaagggtcaaactctaaaacatgtgaagagatttattctgaaccaaatatgagtgaccaatggccatgacacagccctcaggagattctgagaacacataccctaggtggttgggctacaactttgttttatacattttagggagacaaaaagcatcagtcaatacatataaaatgtacactggttcggtccagaaaggcaggccaactagaagcaggtatgggggagtggggtggtgggggggtgggtggttccaagtcataggtagattcagagattttctttcttttttatttttttagacagagtcttgctctgttacccaggctggagtgcagtggcgcaaccttggctcactgcaacctctgcttcccaggttcaagcaatcctccagcctcagcctctcaagtagctgggattacaactgtgcggcaccaagctcagctaatttttgtatttttagtagagatggggttttgccatgttggccaggctggtcttgaactcctcacctcaagtgatctgctctcctcagcctcgcaaagtgctgggattacaggtgcgagctaccgtgctcctggcctagattcaaagattttctgattggcaattggttgaaagagttaagttatggtctaaagatttagaatcagccaggcgtagtggctcttgcctgtaatcccagcactttgggaggctgaggtgggtggatcacgaggtcaggagtttgagaccagcatcgccaacatagtgaaaccccatctctaccaaaaatacaaaaaattagccgggtgtggtggcaggcacctgtaatcccagctactcgggaggctgaggcaggaggatcacttgaacctgggagacagaggttgcagtgagctgagatcacgctattgcactccacagcccaggcgacaatgcgagactctgtctcaaaaaaacaaaaacaaaccaacaaaaaaatttctgtgttaagataagggattgtggagaccgtagttctgtcatgccaatgaagcctccaggtggcaggcttcagaaaatagattgtaaatgtttcctactaaggagtctgttctgggctggatgccgcggctcacgcccgtaattccagcactatgggaggccgaggtgggcagatcgtaaggtcaggagtttgaaaccagcctgaacaacatggggaaaccccgtctctacagaaaatacaataattagccggggcttggtagcatgtgcctgtaatcccagctactttggagtgtgaggcacaagaatcacctgaacctgggaggcggaggttgcagtgagctgagatcacaccactgcactccagcatgagtaacacagtgagaccgcatcttcaaaaaaaaagaaaaaaaagctaggtgtggtggctcacgcctgtaatcccagcactttgggaggctgaggcaggcagatcatgaagtcaagagattgagtccatcctggccaacatggtgaaaccccgtctctactagaattagctggacgtggtggtgggcgcctgtaatcccagctacttgggaggctgaggcaggagaattgcttgaactcaggagatggaggttgcagtgagccgagatcacgccagtgcattccaggctggcaacagagcgagattcggactcaaaaaaaaaaaaaaatagctgggcgtggaggctgatgcctgtaatcccagcactttgggaggccgaggcgggcggatcacctgaggtcaggagtttgagatcagcctggtcaacacggagaaatcctaactctactaaaagtataaaattagccgggcgcggtggcacatgcctgtaatcccagctactcaggaggctgaggcaggagactcgcttgaacctgagaggcagaggcagaagttgcggtgagccgagattgtgccattgcactccagcctgggcaacaagagtgaaactgtcaaaaaaaaaaaaaaaaaaaaaagactctattctatcagtaattctaaaagggaggagtctatcgtgaggcatgtctggctcccatttcccatcatggcctgaactagtttttcaggttgcctttggagtgcccttggccaagaggcgggcttcattcagatgactgggggactgagaattttatttttggtttatagccatgatttccatagctgggatttggttctttccactgtgggggccaaggggaaaacttcctcttagtcctttgaaagttgctgaaaaatcagctcagaaaaggcagataaactggagaaaaggtagacaagttttactgacttgtaccctgggggagaaccacagagtgaatacctatccctcaacagagttcagcagcttataaattatttattttattttttgagacagagttttgttcttgttgcccaggttggagtgcagtggtgccatctcggctcactgcaacttctacctcccgggttcaagcgattctcctgcctcagcctcccaagttagctaggagttcctagctggtctggaactcctgacctcaggtgatctgcttgcctcccaaagtgctgggattacaggtgtgagccaccgcacccagccaaattatcacaaggctacaaaaagaatgagggcttggaaccccagcaaaacaggttatgggactggggagaagaggaattctgttgaggagcaataaaggatcactggagatggaatggatcctggaatggagattatgctgtaaacagttctctttggaatttgaatgattctgagagggtctttatcttgtgaaagcatttgttcaggtgtggttaccttctcagttttacagggaggggaaaaattgttatttttggtgggtcccaagtttaggcagatgaaggaacttcatcctggctttgagagatttgctgtgttatgggcgaggccagagagactatgatgcttcttcagtccagcaggtcaaaatgccatattttcgggtactggtttctaagccccaacgccactttttcattattacagagaatgctgcagactggggttggtggctcatgcctgtaatcccagcactttgggaggccgaggagggtggatcacctgaggtcaggagttcaaggctgaccaacatggtgaaagccgatctctactaaacacacaaaatacaaaagttagcaggcatggtggcacacctgtaatcctacctactcgggaggctgaggcaggagaatcactagaacccgggaagcggaggttgtagtgagccgagatcgcgccattgcactcctgcctgggcgacagagtgagactccatctcaaaataaaaaaaacaaaaataacaaagacgtattatggatcaattgagtaagtctccttcagcattagaggaaaaaaagaaagtagaggagaatgtactacctacagaattgttttttaaaacatctccttaagtgtatgcttatgtgtacaaggttatgatataaaatacatttcttcactcggggtgtgggcaaaacaagttgggaaaatactccttcagtcccttttccccgatgtgtaaaatgggacgaaaccctggacttcataacaatgtgcagggcgcggtggctcacgcctgtaatcccagcattttgggaggccgaggtgggtgaatcacgaggtcaggagatggagaccatcctggctaacacgttgaaaccccgtctctactaaaaaaatacaaaaaattagccgggtatggtggcaggagcctgtagtcccagctacttggcaggctgaggcaggagaatcacttgaacccgggaggtggaggttgcagtgagccaagatcgcgccactgcactccagcctgggcgacagagcgagatgccgtctcaaaaacaaaacaaaacaaaagaacgttgtgaatgtgtcacacttgtgttcacactcaatccatcaccttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaatccatcaccttttctatctccactgccaccactgtagacaggcaccatgtcttgcctggacaactgcaataactccttaaccacctgctctttctccaccctgcccccattataattcattctcatcccaggaagagccatttttgttgttgttgttgttgagagggagtctcactctgtcacccaggctggagtgcagtggtgggatctcggctcactgaaacctctgcctcccgggttcaagcaattctcctgtttcagcctccccagtagctgggactacaggcgcacgccaccatgcctggctaatttttgtatttttagtagagatggggtttcactatgttggccaggctggaatcgaacttctgacctcaggtgattcacccaccttggcctcccaatcatgccttgggattacaggcatgagtcaccgcgtccggcctaggagccatatcttaaaacctaattcagatcgtatcactcctctgcttgagtcctttttttctttggtagagaacggcgtctcgctacgttgcccaggctgctcttgaactgctggcctcaagcgatccgcctgcctccgccctcccaagtgctgggaccttcctagaattaggcagaaaagcccaaactccttcctctggcctgcaaggccctccctccacctcctcaatctccttttctcactcaccctctcgaactcctgacctcaggtgatccgctcgcctcggcctcccaaagtgttgggattacaggcgtgagccaccgcaccaggcctattttctcactcatcccctcgctcctgtcaacccctccaggcaggggccttgcaattgcccctccttatggaacactttccctggggatcttcccggactgggttcctctcatcatccaggtctgggctcagaagtcgcctccttagagaggccctccgggattgcccatccgcctgtgcccacgctttgtcccgttcctctatttttatttcctttcccgctcgcatccctctctgggacgaagtcgccccatcactcgtgggaacctcaggaaggcaggggaggcgtcttgggcacttggggacagcgacgcctcctcgcggggtctcgggtttaccctgagtctccagcccgcgtagcctcagcaccgctctccacaccgggtccggcgacttggatctgcgccgcggtttacgttccgggtcggcgggcggggcctcgtcggcggccaggctctacttccggggcggggcggccggggcggggctcctgtctcccggcctgtctggagctcggcagccgcagaagcggcagcggcggcggcgcggcgcaggcaccggcccggggagaggcaccatgagcggtgagtggcggccccgccgctgtcacctgccccggccgccccggctcccgccgctccagctgcacactccggcccctgcgtcctcgcgccccgctccctcgcagaccccctcccagtcgctcccttttccagacccctggcccccaggactcccggctcgtggcccctgctcacctgcgggtctctgatctcccgtggcggggcactcctggtctcctgactcctgtccatccataaaaaccagctcctaaacccctgtccccagttgttccagtcctgcgatccccttgcctagtgtccagacccccagttctgagacctcccaggtctcagtctctcctaactcctagacccgctgcgtcccagctccagttccaggtcccccatccccagtcatccccgctacccaggcccctggtctccagtccctgcagtttccacacaggcatagtctttctggacagttagtttgctgaccccagtacccccgtgtcccaggagcttctggtccccagaggagctcaattctgcaacccgtttgtcttccccatccctctcatccctcccacccctgttcccagtgctttgctcttcccatcaccagttcttcccagttacccactcggcttccctctccggtcctggcttttacatttcgatgatccttgcatattccatccttgtccatgtcttatcctggctcatcattatcatttaagatctctcttgccttgtcctgcagcccttcccttcttgtcccgtgcccagcccatctggggaccgtcacttcgtccttcttcttcccagtccaaacttcttcctctcaccatcgagggggtggtgttgatggggatgctggaagtgagagggaggtgggtgtgggcagctcgtcctcaatgttttctgaagtttagtcccttgactctaccctcctttcctctgaggagtcttattggtgttttggtgctaagtcattcctgggtgttgtatgtggagatgggagtgactcagggaagcctctcagctctcccctgactgtccagccactctgggatctggatttatttaggaagccccgcctatcctcctagtgcctgttttcccctcactgtggaattgtttctgaggatccctgcatccagccgtcctggccgttgtcttccactcaggcatttctggaggttgagcggggggcaaggccaagggatactgctgtcttcaattttaacttttaaagttatctctgtggaccttttttgttggttggttgtttaaacaagtgatgtgccttttgtttttgttattcaagggcaagatttgtgaaatggacagtcctaataatgagggggctggtgagggggagtttcctgggagataatccacctttggttgcaaatcaaatgattttaagcctaagtatggtttctgattcgtgaatgttagtaatacctcagtaaagatgttatgagctggcttcccccaggagctgaggtaggttggtgtaagtgcaggccctgaggccagacatcctgggttcaaatcttggccctgccacataaacctgtgttatttaagagtaagttctcgaccattctgggagtcccagcaaaatgaggatacctagtagtacctatctcctaggcttgtaatgactaaataacattcatcagttaaagtgactggtactgtgaatatcacgaggtgcattgtcagaatctcagagctgcctgctgttgtttctgcaagagctcatgtggggtaggagtggggttgtttttgcctagttatgagaggagggctgggactaggcactgtctgaaaatcttttccttttactatgaccaaggagtctttgccacaagctcacagttctggacccttttcgttttacctttagcacaagagacaatgaaattgataagccaatagaaattgatcagtttatctttcaaggagaaataatatgaaaactctggtggcacgcgcctgtaatcccagctacttgggaggctgaggcaggagaatcgcttaaaccccggtgccagaggttgcagtgagccaagatcaagccactgcactccagcctgggcgacagaacaagacttcgtctcaaaacaaacaaacaaacaaaaaaacaaaagaaagaaaactttaaaatttaattaaaaaatcattacgtctgctgggtgtgatggctcacacctgtaatctcagcactttgggaggcagatgcaggctgtcacttgagatcaggagtttgagaccagcctggccaacatggtgaaatcccatctctactaaaaatacaaaaactaacagggcatagtggcaggcgcctgtaatcgcagctactcgggaggctgagggatgagaatctcttgaacccaggaggtggacattgcagtgagcggtgatcatgccactgcactccagcctgggcaacagagtgagactcagtctccaaaaaaaaaaaaaaaaaaaaaaaatcgttacatctaaagccaaagagaaaaggaaaccaacaaatgactttttaggaaaaagcattaaggatgaaaaccttcttttggaaacattgtaattgaggcagaaaaagtggtctgtgaaaatggaaggggaagtccaacgatatattttgtttcttgagaatgcagttgaaagtgggtttccccacttgtggggtgggtaactggtacacgataaaataaagtggcatggaaatatttcctctttcttctgttccccacttataatattttgtttatttatttattttatttatgttttagagatggagtcacgctctgtcacccaggctggagtgcagtggcaggatcttagcttactgcaaccttcgcctcctgggttcaagcaattcttctgcctcaggctcccaagtagctgggactatagacatgtaccaccatgcccggctgagttttgtatttttagtagagatggagtttcgctgtgttggccaggctggtctcgaactcctggcttcatgtgatccacttgtgaactcctggcttcatgtgatccacttgtgaactcctggcttcatatgatccacctgcctcagccccacaaagtgctgggattacaggcatgagccactgtgctccggccataacattttattttatagtgtattttaaaaactcagaatctaagtaaggtttaaacagtgcacattggtttgtgttttaaatcttttaggtctctccctcacctcctgtttattttatttttattttttggtattttcagagccgtgtaaacatcaccatagttaatttcacaacattttaattaccttagaaagaaactttgtacccattagcagtcattcatctttccccctcccctcagaccctgggaaccactcatctactttctgtctctggatgtgcctgttgtgggtatttcatataaatgaaatcatacagtatgtgacctctcttatctggcttttttcactcggtataattttcctgaggttaaaccacattacagcatatatctgtacttcattcctttttgtggccacattatattcctttatgtggatatcatattttgtttattcatgcatcaaaaatgggcatttgagttgtttctactttttagctgttctgaataataatgctgctatgaacgttcacgcacatgtttttgtgggggcaagtctcttcatttctcttgggcatgtttgtaagagtggaattgcagggtcatatggtaactgtttaaccatttgaggagctgtgtcagactgttttctaaagtggctgcaccattttcagttctcaccagcagcatatgagggttctgtttctccacaccttccccaagagtctttttaatcatagacattctagtgagtgtgaagtggtatttcttcgtagttttgatttgcatttccctagtgactagtgatgttgagcatcttatcttgtgcttattgaccaattgtgtatcctccttggagaaatgcctcttcagatcctttggccattttaacattcggtggtctttttattgctgatctataagaatcctctgtaatttttagatactagtcccttatcaggtttattgtttacaaaaattttctccccttccatggtttgtcttttcattttcattttctttttttttttttgagttggagtcttgctctatcacccaggctggagtgctggagtgcagtgagaaatctcgtctcactgcaacctctgcctcccaggttcaagtgattctcctgcctcagcctctggagtagctgggactacaggtgcacacccccacacccagctaacttttttgttgtttcagtagagatggggttttgccatgttgactgggctggtctcgaactcctggcctcaagtggtccgcctacctcagcctcccaaagtgctgggattacaggcatgagccaccgcacctggccaatttttgtattattagtgttgatggggttttaccatgctggccagctggtctccagctcctgacctcaattgatctgcctgcctcagcctcccaaagtgctgggattacaagcctgagccaccatgcctgggctcttttcactttcttggtggtgttttttgaagcagtctttttttaaactacaggctgccctttaatctctctccttttcccccttgcatttgttgttgaaggaaacagagttatttatcccaaggatcctttgcaggcctctgctgattgcatccttttggtgtggcataaagtgtttttcagtctcttgtatgtgctataaattggtaattagagtctgctgtatttttgagttgaaaatatttgagtagagtcagaggagagatgggtgcaaagctgaatacattaagtacaaataaccaggcagtggaatggcgctaggtaatatatatatacaagataaatgggtatcatgaggccagaaacaactaagatgaccattaattggggagtaggtaaacctagtgtgctgtggacacctgacggaaagcctcagaaatgttaaaaggattgatacggattcatacacatcaccgtggctgcatctcaacgttaatgttctgtaagaaaagcagggtgggtctggcgtgattgctcacgcctgtaatctgagccctttgggaggcccagttgggaggattgcttgagtccaggagtttgagaccagcctgggcaacataacgagatctcatctcaattaaaaaaaaaaaaaagcagggtgtagaattatacctaaaatatataccttgatgcaaattaaaacatactgaagacaatatttatggattcatatatgtatgtagacctaaaaagattatcaggaagaaagatgcctgccagacatgtgtgggtggttattgtagggtggtggtcacaatttgtttatttttctttaaagaacccagtagataggaatacttgattgcccacctcttcagactatgtaaggaatgctgattttcagatatgtgtttgttgttactgggaaagtagaactcgtagagccagaaagtcattatactcaagttttgtcttttgtaagtcttcatccttaagttcctggatgctcctttccatcagtttttttttttttttttttgttttgagatggagtcttgctctgtcacccaggctggagtgcagtgatgcgatctcggctcactgccagctctgcctcctgggttcaggccattctcctgcctcagcctcccgagtagctgggactacaggcgcttgcaaccacgcccagctaattttttgtatttttagtagagatggggtttcaccatgttagccaggacggtctcgatctcctgacctcgtgaaccacctgcctcggcctcccaaagtgctgggatcacaggcgtgagccaccgtgcccggtctccatcagtaaaggagacactgagattcctgtttcaagggtgaggaaagccaggcccatagtgatcaaacaatttgtgtaacagatgagctctaagattcatcatatatcagagttttgggcttaatgggtaatttactgctgtttcttgcctgacgttaatgtatattttggcagctttttattaaaaaaaattttttttaattaacgaatatttttttgagacagattctcactgtgttgtccaggctggagtgcagtgccactatcttggctcactgcaacctctgcctcctgggctccagtgattctcttgcctcagcctcctgagtagctgggattacgggcgtgcaccaccacgcctggctaattttttgtatttttagcagagatgggttttgccatgttgtgcaggctgatctcaaaattctgagctcaggtgatccacctgccttggcctcccaaagtgctaggattacaggtgtgagccactgcgcctgggttacaattttttttttttttttttttttgtagagattgggtcttactacgttacccaggtttatctggtactcctggccttaagccatcctgtctcaaccttccaaagtgctgagattatagttgtgagccactgtgcccagctgctttttcttagttttctggaatgttgaaggtcacagttttctcctcggcactgactgggccctctctgacagtagcttgtacttagaataaataatcagctgaaatgaatgaatgaatgaaaaaagaatatttgtggttttcattcaaagtagaaaagtgatgctatcaacattttttcccccttgtgaaggcactggattgatctatgatggtggaatgcaagaagtacatgttctaccatcagcaaacagttgacccccacctctgctagcaactggcgatggactaggtcctactgatgttggctatcttgcctcctggttgcttgactccaggtaactgataggaactcaaatgcttagagctcttaaaatttggaactaaaatccaagattttatagatttctccaaattgtggcaatgtgagcatatttccagataaagcaccttccatctgccactgtcttgtctatacataggccgtatatttgcagtgggggtgatatcacccccaagggggtgaacactggttctcaggagagaaaaaaaacttacttggatgtataaagcacagataggcatatagtacataaacagatgtacattgtatctgtggtattactttttcatggaggggatgattagcaaaaaagtgtctaaaaagtgtccttagggggaaagaatgaaaaagattgagctggacacagtggctcacacctgtaattccagcactttaggaggctaaggtgggaggatcgcttgagcccaggagtttgagaccagcctgggcaacatagtgggacccgtctgccggtctttgtacacacacacacaaattagctggatgtagtggtgcatgcccatggtcctagccactcgagaggctgggctgacgtgggaggatcacttgagcctgggaggttgaggctacagtgagccatgaaagtaccattgcactccagcctgggtgacagagccagacccctcagaccctgtctcaaaaaaaaaaaaagaaaagattgagactgatataggctgcagtaattgtattattatcatacaactttgcatcttgctttcaccattaacatttcaggacaaaactttaccacattgctccatgggctcactattgatcacttttatggaatgtacagtccatcattcatcattttgcatgtagtacaacttttaactattgattctagttgtagaaacttagcctatcttcctctctccctctcctccctctctccctctctctctcccttcctccctttcctctctttttcttttgagacagggttttgctctgttgcccaggctggaatgcagtggtgatacaattatagctcactgcagccttgatctcctgggctcaaatgaccctcccacctcagcctcctgagtagctaggactaaaggtgcgccaccacacccgtctaactttttcatttggtgtagagacagggtctcagtatattgcccgagctggtcttgaactccagacctcaagtgatcctcctgcttcagcctcccaaagtgccaggattacaggtgtgaaccactgtacctggctttccttctttcttttttgtttctgttataagtaatgatgcagtgaacatttttttttcaaggtagttttccatcccttagattatgtctgtagggagattttccaaaagtagcattaacatcgaagagtttatcacttttgattccttttttttttggcctataattaaactcagttgaattgatttgattttttccaaagtggttgcactagtttcaatgctgctagtaagaataagggctctggtggaagcagaggttggccagaaatttggggttcaacattcagcaaacattggatgatagtttggtgcatcctctatcacttatcaaaaggttgttaccactggggtctgttgaagcaaaaggatgttgttgggaccgtgctgagtgtgttagccagggctcttttcagtggaatgtggcagaagctgatgaaactgatttcaacagcatgggaatatatggtgtcttgtaatggaaaagtctagacatagggctggcttcaagcttagctggatccacgtgttaaaggactatcaggattatctttctgtctggctgtcaactcgtcttttctctctgttggcttcacccacaggcagccgctcctccatggagcgggctggccatgtggtcatcctgcaacccatcactgtgattttggttggccaggtctggaccataagtctagtctggagcctgtggctgggagtccatcctactaaattgtctggatggaggatgaacttcaggggaagggctgctgtaattttggatggggtggttaggaatgtgatgtggcagcagaggcttcctgaggcaggtggctcctaggttttcttcctgagcagctgaaaggggttggaattgccttatctttttttttttttttttgagatagagtcttgctctgtcacccaggctggactgtagtggcgtgatcttggctcactgcaacctctgtctcccatgttcaagtgattctcccgcctcgagcgccaccatgcctggctcattattgtatttttcgtagagatggggtttcaccatgttggctagactggtctcgaactcctgacctcaggtgattcactgacctcgggctcccagcgtgctgggatgacaggtgtgagacactgtacctgaccagaattgccttttcctgaggtgggagagccagtaggggagcaggttaggtgggggctgagcagtttgaatcctgcaaggggagtgaggactcttttccttgccctgactttttgctgtccgggagcccttcagagacctggcactagtgtttcctctgctcacccaggcagtaccccgcttcctccgaggagggaaacttgcccactccatctcatttttcttcgcttgcatctgtgtttcttggaatctgctctttcctcctacaacttaaaaaaaaaaaaaaaaagcgaaaacccaaaatgacattaaaaactattgtgaaaacagaatatacctttaaatatacattcctggcacatttaatatttaaatttgtaggtattcctcttctgcctttgttcaaagcatacactatatatgcattttgcataattgcattgtatctccgtttgagcgtttctgcttacatgatagcacttatccacgttccttctcttcacgattctttgaaaaggcagcatagcattccaccaaattgatgtaccgcagctatttaacctctctcccattgcaaaagacagtcaattccatttatggtgttctaggataggattggtaggcgtttcctgtgaagggccagatagtaaatattttctactttgtgggccatctggtctcagcctcaagtattcatttctgctgtcgtagtttgaaggcagccacagaccatgggtaagtgaaaggacgtggctgtgttccaataaaactttatttagaaaaagtcagcagctggatttggctcgggggctatagttgactgacccctacactaggacactgcaatacaaatcttcgtgcccattgatgctcaggaagtcattgtgttattacggaaaagcttcggatacagacaagttctggatttaactccctattgaagaagttgggcagttttttgttttctgtcttatttttttgagacaaggtctcactctgtcacccaggctggagtgcagtggtgcagtcatagctcactgcagcctcaacctcctgggctcaagtgatccttcctcctcagctccccaggaggctgggactacaggtgtgtgccaccatacctggctaatttttttttttaaattttcatagagacgaggccttactatgttgcctagggtggtcttgaagtcctgagcccaagcagccctcccaccttggtgtcccaaagtgctggagttacaagcgtgagccactgcacccggcctgggcagatttttgaacttctctgacttttactcttttttttttttttttttgagacagagtctcactctgtcacccaggctggagtgcagcggtgtgatcactgcaacctccacctcctgggttcgagtaattctcctgccttagactcccgagtagctgggactacaggtgcgtgccaccacgcccagctaatttttgtattattagtaaagacggggtttcaccatgttggccaggctggtcttaaactcctggccttgtgatctgtctgtcttggcttcccaaagtgctgggattacaggcgtgagccagcatgcctgattctgactcttactcttaattcccttttcagaaaatggaaattaaagcaagtaatgaatgtatagtgcgtttctcaggacctggaacatagaggaccaggtgaaattgttatttgtatcttttctcatttcccctgttcctttttagcttaatttccaaggtgtgaaaagggattttgatttatttttgtagcttttgatatgcattgccacatcgcttttcagaacttactgcacccatagattgttaccagtggtgtgtacttgatttatcatagctttaccagcattggggaatttcactttaaatgtttcttggaggctgggtacggtggctcatgcctgtaatcccagcactttgggaggctgaggcaggtggatcacctgaggtcaggagtttgagaccagcctgaacaacatggtgaaaccacacctctactaaaaatacaaaaattagctgggtgtggtggcgggtgcctgtaatcccagctactcaggaggctgaggcaggagaatcacttgaacccgggaggcagagattgcagtgagccaagatcatgccactgcactccagcctgggcgacagagtgcgactccatctcaaaaaaaaaaaaaaaaagtttattggttaatttgtagttacataatggtgccatgtggtagttattaataggcatataatttgcatttctccaaccaggagggaagatattctttcttttttgagataggattttgctgtgtcactcaggttggagtgcaatggtgtcatcagtgctcactgcagccttgacctataggctcaagtgatcctcacacctcagcctccctcatagcttggactacaggtgtgtgccaccacacacggctaatttttaaaaaactttttgtagggacggggtgtcactgtattgcccaggctggtctcaaactcctaggctcaagcaattcccttgtctctacctcccaaaatgccaagactacgggtgtgagccaccatgcttggcctattgtctctttaaagtttttgtacattgccatgctagtgttttttttttattttgttttctacagcaagaactggtgaactgggttggcctcctgttttgcaaataaagttttattggaacaaagccatttctattcaattactgttatctatggttgctttcaggctgcaatggcagaattgagtaactgtgacagagagtgtatggcctgcaaagcctaaaatatttactgttttgctctttacaggaaatacttgccaatccctgctctagagtaatttttttttttgagatggagtcacactctgtcgcccaggctggagtgtagtggtgtaatctcagcttattgcaaccttaacccctttgggttcaagcgattttcctgcctcagcctctcagtagctgggattacgggtgggtgccatcatgcctggctaatttttgtattttcggtagaaacggggtttcaccatgttgttcaggctggtcttgaactcctgacctcaagtgatctgcctgccttggcctcccaaagtgctgggattacagacgtgagccatgatgcccggcctgctctagagtaaattgatggtccccattctttgctcatttattttgtctttgatcttagacaccataagcccacatggatggcccgagcccatctgtctgcatgcagagcctgtctctttccattgtgtgctggcagacagtctgtccttttgtcctgggccagctgtgccacttcaccctacaatactgggagacagcgccctgactttgggggagaacgattgtccattttatctgtgcgtatgctaagtctagagcagataaaaccaccaccgcactctgcccatgacaggaatgaggcagccgttgtgccctggccagttctggtcctttttatttaaagtagcaacttggggagccacagaagtgagctgcaccagaatctagattcaacaactgttgagttccttctgtgatgggagagagttcgtgaggcttctgtctatgtccgagagctcacaatgcataatccctcccacgatggggattacatcagcgctatggcaggactgcagggccatgggagcactgtgtagagggacagcagtgtgtcccttgggggaccctctgcaggaaggcttctctgagaagggaacgtttgagtcagccatcgggaggctgttttttctttggcagcactttgatgatgtagccctttttctgtgctaagattgagccattcaaggagtgagcctggttttgtggaggttgaagtgtacaaggtttggggtaaaatgtcaggtctgtcacctctgagctgttccttgggtaaatgatcaatgtctccaagtctcagttcctttgtttgtttcaccagggcggccagcccccaccttccaggtagatgtgagggttaaacgtatgtctcagtatggcggattggtggcgggcctggccccaggtgtgttgtgtttgtttcatgtcgagttggctggaacattgttctcacaagagtataattaggtgccaactaactgacataaaaaagctgggttttcagcctctcttgaaaaaccaggagatggggcaattgctggtattgctgtgaggtactgtctgctagagctggctagcagctgccatcttgagaggggcacctgctctgttcttgcaatctgtgccttgccagcccaacccgctcatttccatgcctcacctgaccccttgggcactgcgggggtccctcctggtcttgtatgtgccccgggcatatattgggcagccctttctgcccccctcctcctttgcttctgctttctttcagtttctttatttggaatggttgtggattttggggggtgggatgggagttaaacaatagcagcaacactaaagtcatcattgggctggtagcgccgggcatcccagatgcccgccagtgtaactgagaatgaattctgcagtgacaacaggttgatgatgtccttgttccctgcaagactctgtatgtggggccttggttagagggcaagggaagatgggagcatgattatgatgcgggcctggtctacagcctgctggggaactctcacgtttaaccatctaaccgcacggtggctgtaaggtctacaaactccgacactattgttttaatttttaacctgccagccttcattatttctgccagggcagtgggctgttaaatccagcccaagacctgttcgttacatattatctatggctgttgttcacactgcagtggcagagttgggtagtgacagcaaccctttggcccacaaagcctaaaatattgactgcgggactctttccagagaaagtttgctgacccccattctagggtatgctaaaggtgtaggttcagtgaaaatcagaaacaaatcatgtgaggcagcccgccacagatgcacacgcagggcttagagaaatgctgtgttcattgcagttttgcagggcacattggatgaatcacataacatcattgtgtgtatcctgtaatactagtaagtcatttattgtgtattcatctgcccttcccgatgctctagccactgcatagataattcagtgcagggtaaaggaaatgagagcaaaagggccagagctaggaacagcaactgaggcaggggtggctgtcacagagggcctttgccgtgagacttgccgtctcatgaaggaagagccatgccaggcagggggagacaggggtgcaggaggggcccgtggaagcaaggcatggtttctattacatttattcattttattttataaaaatataaatatatgtaaatttatttatttattttttatttcattttattttattttgagatggagtctcactctgtcgcccaggctggagtgcagcggtgtgatctcggctcactgcaacctccgcctcccaggttcaagtgattctcctgcctcagcctcccaattagctgagattacaggtgcatgccaccacctgaggctaatcttttttttttttttttttttccagtagagatggggtttcacacgttggccaggctggtctcaaactcctgacctcaagtgatccacccactttggcctcccaaagtgctgggattacaggcatgagccacctcacccagctgggagtagcttttctattgtgtgattcaatatggggactgggttctccatgcagttgccttgtctagcccttgggagaatcctactgtagttgttccttagaataggaacattttctcagccaacatctacctgttgcagtccttctcataaaaatattgggccaagagtggtagctcacacctgtaacctcagcacattgagggactgaggcaggaggatcatttgaggccaggagtttgagaccagcccaggcaacatagcgagaccctgtctttacaaaacgtacaaaattagcccagtgtggtggtgcatgcctgtagtcccagctacttgggaggctgaggtgggaggactgcttgagccctggagttggaggctgcagtgagctatgatcatgccactgtacttcagcctggttgacagagccagactccatctcttaaatttttttttttaattgaggtgaaattcacaaaacaaagaattaactgttgttctaaagcaagcagttcaggggcatttagtacagttgcattgttgagcaatcagccctctatctagtttcaaaacattttcatcacccaaaggaaactccatatccattaagcagtagctccccatccccctaccaccccagcccctggcaaccacctgtctgccttctgtctctatgaatttacctgttctgtccttcccagttttgcaagcacggctcaggttcccaattgttcagtgagcttgccctggtccccaccaggatgacagtgtggtgtgtggaaggaacacttgcctgagagttagggagagcagggctcagcctccaatgcagcacctgcttgactgtgtgcccttgggcagaattcctcgcacacagtgggcactcaaagagcattgccttctttttcttttctcgcttgtacctgcttaatgtgttacaaggatctcaccagggaaatgtctagcatgacgtcacctccaccgctgcatggagagacagcgaaataccactatttaaatatctgcagggctgggcgtgggggctcacgcctgcaatcccagcacttcaggaggctgaggtgggtggatcacctgaggtcaggagttcgagaccagcctgaccaacatggcgaaaccccatctctactaaaaatacaaaaaaaattagccaagcgtggtggtgggcacccgtaatcccagctactcaggaggctgaggtaggagaattgcttgaacatgggaggtggaggccttagtgagaagagatggcgccaccgtactccagcttgggcaacaaagtgagactctgtctcataaataaataaataaataaataaataaataaatatctgtgtggccttgattaaggggcttgacctctgtggaatgggaaccagtttacctggagctccagggttgcgagggttaaagaaggaatatagccggagtgcctggttgcctcctgcttgttttctcctccccacgtgccaggggtcctctttcaccctttcatctcccagggcagcaaacacagaggcttggattgaattgctttgcctgggctttggagagaaggtagctagttgaaaggacttctgggagccagaggtcttgataccttggggtaagggttgccaacaatgatgataatgatagctaattttattaaatgcttggtatataccaggcactgttctaggtgcacaatacaatttccctcattttatcgtccgaagaggtaggttctatgatgagcctgaaggagggaggttaagtaacttgctcatgatcacatggctggtggagtaggattctaacccacactatcctgttcttaatttctgctctttctctccaggaggtcactgtagcttgaatggtgaccccaggcagaaggctagagatttgtggtaaaaattaatgtaggatccaaaggactctaaacattaaacattagatcctgagagttctaaacattgaagacaaaggccgggcgcggtggctcatgcctgtaatcccaacactttggaaggccaaggcaggcagatcacctgaggtcaggagtttgagagcagcctggccaacatggtgaaatcccgtctctactaaaaatacaaaaattagctgggcatggtagcaggagcctgtaatctcagctacttgggaggctgaggcaggataatcgcttgaacccaggaggcagaggttgcagtgagctgagatcgcgccattgcactccagcctgggtgacaagagcaagactccgtctacaaacaaacaacaacaacaaaacattaaagagagacccaactaggtgactgactttcccgtgcacatgaggattctgagtagagttagggagtgtcagctgactgcatttctcagacaggtttgtggacccctggaggtattcccttgggtgcctttccattttctgttttcattttgatggtgatctaaatgagaaataaaaagaagcctgttcttgttcacctggttgactgctggctgggggctgcccctggagatgaggaagcaggaacatggggtttgatcgctcctgtgtggcaaagtgtttgctgaatttgcactgggccactgctgcaggttgtgatggaggtcgagggtgagcagggcttagcagctggcagctccaggatcccatggacttggaaatgtatccctcctcggccacttcccatgagtctagccctgggtaaaggtcttttcctctctgagtcacagtgttctctactgaatggaaccacttttccttctttgtcaaggattaaataggtcatttaatgacttagcctgtggttgggattcggtaggtgggcacattgttcctacttctctctgagtggcggcaacatttgaagctggcagattcttctgggccctggcggaggtgctgtactctccactggattcaaagggagaaggtaagaaggagactggtagcattgattgctctgcctgcctgtctctgcagagtctccatagactgtagagctggaagggcatgatctcatgcagaaaccagtggccagacaagggaagtgactgtccctgtcacatggctagcaagcaggccaggcaggatgagagctcaggccttgtgacttcccgttcagtgctctccactgttcctctcagttgataagtggtcctgagaccacctgtgctccttgcagcctagtaaacccccttctctcttatttatttatttttgagacactctcactctgttgcccaggctggagtgcattggtgcaatcttggctcactgtaacctccgtctcccaggttcaagcgattctcctgcctcagccttctgagtagctgggactacaggcgcccgtcaccacacctggctaatttttgtatttttagtagagacggggttttgccatgttggccaggctggtcttgaactcctgacctcatgtgatccgtccgctttggccccccaaagttgctgggattataggtgtgagccactgtgcctggctgacccctttctcttaagctcattcagggctaagttggccacagctgccccttctgaggtcaagattatctcacttgacagcttcttgcctgcagagagatcacagccaggaagtgtgagcctctgggttgagacctgcacaatctcgggtagtttttgtataaagaacaggtttttcttttcttccccccccaccccatcatgaaaagaggctttgcagagtaaggcagaggaggctgctgacatctcatccagaataatcagtagagcaaaatactcttaaaaaaaaaaaaaaaaaagacatcgaggatcattgtgcataccaggaagggtaggtgctaaacctttattattcaggtgtgaaaggagccggcagtgtcagctccactggaagcttacgagaaacacagagttggcagggcacggtggctcacacctgtaatcccagcactttgggaggccgaggtgggtggatcacgaggtcaggagtttaagaccagcctggccaacatggtgaaaccctgtctctactgaaaatacaaaaattagccgggcgtggtggtgcgtgcctgtaatcccagctttttgggaggctgaggcaggagaattgcttgaacctgggaggtggaggttgcagggagccgagactgggccactgcactccagcctgggtgacacagcaacactccgtctcagaaaaaaaaaaaaaagagttaggccccatcctcaacctcctgaaccagaacctcccttttgggctgggtgtggtggctcacacctattatcccagctgtttgggaggcagaggcaggaggatcgcttgagtctggggtgagaccccgtctgtataaaaaataaaaataaataaattatctgtgagtggtgccctgtgcctgtagtcccagctactcggagggctgaggcaggagagtcgattgaacccaggaggttgagactgtagaaagctatgattgtgccacttactctagcccatgtgatagagatcctgtctcagaaaaaaacgccaaaaaataaattgctgctttttaacaagatctccaggagatctgtgtggacattaaagtttgagaagcactgcattaaaaaattatcactagggagatgaaagagatttttattttctttgtacattttttcctgatttgttattattctatttttttcctgcatgaattgcttttatgatgagaaaaaaatagcaaaggcatttccagtgcggggaaccctgtcaagtttccagttggcattgctcaagggcaggtagagctgtcgggctcactcatacttggaaaaaggaagaaagcaagcctaactttttttctattctggtgttagggagggaagatcagaatccaaaccctggattctgaaacaaagagcgtttgattgatagacacaggtgtcaagaggtgttggaggaccttggccagatgggtctatagccatcctgagcgatgccttgagatgcctcatggctggtgggaatggtgcctaggctattcttgatcgaaacctcttccagaaaaaaatactaacggtactttttgaagagtcagttgttttattgtgtgtctcaaagaatctgctgactggtttcattaccaggcctgggggtaaggcaggatccttggtattgtggtcctaacacaggctttagaggtcttgagtcaggatcactgttccaccaattagtattcaaatttcaacagtctaacccctttatcatggcccacacgatcctatgtgactgacatctgcccgcctgtttgatctttccttccacttttttgctttttgctcaagccacagcaaacttccttctggtcctggaagaccagagccaagcttgtcctacctccgagcctctccccttgctgtttgctctgtctggaacactggcctgccctgtctttccatagctgttccttctcttcatagagggctcagctcaaatgtcacctgtgcagagaggccctcagtggctgccttggctaaagcagccttcttgcttcctccctatcccatcactgtgtttgttttgtcttcctagtgtgactctctaacactttttcattgattagtttacatttatactttttttttttttttgagatagggcctcactctgtcactcaggccagagtgcagtggcacgatctcagctcactgcagccattgcctcctgggttcaagtgatccttccacttctgcctcatgaacagctgggaccacaggtgtgtgccaccacgcccggctaattttttgtgtttttggtagatacagggcttcatcatgttgcccaggctggtctcaaactcctgatgtcaagcaatcttcctgcctcagccttccaaagtgctgggattacaggtgtgagccactgtacccggccttctagtaggattttagctccatgagaagatggatcttttacaccatttaactccggtgtcctcagctcttaaaacattgcctcacatacactagaagttaaataagtcctgggtggatcaacacacacaatcacttgacttccccgagcttcagctttcccatctgtgtttgggaacctggcttatagggtgaatgtgaagatgaagggagatgatgcatgcatagtgcttagcttggttcctggcatgtaggatgcgcccagcacacggtggtggttgttatcaaccagctggccctggcttgacctggaggaatcactgaccacctctgagataatgccctgctgctactctctggtgcagcccacgtagagttgcccaagacagaagcagcctgatggcaattcaacgcctgcagtgtggagcgtctgcccttagaaactgaatttcagtatcctttgaagtgaatgtgctctgtgtctggtgcatcatactccgggctttgtatcttgcttggagtcattgggcctcttgtggagatcaggtgtggctctaccaactgtctgcctggtgctttcaagtgctcttgccccagaccttcctaaatggaagttcagcatatgtcatgtgtgtcagttgggaatgcttttggatgcaagtaacagcccaatgtgcagtggtgtggacaaatagggttatttattttgtgagagttagcttgtttctagtcttggcttaccaactcagtgatatcagggctggtgtctttgtgattctctaggtctttctctcaggctcatgacttcgtggtggcaaaatgctactctggctccacccaacatgtttatgattaaggcatgaaggatggtggagggagtgatgctctgcatagctcttctttctatcagaaatgaatgactttcccagaactttgggagccacttctgctttcttctcattggccagactgcttaagttcaacctcagctgctgagaagaggagtaatcaggtttcacagcttggattgctgaaggtggcatgggaaaaggatgttggagatgatagtgagaacagccagtgagcagttcctgctgtactgggaaacttatattttattttaggctgctggttgacaactgggggcagttttgattcccaggggacatttggcattacatggagacatttttgttataactcaggggtttgtgtgtgctaatgccacgtagtgtgtagaggccatggatgcagctaaacatcttacaatgtcagtagtgccaagggttgagaaacctttagaccattctagacatgttcagatttggggaaaattagtttagctgttttcctttgatgcagtaacaggcaatagccaaacttcattgtaatgatacagattattgatacctagttgtgctactgattttgttaaagatcagtaggaaaggactgatctagttggggacagccgtgtccgagcgtcagagagaactaattaagcctcattgcattttaggatcacagaacaatgacaaaagacaatttctgctggagcgactgctggatgcagtgaaacaggtaagcagaaagcacacatttgcctttttggtcgagtaatagtgtcagataattaatgtaggtcatttcttccctataacatacacagactaactcccactttatacctgggaacagtgaagtgatctactcatttttcccaggaaatgatagagcagtgaacacggtcaaggttgggttggaggaagtcctgtgtcttgaattcccaaagccctctagaggaccccatccgtcagtgatgtcccttcaagaaaggcactgggccaggtgcagtggctcacgcctgtaatcctagcactttgggaggtcaaggtgaccggatcacttgaggtcaggagttccagactaacctggccaacatggtgaaaccctgtctctataaaaatacaaaaattagcagggtgtggtggcaggcacctgtaatcccagctacttgggaggctgaggcaggagaattgcttgaacctggtaggtggtagttgcagtgagctgagattgcgccactgcactccagcctgggcaacagagtgagactttgtgtcattaaaaaaaaaaaaagtcattgatgtgggtttcaaagtctcattgtctcatttccaagcagttgtgtttgagggcaactctgaggggtgcagaggtggtggtttggagttaggaccctcgagcacaagaaggctaggacaaggaggatggaggccacgcctgaggtcctctgctgctgcccccagctgtgtggacgctccaggtagctttgctgtgattgatgtgatgctgtttgtgatgcttgactccggctgggcttggaagtaagcttggatgtgagactggaatctgcttgccgcatgtaccagatgcatgctgctgttagctgtcactgatcacacctccactgtgtgccaggctctctgctaagcactttatatttaatccttctaacaacactgtgagattatagttcctacaattggtttcattttacggatgaagagactgaagctcagagggatccaacaacttgctcagggcgtcatagtaagaggcagagctaggatccaaatctaggaattctaggagcttgctttttggaaggggcagttgacggttataattatgtgtgtaattacactatagggaggtaagtattttaataggggtgtgtgttaaaatttttttttttattttctagagacaaggtcttgctgttgcctaggctagagcgcagtggtaccatcatagctcattgtaacctcaaactcctgggctcaagcaatcctcccaccttagcctcctaagtggctgggactacaggtgcatgccaccacatgtgccggggtgtacgttgagtattgaagtgagcccagagaatgcagtatctacgcaagccttgaggcattgtatggtaggaaggtcacaggcttttggctcagacgtagctggaattaaaggccagctttattacttctttagctctgtgtgtacagggacaactcgtgcaccctccctgagcagctctctgctcttctgtaactgggtcacttatctgtgtatggctgctgagggaattggattgttaaagtaggtaaagggcctggacagagcctggtcctctgttaacatggtaacatctggagcccatgttattagctggttctttctctgctgcagaaatggaaaatataataaggcgaagaggcaagttgaactactttaaaggtagcagttagagagaaataaagtggagcttatgcccagagctgctgctgtttttttttagatggagtctagctctgtcgcccgggctggagtacagtggtgcagtctcagctcactgcaacctctgtctcctgggctcaagtgattctgctgcctcagcctcatgagtagctgggactacaggtccgtgccatcacacccggctaatttttgtattttttagtagaggtggggtttcaccatgttggccaggctggtctcgaactcctgacctcgggtgatccgcccaactcggccgtcctaactgctgggattacagacgtgagccaccgcgcctagcctgctgttattattatcattattattattattgttattttgacggttaaagtgttgcatatgactttttttgcatgactttcaaaaataaactttattgatgtataatttacatataataaaatatagccatttaagtgtacagtttcatgtgttttgacaaatatgtcatttaaaattatatgtatatacacacacacatatacacatacacacacacagatacacacacacacattgtagtagttttgataataagtttaggaaccctgcaagcgtgctacccatagcagagatactatacctttaaaagaaaagacaagtaggccaggcacggtggctcacacctgtaatcccagtgctttgagaggttggggcaggaggatatcttgaggccaggggtgtgagaccagcctgggcaacatagtgagacccctgtctctacaaaaaataaaaaatatcagttggacctggtggcacgttcctgtaatcccagctacttgggagactgaggtgggagaattgcttgagcctaggtattcgagattaccatgagctatgatggcatcactccccttcagcctcggtgacagagagagaccctattttttttttttttaaagaaaattagaatagtggataatggtgatgattgcttaacattgtgaattgaaatttacacctaaagatggttaaaatggcaatgtttatgttatctatattttaattttactaattcaaaaagtagcctgcagggccgggcgcattggctcacgcctgtaatcccagcactttgggaggccaaggcggtcggatcacctgaggtcgggagttcaagaccagcctgaccaacatagagaaaccccatctctactaagaatacaaaaattagccgggcatagtggcacatgcctgtaatcccagctacttgggtatctgaggcaggagaatggcttgaacccgggaggcagaggttgtggtgagctgagatcgatattacactccagcctgggcaacaagagtgaaactccatctcaaaaaaaaaaaaaaaaaggagtagcctgcttctatttttcccaccctcagtaaattgtcattccgcacaaccagatgactcatatgaggcttgatttgtgctgttgtaacgtcatagccagtcatgacaactctggggctcgtccaaagggatccattcagcacaggcttatagaagttgtaattatcgcccgtgaagagctgtgtgtggtagacagtcagctgccgacaggcaggagcagcttcctggataatgcacagatggctgtgtgcttttgtttttctgttagcaatgttttcccacaaggcttgcttctgtacaagtgggagataagggtttcctttaagtggcagcttcaaggctggggtgcgcaccttcttaagtcttgtgctgatacccaggggacagggacgtcctcacttggcatgcagagcttctggtcccgtgtcccctccctgacccttaagccctgtgtaggctgttttatgacgttttgagtgtcccatcccaacagctgatctcagcagcttctttttctgtgcagtgccagatccgctttggagggagaaaggagattgcctcggattccgacagcaggtaaatatgtcacttctaaaaccgttgaccatcgaggttggaaaggcggcagaaggtggccggcttctaaaaccgttgaccatcgaggttggaaaggcggcagaaggcggctggcttctgggctctgcctctgcagccaagaggtgcagcgctgaaatttgactcaaccgtggactctgtgcggtgactgctcatctccaacactccacattttccataattctctttctaggaatctattctgagggaattattcgagatacctttccatataaagttattttcagggtaattaataattatgagaacttggatgcctaaatacccaagatttgggaaatggttaataaaatatagtgcattaatggggtggaatgttatatagccattaaaaatgatgtttatgtagaatttgttttcaacagaaaaatgcataggtagtgatttaaaaattacatatatagtaaaaaggcatatgttataacaagagcaggatccgaaattctatgcgtatggagtggtcctagctatgttagatagcacctctggccagaacacaccgaaacgtggcctgaggtagcagtaggggtaagaatactgggaatattgctttctagtatttttcacattttttattgtgatcatttgttccttttatgacaaaaataattcctaaaaatgggccgggtgcggtggctcatgccaataatcccagcactttgcaaggctgaggcaggtggatcacttgaggtcaggagttcgagaccaggctggccaacatggtgaaaccccgtctctactgaaaacacaaaaattagctgggtgtggtggtgcacacctgtagtcccagggtcttgggaggctgaggcaggagaatcgcttgaacccaggctaattttggggaaaattaagggtttaggaggtggaggttgcagtgagctgagatcgcgccactgtactccagcctgggtgacagagtgagacaggatgagactgtgtctcaaaaaataaaattcggctgggcgcagtggctcacgcctgtaatcccagcactttgggaggttgaggcgggtggatcacgaggtcaggagttcgagtccagcctggccaagatggtgaaaccccgtctctactaaaaatacaaaaaattagccaggcacggtggcgggtgcctgtaatcccagctacttgggagactgaggcaggagaattgcctaaatccaggaggcagaggttgcagtgagccgagattgcgccactgtactctagcctgggcgacagagcaagattccatctcaaaaaaaaaaaaaaattcctaaaaatggccattgacattcacgacccaggaaaggctgacatcattgcataagctgataacattggctggaaggagacacatagggcttggtaaaggtaggagacacataggcatccagtccttgctgcaaatgcgttgtgagctcagtcagagctgatccttgctctgtagcccctggggtggcaggagggacattcctgtgtgggaaggaaagggaagggaacttgcttgctcaatgttcatctcatcctggaaactgttcatgtcccccaccctctcaccctagcccaccctcctgtgtccatcgttcctctttctgtcctttcctacccttgttcttttgtagaattttaacagccatgagaaagcatgtagaccttcctggaatagagccacgtggatgatttgaaactggcacagatttaaaatgatgcaccctattatccattccttctttgcttaggttttctccattgcacgtattaccatccaacaaactatatatacattcggctttttaattttgcctattacctgtcactataatgtcggctctgtgcaggcagggatgatttgctgtcttgtttacagatgtttctctagtgcctagaagcatctagaaggtgctcagtaaaaatttgttatccggatgagcgtgtgtatcacattgtactgtagtcaagcatttaaatatgtgtgccaccacgaagcctgtaagatttgaaggcagaaagggtgtttctccatttatttttaaaattttacttctcagtgttgtacacaagcactttgtgcctgtcgtacattagattctcagtatatgtttgtggcattagatcattcgactgattgatcaatttagtccttcttgagggcctactatggggcctggccttggtccacacagggatccaaggtctgcttgcatcagaatcacctgggaggcttattgattaatgatcctgtgtctaagtcctgtcctagttgtactggagcaggatgtgtatatgtgcatgagtgtgtgtgtgtatgcctgaagccgaggagcttgctgagaatttgcatttcaacaggactcccaggtgattctgctggacaccaaagcttccagtgcaatcactgttccagggtctgggatgcaaaggtaattaggaaagactcctccttcctggccgggttggtttgtctgtgtgtatgggtgtgtgtgccgtgtgtgtgtctaagtatccatgacttcttgaccacttttcttcattaccatgctgtccacttcctgagagaggcaatcctgctctgaatgttgggttaatgtattcttacacgggtggagtatccctcatccaaaaacccgaaattcaaaatgctccaaaattcaaaactttttgagtaccagcatgatgctcaaaggaaatgctcatggaagccagttggattttggagttttggattaggcgtgcctaactgttaagtatataatgcaaatattccacagtcaggaaaaatctgaaatccgaaacatttctgatcctaagcattttggataaggaatactgaacctatataatagaatttactaccataacctttgttatagaaaatgttctattttatagtagaatttaaaaagttaattctttctgtgataactgttgtttatggctaaaaggagtacgtggcttactattactaataataggccaggcgctgtggctcatgtctgtaatctcattgctttgggaggctgaggtaggaggattgcttgaggccaggagttcaaggctgcggtgagctatgatcgtgccattgcattctagcttgggcaatagacagagaccctgtctctaaaataataataataataataataataatagccaggcatggtggctcacgcctgtaatcccagcactttgggaggctgaggcggaaggatcacctgaagtcgggagtttgagaccagcctgaccaacgtggagaaaccccgtctctacttaaaatacaaaattagccaggcatggtggcacatgcctgtaatcctagctaagcagggaggctgaggcaggagaagtgcttgaacccaggaggcggaggttttggtgagccgagattgcgccattgcgttccagcctgggcaacaagagcgatactgtctcagaaaaaaaaaaaaaaaaaagcaataataatagttatagtttgtgactacttttgctacattttatttatgttgattcctagtcctcagaaggagcagaagtattaccctttctttttttttttgagacagggtcttgctctgttgctcagcctggagtacagtggtgtgatcatggttcacatcagcctcaacctcccaggctcaagatcttcccatctcagcctcctgagtagctaagactacagatgcaagccaccatacctggctaatttttgtattttttgtagagatggggtctcactatgttgcccaggctggtctcaaacttgtggactcaagtgatcctcccaccttggccacccaaagtgttggtattacaggtatgagccacactgtgcctgggttatcccttttttactgatgagaaaacagattcagagaggcaaaatgccatagcctacgttagacgttttggaacggctagagttccatgacttgttctttctcccttgtgtgctatttagtgactaaatggtttttgaggctgagtttaaaaaaaaaaattattctcctctacctcagtgggattccttcttaatatcagagacctggtcttacctttgaaatgtatttgggtaaaggtggcaccaccttcatgttggaaaggccacatcattgtccctattctgtgagaaagttgaatctcggctggatgcagtggctcacgcctataatcccagccttttgggaggctgaggcaggcgaatcacttgaggtcaggagttcaagaccagcctggccaacatggcaaaaccccgtctctactaaaaatacaaaaattagccaggcgtggtggtgcccacctgtaatcccagctactcgggaggctgagacaggagaatcgcttgaacccaggaggcagaggttgcagtaagccgagatcacaccgttgcaatgcagcctgagtgagagagtaagactctctcaaaaaaataattaaaaagaagaagaaagttgaatctcaagagggaaagtcagcgaacatttaaaaataacttaggactgacaagatagatgagttgcctcccttcctcaccgctgatagctggcccggccctggagttgagctcaaatccactcacttccctccaactcctctcctggcccgcggtccccatcaccagcatctcacagcatggccgctgcagccttaggctcttcccattcgttcttgtcctgcttccaccacattgaatgcagaatgcagattccctcacctcatgctcccttgaaacctcccagctgccttgtctttgctcttgggagaaagacccacgtccttaacacagcctggaggcctcacatgccctgctctctgatccagccatctgccctttttctccttttgtttttaaagcttttcactactttttctttctttttttgagatggagtctcgctctgtcacccaggccggagtgcagtggcgctatctcggctccctgcaagctctgcctcccaggttcacgctgttctcctgcctcagcctcccatgtagctgggactacagacgcccgccaccatgcccagctaatttgtttgtatttttagtagagatggggtttcaccgtgttagccaggatagttttgatctcctgaccttgtgatccgcccgcctcggcctcccaaagtgctgggattacaggcgtgagccactgcgcctggcctgcttttcgctactttttcaaggaaatttttttttctttttttgagatggagtttcgctcttgttgcccaggctggactgcaatggcgcgatcttggctcaccgcaacctctgcctcctgggttcaagcgattctcttgcctcggccttccaggtagctgggattacaggtgtgtaccaccatgcctggctaattttgtatttttagtagagacagtatttctccatgttggtcaggctggacctgaactcccgacctcaggtgatcctcccgcctcggcctcccaaagtgctgggattacaggcatgagccaccgcacccggcctggatcatttttgacttacaaaaatgacagcttgttcaaaatagttaaaaacaatatgtttttcgtatgcctctcttttttaaaagagtgtgcagatatcaggctcagagccgtcctctggccatggcagagagtcaaaatttattacattaattgtatttagttttttttttttttttcttttttaacttgagatggagccttgctctgtcgcacaggctggagtacagtggcgcaatctcagttcactgcaacctccacctcccgggttcaagcgattctcttgactcagcctccctagtagctgggactataggtgcgcgcctccaggcctgggtaatttttgtatttttagtagagacggggtttcactatgttggtcaggctggtcttaaacacctgacctcaagtgatccacctgcctcagcctcccaaactggtgggattacaggcatgagccactgcgcccggcctatgtttagttttaaggctactgtttttatgtcatatgatgctagtttaccatttacaactgtgatggagctttccattttttaaattttaaaataatttttaaacaggtgtatgtaactgaacaaagtgagtcaaattcaagacaaataagtaaataatagtacatatccttacaccgaaaaaaagctgccaaggtgttggtggatgagtaatgtttcgagtagagacagtgctagcaggacagagcagaccattgctggatttgggagcctaaatggtgcaccgtattttgccaaaatacaaaatccaaggtggatgtgtgtgagcatgtttttgtatgtgtgtgtgggtatgtgtgtgagagatatatatatgtatacatgtatatatatatttttatatgtgtgtgtgtatatatgtgtgtgtgtgtgtgtgtgtatatatatatatgtatatttgatcttgtgagagacggacaccgtgagatgctgccatcttcacatggaacataaaacagtattgacattaggggaaatgcaggcgagacttgttttttccttcagatggagtcctgagaagcctccccaggaggaagtggtggcagccgctgggctctgaaatgcgcgcttctctttgttggtggtgttttctagctctgtttttctctaggaacaaagactcgttcttatggttcattgaaattattccatgttctttcagtcagactggcctgtgaagaagctttaagatatctttggaatattttgccctctagaaataatggcccaggagctttgtaggccctagaagttacctcaaagactagaaacgtgattgttccgccaaggcgtctttgtcccatacggaatcagaggacgtgatctggaagttttcccttcaaattatgaacaggaatgctaacgggggcagtggaatcagcatgggctttggagcttggcatttgaatcctgggtttgccagttctgggttgtgttgcgattttgggcaagtttctttcttgcacctcaatatcctcaactctgaaatgggtagtataatggtattcacttcagagggttgttatgagtcagttcatgtgcaacccttaaaacattgcctggcaggtagtaagtttccagtaattgttagctgttgtgattttcattataaggatatgtaaggtgttttgacacttggtagacatttaccacacactcacacactggatctctttgccatatgggtggcagtgagttggcttcaggtattcatctgcatttagaagttgttaattatggccaggtgcagtggcccgcacttgtaatctcaagccctttgagaggccaaggtgggaggatcacttgatcccaggagttcgagaccagcctggccaacatggcgaaaccccatgtctacaaaaaaaccaaaaattagctagccaggtgcggtggtgcaggcctgtggtctcagctactcaagaggctgaagcgggaggatcacttgagcctaggaggtcgaggctgcagtgagtcatcaacccgccattgcactctagcctgggcgatgtgagacctcgtctcaaaacaaacaaacaaacaaacaagaaattgctctttttaatgaactttcaggtgactgtcagaagaaatcataggagagcatttcttctcctttcaaagcatgcagaaaagaatgatttgttttggtgatttttttttttttaaccttttgaggaattagaatcagttttggacttttcaggaagctaaaaaccaaaaccagctgccctttgttgttcctgatgttattcttaatgcagttgaaaactgtcacgtgtatcccccagaggacttacgaaacggaatggctttttcaggcttttttttctcttttaaatatctctgaatgtttgtcatgtgatttttatgttccctgcatcacaagtttcttaccagcctctaactagtttgaggtgttgactggatgttacgattcttgtcatcctgaccaaaaatcctggggttcattaattggactctccccctcccttaccccaagtactttatttccactttgaggctctgtagtagacagtccatattgcatactcttttattttactgcttgattaaatgaattgcttggggtttttttttttttttttttgaaaaaagattatttctagcaatggggaacctccaggacgtttaacaaatctaagcccatttttatatctgatttttttttttttgagacaggatcgcactctgtcgcccaggctggagtgcagtggcgtgatcttggctcactgcaacctctgcctcccaggttctagcgattcttgtgcctcagcctccgagtagctgggattttaggggtgtgtcaccacacccagctaatttttgtgtttttagtagagacggggtttaaccatgttggccaggctgttctcaaactcctaacctcaggtgatccacccttcttggcctcccaaagtgctgggattataggcgtgagtcactatgcctggccctgaacctatttttatatctaaatttaaattaatatttgtcttacttatattgatagttgttgagaaatactgcctaggccataataaacattatgttagcaccgtcatcttcgtcatgaacctgacagtggagagaggtggtgagcatggggtgtgagctttggtgtcagatatacttaccttcatgcctccttcagccacaaatcaccagttaccagctgtgtaattttggactgacttagctcctttaaacctcgcatgcaccatctggaaaatcagataataataatgatactcacttgctagggttatagtcaggattagctgtaataatatttgcttggtacacccagttaaaacgtaataaactcaaaacttttttttgtatgactagacatacctgtgttttttgacaattactagtaactgaaggttggagggattgcctcattaattccttcattcaacaggtatttatttatagagtactatgttggcattggcgatgcaaattggatgagatggttgctgtcttcaagaaattcaaaactgaatctgggagttggacatgtaaattgtgggcaattatggtgacctgtaataaatattagttgtcatagggcgacagcagggttgttagcggtcaaataggtgggataggaattttaggcagagggaatagcagatgtgaaagtgcagggatgtggggcaaagtggtggggtgcatgaatgagtgttgtttggtttgggagatcagttggaaagtcagcaggttcttctctgctatcacagggaagtattggaatgccatcagttagggcagtatttcttttgtttattttttatttttgagacagagttttgcttttgttgtccaggctggagtacagtggtgcagtcttggctcactgcaacctccgcctcccacgttcaagtgattctcctgcctcagcctcccgagtagctgggactacaggcgcctgcccccatgcctggctaatgtttgtatttctcgtggagatgaggtttcaccatgttggccaggctggtcttaaactcctgacctcgtgatctgcccgcctcggcctcccaaagtgctgggattacaggcgtgagccaccgtgcctggcagggcattatttcttaaacttaggccattgtgtaccattttcaccatttttgccatttctatgttccatctgagccagaggttggcttgaggtggaattccaaggcactgtctactctggtctggtgctggttatattttttcctgacacacataaatgtttatctgggtttccctaaaatcgtgtcatgtactgtgtacctacagcgtagtatggtaccaattgggaaaaaagaaagaaaatgacaaagtcacatttgcatttcaggtagatagcttctgcccaggatgcatgggttggggtgggtggaggagtggaggtgggtggggtgagatggaatctgggagaaccggggttggagggcagagtgaagcagggactggggaagagacagaaggattgaggtttgggactgagccttgatgagattcagtgattacccagatgtggaggttgagaaataatgtcatggctctaccatgga

SEQ ID NO: 36 - DNA, 150525 bp, Homo sapiens
ttcgccatgttgcccaggctggtctcaaactcctggtctcaagtgatccgcctgcttcagcctccgaaaatgctgggattacaggtgtgagccaccacgcctggccataatttagtattttaaaagctctttttcatcacaagatcagaaaaatattcaacttgttttgtctcattttatgaattcctgtctaagctgattaaattattttagctgattaaattattttagaagactggacggatcaactattaacaaaactcgtgacatgccacttaacatctttagaccccaggtccacgtgcaaaatgaaacaactgttacagtttatttctggctctaatacttttttattccaaatctgtttgtagagagctaaggaacaagagagaagaaaaggggaggagggagagaggcagcaagaaagtgacatttagaagcctcaaaaccctcagaggaaaaaaaacacaggtgaaccaatagttagtagagacaagagtctgcagtcaaagtcccaataaactgggctttctccctgttcctaaacagcagatcactagttcttccctcttggtatccagtcccccttagctgctgtcagaacatctcctaacagaaaaaaatgttccacacactctttctcaataaattctgtcccacttattttcaatgacatgagaagtaattttcaagtggctcaaaagataaattaattcaaaaccaccctaatagaggaaagaaaatacagggcaactgtgcaagtatgcaaaaaaagaaaaagaaaaagaaaaaaaaagtcctatatagaaggggttggcaaactttttctgcaaatgcccagacagtacatgttttaggctccatgggccatatggtctctgtcaaaactaccatatgttgcaaaagcagccacagataatacataaacaaatgagtgtggctgtgttccaataaagctttatttgcaaaaaaataaaataaaataaaataaaataaaaggacagcaggccagattgggcccacaaggccatcatttgccaacccctgctacaaattacagttcacaagccacttgcagagctttcaagcagaccttcccggagtcattaccgcatattgctcctgtgttcctggatatgacagcggtgacctaagaagaagaaacaaattaactgtaattatcaagctccttatcgggacctgttcagccagaagtcatcttaaatctgtggttccattagcttgccactggttcaaggcatatttcaaagacttcctcctcctttactaccattattcacagatgactacagttatgggaaaaaaaatacatatacatatatatatatatatatatatactattccttagtattttttaagtacaacactttactttcaaacctacttctattttttaaaaaccctaattcttcaactgccaaaaaagaggttaaaaatagtacagagccactaacaatatttgatccaatttactgcagtatagagagaatgtctccttcccaggaaggaacaaagaggcccttctgcccggacatgtccatccaaaccacagctgtctcatcattgacatgcttcaagaagtccaattaaacactgagcttctgaacagacacgtctgatcacagaagccctctgtgccgccagatgttcattttcagtcactttccactcagcagcactgttcatagaacaaattcaaatttctcagtctaacgttttgggggagactaacaattgtagccctaaaagccagcaaaagtaacacttgcttccgaatgcaagaatgttcaaatggacaaaagaaaaaaatattgctagaatatggagtttctaacccaaattaactggacctattaaacatgactaaagagttcttcctctccacaaaacatacatccacaccaaagaattaggacgcggcaagaacacaagaactctgaagctcttactgtataaactgcagtccttccttaatgttctgctgcctttttcttctctcctcggacacattggacatgttatcccacacatccactttctaaatgagcaatctggaaagaaacaaggcaaaaaagcacataaggtaccagggtccctggactccaatgaaaacacccacaaatccagaccttgtcacacaatcagctgtggacacatccatttctgacttgactccagggtcctggacggcagggaccgtacaggagtcatctttgtggctcccctgtggtccggcacaccataagcacaccgttttcatattctttttttttttttttttttttttgagacggagtctcgctccattgcccaggctggagtgcagtggcgcgatctcgcgatctcggctcactgcaaacttcacctccagggttcaagcaattctcctgtctcagcctcctgagtggctgggactcagatgcctgcgaccacgcctggctaatttttgtatttttaggagagacagggtttcaccttactggtcaagctggtctcgaactcgtgacctcaagtgatccacctacctcggcctcccaaagtgtgggattataggtgtgagccacagcgcctggccagttttcacattctttaaggctgaatggctatgcagactttgtatacccctcctgagcagtctccaggaaaaagtcatgtctccccttcctttcctcttccctcctttggcttcaggttttgtttttccctgtctacacgcacgcataagctgtccctagaacagttccagccttgttttgcttctggaagctctccagaaataaaaaggtttcacatccgcttgcctccgagggagtctgacttccttgtaagccaagtttaaaccttatacatattttgtcccacaaacttccaaaatgattattgttgatacaacagataaaataatgatataaagttacttccattggaattttctggatattaaaatgttatcctcaatataacacttgcaaatgtcaacacatatcattcttttgggccccacctccactaatcaacgttcaccgagcagttccccaagttcaaggagagccacagagaagagatctgagataaaacatcatctcccagtggcccaaactagagttcctcaggcttggcattctgggctagctaattccttgtcttgtgattgcaggacattggcagtatttctgcctctacccactatgcctgtagcccctcaccccaaccccactcacaaccaaaagtgtctccagatatcgttaaatgtcagggtggggaaagcacaatcagccccagttgagaacaactgagacctaaagttaagacaacatcttacacataaaccacgtatttggacccaggtgacaggaagggaaattccactcatgtttgaagtacattgctgaaattttttagtttcattattgcttggcatttacagttttatttttaaatctcatttttttcaaagtataagggtgagatgggggttggaatgtcccaaatgctgataactggtgctaaaccctttcttctttgaaacaccgtcagttctcaatatttttgtcctataaagttggtactttactgaagtgtttacatgggaaaggatatgacataggggacttgctttaaaatactccagtaacaacaaaaaaggggggggctgtgaggtggggaggaaacagcagaatgctgataaccaggggagggtgagaagtgcaggggattcttcagtactattctctggactttgtatgtgtttgaaacattacaaaataagaagtttaagaagtccatgacactagagtaaaatggcactatttctggaatgtgcttttaaaacagtttagccaaaaggggggtagctgggtggaaataaaacaagaatgccaaaaatatggataatggttccagctggatgaggggcatggaagctcattccacccttctagctacttggacatgttggcccatgtccttaatagaaatgcttttttaaaaaaatttatatatttttttaatttataaatgttttctaaaaatttatatgtacaaaataatttaaggaagcactatttgtaaaagaaaaagattttttaaattaactcaggccactcatggtagctcacacctgtaatcccagcactttgggaggcaaaggcaggaagatcacttgagcctaggagttcaagaccaacctgggcaacacagggagaccccctatctctacaaaaaattttaaaagaggccgggcgcagtggctcgcgcctgtaatccagcactttgagaggccgaggcgagtggatcacccaaggtcaggagttccagagcagcctgaccaatatggagaaaccccacctctactgaaaatacaaaattagctgggcatggtggtgcatgcctgtaatcccagctatttgggaggctgaggcaggagaatcacttgaacctgggaggcggaggttgcagtgagccaagatcacgtcattgcactccagcctgggcaacaagagtgacactccatctcaaaaaaaaaaaaaaaaaaaattggcagggcatggtggctcatgcctgtaatcccagcactttgggaggctgaggtgggcagatcacctgaggtcaggagttccagaccagcctggccaacatggggaaaccccatctctactaaaaatacagaattagccgggcgtggtggcacatgcctataatcccagctactacggaggctggggcaggagaatcgcttcaacccgggaggcggaggttgcagtgagccgagatggtgccactgcactccagcctgagcaacaagagtgaaattccatctcaaaataaataaataaacaaaaataacaaagattagccaggcatggtggcatgcacctgtagtcccagctactcaggaggctgagttgggaggactgatagagcctgtgaggtcgaggttgcagtgagctacaatcatgccagtgcactccagcctgggtgacagagtgagaccttgcctcgaaaaaataaaaaaaaaagcaaccgggtgtggtggtgcgtaccagtagtcccagctactcagatgatggaggcaggaggatggcttgaacccatgaggtcagggctgtagtgagctacgattgtgccactgcactcccgcctgggcaagagagtgagaccctgtctcaaaaataatatttttttaaaaaaactaacccagtgtctatcaaaaaggaaatgcctgaagaaattataggaaaaaaaaaaaagatgaggcatttaagtatccatatgacccattttgttttgttttgttttttgagacagagtctcacttgtcacgcaggctggagtgcagtggcacgatctctgctcactgcaacctccgcctcccggcatcacaccattctcctgcctcagcctcccgagtagctgggactacaggcgcccgccaccacgcccggctacttttttgtatttttagtagagatagggtttcaccgcgttagccaggatggtctcgatctcctgacctcatgatctgctcacctaggcctcccaaagtgctgggattacaggcgtgagccaccgcgcctggccgttttgtgtttttttaaagtgacgggtaggtatatatattgacatatgcttgtgtaaacataaaatagtcccagatggaatcatgggagactacagcagtagtagaagactgaggctggaaaaggggtaggacgaggtcttttcaatctatgtgttcaaaacttttgttttatttggagccacgtaaatgaattacctctgtacaaaaattaaacaaatttttaaagtttatgtatcctctgagcccttccttggaaagatgacttaagggaccaccgggcttttgtttgttttagctaaaacagggcaatttacttagagttcgaactttagagttcagaggaacccagagtagtatgcaggatgccagagcagtcaggccagagggagggaacaaaagaaaaggatgtctgaaaccaggacgatggccacacagttcagtgaatgatgtacctttctctcagcctctatctagccaaggtagggaattggtttgaggttgactcaaaaagttaatctgctggctaagaatggactcctgggtagtgatatctgccaagtttatagccttaaagctattttccccagaaagtgttagagaaccttgaacctcaaccttatacacaaaaggcgtgtggcaaagagctgacaccacaagtaagtgattgaaaggaaacggaaaatggatacagacgtttttaatgcacaaaatacacccctttagctgtttatagatctaggatcacaatatcaggcaatatttgaatataatatgacagagtatttcatgttcagtagttttttaagtttccccaaaaacttttattttgaaagttctcaaacacacagtaaagttaaaaacaattataatactgtatgcccaaacccacaattaatattttgtgagatcacatctgcccatctttatctatctgctcatccttctgttcattcatcagtccgtcttactgttttaataaatttcaaagtcagctgcagatacctaaacatctcagcacacacacaattaagtagagatcaatatttgtttacagttttgttttttaaggtaaaacacgcaaatcttaatgtgagttttgacaaactcatgtgacccagagccctatcaggatatagatcagcaccttgggaggccaaggcaggaggatcatttgagcccaggagtatgaaaccagcctgggcaagatggagagaccccatctctacaaaaaattaagccaggtgtggtggtacgtgcctgtagtcctagctactcaggaggctaaggcaagaggactgattaagcccaggagttggaggctgcagtgagctgctgaccgcgccactacaacccaacctgggcaacagaacaagatcttgtctcttaaataaagaaaagatatagaccattaactgtcactctacaaagttccttcatgccccttccccaaaccactactgtaatttcttttttcctcaccattgattagttttacctgtgaaataatctccccccaacacacacccctttgtgtgtgtgtttttgttttgttttgtttttgacacaaggtcttaccctgtcatccaggctagagtacagtggtgtgatcacagctcattgcaaccttaaacttccggtctcaagcgatcctccctcatcagcctcctgagtagctgagactacaagtgtgccaccatgctcagctaatttttttaatttcacagggattaaaagcacagggactggccaggcacagtggctcacgtctgtaatcccagcactttgggaggccgaggcgggcagatcacctgaggtcaggagttcgagaccagcctggccaacgtggtgaaaccccgtctctactaaaaatacaaacattagccgggcatggtggcaggtgcctgtaatcccagctactcggaaggctgaggcaggagaatcgtttgaacccaggaggcagaggttgcactgagccaagatcgcgtcattgcactccagcctgggggacaagagcaagacttcgtttccaaagaaaaaaaaaaaagcacagggattacaggtgtgagccccctcgtccagccccatactcctttttttaaagaaagaaaaagacgtttaaaaatatactatcttatttttggatactgttaaaatctagcctcaattttaaagaaagaaagaattttacaaagttaacccaacagtctcttttcttactcagtctcagcagcactccctcccaggggcccctcccttcaacttccacctcacagcctgggctaggtctgtccccacctcacaggccactctgtctcctgcaagctgaggctccatctccacagacctctcaccttgagagccctgaggacccactcttgagatctccccgagccatactctcccatagaggtcctccctccatcagatgtcaaatgccctcatctagggccccatgacaactctcacgtccatccccaggcagaccctctggcctgtttgacagttccatttgaatttctcacagacatcctaaactgttcattttaacatgacagtgaaaaggaatgtctccttcccatcctatcacttagccacccatttgcccttccgcccgtttgccctcctggagggccaccaaccactgttaccagtctcagaaaagtccagacaaatatattgctttcttttttttctttctttttttttttttttgagacgcagtctccctctgttgcccaggctggagtgtagtggcgtgatctcggctcaatacaacctccgcctcctgggttcaagcgattatcctgcctcagccgccccagtatctggggttacaggtacgcaccagcacacccagctaatttttgtatttttagtagagatggggtttcaccatgttggtcaggctggtctcgaactcctgacctcgtgatctgcctgcctcagcctcccaaagtgctgggattacaggcgtgagccaccacgctcggcctcacaaagatattctatagaacgattctgtatcttgattgtgggagtggttacatgaatttatgcatgggataaaactgcataatactacacacacacacatacacacacaggcacgcacaaccacacacacacaagtgctgcttaaaacccagtgaggcccatagtttggttaacagtattatactaatgtcaatttcctggttgtgacagtgtgctacagttatatgtcaccattgaaggaagagggggtgaagggttcatgggactccatgtactacttttgaaacttcctgtgagtctataattatttcaaaataaaaaggtaaaagtattctgtgtatatgtttgtttgtttttattttttttttgagacaaactctcgctctgtcacccaggctggagtgcaatggcacaatctccagcctccgcttcctgggttcaagcaattctactgcctcagcctcccaagtagctgggattacaggcgcacgtcaccaggcctggctaatttttgtatttttgtagagatggggtttcaccatgttggccaggctggtcttgaactcctgacctcaggtgatcggcctgccttggcctcccaaagtgctggaataacaggcatgagccactgcgcccggccgtgcatatgttcttttttattcaaactggagctaccagtgagttctgtaccccactgtctttatgtagtatctaatcagtgtgttcgttttcaaaacacacagcgttccatgatatggttgtaccataattttaccaggcctctggtgatggaccttctggttgtttccaatctttaaaggtcaccatgtacacagggcatttcatacacatctaagtatccctttaaagaacttttataggataggccagccatggtggctcacacctgtaatcccagcactttgggaggccgaggcaggcagatcacttgaagtcaggagttccagaccagcccagccaacatggtgaaaccccatctctactaaaaatacaaaaattaaccgggtgtggaggcatacacctgtaatcccagctactcgagacgctaaggcaggagaatagctagaacccgggaggtgcaggctgcagcgagcaaagatcatgccactgcattccacctgaaccacagagtgagactccatctcaaaaaaaaaaaaaaaaaaaaaaagaatttctaaaggataaagggcatatgtatttgtttattttgccagctattgacacaatacaccaaatgattctcccaccaacaatgcagaggattcctggttccccacttcacccaggcatcaaatgtgtgcatccttgtgaaccaaaaaagtgagaaacagtgtggcaatgtgatgaggccatgtttgttttaatctatcattagcaaggctcagcgtcctttcaaatttaagaatcatctgtacttccttgtctgtgaattgtttgctcataccctctgctcatttttcttccaggctgagctttacttatttatggaagctctttatatgttgaggaaaatagtcctttctgatgttattggtattttttccaatttgatgtcaatcttttgactttggttatttttgacagcaaaggtgttgttgtcgtcgtcgttattattgttgtttgagacggagtttcactcttattgcccaggctggagtgcaatggcacgatctcggctcattgcaacctccgcctcccaggttcaagcgattcttctgcctcagcctcccgagtagctgtgattacaggcacacgccaaaacgcccggctaattttgtatttttagtagagatgaggtttcttcatgttggtccagctggtcttgaactcccgacctcaggtgatctgcccacctcggtctctcccaggaggcagaggttgcagtgagccaagattgcgccactgcactccagcctgggccacagagcaacattctgcctcaaaaataaatagataaataaaacaagtaaaaaataaaaataaaaatcagcccagactggtggcacctgcttgtatgtagtctcagctactcagaggctaagggaggaagatcgcttaagcccaggtcttcaaggctcagcaagctataatcacaccactgcactccagcctggggtacagagcaagaccctgtctctaaaataaatttttaaaacacacacacacacacacacacacacacacacacacacacacatcccaatgcttgcactctgcttaagacccttcagcagttgcttgggacgctggatgaagccttgcctccgtacggtgacctagcagacccccatccccaagccacgcagctcctgcctcccccagcttcacacatgaggctcccgtcacactgaccttttaagagctcccagaacaagtcaggcactccatgcttctaagtcactgtgtttgttgttccctctgcccaaaatacacttcccagctcttcacagagctgcctccctttcatccatccacaagtgggcttaaataacactgttaggtaccttcccttgccaccctaaattgctgcctcaccccagtctcacccctcttattcacttcagcaggtacctgctacttctcatgcttcattgtaagaacaagatctgggtccagctcaacaaatacttgaacaaagaatgaagtaagcagcccagtgtaaagagaatgcctcatacaaagttcagaggcccaggagatagaagctggtaaaaccattcacaagaagcaagcgtgaagaaggagggtgcccagcaggaaatgactgcatgcaaacagagctggttatagtggggcttggcccccaaccctttggggaaacaaggtgggaagtgaatcaatatagtgggaactgcctggagacagcgacggaaaaaaacctgaaaccataagggattcctcaagatatacaatgacaagtttcactgatcccctcttctcctaaataaaaaagaattccagggaagaaggcactttgtttttttgttttgtctttgagacagtgtctccctgtgttgcccaggctgcagtacagtggcacaaccatagctcactgcagcctcaacctccagagctcaatcttcccatctcagcctcccaagtagctggaactacaagcacatgccactatacctgaataatttttgtattttttgtagagacagagtcccactatattgcccaggctgttctcaaacttccaggctcaagcaatccacccaccttagcctcccaaagtattgggattacaggcgtgacctgtgtctggcccaaggagagatactttgaacagttcattttaaagcaagaaactcaattaaataagaatttcattaaattaactgaactcttacaaactggaatatcatctctctgggatcagctgatttaaaatttgttactaatcttgaagttatgtaagatctcaaggtatcctggatcttcagaactcccttactatttactcagtgcctggtaggttaaactcattatcccaaagtctagtacaatgttggtaactagacaaataaatccacatccatgagcttttgaccttacatggtaactttagaaactagctcacattaacagaagacatcaaggtaagggaaatgtgactgcaacatactgagacagaaatagtagctcttactggactccaggcactgttctacatgctttatacgtattaagtcatttaatcctcctgctaaccttaagtgacaggtactataaagaaactgaaatacagataagtgacgcagctggcccaggattacacctaggaagtagcagagctcaatttcaaaggcagacagcctggctccaagcctgagagcctatccacctggctcttctgcacattacgtgccaaagacgcctggaggggagtgagcatctgtctagggtggccctgggctgggctctgaaagacaaatatggctctgatgaacaggtgggcactttaaagccattcaggagaaatgaaagaaacacacgcatgcgtgtgcacttgtgtacacaaaaagatatgctcaacagacgtcatttaatgcaactcagacaaagcagagggctttcacaggaatgcagtaggccaggagtctggacatcactccagggaaaatctttcaaggggatctgctccacccagaacataatgtatttaaatacaaataatattaaaacagccttacttacaagatgtactaacacaggaccaaagtctcccagtgaaggcagtgcagaggtcacctagcacagcatttgtacttttgcctaaaaaggtatccctacatttcaagtgaaaaattacaggctgggtgcagtggctcatgcctgtaatcccaacattttaggaggctgaggtgggaggatcgcttcaggccaggagtttgagaccagcctaggcaacataggagaccccatctctataaaaatgtttaaaaaattaaatgggcatggtggtgtacactgtagtgccagctactcgggagactgaggcagaaggattgcttgaggccaggagtttgaggtcacagcaaactatgactatgccactatactccaacctgggtgtcagagcaagatcctgtctcaaaaaaaagggggtgggggggaggaaaaatgatacattccactccatattcaattctatccccagactgaagcctgtgtaatattaatagctttaaaacaacaactacaaagtagttaaagtatcattattgtcatccttaattggcaacagtatattaactggctcttgcaacacttacaaaagcacctggggcacaaggcaagcctcagaaggctgcaaacccagatgataagacattaaagttgttgaagctcctattggatactttatgaaacagtttctcccttttactgaaaaggaaaatttcatgagagacagtatgccaaacaacagcaggaaggtaatgttacattttggctggagttcttccccccacaggaactattcactttgaaattgctgtcagatttcagattcagtaagatacaaagtctgtgaagagcctgaagagcctccctctgcgaagaggctccgcctgccaagagcctccctcggcacccacgccctgctaagtggtggttcccaggaacatctcatcttatctatgacctctgtatggaagaactcaacaggaatatttcatgtaaaagcttcatgacaaatgatttgcctggggacactgataccaccacgatgtacccaagaccgccagccgatgaagtcttcccaaccaagtaaccccaacacactctcaccttcttaccaaatgtgccagattaatgtcctgctccaaattcaggccttttcagaaaacataaagcttcccgctttctatttgtgaaaaagtaacctcgttgctttacataaacgaaaatcacctcatttaatatgccttttgtgtacatgtaaattaaaacgttatcactagcagtaatttttaaacttctggattaatactttaatacttctctcctccttaaaaattatctaaaatttcttcttgatttgccaacacctcacactttaagtaattttcataaggattctggagaaaaatattttcactagaaaaaaaacaaaacaaaacagaacacttccagacgttatccagaagacaaaagtttgctcacatcatactgtctctagaaagccctttctagggtatctgtggcaacaggatacagacgtcttttgtttctttcttcctttactgaaatgctcaaaactttccaacagtcactctcaccatccctggagttgagagtttctataattgattctcttccacttacaatgacaatttaacccaccccaactggcaggttttaaaatcagtcaaaactaagaattgtggaacaatgtggctgacaagccaccattcttatttgcaaaaactgacagaatctggggaatgggaaggaaagagggtgtaggtctgtgtaaaacccccaacgaaaagtcacagtaacatgaagaaaggcaggaattctccacttcgtttggatggcagaaaatcaacgggctctttgtagaataaacacacacacacaaacacacacgcacaaatattgataatattgagcctcaacaactcatgatctcatcctgagacaaacctcatacaactatttgtagcctccagcatacagcagatagggaaaatttttcaacagggaaaatactgtccattaacttgaattattctgcaaattaggacaagacccattgtgcaattcagttcaacagtttggctcagtatgagaaggaagaggcagtggattctttgagagcttaagggaaggaggccacatgccatcagagaagcaggaaagataagcagatagacatgtcttctcagggccaccacccattcagatgccccagctgcgcgctgtccagtcgaaatattgtacaaaatatattacacaaaataagccatacgtgtcattgtatgtatgtatgtatgtacgcatgtatgtggagagggagtctcgctctgttgcccagggaggagtgcagtggcacaatctcggctcactgcaacctctgcctcccggttcaaacgattctcctgcctcagcctccccagtagctgggattacaggcgcctgccaccacgcctggctgatttttgtatttttactagagacggggtttctccatgttggccaggctggtctcggaattcctgacctcaggtgatccacacacctcggcctcccaaagtgctgggattacagacgttgagccaccccgcccggcccgtatatgtcattttaaatttccaaatagccacactaaaaaaagagaaaaagaaaagcagtgagattaacttttgtttttttatttgtttgttttgagacagtgtcccaggctggagcacaaaggcacaatctcagctcaccgaagcctcaatctcctgggctcaagggattctcccaccccagccttccgagtagcagattctcccacctcagcttcccgagtagctgactaccggcgtgcgccaccacgcccagttaattttttgtattttttgtagagacaggggtctcactatgttgctgaggctggtcttgaactcctgcactcaaacgatcctcctgcctcagcctcccaaagttttgggatgacaggcatgagccactgcatcctgccaagattaattttaatgatctattttcgttaatccaatttgtcccaaacatgaccatctcaacatgcatttaagtataaaagattaccaatgacatcttttactttctttctcatccgaagtttttaaaatcagatgtacgtttcacagctgggaccgcaactgaaactggccccatttcgtgggctccatcgtcccaaacggcggggggtcagtggccaccgtactgggcatggcaaggtccttcgtggttcaataccgaacacgggcaactccttttcatccctagacaggtggggacaggaaaatacccaactcctggcaaatccacccagtcccgactcaggctcgacctcggaggccccggccgggcctcaggcggccccacccctttgctgcccaggcctgaccggaagccccgctaatgggaactgacaggtcccggtcccggtcctcccgggcggcgcccccgcctccgcggaccccaaggcctctccccgcccggcccagggctgcaccccgcgcgaaaaaataaaaaaatcagaaaggggggtaaaaaagacggatgagccccaaattaatgcgccaagctctccgccggcatccttcccgcccccaagcccaagacgctgaatcgggatccccgcgatcaccagagcagacagaaataaccaaaaaaaaaatttttttttagtgaaatcaccaaaaaggagacattttgccgagggaatggcaggcagaagtgggtcacgttattctcggtgggggaaggggacggcgcgcccacccgtccctccgcgcgcacaggccccggcccggctcctctcagggtcctctcgggtccgcgggccccggaccccgccgcccctcccccgccccgcccgccgtccgttaacggccgcgcgcgagcacgaggcggcggcgcgcgcggggggggcgggggcgcgggcgcgcgcgtttccttcatgcccggcggcgtccccctacccctacctgtggggacgacgcgccggccggcggcagaaggcaggcggaggcgggcggcggcaggcgggcagcggtggcggcggcggcggcggggcctgggtgctcgctcgcagctctccctcggttagcggcggcggcagcggctcggttgcgcccgcggcggcgccctctagcggcgggaggccgcgcttgccgcccgggagacgccgccattggctgcgccggagctacgggctgggggcggtggcgccacgtctgactgggggcagggacctgggcgcgccgttcaatccggagccccggcgtcgacgcgcggcccactgggtgagccaatgggaaggccacgttgcgcactggacgcgctcggactcaagactgattaaccagcaccggggttttctggggcctcgcctgggccgcggcctgagcagaagcgctaggaggtagaacagcgtccagcggggagaggagctagagtcggcatcgggaagcccaccctggagcctgcttagcttgacgagccctcaaccggggcgccctgctctgcgaagagtaaccctgcatcctcagaacaaccgtgattgtcttcattcctacatatgaggaacggaggcgcggagccccacggcagccggggatccaaagacagcctccctccagttccatctgccggctcttggaaggcctggatccctgtccttcagggcccagcccaaatgccgcctcgtccatctgcattttacggccaggtgccccgctgcgggcacggcttcttgtaaaatgctcagctcagcagtgggcgaggcagggtccctgccccatgggatggagggcggagatcaggacccacaagagcccaaagaagaccattttggtcggtgaagaccaaagaaattcaagcaggaggatgtgacaggagcttttgggaaagcctctgaggaggtgacagccatgcaaccgtgttcggggaagtgtgccgcaggcagaggggaaatgagtgcaaaagccctgaagctggagttcggtgtctggataacaggaaaggcctgcatagctgatgtgtgccagaggggagaaagatctgtgacacaggggggccgccatgtttaatttggagttttgtgtggaagggggtcattcattgagtctgaattgggagttccgaggtctcatttatattttagaaagttctctcctgctactatgcagagattgggctgtaggagagacaagaggggaagtggggactctagctacagtagctcttccaggggtctgggtgacgtagatttacaaaccagagtattagctcaggctgccatgacaaaataccccagaccaggcagcttagacaacaggaatttattttctcacagttttagaggctgcaaatctaaggtctgggtgccggcagggctggtttctggtgaggcctctctccctggcttgcaaacagctgccttctcactgtgtcctcctatgaccttttctctgtgagcaggaatccctggtgtgtcttcctttttcttacaagaacaacaattttactagattagggccccaccctatgacttcatttaaccccagtgactacctaaaaggccgtattcaaatagtcgtattaggccaggcgcagtggctcacgcctgtaattctagcactttgggaagccgaggcagatggattgcctgagctcaggagttggagaccagcctgggcaacacaatgagaccccgtctttactaaaatacaaaaaattagccgggcatggcgacgtgcacatgtaatcccagctactcgggaggctgaggcaggagaatcgcttgaacctgggaggcagaggttgcagtgagctgagatcgcgccattgcactccatattgggcgagagagagagtctgtaccaaaaaaaaaaaaaaaagtataagggtcctatgacttcatttaaccctaatgactgcctaatatgcctaatagccatattagggttagagcttcaacatacggactccggggtgggtatgtgcggagcggggagcgtttcagtccgtaacaccaggtaagtgctgcaacagatattggagagctgatgggctgtggttttagggaagctcctctaagaaaggggtggattataccgggcgcactggctcacatctataatcccagcactttgggaggccgaggcagggggatcacgaggtcagaagttcaagaccagcttggccaacatggtgaaaccctgtctctactaaaaatacaaaaattagccaagcatggaggcaggcgcctgtaatcccagctcctggggaggctgaggcaggagaatcacttgaacctgggaggtggaggttgtggtgagtcgagatcgcgccactgtactccagcctgggcgacacagcgagactccgtctcaaaacaaaataagaaaaagaaaggggtggattattctcgtgaccagaggctgctcatcattcaggcctcaactacagtagcctctcttggagaggccttcactgacagcccatctaaaagttgctcactaacacagcgccctatctgatcttccaagcagtcatcatgatctgaaatgacctcgtctagtcctgttgccagaaggctcaggaggtctctggatactggtgacaccccagccccagccagtttccaggttcttgacaccttggagagaaagaattcaagaatgagttgaatgaagcaaagggcaagaaggtttttttttgttgtttgttgtttttgttttttttgagacaggatctcagtctgtcacccaggctggagtacagaggcgcaatcatggctcactgcagtcttgatctcccgggctcgggtgattcccgccacctcagcttcctgagcagctgggactagtaccacaccggctaagtttttggggttttttttgtttttgtagagacagggttttgccatgttgcccaggctggtcccaaactcctgggctcaagcagtcctcccaccttgacctcccaaagtgctggcattacagttgtaagacactgcaccgagctgcaagaagcttttattgcaaagtgaacatacacatttaagagagaagtgcaggcatgcccgtgagaatgagtcttgcacaatggagtttgggttcctaattttatgggtgtttcttttagttacaggatggaattatcgttaggcattctggaaagggaggggatttcagggacctccacctcaattactgtctcctttcttccttatctgggtttgctggaagaagcatggacatgtcaccctggccagagttttggccatcttctctcccttgggttttctgttatcctatggtttatttgcctagttcctgtttcagctgtttgggtttttccatcctcctgtgaccacccagtgctgttcctgtctcaggcatttgggcgcttgtttgtggtcggcctccaaccctacaggagagcagagactctgctttttttgttttgttttgtttttgctttttgagacagagttttgctcttgttgcccaggctggagtgcaatacataatcttggctcactgcaacctctgcctcccaggttgaagcgattctcctgcctcagcctcccaagtagcttggattacaggcgtgcgccgccacctcacccggctgatttttgtatttttagtagagacggggtttctccatgttggtcaggctggtcttgaactcctgacctcaggtgatccacctacctcggccttccaaagtattgggattacaggcatgagccaccacgcctggcccaaaccagtttcttttgtcctatattctcagccccttgatagtaggtagcaccccttaaatacttctggagtggatgtctcaagcaagcctgaggctaagatctgattagaagcgtgagtaggagatatcctaatgcagtggtgcatgtagaaaagaaaaaagcctgatgcggtggctcccgcctgtaatcacaacactgggaggctgaggtgggcggatcgcttgaggccaggagttcaagacctgcctggccaacatggcggaaccacatctgtactaaaaatacaaaaattagccaggcgttgtggcgggtgcctgtaatcccagctacttggaaggctgaggcactcatgccactgcactccagcctgggtgacagagtgagattccatctcaaaaaaaaaaaaaaaaaaaaaagctcttgtgattgcattgggtccacctggataacccaagatggtctcttcatctcaagattgtaacttaatcccaatagcaaactcccttttgctaggtaacaggttactggggtcagcatgtggacatctttggggaaccattattctgcctaccacagagagcaaagtaaaggacatctgcgtatgggtgtgcctgcttcctggaatccccatctccagcccttgttgaggtgatgacactccctattcccccacccctggtagcactaggtgctgtagtgctgaggaaaatagactgactcattcctcaggcttccactctagtgggagaaattttcagtttcttcattggatattacactgacaagtacactctctaaggacctattatgtgccccatgcctgagggtacaaagttggataagacaggattcctgccctcacccagcctacggtcaggtcaaggattcaggctgtgttcatcagtgattctaggggtggccagggtaggcggaggagtctgtggagccacctaggagtgacctcttcattctctccagaaatacttacagagcacttactctgtgccagatactattctaaattcatgggatgtgtcagtacagaacaaagatcactatcctaatgaagtttacattccaggagagtgaaacagacaacaatataagtaaatcatagagtatgttagaggatgctaagtattatgtttaaagaaaaagcaggggtgggcagaagccgagcacagtggctccacctgtcatcccagcactttgggagactgaggcagaagttcgaaactactttgggcaccatggtgagacagtgtcgctacaaacaaaaaaggtggggaaagggggagacgtagaagcaacagtacttaaagacactgatatagatgccagattgagaagtatacagggtggttatcaatgaatgctatgaagataccataaaggagatggtgacaggctattctgggcacactgcttgtggggtagccctgctctgcaagaagcggggttttgttttttttgtgtgtgtttttttgggaaaatttaattttgggccagacatggtggttcatgcctataatcccagcactttgggacgctaaggtgggcagatcacctgaggtcaggagtttgagaccagcctggccaacatggcaaaacctcgtctctactaaaaatacaaaaattagccaggcatggtgatgcgcacctgtaatcccagctactcagggaggctgaggcaggagaatcacttgaacctgggaggcggtggttgcagtgagctgagatcacaccactgcactccagcctgggcgacagagtgagactcccatctcaaataataattttttaattaattgaaggagatgatggggaaaccaagtcatacaaaaggggttgcagagtcattcctgtaggggtccagccggtaacctaatgagcctgcccaggggtcagcgtagactcaggaacaccctgtccactctagctaaggtaacaactgcttcccaggcctctctgttcttgccatgtggtctacaaatgcagttttgccagaaactccaggcgtatttcaagattagctagaaattgggattttattacaacaaatactctactttgaaaagttaattagtagaaaaaagaaacactatgtaatacaaataagccatgtccataggcagcagtgagcccatgggccacccacttgcaacatctgtcgtaaaaactaaataagatatagatagatcttaggacagaccttctagattcattaatgggagttatgatgtagtcaccagatactgtagtgaatgccataaaaaatacagatggggttaggtggggtggcttatacctgtaatctcagcactttgggaggccgagggaggtgaaccacttgaggtcaggggttcgaggccagcctgggaaacatggtgaaatgccgtctctactataaatacaaaaattagctggacgtggtagtgggcgcctgtaattccagctacttaggaggctgaggtgaaagaatcgcttgaacccaggaggcagaggttgtagtgagccgagatcgacccactgcactccagcctgggtgacagagcaagactttgtctcaaaaaatatacgtgtgtgtatatatatatatatatatatatatatatatatatatatatatatttgtgtgtatattgtgtatatacatatgtgtatacacacaaatatatttgtgtatatataaaagatatattttgtgtatattttttggggagagggggaaaaaaaggaagacaaagttatgaccagacacctggtctttttttcttctctgtctctctttttttttttttttttttttttttttagagacagggcctctctccgttgcccaggctggagtgcaatggcacaatcacagctcactgcagcctcagtctcctgggttcaagcaatcctcctacctcaacctcccaagtagctgggactgcaggcttgtgccacagcctctttaattaaaaaaaaaaagagagaaagaaaaagcaaacaagggctgttctttcctatgcttttggtttttctgaagtatattagtttgcaatttcagccttcttgctcaccttgaatcctccacccctctgcatgttgtacctgttctcagctgtattaggagtcagtataataggattatttccggttgccttggttttcctttcagctgggcaccaaattaagtatctcagtaaaataacccatctcctagcacccacccaaaaaattgggagttacttttccttggcccgtgaggtctctggataccagcttctacacataagcagcaatagcagtagtagttcagctttatatacaaagttatctgagattctcagcaggagctggcatgcacacatagcaaaagtgtccactttttaaaaatatattcactggccgggcgcagtggctcacgcctataatcccagcaatttgggaggccgaggtgggcggatcacttaaggtcaggtgttcaagaccagtctggccaacatggtgaaaccccatctctactaaaaatacaaaaattacctgggcatggtggcggatgcctgtagtcccagctacatggaggctgaggcaggagaaatgcttgaacccaggagggggaggttgcggtgagccaagattgtgccactgcactccagcctgggtgacagagcaaaactccatctcaaaaagaaaaaaaagaatgcacacaaacacacacaagttccccccaaaggaaaaaggtactttgtattgtgataaatatattgactcatttaagctctcccaaataaatacaaggtgaacgtttaagatgctatgagtaggtggcacagttgtggaaagagaggggctttggagtctgggaagcatggagacaagtcctccttacccatctgggtggccctaagcaagtatctttcagagcctcgaggtcatctttaaatgtggataatgatccccctggcacggtgatgatgaaataacatatataaaccacctggcacagagactgttcaataaatagcagatccttttttttttctcgcctagagttcagtggcaagatcacggctcactgcaacctcagcctcccggagttcaaggagtcctcccacctcagccttctgagtagctgggactacaggcatgcgcaccaccacgcctggctaatttttgtattttttggtagagacagggttttgccatgttgcccaggctggtctcaaactcctaggcttaagcaatctgcccacctcggcctcccgaagtgctgggattataggtgtgagccaccgtgcccagcatagcagttattatactttccatgatgaatggagtaatctttccagcagtaatctttggggtgggaaggggtacttgcacacacacacacacacaccccatcccagagattgtgaggcatgctccctagtccccctgggagtgactgccttggaaaaaattgttcctgaagggcaggatggagggtcacaatccctcatccttttccaccatgaggtggaaaaatggtcaagagtctctgccttaaaaatggagcttaggagataaaacccaccatctaggggccattatcaccatgttacctactgaaatgagttgaccacaggaccaacctcaaataagaacaaataacaaaaatgatctgtttgcaagtattacagacctgtaccagaaaagaagtaccttccaatttctagcactcaaaatatgaaagaaacatttaggaaaacatttagagaagaaacatttagtactcaaaacatgctcaatgtttgccaaatggccccaggatactttgacagaccacatgctttgagttttgtcagtactcctggaaatctgtgatagaatcttaatgtgcaccatgcaaagtttaatatcacatttctgttgaataatcactgtgaggccgggtgcggtggctcatgcctgtaatcccagcacttcaggaggctgaggtgggtggatctcttgaggtcaagagtttgagaccagcctgaccaatatggtgaaaacccgtctctactaaaaatacaaatttagccaggtgtggtggcgcatgcctgtaatcccagctactcgggaggctgagacaggagaatcgcttgaaccctagaggcagaggttgaagtgagccgagatcgcacctttacacttcagcctgggcaacaagagtgaaatgctgtctcaaaaaaaaaattaattaaaaaaaaattaaacatgctctttgaggatcccccaaggtgtggatctgggaaatgaaccatagaatagaaaggagcaaaaacacagattaagggaacctgatacgttgggatacaggagccaagacctttgtcattcagtatgtgaaaatgtcaggatgtgcaagtgagaaacaacttaaaaccttaaaatcagaagatcactccccactgacactgcagattaaaagatactaatcactggccgggcgcggtggctcacgcctgtaatcccagcactttaggaggccgaggcgggtggatcacgaggtcaggagatcgagaccatcctggttaacacagggaaaccccgtctctactaaaaatacaaaaaattagccggccgtggtggtgggcgcctgtagtcccagctactcgggaggctgaggcaagagaatggagtgaacccgggaggcagagcttgcagtgagcggagatcgcgccactgcattccagcctggggacagagcgagactccatctcgaaaataaataaataaataaataaaaaataaaagatactaatcacctcaaaggaagctgctggagagctcctttaattcaactaatcaacaatattatgcaacggcttttttaaaaaacatgttcaaggatcatacattttactcagtcttttatataatttggcagggaatcaaggcatattaggaaattcacagaaaccataaacataaaaaaatgcataagtcctcagttcagtaaccacacaaatatttccgagaacacatccaaagccactttcccttctgcaaagctgttataaaatgtacttagcgtcgggcatggaggctcacgcctggcttacaggcgggcacctgtaatcccagctacttgggaggctgcagcagagaatcgcttgaagctgggaggtggaggttgcagtgagccgatattacaccctggccctccagcctgaatgaccaagtgagactctgtctaaaaaaaaataataataataaaataaataaaaaatgtacttagcaagccaggcgtgatggctcactcctgtaatcccagcactttgggaggccaaggcaggtggatcacatgtggtcaggagtttgagaccagcctggacaacatggagaaaccccgtctctgctaaaaatacaaaattatctgggtgtggtggcacatgcctgtaatcccagttacttgggaggctgaggcaggagaatctgttgaacgtgggaggcagaggctgcagtgagccgacatcacgccactgcactccagcctgggcaacaaagcgagactctgtctcaaaaaaacaaaaaaacaaaacaaaaaaaacaaatgtacttagcacagacctacctcttctgctctaggtggatttatagaaaaattttaacagatttttaagacgtttgcatagaaggaatgaatatgaatgttaaatcaaaatcctggtaatctgattgtgctataaatgtgaaatatcacaaacaattaattggaaggacatgcaaacaaaaacaagaactgagccacctctgcttcctaacatcattcatccttcaagtgtaatatttaaggtatgtgccttcattacaaaaggtatttctggctgggcatggtggctcatgcctgtcatcccagcactttgggaggctgaggcgggcagatcacctgaggtcaggagttagataccagcctggccaacatggtgaaaccacttctctactaaaaatacaaaaacattagctgggtgtggtggtggacgcctgtaataccagctacttcggaggttgaggcaggagaatcacttgaacccgggaggcaaaggtcacagtgagctgagatggcgccattgcactcgagcctgggtgacaagagcgagactctgtctcaaaaacaaaaacgaaagatatttctgtaagcactcaccactataagtgtatacgtgcaggccaggcgcagtggctcacacctgtaaccccagcactttgggaggccgaggcgtgcggatcacgaggtcaggagatcaagaccatcctggctaacacggtgaaaccccgtctctactacaaatacaaaaaattagccgggcgtggtggcgggcgcctgtagtcccagctactcgggaggctgaggcaggagaatggcgtgaacctgggaggtggagcttgcagtgagccgagatcgtcccactatactccagcctggacaacagagcaagactccgtctcaaaaaaaaaaaaaagtgtatacgtgcagagaactaaatatctcagcatgcatgtgtgtgtgtttgtgcacgtgcattcccttttggaagaaaaaatacaaaatgttcatatacatatttcatataaatttattataggatgcacttagatctcctttttttttttttcccaaaaatatatctaactaggttttcagtacttttgggttcagggtggctttcttagtgcttctcagttcaaatgttagtttcttccacctcttctgcagtatcagtgaagtcttttttcccagcttggatcagcgaaaggatttaaaatctgctaatttggccaggtgtggtggttcacgcctgtaatcctaacactgggaggccaaggcgggcagatcacaaggtcaggagttcgagaccagcctgaccaacgtggtgaaaccccgtctctactaaaaatacaaaaattagtcaggcgtggtggcgtgcgcctgtaatcccagctactcaggaggctgaggcaggagaatcacttgaacccgggaggcagaggttgcagtgagctgagatcgtgccactgcatcccagcttgggcaacagagcaagacactgtctcaaaaaaagataataataaaatatgcaaatgtatccacaaaacgtatgacaatggtttggcaccttttttgctaggatgtcaaaatccagcaataaagttgttctaaccagattcgaactagttttggtgttttttttgtttttttgagacggagtttcgctctgtcacccacgctggaatgcagtggcatgatctcagctcactgcaagctccgcctcctgggttcacgccattctcctgcctcagcctcccgagtagctgggactacaggtacccgccaccacacccggataatgttttgtatttttagtagagatggggtttcactgtgttagccaggatggtctcgatctgacctcgtgatccgcctgtctcggcctcccaaagtgctgggattacaggcgtgagccactgcgcccgggcctagaactagaatatcatatatcaaatctaagcagtcaaatcttgcccaagtcttagtgattcaaataccctttgagggaccagttccctttcaagcacttcactggtattttctttcaaggtgttatgagtgcatatgtcaagaattttttggctgggtgcggtggctcacgcctgtaatcccagcactttgggaggccaaggcaggtggatcatctgaggtcaggagttcaagaccagcctagctgacatggtgaaacactgtctctactaaaaatacaaaaaattagccaggcttggtggtgggcgcctgtaatcccagctaccagggaggctgaggtaggagaatcagtggaacccggaaagcagaggttggcggtgagctgagattgtaccactgtactccagcctgggcaacagagcgagactccatctgaaaaaaaaaaaaaaaaagaattttttagttgtaagagactgttaagtagtgaaccctaattaaacaaggctaaggggaagaaaggaaatttatgagctcatagaacttaattgtccaggtaaggttcgtgtcagtatcatcagaaactcaggcactctctctccttctgtcagttctgctttccattctcaggcagactcaccccttgcggcaacgtaactgccagcagttccaggcttaggtggtcttttctcagcaactcccacaaagccttgctcttacaaatacttccgtaaaacctggacctgactctggccagaactgtgtcacactgttacgggtggagggtgtccaggttcttgacgttttgaaaaaagaattggacgaaacgcacaaagcaatgaaagaaaagcacagatttattgaaacgaaagtacactccacagagtagggagcaggttagaggaagtgactcaacaatgctggttacagaattttctggggtttaaatacccttcagaggtttcccattggtatgccctatgtaaatgaagagggtaagtgaagttacaaagttatttacttggcatacaccccatggaaatgaagaggatgtttcctgccatagctgaagtgaagttacaaagttatttagttgggcatagaaagttggggttttggcctggaggtgggagagcggggagggctcatgcctgtaatccaaacactttcggaggcggaggtgggcggacctttggccaacatagtgaaactccgtctctactaaaaatacaaaaattagcctagcatggtggggggtgcctgtaatcccagctacttgggaggctgaggcaggagaattgcttgaacccgggaggcggaagttgcagtgagccaagatcaggccactgaactccatctagaaaaaaaaaaagacagttaattggggtttttcccttttattgagttctaggaagtatgtatgtttgtttgtttatttattaaaacagagtctcactttgttgcccaggctgtagtgcagtggtaggatcttggctcactgcaacctctgcctcccaggttcaagcgattttcctgcctcagcctcccaagtagctgggattacaggtgctcaccaccacaccaagctaatttttctatttttaatagagatagaatttcaccatgttggccagggtggcctcgaactcctgatctcaggtgatccaccggccccggcatcccaacgtgctgggattacaggtgtgagccactgcactcggcctagttctaggaagtttttaggttccctgcctccagaccccattctcctgcatcaacataagcatcctgaatcaatcatccaggcaggacgggcaggttatacagttttgttgtaaacagttatgttaaggccaggcacggtggctcacacctgtaatcccagcactttgggaggccagggtgggcagatcacttgaggccaggagttcgagaccaacctggccaacacggtgtaaccccatctctaccaaaaatacaaaaattacccaggtgtagtggcatgcacctgtaacctcagctacacgggaggctgagggaggagaatcacttgaacccaggaggcagaggttgcagtgagctgagattggccactgcactccagcctgggcaacacagccagactctggatcaaaaaaaaaaaaaaaaaaaaaaaaaaaaaagaacaatgctccttgatagctgctgttctacaacacagagactaaggggtattgaaagatgatcctcaaagatgtccatgtggtggccaggcgcagtggctcactcctgtaatcccagcactttgggaggccaaggcgggtggatcacgaggtcaggagatcaagaccatcctagctaacagggtgaaaccccatctctactaaaaaatacaaaaaattagccgggtgtggtggtgggtgcctgttgtcccagctagtcgggaggctgaggcaggagaacagcgtgaacccgggaggcggagtttgcagtgagcggagatcacgtcactgcactccagcctgggcaacagagtgagactccgtctcaaaaaaaaaaaaagaagaagaatcaaattcagggctgggtgcagtggctcatgcctgtaatcccagtactttgggaggccgaggcagacagatcacctgacgtcaggagttcgagaccagcctggccaacatggtgaaaccccatctctactaaaaatataaaaatcagccgggcgtggtggctggcgcctgtaatcccagctacttgggaggctgaggcaggagaagtgcttgaacctgggaggcagaggttgtagtgagccgagattgtgccattgtgctccagcctgggcgacaagagcaagacaccatctcacacacacacatacacacacacaccaaaaaggtgaagaatctggctggtcatggtggctcacacctgtaatccctgcactgggattacgccaaggcaggtggatcacctgaggtcaggagttcgagaccagcctggccatcatgataaaaccccgtatctactaaaaatacagaagttagccgggcgtggtggcccacacctgtaatcccagctacttgggaggctgaggcaggagaatcacttgaacctaggaggcagaggttgcattgagccaaaatcaccgcactgcactctggcctgggtaacagagtgcgactccacctcaaaaatataaaagaagaagaatctaatttggtaggtttagggtgaggcctgaggttttgcacttcttacaaattgttaggccctgccagtgctgctgctccaggagccacactttgagaagtgacgttcctctagagaatgtctaatttgccacctttaaaccctattcctgcggccaggtgcagtggctcacacctgtaatcccagcagtttgggaggctgagactggtggatcacgaggtcaggagattgagaccatcctggctaacacggtgaaaccccgcctctattaaaaaaaatacaaaaaaatcagctgggcgtggtggtgagcacctgtagtcccagctactcgggaggctgaggcaggagaatggcgtgtacccgggaggcggagcttgcagtgagccgagatcgcgccactgcaccgcagcctgggcgatagagggagactcttgtctcaaaaacgacaacaaaaaaaccctattccctttcttatggtttctgtattttcacctataaaagaataagataaacagggcgcggtgactaatgcttgtaatctcagcactttaggaggccgaggcaggtagattgcttgaggacaggagttcaagaccagcctgaccaacatggtgaaactccgtccctactaaaactacaaaaattagccgggtgtagtggcaggcacctgtaatcccagctactcgggaggctgaggcaggagaatcacttgaacctgggtggcagaggttgcatcgcgccactgcactccagcctcggtgacagagcaagactccatctcaaaaaaaaaaaaaaaagaatacgatattgggattttacagtgcttccaaacagaaaaacagcaatggttaaatatggcagtttaaaaatagccacatccagccaggcgtggtgcctcatgcctgtaatcccagcactttgggaggccgagatgggtggatcacctgaggtcaggagtttgagaccagcctggccaacatggcgaaatcccatctctactgaaaataaaaaaatcagtcgggcgttgtggcatgtaccagtaatccagctactcgggggctgaggctggaggatcacttgaacctgggagacagaggttgcagtgagccgagatcgtggcactgcactccagcctgggcaacagagtgagactctgtctcaaaaaaaaaaaaaaaaaaaaaaaaaaagtcacgtcctttcttcatcaaaacaattctcgttttgagggtggcggggggcgtggcgggggggtgggtgttgtgagtttcagagggctatgatagaccactagtgacaacttgtggctagttcttatcattacaatcacattttgcgttccctttcaaatgtaacacaattacaaaaatcaacattgggtattctgtttcatttacatagttttgtgaaactaaaatgtgtttaacttttcattttgagatgattatagattcatcagagggtcccaagaaatgtatagggaagttccacggacccttctctcagcctcccccaatgttaacgtattaaatatcaaaaccaagaaagtgacattggtacagtctatagatgtaatgcagttttcacagttatacctgctctcctttgtgacaaaaacactttgacatatcaaggaagatgtatcaggccaacaagaatctctttctttggtggttaaataatattaaattcaacaaccaactagaaattcttagttttgtaataaagcaaaatgaatctcagcattctacaacttacagttttgttgaaacaaatcttgttgcccaggctagagtggtgccatcatgactcactgcagcctcgacctcccagctcacagctcgaatgatcctcccacctcagcctcctgggtggatggaactacagggacacaacgcaacacccaattttttttttttttttgagacagcgtctcactctgtcacccaggctggagtctggagtgcagtggcgtgatcacggctcgctgcaatctctgcctcccaggttcaagcagttctcctgcttcagcctcctgagtatctgggactacagacatgccacacctggctaattttttttttgtatttttagtagagacagggttttgtcatgttggccaggctggtctcaaacccctgacttcaggagatccaccggccttggcctcctaaagtgctgggattacaagcgtgagccaccacacccagcccccaactgatttcttgtacttttttttgtagagatgaggttttgccaggcaggtctcgaactcctgacctcaagtgatctagccaccatggactcccaaaatgctgggattactggtgtgagtgaccacatgaggcctctagctttgtgtgtgtgtgtgtgtgtgtctgtgtgtgtgtgtgtgagagagagagagtttcactcttgttgctcagggtggagtgcaatggtgcaatctcggctcaccacaacttccgccttccagattcaagcaattctcctgcctcagtctcccaagtagctgggattacaggcatgtgctgccacgcccagctaattttgtatttttagtagaaatggggtttctcaatgttggtcaggctggtcttgaactactgacctcaggtgatccatctgcttcggccctccagagtgctgggattacaggcatgagccgctgcatccagccattttcttctttttttttttttttgagacgaagtctcgttcttgtcatccaggctggagtgcaatggtgcgaccttggctcattgcaacctctgcctcccaggttcaagtgattctcctgcctcagcctcccgaatagctgggattacaggctcctgccaccacgcccagctaattttagtatttttagtagagacggggtttcgtcatgttggccagactggtctcaaagccctgacctcaggcgatccactcgcctcagcctcccaaagtgttgggattacaggcgtgagccaccgtgcccggcctagctttcttcttttgctcaggattactttggatatttgggctcactttggttccacatgaattttaggatttttttttctatctctgaaaatgtcattggtattttgatagggattgaaatgaatctgtagatcactttggacagcgtggtcactgaagggaaaaacaccacgacaacaatgacacagaagacttctgtaaccaaatgtgtagggatttctccccacacaccaagcaaccaatcaattctacatcagacatctgctgggtgtcctccgacttttttttttttttttggttggggggacacagagtctctgtagcccaggctggagtgccatggtgtgatctcggctcactgcaacatccgcctcccgggttgaagtgattctcctgcctcagcctcctgaatagctgggattacaggtgcctgctaccatgcccgggtaattgttgtatttttagtagagacagggtttcaccatgttgtccaggctggtcttgaacttctgacctcacgtgatccaccctccttggcctcccaaagttctgggattacaggcatgagccactgcacccggcatttttttttttccttttaaacaaggtctagctctgttgcacaggctggagtgcagtggctcaatctcaacctctcagactcaaagtgatccacccacctcagctttccaagtagctggaccacaggcaagtgctatcatgcctggctgtttttgtttgttttgttttgtttttctttttttgagacggagtcttgttctgtcacccaggctggagtgcaatggcgcggtctaggttcactgcagcctccacatcccaggttcaagctattttcttgcctctgccttctgagtagctgggactacagggacacaccgccatgctttgataatttttgtatttttagtagagacagggtttcaccatgttggccaggctggtctgaaactcctgagcgcaagtgatctgcccgcctcggcctcccaaagtgctggattacaggcgtgagccacagcacctggcctgtttttgtattttttatagagacaggcttttgccatgttaaccaggctagtctcgaactcctgaactcaagcaatctacctgccttggcctcccaaagtgctgggattacaggcatgaggcaccacgcccagcctcaattctgacagtatctacctcactgatacagcatcaggccccacaactgagggctcactcccaccaagcagccctctcccttcccaccagtcacaaatctgagcctccagaacttctgacttgtttcaacttggtgttcccacaaccctctctttgggttcatttaattgctaatgcagcttagagaacccagggaaacacatttactggtttattataaaggatgttaccgggcaagagatgacggctcacgcctgtaatcccagcactttgggaggcaaaggcaggcagattacctgaggtcaggagtttgagaccagcctggacaacaaggcaaaaccttgtctctactacaaatccaaacattagcctggtgtgggggctcacacctgtaatcccagctactcaggaggctgaggcaagagaatcccttgaacccaagaggcagagcctgaagtaagctgagattgcaccactgcactccagcctgggctacagagtgagactctgtctcaaaaaacaaaacaaaacaaaacaaaaaaacgacacacacacacacacacacacacacacacaaggatggcatcggctcacactttgggaggccaaggcaggtggatcacttgaggtcaggacgtcaagaccagcctggccaacatggtgaaaccccttctctactaaaaatccaaaaagtagccaggcatggtggtgggcacctgtaatcccagcactttgggaggctgaggtgggcagatcacttgagatcaggagttcaagaccagcctagctaacatggagaaattctgtctctattaaaaaatacaaaaattttgtgttttttgtattaaatacaaaaaatacagccgggcgtgatagcacagtaatcccagctacttgggaggttgagtcaggacaatcacttgaacctaggaagcagaggttgcagtgagccgagattacaccactgcactccagcctgggcgacagagcaagactgtctaaaaaaaattaaaaaaaataaaaaagatgttaccaaggatacagatgaagagatgcatagggtgaggtgtggggaaaggggctcagagcttccctgaccttcttgggtcagccaccctccaggaacctccccgtgttcagctctctggaagttccctgaaccctgtgctcttaggcactggatagttgtgacgaacaaccagacagaaacatgactggacacaaaggccatgatctaacagacgaagtggagaaacagagcaaggctccaattcttcatgctttctgtggccccttcttccagggtatatggcaggatctcctctgaagtagggggtattgtgacctgcaatcaaagtaggttagacgacattccttcttccagggtatggggtagaccccttctgaaatgggagtattgtcacctactgtcagacaaggtacgtcaccgaatttacttttttttttttttgtggagacggagtctcgctctgtcgccaggctggagtgcagtggtgagatttctgctcgctgtaacctcctcctcctggcttcaagcctcagcctcctgagtagctgggactacaggtacgcgccaccatgcccagctaatttttgtatttttagtagaaacggggtttcatcatattgaccaggttgggtcttgacctcgtgatccacccacctcggcctcccaaagtgctgggattacaggcgtgagccactgtgcctggccacagaactttatagccaactgcaagaagaaaggtgagaagattcctgccttggggagaaaaatggcaggagaaagacaggttgttttccaagacctgattcagaaatcttggctcacagcatcctctgcatcccaggttcaagcaattattgcacctcagcctcccaagtagctgagactacaggtgcatgccaccacgcctggctagtttttgtattttcagtagagatgaggtttcaccatattgctcagactggtcttgaactcttggcctcaagtgatccagccacctcaacctcccaaaatgctgggattacaggcatgagtcaccgcactcggccgacttggattttttttttttttttgagacggagtctcaatctgtcgcccaggctggagtgcagtggcgtgatcttggctcactgcaagctctgcctcccaggttcaggccattctcctgcctcagcctccagagtagctgggactacaggcgcctgcaaccacacctggctaattttttgtatttttagcagagacagggtttcactgtgttagccaggatggtctcgatctcctgccctcgtgatctgtctgccacggcctcccaaagtgctgggattacggcgtgagccaccgcgcccggcaacgacatgtaattttttgttgagtgggaggggaagacagtctcattgtgtcatccaggctggagtgcagtggcacaacctcggctcactgcaacctccgcctcctgggctcaagcgattctcttgcctgagcctcccaagtagctggaactatagacatccaccactatgcccaggctaatttttgtattttgttttttttagagacaggatttcaccatgttgcccatactggcttcaaactcctgggctcaagcgatccacccaccttggcctcccacagtgctgggattacaggtgagtgacactgtgcccggccagatggcatgaatttgacaggcatcgttatgacctgaaggtccttctgtagacagaatcttatgttttagggaataagaacattataaaattagaagggttttttttttgagacagtctcaccctgtcgcccaggctggagtgcagtggcacaatctcggctcactgcaacctccgcctcccaggttcaagcgattctcctgcctcagcctccagagtagctggaattacaggcggctgccaccacacctggctaatttttccatttttagtagagacggggtttcaccatgttggccaggctggtctcgaactcctgaccttgtgatccacccaccttggcctcccaaactgctgggattacaagagtttttttaaaagccagattttatttctatttaaaaacaatgctcaggagacttagttccaaagacgaagatgccagggttcaatgtacaactacagcgaggtgctagcgattattgagtgagtcatggaaggctctgtagttccttggagacttccgctttttcgtatcactcctagtcttagcctcgtggttttctgcaagttctcgtcgactgtaaccgtacacagggctgtcactccagtgaggacaacaaaaaaagcacctatggctatcattgttaatccagtagagaaaaccacagagtcagaggggtcctgtagaacaacaatgagtcccagaatcacagtcgataaccctaagcaggtgacaagcagacattcagagcaagacaagcatcggaactcccgtcttctggatagattcatccatggataagtttggataggttggtacatggtgattttttgctgcagtggttaagggaagaaaaagtctatgaaagctcaaatacaaaaagtgtaaatagaatcttttcttcttttctgtgaattgcatctactatgcattctttttctttttcttttttttttaagatggagtctcactctgttgccaggctggagtgcggtggcgcgatcttggctcacttcaagctctgcctcccgggttcaaatgatgctcccgcctcagactccctagtagctgggactacaggcgtgcgccaccacacccagctaattgttgtatttttagtagagacggggtttcaccatgttgaccaggatggtctcaatctcttgacctcatgatctgcctgcctcggcctcccaaagtgctgggagtacaggcatgagccaccgtgcccggccctttttctttttttttttaaatgagacagagtctcactctgtcgcccaggctggagtgcagtggtgcgatcttatctcactgcaacctccacctcccgggttcaagcagttcgcctgcctcagcctcccgagtagctgggattacaggtgcccgccaccatggctggctaattttcgtatttttaatagagacggggtttcatcacgttggccaggctggtctcgaactcctcacctcaagtgatatgcccaccttggcctccccaaatgctgggtttacagacataagcaccaccttgggcctactatgcattttcagtcagaactcccttcaccctgtctcatatcctgagggtaatttaaagggctggcctctaagaggcacccaaattcccctctgaggagactctcaggaggtcagagttcttaatggtttaaaatacatcttttggctgggtgcggtggctcactcacaaaaatgctggtaatcccaacatttttggaggccaagatgggaggactgcttcagcttggaagttcaagaccagcttgggcaacatagtgagaacctgcctctactaaaaattttaagaaaatagccgggcacagtggctcacgtctgtaatcccagcactttgggaggccgaggagggcagatcacaaggtcaggagatcgagaccatcctggctaacgtggtgaaactccatctctactaaaaatacataaaaattagccaagcatggtagcgggcgcctttagtcccagctacttgggaggctgaggcaggagaatggcgtgaacctgggagacggagcttgcagtgagccgagattgcaccactgcactccagcctgggcgacagagcgatattccgtctcaaaaaaaataataataaaaaataaaaataaaaaatttatccagttctggtagtacatgcctgtagtcccagatacttgggaagctgaagcaggagaatcacttgaacccaggagatggaggccgcagtgagctatgattacgccattgtattccagccagagtgacaggacaagaccctgtttcaaattttttaaaaaaggaaataaaaagatacatctttacagtgtgaaaagaaaacaaaatctcagccccaaactcactatgcctaggggaaaagttaagcttggaaatcgagtcacacacaacaaaatctgcctttcgttttgttcctaaacagatagctataagatagaaggccacacgcctcacaacggggactttcttaccctgacaatgtaaattaatagcttatcttcataggtaggagacaagaagagactataaattgctgacccacccacgctgagacccatgcgtatttgattttttttttttttttttttgagacggagtttcgctctttttgcccaggccggagtgcaatggtgcaatctcggctcaccgcgacctctgcctcccgggttcaagcatttctcctggctcagcctcccaagtagctgggattacaggcgcctgccaccccgtctggcgaattttttgtatttttagtagagacaggtttcaccacgttggcctggattgtctcgatctcctgacctcgtgatccacccgcctcggcctcccaaagtgctgggattacaggcgtgagccactgcacccggccgcatatttgatttctatgtttatctacaggtcaagtacagattgcccaagttcaagagaaagacttgattgttcttcctctctttccttttcacatgcaacacgtggattgagtgagtgctgaaagcctcattacaatgctaccctatccttctccattttttcttttcacctctcccctcctgcccactttttccctttaaatattgaagccctttaaatcctctttggaaaaagtgctgactccagatcctcttgtggcttctgtctatttcctgggcatgtcctcaatgttagctaaaataaacctctacagtgattgagaccttctgagacttctggtttacaagtgaaatttcatgaagctatctcaagacatccaaaaagactgcttctgaaaatgaatcctcacgcttgggaggccgaggcaggtggatcgcttgagcccaggagttcaagactagcctggggaacgtggcaaaaccctgtctctacaaaaaataaataaataaattaaataaaatacaaaaaattagccacgcatggtggcacgtgcctgtagtaccagataccctgggagctgaggcttcagtaagccttgattgtgccactgcactccagcctgggagatagaaaggccccatctcaattctaaaaaaagaaggctgggcacagtggctcatgcctgtaatcccagcactttgggaggccaaggcaagtggattccctgaggtcaggggttccagaccagtctggccaacgtgatgaaaccctgtctctacaaaaaatactaaaattagctgggtgtggtagcagaagcctgtaatcccagctactcaggaggctgaggcaggagaatcacttcaacccgggaggcagagattgcagtgagccaagatcgcaccattgcactccagcctgggtgacaagaatgagacttcgtctcaaaaaaaaaataaaaataataaaaagaagaaaatggctgggtgcagtggctcatgcctgtaatcccagcactttgggaggccaagacaggtggatcacctgaggtcgggagttcaagaccagcctgaccaacattgagaaaccccatttctactaaaaatacaaaattagctgggcgtggcggcacatgcctgtaatcccagctacttgggaggctgaggcaggagaatcgcttgaacccgggaggcagaggttgtggtgagccaagattgcaccattgtactccagcttgggcaacaagagcaaaactctgtctcaaaaacagaagaagaagaagaaactgaagtacaaggccaaaggtacttgaagtaggcttaacttcttcctgaagcaccattactatttgatggtaaatctatgtttttatactttaggtacaagtgatgaaattcaaggccaggcatagtgactcatgcttgcaaccccagcactttgggaggccgaggcaggaggatcacttgaggtcaggagtttgagaccagcttggccaacatggtgaaatccattctctactaaaaatacaaaaattaggccaggtgcattggctcacgcctgtcatctcagccctttgggaggctgaggcgggcagattacttgaggtcaggagtttgagaccagcctggccaacatagtgaaaccccgtcgctactaaaaatataaaaattagctgggtgtggtggcgcacacctgtaatcccagctactcaggaggcggaggcagcaaaatcacttgaacccaggaagcggaggttgcagtgagccaagatcacgccattgcactccagcctgggtgacagagtgagactccatctcaaaaaaacaaacaacaacaacaacaaaaacaaaaattagccaggcatgatggcccacatctgtagttgcagctactcagaaggcttgaggcaggacaatctcttgaaccccagaggcagaggttgcagtgagctgagatcacaccactgcactccagcctgggcaacatggcaagactctatctcaaaaaaaaaaaaatcccgaagaagcaaacaaaaacaagtgacaagtgatgaaatccaaggtcaaagattaagaacattgacttgaaggagaggggacagtcacgagaaggaaatgtattttcttttccaccagcatgaggacccagtaggtacaaagtttaccaagggagaagcttgggtggggatagtgattgccaaacgctccccgcagctgtggttgctcttgccttggggacagttcactcaaggtcactggttattagagaacatcaattgtggattgcagaactccatagccaccaacataactcaagtcccggttgggcttttcactgagaaatggttgtgtggcattttatcaacacatcacaggccctgtggaaaaaggcttggcttctaattaattggattaatagccaacttccaaatcaattgtttttcttaatgcactggcaaaagtcatttacggagtgaaaacctgagaacatctactattcaatcatctttcctgaagagataagtggtaagagtaactctgcccaacatagtatgaagtcttaggtttttcaagcagtaaatgaatactgaatgaaagctaagcataaagataatacattaatggccgggcgtggtggctcatgcctgtaatcccagcactttgggaggccgaggtgggcggatcacctgaggcgaggagttcgagaccatcctgtccaacatggtgaaaccccatttctactaaaaatacaaaaataaaaatagccaggcatggtggcgcatgcctgtaatcccagctactcaggaggctgaggcaggagaatcgcttgaacactggaggcagaagttacagtgagccgagatcacaccgctgcattccagcttgggcaacaagagtaaaactctgtctcaaaaaaaataaaataatactacattaatataaaatcatgtggacaactggagtgaaaaaaaattcaaagagaaaaaatggtaaaaccttgctttttttctttttttttgggacggagtctcactctgtcgccagtctggagtgcagtggtgtgatctcagctcactgcaatctctacctcctgggttcaagtgattctcctgcctcaacctcccgagtagctgggactacaggcatgtgccaccacgcctgggtaacttttgtatttttaatagagacagggtttcaccatgttggccaggatggtcttgatctcttgacctcgtgatctgcccgcctcggccttccaaagtgctgagatttcaggcgtgagccaccgcgcccaaccggtttttttgttttgttttgtttttgagacagggtcttgctctgttccccaggctggagtgcagtggcgcaatgtcagctcactgcaactgctgcctcccagactcaagtgatcctcccacctcagcctcccacgtagctgggactacaggcgcctgccaccacccatggcttattttttttgtatgtttttgtagagacggggtttcaccttgttgcccaagctggtctcaaacttctagggtcaggcaatcctcctgcctcggcctcctaaactgctgggattacaggtgtgagccaccacatgtggcccaggtgttttctttaagtgggtgatggtgacgatcaactcccttaggtatttagagtccaacagatgtatttgagaatggaatagttttagtttcaaagatcactatttacacaatggcaagtaattatgtctttgcaactgtatacactaaacattttaggtgtcaggttaaatactaggtggaacagaatttgtcacaaaattttacagtatgtaggaacaaaaaaaacactaatgaaaacaatgacaaatattggccttttaggtttgaactcaccgttaatggcaccattttattaatttgccatttcatatgatgttttaaccctaaattgctggtaagttttgtagctgaattttcttagcatttctggctaactatgctgtgttctttagtttactaacaatttttgtttctgattccctaatgtttagccatccttacattcctcagataagctctcctaagctgttattatcctggttaagcagtatgtggtatcttacatttatcttaagaccaggtgataggagtttttctggcgaagaaaactactaggtttgagtaccgaaaaaattactttcgcagaatgaattgggaatctttgaattataatggcaacaactcaagatttgtatgcatgatattattttatttttcgagataggatcttgcttgctctgttatccaggctggcagtgcattggcgtggtctcggcccactgcaacctccgccttccacactcaagtgatcctcctccctcagcctccagagtgactgagactaagccaccttgcccagctaatttttgtatttttagtacacacggggtttgccacgttacccaggctggtctgagctcaggggatccacccacatcagccgtccaaagtgctaggactatagatgtgagccagcgcacctggcccacaatattaagtgaaatctcactgtcttttctcttccagtttttaggtttttgtctcttcattcagttttgggaacttattagttcccattatctagacttaagaatgttgtatgggccgggcgcggtggctcacgcctgtaatcccagcactttgggaggctgaggcgggcggatcacgaggtcaggagatcgagaccatcctggctaacacggtgaaactccgtctctagtaaaaatacaaaaaaattagcctggggtggtggcgggcgcctgtaatcccagctagtcgggaggctgaggcaggagaatggcgtgaacccgggaggcggagcttgcagtgagctgagatcgcgccactgcactccagcctgggcgacagagtgagactccgtctcaaaaaaaaaaaaaaagagaatgttggtatgaaataggaataattctctttgattttttttagcttatctttcctgcctaggttattaaatagcaaatgtttgttttttccccctgctttgcaggggcgtattgatctgccacctttttcaagaaccagtttagggccaggcacagtagcttacacctataacccccgcattttgggaggccgaggcgggcggatcacaaggtcaggagatcgagaccatcctggctaacagggtgaaaccccgtctctactaaaaatacaaaaaattagctgggcgtggtggcaggcacctgtagtcccagctactcgggaggctgaggcaggagaatggcgtgaacccgggaggcggagcttgcagtgagccgagatcctaccactgcactccagcctgggcgacagagtgagactctgtctcaaaaaaaaaaaaaaaaaaaaaagagatcagcctgggcaacttagtgagacccctgtctctactaaaagtctaaaaattttttaaaagccaagcacaatagctcacgtctgtaatgctaacactttgggaggccaaggagggtagatcacttgaggtcaagagttcaaaaccaggctggccaacatggtgaaatcccgtctccaataaaaatacaaaaattagcagagcatggtggcacatgcctgtaatcccagctactcaggaggcagtcagctgagattatgccactgcacttcagcctgagcaacagagaccctgtctcaaaaaaaaaaaaaaaaagaaaaagaaaataaaaagaaagaaaaaaagagaaatccaacagcctaacagaaaaatagtcaagggagatcaacaagagactagatctctgaagaaatataaatcataacttaatataaaaaaaatatacagcccgactaacaatattcatatttaagtcagtcttttaagtgactttcaaacacacttaacaaaaagcaagctaaaagttttataaaagaaatgatagcttctctcacctggtacagcaggcaactttttagtcaaaataaggtcaggaatagtttccccaaaacagccagacaccctctgtcaagacaaaccgtccttagataaaaagatgagcaacaagctgctgtgtttcttttatacgaattaggctcttgattggataattgaaataacacggattctcacaagcagaaattttcacacatcaggttagattgttttcttaattcatccaataatgtaatacctcagttctataaacgttgaagaaattcacttctcacaaggagagactgggggcaaatgcatatagcagttcacttgaatgtccccacataaaaaaaaataataataacaacaacaagaaataaaagatctgttttaccctggttggctttcagttgaccatttcatttggttcacctgctgagaattcggtaacgatgttactgtgaggcaggacgacaggacgacttctagccactgtatccttcttagcactgtttcccagcactaactgagcagaagaatcacctggcctcttggtcaaaacacagattcctaagtcccgcatgtatacagtaattccagttaagcaggtctgcagcaggaccaggagtgtgcatttttcagaaataccacctgcccccaccagaaatctttaaatatttttatcatgctctcaataatagacatttcagagggatgagttgaaggagggctggcatttgttcactacaaaatcatatcattgaaggaatcttggaaaatatagaccagaaggaaacaaagggagaaaaataagcacaggagccgggcgcggtggctcacgcctgtaatcccagcacttcgggaggccgaggcgggtggatcacaaggtcaggagatcgagaccatcctggctaacacggtgaaaccccagctctactaaaaatacaaaaaattatccggtcatggtggtgggcgcctgtagtcccagctactcgggaggctgaggcaggcgaatggcgtgaacccaggaggcggagcttgcagagagctgagagctgagatcgcgccactgcactccagcctgggcgaccaagcgagactctgtttcaaaaaaaaaaaaaaaaagaaagaaagaaaagaaaaataagcacaggaaaaaatactgtaaaaaaatcaagatattaaatattaactgtgcttatgcttggaagtggaactatatgtattattattatttacaggttttatttacagactaaagggtgcagaaggcatgaaaatattttgtgatactaatcccattttggagagaaaaaataagcactggccaggcacagtagctcatgcctataatcccagcactttggcaggctgaggtgggaggatcactagaggccaggagttcaaactggacaacataatgagatactttttttttttttttttttttacatggaatctccctctatcgcccaggctggagtgcagtggcaccttctcggctcactgcaacctccgcctcctgggttcaagcgattctcgtctcaggctcccaaaatagctggggctacaagtgtgcaccaccacgcccagctaatttttttttttttttttttgagacagagtttcgctcttgttgcccgagatggagtgcaatggcgtgatcttggctcaccgcaacctccgcctcccaggttcaagcaattctcctgcctcagcctcccaagtagctgagattagaggcatgcatcaccacatccggcttattttgtatttttagtagagacagggtttctccgtgttggtcaggctggtcgcgaactcctgacgtcagttgatttgcctgccttggcctcccaaagtgctgggattacaggcgtgagccaccacgcccggctaatcaggctgagtctcgaactcctgacctcaggtgatctccccacttctgcctccctaagtactggcattacaggcgtcagccaccacgtccagccactttctttcatttctgtttctgaggtccattgctccattcagtagaaaaggggtggcttggagaggatttgccaaccttcccatgatttccatcaccacatcccccaaaatgcacaacctaagtttaaaagcatagcaactggtcaggtgtggtggtttacgcctgtaatcccagcactgtgggaggctgaggcaggcggatcgcctgaggtcaggagttctagacaagcctggccaacatggtgaaaccccgtctctactaaaaatataaaaattagccgggcgtggtagtgtgcacctataatcccagctactcaggaggctgaggcatgagaattgcttgaacccaggaggcggaggttgcagtgagctgagatctcaccattgtactccagcatggttgacaagagcaagactccgtctcaaaaaaaaaaaaatagaaaaagaaaaaagaaaatgacccagctgagttatataagcaggtgatactaatcttttatttatttttctttcctttttttttttcagatggagtctggctctgtcacccaggctggagtgcagtggcacgatctcggctcactgcaacctccgcctcctgtgttcaagcaattcttctgcctcagcctcctgagtagctgggacaacaggcgcgtgccaccacacctggctaatttttgtgtttttatggggtttcaccatattggccacgatggtctcgaactcctgacctcgtgatccacctgccttggcctcccaaagtgctgggattacaggtgtgagccaccgcgcccagccgatactaatcattttaagtgctggactgcagtgttataatctggggttaagtagagccacctaaataatttgccattttttctctccaggaccactatactgaaatgatccctataaccaaaattttattcatggtcttcgatcagttgcactaatttccttaggatccaaggattgatgaaggtttctcgtggctcataaagtccaaattgggaatcttggtatttgaatattaatactatctgtaggcaagaaaaatcgtaacaatttcagaaaaaaaaatgtagggagtgcagaactttcaaatatttaactaaatggcaagaattctttgctcttaaacacccatatatggaaaatagagcaagggttttttggccaggtgttacgaataggatgacacttagcaacttcttggtaccctcattttcgtattttcaaggagactgaaatacaatgtgatcctttcttttttttttcttttctttttttttttttttttttgagacggagtctcactctgtcgcccagcccaggctggagtgcagtggcgcgatctcggctcactgcaacctctgccttctgggttcaagcgattctcctgcgtcagcctctcaagtagctgggattacaggcacacaccactatgcctggcaaatttttgtatttttagtagagatggggtttcaccatattagtcaggctgatctcgaactcctgacctcaagtgatctgcccaccttggcctctcaaagtgctgggagtacaggggtgacccactgtgactgatcacccggccagtattttagttatttgtagagacaagggccggctatgttgcctaggctgttcccaaacttttgtgctcaagtgatcttcctgcctcgagttcccgaagtgtggggattacaggcataagccaccatgcccagcaggagctcttaaggtctgcttgaatggtccttgttttgctgggtacagttagttacattttatcattttttttttttttgagatggagtcttgctgtgttgtccaggctgccgttcagtggtgcgatcttggctcactgcaacctccgcctcccagacacaagcgattctcctgcctcagcctcctgagtagctgggactacaggcgtgcacaaccaggcctggctaattcttgtgttttcagtagacatggggtttcgccatgttggccaggctggtctcgaactcctcatctccccacctctgcctccctaaatattgggattacaggcgtcagccaccacttccagccacgttctttcatttctgtttctgaggcccattgctccattcagtagaaaaggggcggcttgtaggagatttgccagccttcccattatttccatcaccacgtcccccaaaatgcacaatctaagtttaaaagtgtagcaactggtcagatgttgtggctcacgcctgtaatcccagcactatgggaggctgaggcgggcggatcgcctgaggtcagaagttctagacaagtctgactaacatggtgaaaccccgtctctactaaaaatacaaaaattagccgggcgtggtggtgtgcgcctgtaatcccaactactcaggaggctgaggaacgagaatcgcttcaacccaggaggcggaggttgcagtgagctgagattgcaccattgtactccagcctgggtgacaagagcaagactccatctcaaaaaaaaaaaaaaaagaaaagaaaagaaaaaaaagaaaataagaaaatgacccagcagagttatataacaggagatattaatcattttaagtgttggactgctatgttataatctggggttaagtagaaccacctaaataatttgccattttttctctccaggaccactatcctgaaataataatccccataaccaaattttattcatggtctttgatcagttgcactaatttccttaggattcaaggattgatgaaggtttctcatggctcataaagtccaaattgggaatcttggtttttgaatattaatactatctgtaggcaagaaatactgcaacaatttcagaaaataaaatgtagggagtgcagaactttcaaatatttaactaaatgggaagatttcctggctcttaaacacccgtatacggaaagtagagcaacttcttggtaccctcattttagtatttctcaaggagactgaaatacaatgtgattatatatataattttttgagacggagtctcgctctgtcgcccagggtggagtgcagtggcgtgatctcggctcactgcaagctccacctcccaggttctcaccattcttctgcctcagcctcccgaatagctgggactacaggcacatgccgccacgcccagctaattttttgtatctttagtacagatcgagccaggatggtctcgatctcctgacctcgtgatccacctgccttggcttctcaaagtgctgggattacaggtgtaagccaccacgcctggactttttttttttttttttgagacggatcctgcctcagcctcttgagtagctgggattacagatgtccactaccgtatcggctaatttttgtatttttagtagagacaaggttttgccatgttgggcaggctggttttgaactcccaacctcaggtgatctgcccacttcagcctcccaaattgctgggattacaggcgtgagccaccgtgcccagccacaatgtggtgtttattatacagttggattgacttaaatacattcatggcatttaaaatgaaattttaattattacgattcctaaaaaacaaatgaactaaaactcaattacttccttcagaacaaaaacgttacactcaaatttctcccatcagatctcatttggttcattaaatctccctggtgaagaggatggattccagaaacccagtgccaacaatgaaatatcaccctcatacttggcccacgagaacatcatataccatagtagagatttcgccctcctcttggcccccgggggagactactgttggctcctagcactatcagctggctaggaatgtgtatgcaacacttctgaagccttggaaacatagtacagaatgtacccattttaggatgattcaactttatgatttttcaactttttgatggtataaaagcgatacataatcagtacaaaccatatacataccaccatttttcagtacagtactcattacatgtgtcaacactttattataagataggttttatgttagatgataacaccagcatcttgctcaataaattgaagccagctttttcaacagagaacattattagaatgaaactagatgcaagaacaggaaagtaaacacctgtgtcatgttcaacaagactgaactacggagcaaagaatcacacagtgttgcaagatcttgaactgactagatgataggattacaaaaaccacacagctattgctggaaaattatgtcatgcagagaacagactggcacgattacatatgtgggtttgtcctacacaaaccagacctttaagtgaaacaagtctatccaaccatcttcccataaaacctagtttctatggaaaacaatcaattaagctaaacccccacattttagatgtatattcatttatagaagcccaaaaggacagtggggttacaaataattttatattttagatgctttcataatttaaaaagttaacattacaatttgtgttactaaaatgcaaaaacaggattggcatgctgcctcatgcctgtaatctgaacattttgggaggctgaggcaggaggacttgagcccaggagttcgagcccagcctagggaacacagggaaaacccatctctacgcaagacgtaaaaactggccagctgtgatggcatgcccctgtagtctgagctacttgggaggctgaggtgggaagatcgccttgagcccaggaaattgaggctggagctgtgatgacactagtgcactccagcctggggaacagagtaagaccatctcccccactgcccgctactctcgctaccaaaaaaacagcaaaagcaggctagactcctctaatttcagggagagctagatgtttttttttttctctttttttcagttttgctctgccgcccaggctggagtgcagtggtgtgatctcagctcactgcaacctccacctcccgggttaaagtgattctcctgcttcagcctcccaagtagctgggattacaggtgcctcccaccatgcctggctagtttttgtatttttagtagagatggggtttcaccatgtaagccaggctggtctcagaactcctggcctcaagtgatctgccagccttggctgggattacagatgtgagccaccacgcccagcctcattttttttgagactgggccagggaagggggcagtgggccagggactgtctctctctgttgcccaggctggagtgcaggatcgtgatcatggcccattgcagcctctacctcccgggttcaagcaatcctcccacctcagcctcccaagaagctgggaccacaggcatgttccaccacacccagcttatttttggtaaagatggggttttgccatattgcccaggatggtctcgaactcctgggttcaagcaatccacccagcgttccaaagtgctgggattatgttgcgaaaagctgagtgttgggagaagctgaggcagggcttgcattctgacataatgtaaaagagtcttggaatatgtccagggtcaagggtctaaaaccccttgtggtctttggaacaccaagctctgtgctaaagggtggaaggctgccctgacgcaccataatctaagcccagggcataaaatccctcgtggcttggataaaatccagggcctgtggctctggaatgtctagacttgctggctccttgctctcccaggatcgactgtaacttgagttaaaagaacctgctctccatcatctcaagtagcagagcaaatgctaaaccatcacagctgtaaatcatgtgcttaatgcaaggtgcccttctgaccttcacattctcaccatctgtttctttgttggattaccaataaatagtgtgggctcccagagctcacggccttcacagcctccaccatcccgatggtctgctggtcctacttctctctcaaactgtctttttctcaatcctttgactccactggactttgtcacccccacgacctggtgttgggtctggtcaccctaacagggttacagatgtaagccactgcatctagcacccacattatctttgaaagcagttgagtctttggcatgcaagaacattcctgcactgcagtgaatctgtgaacttactactacggatgcataccaattcacaaccagtgaaaggccacgtacctaaaaaggtgtttactgcctcagaatatacttgacaattgtggaaacgttagcaatctactcttccaagattccttggagttgtcatacataagcaaatccatatggactgaggaataaggaggaagaggataaggcttatggaagataaatcatgttcttgcctccggtaggtaggattcaatttagtccctgtataaatgactccatgttaatttcccttcccatatggatgctaatccagtgactcataagcttagaccaacaagctcagcatgaaagccaagaaacttctgtttctcctaaattccgtagccgactctcatacagcgagaccctcactgggccactctgggaatgactacaaatgaatatgatggagtccatgtgaataatggttgagcaggtgaggaaaagggtcacatcacagacctcaagtcagacccactgatttggaaagccaacagtatactcagaagcaaagcaatgttatactttgttttttctgagacagaatctcacactgtcacccaggctacagcacagtggggtgatcgtggctcactggagcctcaacctcttgcgctcacttgatccttccacctcagcctcgtgaggagctgggagcacagatgcatgccaccatgccacactaatttttttttttcttttgtagagatggggttttaccaagttgcccaggctagtctcaaactcctggcctcaagcaatcctctcaccttggctacctaaagtgctgaacaaccacagagaagcactctatttttccctctattacattagcaaatacacagaaggacaatttagaaacagattatacccaggaacatatgtcaggattacttatggaggttttattatttttatttatttttgagactgagtcttgctctgtcatcaggctggagtgcagtggctcactgcaacctccgcctcccaggttcaagcaattctcctgcctcagcctccctagtagctgggattacaggtgtccaccaccatgcccaattaatttttgtatttttggtacagacagggtttcaccatgttggccaggatggtctcgatctcgttgaccttgtgatccgcctgcctcggcctcccaaagtgctgggattacaggcgtgagccaccgcccctggactacttatggaggttttaaaaaatcttttaagtccaggcctgacgtttagagaaggttacaaaggcggccaggatctgagtatttccaaaaagctctggaggcagcattgaggtttccttccagttgaatcactgactttaggtcgactggggtactttgggttttttgggccattttttgggggtgtgggaagcttttctcacagatttactaggagtggtgaaaaacttggcctctggcttttttggagtctgtctcgcatcttttttccccagcgaaggacttttttccttcactgcctcttctttgatttttggcttcttctctgggcttttccctggggtctcagactctgcagcttttggggtctcagatgctggcaaagcctttcttttcttcccacgaggtgtgctgggattaggactctttgctggagacttctttcctgtggcatgtttttgaatctaagaaaaaaaaaagtaagtttaatatagaaaaagccacaaaacctgacactctaactccaggagttactgtttttatttgtatttatttatttttcagactgagtttcgctcttgctgcccatgctagagtgcaatggcacaatctcagttcactgcaacctctgcctcccgagtagctggtattataggtgtgtgccaccacgcccggctcattttttgtatttttagtagaaacagggtttcaccatgttagccaggctggtctcgaactcctgacctcaggtgatccacctgcctcggcctcccaaagtgctaggattacaggcgtgagccactgtgcccggccaagttactgtttttcagcgcatggccaagttactgtttttattagttaacccccaaaaggtacacctcagtatgatgacagaaataagctgtattccactattaagaatgaggtataggtgaggtggctcatgcctgtaatcccagcactatggaaggctgaggcaggtggattacttgaggccaggagttcaagagtagcctggccaacatggcaaaaccccatctctactaaaaatacaaaaattagccaggcatgttggcacacacctgtaatcccagctactcaggaggctgaggcacgagaattgcttgggcacgaaaggtggaggttgctgtgagccgagatcatgccactgcactccatcctgggcaacaaagtgagaccttgtctcaaaaaaaaaaaacaaaaaaaaactgtgaagacccagaggtcttcctggtccaatcagaggaaaaccacctttccctatgactgaggggagggaatcctggaagcaccatgaggagcacagcagagacacatgggagcaaatcctgagtcttccaaatgtagctgcacatccctggcacatggtgtagggcaagggttcccagattctctgtgtaaaagccaactggtggctgagtgcggtggttcatgcctgtaatcccagcactttgggaggacaaggcgggcggatcacctgaggccaggagttcaagaccagcctggccaacatggcaaaaccccgtctctaccaaaaacacaaaaattagctgggcatggtagtgcgcgcctgtaatcccagctactcgggaggctgaggaaggagaattgcttgaaccagggaggcggaggttgcagtgagctgagatcatgccactgcactctagcctgggtgacagagtgagactccatcttcaaaaaaaagcaaagcaaaaaaaaaaaaaaaagccaaccggttgggactaggtgtggtggctcacacttgtaatcccagcactttgggaggccaaggtgggaagactgttttgacccccggagtgtaagaccggtctgggcaatatagcaagatcccatctaaaaaaaaaaaaaaaaaaaaggtacaataaatcatgatatgataaccaccttcacagttctttgggttcactctagtatttttcatcatttattgctcagcacagtacctgcctgacacagtagccactgaaccaatccattatgaacagtaaatattaaaacaatacctctactttttcattagctggagtcttctttcctattggtaccagctgtgggatttcgtcttcggattcatttgttgctttaacttgggcttttcctctgccacgttttttcttcccatgctctggggtctgttccttctttgattcaggtttcttcactgtagtatcaccactttcaggtgccacatcatctttactaagaactgatgcagtcttcctagcctgctgcctcttcttcttcctctccttttgtttttcaaaatttctttctcttcgttttctccttgcctcctaccaaaaaacaccatacaaacattttagcaggaacagttctgttggttaacaaacggcatagatgtaccacgtgcagttttgattatccataagcccctaaatggacctcgatctatacagagaacaaactccctaaccagcactggaacctcaaccgcagtttttgactcacagccaaacatgcattttatgcagtaaattatataccggcatttcagaatctgactatctaaagtatacagttaagagacttttgtgaaacacagtatggtttagagtgtaaagaataatactcagctgggcgcggtggctcacgcctgtaatcacagcactcagggaggctgaggcaggaggatcacttgaggtcaggacttcgagatcagcctggtaaacatggtgaaaccccatctctattaaaaccacaaaaattagctgggcatggtgatacgtgcctgtagttccaactactcaggagggtgaggcacagagaatcatttgaacctggaaggcggggggttgtagtgagctgagatcatgccactgcacttcagcctgggcgacagagtgaaactctgtctcaaaaacaaaattaaaaattcattggacacaattaacatggctaaagagagaaacactaggagatcagtctaacaaatagcaaaaaattaaattttctctccttccgaaagcttcttttgctagagtacgagtaatactgaaaacctacaaaccaagctcaggaggtatctgtgagcataacctccgacatccaaatacgtgcacattaggtgaactggtgtgttgaagttatcccagtcccagtcccaacgaatgtaggtgtatgagtttgtcctgtgatgaaacagcgccttttctagggttggctcttgcctgttacccttttccctgagctatcaggattaaactccagccacctacaaccgtggatgggaataactgggtaaataattatgtcaattccttttattactgtttcaaatgtatatatagctcacatttatttcaatgtttaatattttaaatgttttggtctttatttagaagtatggtgatgtttctatgaccggaaatatgtggtaggaacttaactcaggccccctcaaaagccagttaatccaggccaggcatagtagctcatgcctgtaatcccagcactttgggagcccaaggcaggcggatcgcttgagctcaagaattcaagatcagcctgggaaacagggcgaccatgtgtgtacaaaaaataatttaaaaattagctgggcatggtgaagcatgcctgcagtgccagctactcgggaggctgaaacaggattgcttgagctcaggaggtcaaggctgccgtgagccttgatcacgtcactgtgctccagcctgggggacagagtgagaccctgtctctctaaaaaaacccagcaagcactggatctaacaaaaataaaaaaaaaatccaatttatcaataaatacaagatatttctatcttaatgcgcattactaacatcaactacctcatgtaaagtgacaaaagcatacccattttacctcatgtaaagtgacaaaagcacaaccaccacaaaaccagaagataactgaaaagtcgggcagcgatgatggtctacttctctcctagtgactgaatttacacccttcattattcattctgtaagtatttaaaattctactaacttttttcttcttattaagcaaagatcttttggtggcttcatcccaattgctgacaaacgaggaaaagatgggaagtgcagccgatttctcagttttcacaaacaggagtttcacgctctcccacttctgaaacaaagaaaagagtaacatcgtctacatatactttgtttcttttaaatgaacaatcaattgatgcacctgtaatactgtacctctggcaatttttctgaaagtcctttggtgacagcaacaatgttttcaatgatgtgctcaatttgcattccaacgtgaccaatacgtatagcactgaaatttaatatagtattagacaagattttaaaaaaccatttttcaaaataaaccaggcaggtatatgagaaatataaatacataatcctcaagtttttctttttcttttaaaaaggtagaaatattaatcccgggcaacatggcaaaatcctgtctctaccacactaacaaaaattaactgggcatggtggtacatgcctgtaatcccagttactcaggaggctgaggcagaaaaatcacctgagcccaggagctcaaggctacatacagtgagcccagatctggcgactgcactccagcctgggtaacagggaaaaacacagtctgaaaaaaaaaacaaaacaaaaaaacaaacaaaaaaatcccattaaaatctttaggttctaaatatattttatttcatttttgagacagggttttcctgtcgcccaggctgaaatgcagtggcacaatcaacgtactgggcttaagtaatccttccaactcagcctccggagtagctgggactacaggtcacccagctgatttttgtattttttgtagagatgggttctcactcctgagctcaagtgatccaccaggctggtatggaactcctgggctcaagtgatcctcctgcctcaacctcccaaagtgctgggattatacacatgagtcaccacacccagcctaaatatgttttaaaggaagattatcatctttcatgtactagaaattccttctacctaaagtaaaatgtcacatcatgaaggggtgactttttttttttttgagatggagtttgctctgtcgcccaggctgaagtgcagtgacgtgatctcggcccactgcaaccttcgcctcctgggttcaagcaattctcctgcctcagcctccctagtagctgagattacaggcgcatgccaccacgcccagctaattttttttttttttttttgagatgcagtttcactcgttgcccaggctggagtgcaatggcgtgatcttggctcactgcaacccccacctcctgggttcaagcgattctcctgcctcagcctcccgagtagctgggattacaggaatgcgccaccacgcccggctaattttttgtatttttttttttttttttagtagagacggggtttctccatgttggtcaggctggtctcaaactcccgacctcaggtgatccgcctgcctcggcctctcaaagtgctgggattacaggcgtgaaccactgcgcccggcctaatttgtgtatttttagtagagatggggtttcactgtgttggccagactggtctcaaacacctgccctcaactgatccacctgccacggtctcccaaagtgctgggattacaagcgtgagccaccatgcccagccgaggcagtgattaaagagctggtagcacctgactgtgaggttaggcgcattgggaggcagggccagaggaggttctacctttatcttagacaaccccatgtcgctgagtccgccttcaagctgttctaaagggacctacctccaggagggtcacctgctctctctatagttctactgctctacccagccgccatgttcaagaataaatagttctgtggctgggcgtggtggctcacgcctgtaatcccagcacgttgggaggccaaggtgggcagatcacgaggtcaggagaccgagaccatcctggttaacatggtaaaacaccgtctctactaaaaaaatacaaaaaaattagctgggcattgtggtgggcgcctatagtcccagctacttgggaggctgaggcagaagaatggtgtgaacccggcaggcggagcttgcagtgagctgagatcaagccactgcactctagcctgggcgacagagcaagaactctgtctcaaaaaaaaaaaaaaaaaaaaaaaagagtaaatagttcttgtccctggtggaatagtgtctttcagctacgagcaagaccatcccttcaggtgaaacagagtgcaggcagaagcccagtgggaagcctggagggctcagcgctggggccagaaggaagtgagccagaaggaaggctcactgtcggcacagtgtctgcggaatgaggaatgagacggactgttgctcctctctctcttcagccaaagactgggcactgcccactccctgtgcctgtcaccacctgcctgcaagcacacctgagcatcccagatggaaagatggtgggggggaagaagggagaggaacagaagtggaagaggaaaataaattcttttgctggggaaaggtaagagaggaaataaagaatgatttctttttttctcaattgtctgcaactttctttaagctgttgcttttgccttggaaaatccccagtggcaggagactgctgctcctttacctgccttcatggtaccatcttcttctcccagatactcatgggtcccataaacaaggcctgaacttctagccaaccacttccatgagccactactttgacattagcctttaaccaaaggggtaggggtctaggctccgtgaccaactcttctaggctacttcattacacctgatgaagggattcccagcagcaggctaaagacaacaccagagaccacctgtcctgcccaccagtaccctgctctgctctacctggagacactcccctggggtcaggcctccctggtgagcagaggcaagaagtctgtgttgttttctgccgactgtgtccactgggtctgcacggctcctggggaatctctgggtggaagggcagtggcctacagctctgccttactggcagctagccatctccacaccgcagtcagcaagtgcagtacttcataaaatgtattttcaatacatttaaaacctgccctacctccccaagctgatacactgccaataatacaaacttaagtcacttctcagcctaataaaatagcctgaaccgcatcctttgctcagccagaggttggaagcaatcactgccctaaaacatctgttctagtaggtaagactaggtgtgggggctccgcctagctcagtatccagggtaaggttaaaccaatatgacaacacacacaccaaataggcagatgaacaggataagtgctgaattcatttaataggaagttaaaccaagaatgaggtggatcttcacgttaaggggtaatatggtgcttttaaaggacaatctgaggccaggtgtggtgggtcacgcctataatctcaacacttttggaggccaggacaggaggaccggttttgtctaggggttcaagtctagatggggcaaaatagtgagaccccgccgctacaaaacattgaaaaattagccaggtatggtgatgtgtgtctgtagtcccagctactcaggaggctgaggtggaaggattgcttgagccaaggagttggaggttgcagtgaactgtgactgcaccactgagtgcagtggcacgataaaggacaagctcaaagcctagaactagtcatgttctccaagcattcatcttactctccttgcttttcttagtatctggagctgccccgtccaatgcagtgaccatcagccactagccacatgtgcctattttaaattaactaaaaattcagcttctaacacagtagccacatttcaagtgctcaatagctacatacaaatagtgcctactgtatgagacagcacagatgcaggccatttccatcacagtagaaagtgctatcagacaacattgttctagagaactgaactttttttttttttcatttaaagacagtcttgctctgtcattcagactggagaacagtgacaagaacatggctcactgcagtcttgaccttctaggctcaagtgatcctcctgccacagcctcctgtgtagctgggagcacagggatgcaccaccacacctgactaatgttcttgatttttctgtaattggctgggggagagggtctcattatgttgcccaagctggtcttgcactcctgggctcaagcgatcctcctgcctaggcctcccaaagtgctgggattacaggcataagccactgcacctgacccgagaattgatcacttctgaggaatagattttagttttaaaaaaggatctggagccattaacaaaatctttttaaaaaggccaggtgcagtggctcacgcctgtaatcccagcactttgggaggccaaggcgggcggatcatgaggtcaggagatcgagatcatcctggctaactcggtgaaaccctgtctctactaaaaatacaaaaagaaattagccgggcgtggtggcaggcgcctgtagtcccagctactcgggaggctgaggcaggagaatggcgtgaacccaggaggcggagcttgcagtgagtcgagatggtgccactgcactccagcctggcagacagagtaagactccatctcaaaaaaaaaaaacaaaaacaaaaaacaaaacaaaacgaataagtatatataaaatcattgtcaaatacaagattaaaagaggcacacatgaatgccttttacctacctgcaagaaccacttttagaaatgtttaagactgttccacctatacagtcattgatctctcttgataaattcttggacagaaggtttacagatactggaactctacaaaataaacacacaggcattcagaacacaatgcatacacacctagaagcttcatgctgctaaagtccagtcattactaagaaacttacttctttctttgatagaaatgtctcccaatgagtgagggtaagagccgcctaattctggcatcagtaaggaagaaatcaaaactgctcagaaggcggagcttggcttcataggatttatattccttctttagagtttggagggagataatctaggaagtatagagaagaataaaaacaagaagttaggaatctaaacaaggagaagaaatacttaggcaacaatttggatttggatttaaaaatgtcctagagccatgcctctatactttaatgaacacttgagggcctaaaatgtgccaggcactacgctacatgctgggaacactgagacaaatgagaaaagaccccagctaaagcaacttagatctaggtgggcaacatatatatattattatacatatgttgctgtatgtgcttacgcctgtaatactagccctttgggaggccgaggtgggtggatcacctgagctcaggaattcaagaccagcctggccaacatggtgaaacctcgtctctataaaaatataaaaattagccgggcatgatggcaggtgcctgtaatcccagctattcggtaggctgaggtgggagaatagcttgaacctgggaggtggaggttgcagtgagccgaggtcctgccattgaattccagcctgggcgacagagcgagactccaaacaaacaaaaaaacttagataccttagatccagagggtaataaagacaagtacaccaactacaaaacagcaaatcagagaaaaacaagatgctgtggaagtacagaggaatgacacgagccacctcttttataatttgcaagatataaaagctactgatgtacacgccaccacaaattaaattaaaaagagaaaagtagaagaaaaatactaggaaatatagcaatgtatttgtgataccatttcgcctgaattaaatcctctaaataacttgaaaatattaaccaggcttcctacctgagaaacggttttaattccatgcttgtttaaaagctttctataaaactgttctgtcttttcaggagttgaattgggttcatccttcgtaaataaacagatatcttctgaatctgatcgaatactatgaggcaaggtcctacaaaatacgtgaaaagaaaccgaggaaagcattattacacacattatgcatgtttgtatcacacagaatacgcgataaacttagtgttatttaaataacttttagtcatgctagttaagcaaataatgcaccaagaacaacacttaaaaatacatttcatggccggtagtagtggctcaagcctgtaatcccacactttagggaggccaaggcagatggatcacctgaggtcaggagttcaagaccagcctggccaacatggtgaaaccctgtttctactaaaattataaaaaattagccaggcacggtggtaggtgcctgtaatcccagctacttgagagtctgaggcaggataatcgcttcaacccggaaggtggaggttgcagtgagccaagatcgcaccactggactccagcctgggtaacaagaggcaaactccgtctcaaaacacaaaaacaaaaaacaaaactcactttcaatggcaagtaaatcacaaaaacacacaggcccaaatatcaattaacacttgggatacaacaagaattaaaatatacttaaagacttccaaatgcttgcatatataattattatacatatgttgctgtatgtgcacacgtactgtaatgcgctataaaaacctagcttaatcaggacaagcctggttcagaattttaccttctttaaaactcttagctccataaacataataactctttcttcttttcctttttttgagacagggttttgctcagtacccaaggctgcagtgcagtggtgtgatcatagctcacgatagcctccagcatagctgagactccaggcacgtaccagttgggtgtaggcccagctaatttttgtatttttcgtagagacagggtttcgccacatagcctgggctggtcttgaatttgtgggctcaagcaatccacctgcctcagcctcccaaactgctgagattacagtgtgagccaccacactcagccaacataacttttttttttttttttgagatgggagtctcactgtcgcccaggctggagtctctgcaacctctgcctcctgggttcaaatgattcttgcacttcagcctcccaaacagctgggattacagacgcccaccatcatgtctggctaatttttgtatttttaggagacatgggatttcgccatgttgggtcaggatgatctcaaactcccaggcctcaaatgatccacccacctcacctcccaaagtgctgagattacagggatgagtcaccatgcccagcataacataacttttaagaattgaaacagcccaggcatggaggctcatgcctgtaatcccaacactttgggagactgagagggaggactgcttgagcctgagttcgagaccagcctggagaacacagtgaaacctcatctccacaaagatttcaaaattagctaggcatggtggtgtgcacctgtagtcccagctacttggaaggctgaggtgggaggatcacttgagtcaggtcagggaggttgaggttgcagtgaacacagatctcactattgtactccagctgggcaacagcgcaagatctcgtctcttaaaaaaaaaaaaaaaaggagagataaaagaatcgaaaccaaaaacatggactaaaccaagagggaccagcaaacacaattatgccacatcttacagaaaataaaatacaagggtttaactcatttcttatgcttacaacctatgttctgaagaagcattctgtataatcaccatggatttcttttccatagacagaaattcactgcagtttttaatagtctctgtacaaaggaataaattgtagccccaaagaatttttgcttgacatggaaagataacagtttctaataaaaaaataaaataaaataaagctgtttaacttattccacctttattctttcgaacaccacgttttcgattcaacagacctgattacgttagctgtccaccaagctctaagaaaactggtgaaatttctagaaaattttagcacatctgaatttctacggttcttttattttttattattttttatttttttgagacagagtcttgctctgtcgcctaggctggagtgcaatggagacatctccgctcactgccactctcctgcctcagcctcccgagtagctgagattacaggcacccgccatcatgcctggctaatttttgtatttttggagagacagggttttaccatgttggccaggctggttttgaactcccgacctcaggtgatccgtccacctcggcctcccaaagtgctgggattacaggtgtgagccaccacatcaagcctctatggttcttttggacatagttgttttacttcacgtcagatttttattataagtttgcaaagtttccattagtaaccatgatgcaattgttcgagttacaaagaataaacacacagataaaaacagcaaaggtagaaaatcacaacttacaatctgaccctcagttctttacttggaattttccataataccaccattaaaaataaactttcattctcattcaaaagcaacccataattgtttttcctggacttgcaatgcgtcaagagagcgtccactgcctttctaacctgcaaagtggaaattagacaaataagtgaaatgttttcacaataacttacacaaataaatgaaatgttctcaatctaatttagcatttgccccctcccacaccttctattttttcccttccaacttctatttcaaggggtaacctccataaccgtatctattaggatcctgcagtttatattcacagaaatctaagaatccatcaaacatgcctaagtacccacttccagtactgtgtgcagaagggcacctcttctacttaaagagattgggctagagggaaacgtgcccctcctgccctcaatgatgaaagcagtaatcccaggaaaaacgcaaagcaaaatgcatttagcatttactgagaactcctggcaattctcctgcctcagcttcccgagtagctgagattacaggcgcccgccaccacgcccacctaatttttgtatttttagtagagacggggtttcaccatgttggccaggctggtatcgaactcctgacctcaggtgatccacccgcctcggcctccaaaagtgctgggattacaggcgtgagccaccgcgcccggcctactgagcaccttcttaccatgtaccaggccaaagcgctttacactcattacctctcccgatcctggataacggggagccgaagggcccactttaaataacgggtaacagacctgcaaaactaagcgattcggtcaagcgctaatgatagggaagctaagccaggtcgccaggtctatctcatctagctccacagcacacttgcaacccaattcactagcgccaggccgcaggaccagggaaagcaggcgcccacccacgtgtgtaaaggggagagacagctgaggcacacggcccgccagcgaccgtcccacagccccggggaagtccgccgagcacgcactcgggttccggcaccctgcgcctcacgaggtaaccgccacactgcttccaagccaccctccccaggaaccactcacctgttctttatccagctgcttccgtgctgtcggggccgctggagtcgaggtggaggttccagtagcggctgcagaagacagcgaggccgaggccgaatcctccatcttgtttccacctcgtgaagaggcgcgtgtgcaaccccactgctggcttctggtgcgcacgcgcgagcaagcccggccccggaagcgagggggcgggaaccgagcctctgtgcgtcatttccgggagagcgtggggtttcgctctccggggcagtggctgctgtcagaatcccttctttgaggaggcacctgctcttccgcttttctccagctttccatgagctgtggggagtagcttgggtgtcctctcactcttactagatagaaatcaagaaagcgccttgaggcgagagaagagtcccgtcaggaggcccagtggggtcctccacactccacggtccccgcctccgggaaggccgcgcgtggcatgggcagagcgcggaatcctggctccactgcccacctgcccgttgactttaggcgacgccaaccccaggctggtgaggagtccctgaaatataaggcacgggagccacccggagccacccgacctgccacgttaagcagcatgagggaccgaaagatgagtctgggccagtctcttaggagcttctggtctcgcagagaggcgggaggtaagatcctgtacaaataagcgtggctggtcgtgcgcgtggctggcgtctggaatcccagcgctctgggaggccgaggcggagggattccaggagttggagaccagtccgtgcatatacgagactccgtctctccaaaaattataaacattagccggcgtggtggtgcgcgcctgtagtcccggctacttgggaggcggaggatggaggatcttgaggaattcgaggctcggtgagttctgatccgcgccactgcactccagcgtaggcagtagagtgagaccttgtcgctaaacaaacaggttaggagtggaggctggataactgacaaatggaataccttagaacaggggagtccaatcttttggcttccgtgggccacactggaagaagaattgcctgggcccatatataaaactaatactaatgatagccgacgagctttaaaaaaaaaatctaaaaaaaatctcgtaatgctttaaggaagtttacgaattcgtgttgggctgtattcaaagcctggcctccagggccgcacgcggcccttgggtaggacaggtttgctttgtaatgtcttcctcccactccacccgcctccccagaggtacccttaccagtgtctcctggaaccttccagagatgttctaggcatgtttaggagatacttctcctttctcttgttggatgggtttaattaatttttttccttttttttttttttttttttgtaatggagtctcgctctgtcgcacaggctggagtgcagtggcacgatctgggctcactgtatccttcgcttcccgggttcaagcagttctctgcctcagcctcccgagtaactaggattacaggcacgcgccacaacgcccggctaatttttgtatttttagtaaagatggggtttcaccatcctggccaggctggtcttgaactcctggacttcatgatccacctgcctcggcctcccaaagtgctaggattataggcgtgaaccaccacggccaatttttttttaaagagggagtcttgccctgacgcccaggctggagtgcagtgatcttgtctcactgcagtctctccctttcgggttcaagcagttctcctgtctcagcctcccgagtagctgaaactacaggcggacgccaccatgcccggctacttttttttttttttttgagacagagtttcgctcttgttgcccaggctggagtgcaatggcgagatctcagcccaccgcaacctccgcctcctgagctcaagctattctcctgcctcagcctccccagtagctgagattacgggtatgcaccaccatgcctggctaattttttttttttttttttttgagacggagtcttgctctgtcgcccaggctggagtgcagtggcgcgatcttggctcactgcaagcttcgcctcctgggttcacgccattctcctgcctcagcctcccgagtagctgggactacaggcgcccgccaccacgcccggctaattttttttttttgtatttttagtagagacaaggtttcaccgtgttagccaggatggtctcgatctgacctctgccctcgtgatgcgcccgcctcggactcccaaagtgctgggattacaggcctgagccaccgcgcccggcgttaattttgtatttttagtagagacggggtttgtccatgttggccaggctggtctggaactcctgacctcaggtgatccaccttggcctcccaaaatgctgggattacatgtgtgagccactgtgcccagccttttttttttttttttttttttttttttttaagaaacggagtctggctctgtcactcaggttggagtgtagtgtcatgactatagcttactgcagtttggaactgctgggttcaacagatcctccggcttcagcttcccgagtaggtaggactaaaggttcaggtcaccacgtcctgctaacttttacaatttttttgtagagatgaggacagggaggggtctcaccatgttgcccaggttggtctcgaactcctggcctcaagggatcctcccacctcagcctcccaaagtgctggggtaatatgcataaaccactggacctggtcaaacttttactttttagaaaaagacatatagtagcctagtatacccattgttccgcaccttgctttttcttcttaatataccttggagattgttccaagtcagtacacaaagctctgcctcatctttttaaacggctctgtggtgttccaccatgcaacaacactacagtttatttaggaacttttttaggcgccttcaggttggtttcagactttttgcaactagttatataaagttttgagagatggaggaatgagagtaataggctttccttcaattgctttcaaaaggtgttccttccatgaaaggatgttctgctaatctctagtaatagccttgtgtttaatcaagttgtagaagaaatgttctgaaatcattggcacctgcttccctttgtgtattctagaatctattagtaagagtggtttccttttagcacagcttaatgaattgttacactgggctttgttgatccatgttttgtagtattcttgagaatatggaggctatcagatgttctttcacctgaacttaagtttgagaaccatacttgtaggccaaggacacagcatgaatgctggtgaaagtgtatggaagtgtttggaagcagtacatagctagagcaggaatgtgcagaggggaggaatgggagatgcagtttggaaagtaggtaaaggaatgaattcattatcaagctgagggtttatactcactttggagaaattgtaaagataaaaggtttttgaactggcagtagagaagaaaaggtagtgatgatttatgcgttaggtaagttaataatctggttgtgatattgtggttttaaagatgtgtcctatctatggattctttgatacctctcccctcaactaatgaggcttcgtttccctccccttgagtatacactgaacttagtggcttgcttctatgaaacaatatggcagaagtgatgctatatcacttctgagattaggttataaaacgactgtagtttcatggcccggggaaggtggttcatgcctgtaatcccagcactttgggaggccaaggcgggcggatcacaaggttaggagatcgagatcatcctggctaacatggtgaaaccctgtctctactaaaaatacaaaaagaaattagccgggcttggtggcgggcacctgtagtcccagctactcgggagaccgaggcaggagaatggcgtgaacgggggaggcagagcttgcagtgagccgagatctcaccacagtactccagctgggtgacagagcgagactccgtctcaaaaaaaaaaaaagaccgtagtttcatctttgatgttctttctctccctgtttccctctctcatttactccctccctcattacttgtaaggcagccctggagagagggaagccagctgccatgttgtgaggacacttgggcagccacacaagtgaggttggaagtggatcctccccgggtccaaccttgagatgattgcaaactcaagaggccctgagccagaaccactcagctaggttgctcccagattcctgacccataaaaactgtaatatcataaatgtgtgttcttttaaggcactaaattggggtaatttgttatccatcagtagataactagtacagattagtatacctcctgtcttcagactcatagacatattcacctgtcttggaaaagtcctattaggaccttatcctcggcaagtcccgtcgtgaatcatcatcttctcaaacctgcttctcttcttgtgtgtgtgtgtgtttttttttttttttttttttttttttttttttttgagatggagtcttgctctgtcgctcaggctggagtgtagtgcagtggcacagtctcggctcactgcaacccctccctcccaggttcaagcgattctcatgcctcaacctcccgagtagctgggattacaggcacgcgccacggtgcctggcaaatttttgtatttttagtagagacggggtttcaccatgttggccaggctgggctcgagcccctgacctcaagtgatccacccacctccggctcccaaagtgctgggattacaggcatgaaccaccgctcccggcccctcttgtgttttctgtttccatcattggtaccaccaagccaaatatgagagttattcttaactctttccttctcatcccccaaacatagtcaataacaaagtcttgcttgttccttttttttttttttttgagatggagtctcactctgtagcccaggctggagtgcactggcgcaatctcatctcactgcagcctccacctcatgggttcaagcaattctcctgcctcagcctcccaagtaactgggattacaagcgtgtgccaccatgctccgctaatttttgtatttttagtagtgatggggtttcaccgtgttggccaggctggtcttgaactcctgacctcaagtgattctcctgcctctgccctccaaagtgctgggattacaggcatgagccactgcaccgagcccttgtttattctttttaaatgtctcttgcatgtatccaattctttttattcctgccacgttgtggtagaggacattatcatgtatttgttttttgttttttgcttagattactgcaacaacctcttaacttgtcttcccacatctacttttgcatcttttatttttatttattttagttttgggacaaggtctcactctgtcgcgcaggctggagtgtggtggggtgatcacagctcactgcagcctcaacctcctggactcaagtgatcctcccacctcagactcccaagtagctgaaattacaggtgtgtgccaccatgtccgcctaattttttaacttttttgtagagatggggttctccctatgttacccaggctgatctcgaactcctgggctcaagtgatcctcccacctaggcctcccagagtgttgggattacaggtgtgagccatcacttccagcctaattttgcatcttacagtccattctctacccgtcggatggcgtaatctttttaaaattgaaatctgatcatatcaaactgtgctgcatcaccttcattggattcttgtcattaggatgaggcatattccttaatttgccttgtatgtatcacagtttgcatctcttgtctggcatcctgtgtagtttagtatttgtccaagaaaatagtgttgcagtttgaaagataaatcatatggactgggcatggtgactcatgcctgtaatcctagcactttgggaggccgaggtaggatttcttgagcttaggagttcaaagctgcagttagctatgcttgtgctactgtactccagcttgggtgacagagtgagaccctgtctaaaaaaaaataagtaaaaatttttaaaagataagtaacatggtcactctcaacatggtaggcactcttcatctggtccctttctttttatctctctaacttcataccctgccactcaacccttcaatctttaagtcctagtttcaactctgcaggttctacttttcttcataccttccaatgtactgtcacttcttcctggaacactatcaccttgtacctccatatcccatccccacatatattaactcatccttctaatttctgcttcagattacttctggagaattgtagcttagataatcctgtccttttaccccaaaatatttatagttttcctactataattggctctcccccatttgacgataagctttgagagggtagaagagagccagttaatggtaggaaaactacaaatggtatcttcactatttttccttatttatttattataagtgacataaatagtatttctttagaatgaataatgcattagaatggcctgagacagggcttaaggggatgaacataggaaactattgtggtatcaagatctgatggtagggtgatagtgaggacagggtacttatactgcttgacctgagcttggacatagaaggagagaaatgtagattactccctaattctaagagcctgaaaagctgggcaaatgggtggtattaatagaactggggaagaaaggaggagcagcagatttagagggaaaacataagattccttttcagtagagtgctgtaccacataatgatgtttctttcaacaacagacccacatacatggtcacgtaagatcataatggagctgaaaaattcctgtcacctagtgatgtcatagccatcataatgtcagcgcattcctcacgtttgtggtgatgctggtataaacaaacctgcactgcccccaagtatggcaaatataattatgtacagtacataattacttgataataataaacaactatgttactggtttatgtatgtactatactgtatttttttttttagggatgggatcttactacattgcccaggctgttcttgaactcctgagctcaagtggtcctcctgccttagcctcctgaagtgttgggcatgagattacaggggtgagccaccatgccctgctatactgtacttttttttttttttttttttttttttgagacagagtctcactctgtcacccaaggtggagtgcagtggcacaatctcagctcactgcaacttccacctcctgggctcaagcgattctcctgcctcagcctcccgagtagctgggattacaggcgtctgctgccatacccagctaatttttgtatttttaatagagatggagtttcgccatgttggccaggctggtcttgaactcctggcctcaggtgatctgcctgcctcagactcccgaggtgctgggattacaggcgtgagccaccacacccggcctatactatactttttatagttattttagagtgtatcccttctacttataaaaaaaaagttaactgtaaaacagcctcagagaggtccttcaggagatattccagaagaaggcattgttaccataggagatgacaactccatgtgtcagtgtcagtgtccttgaacaccttctaatgggacagataagatgtggaagtagaagacagttgatattgatgatcctgactctgtgtagtcataggcctaggtgtgtgtttgtgtcttctttttattttattttattttattttattttagcttgctttctctctctctctccgccaaccccccccctcccaccgcccgccttctttctttcttttctttcttttttagtagagacaagttctcgctctgttgcccaggctggtctcaaactcctgggctcaagcgatcctaccgcctcgacctcccaaagtgctgggattacaggtgtgagccactgtgcccagcctgtgtttacttttttttttttttttttttttttttttttgagacagagtcttgctctgtggcccaggctggagtgtaatggagcgatcttggctcactgcaacctccacctcccgggttcaagcgattctcctgcttcagcctcctgcgtagctgggattacaggcacatgctaccacgcctggctaatttttgtatttttagtggagacagggtttcactgtgttagctgggatggtctcaatctcctgacctcgtgatctgcccacctccgcctctcaaaatgctgggattacaggcgtgaactactgcgcccagcctttcatttttaataaaaacgctttaaaaggggcaggtgcggtggctcacacctgtaatcccagcactttgggaggctgaggcgggcagatcacctaaggtcaggagttccgagaccagtctggccaacatgatgaaaccccatctctactaaaaatacaaaacttagccgggagtagtggcaggtgcctgtaatcccagctactggggaggctgaggcaggagaatagcttgaacccgggaggcggaggttgcagcaagccgagatcaccccattgcactccagcctgggtgacagagcgagattccatctaaaaaaaaaaagtttaaaaacgaaaaaaaggccgggcatggatcacgcctgtaatcccagcactttgggaggctgaggcgggtggatcacgaggtcaggagattgagaccatcctggctaatatggtgaaaccccgtctctactaaaaataaaaataaaaaaattagccgggtgtggtggcatgcacctgtagcccagctacttgggaggctgaagcaggagaatcgcttgaacccgggaggtggaggttgcagtgagcagagattgcgccactgcactccagcctgggcgatagagtgagactccgtctcaataaagaaaaaaaaggaaaaaaaaattaaaaatttcaaaaatagagaaaagcttacagagtaaggatataaagaaaaatatttttgtgcagctgtacaaagtgtttgtgttttaagcaaagtgttaactacaaaagagtcacaaagttaaaaatgtaagtttataaagtaaaaatgttacagtaagccaaggttaatttattattgaagaaagaaaaaatttttaaagccaggctcagtggtgtgtgcctgttgtcgtaactactcaggaggctgaggcaggaggatcgcttgagcctgggagttcaagttcagtctagacaatatagtgagacccctgtctcaaaaaaaaaagaaaaataaatctagtgtacgtaagtgtacagtgtttgtaagtctatagtggtgtacagtaatgtcctaggccttcgcattcactcacttattcacccagagcaacttccagtcctgcaagcgccattcatgataagtgccctatacaggtgtgccatttttaatgttttatactgtatttttgctgtatattttagatacagttgcctacagtatttagtacagtaacatgctgtacaggtttgtagcccaggagcaataggctgtatcacatagcataggtgtgtagcaagccataccatttaggtttgtgtgagtacaccgatattcccacaactataaagtcatccaaagacgcatgtctaaggatgtatcctcattaagcaacccatgactgtattttgagtttgaagttccaatggtacatctaaatggatctggaatgtggaagagaatattcctgaactaaaaagaaggaaattagaagtcattttcatggaggtgatgattaaagctttgttaataggtgagattgcaaaaaaaaagtctagacgaataatagagttgtaaagaaaccttcaataacaaacaaggaggaaacagagaaatagttgaagatgtaaaagaaaaccaatttaggaggctgatgcagccggattacttgagctcaggagttcaagactgccctgggcaacataatgagatcctgtctctacaaaaaatagaaaaattagatgggtacggtggcatatgcctgtgtcccaaatactcgtgatgctgaaatgggaggattgcttgagcccagggggttgacgctacattgagccatgattgcgccgctgcactccagcctaggcaacagagcaagactttgtctcaaaaaaaaaaagaaagaaagaatgaaggccgggcgcagtggctcaggcctgtaatcccagcactctgggaggccaaggtgggcagatcacgaggtcaggagattgagatcatcctggctaacacgacgaaaccctgtctctactaaaaatacaaaaaattagccggggatggtggcacgcgcctgtagtcccagctactcaggaggctgaggcaggagaatggcttgaacacgggaggcagaggttgcagtgagctgagattgcgccactgcactcccactccagcctgggcgacagatcgagactccatctcaaaaaaaaaaaaaaaaagaatgcaaaccaagagggtgccaagttacagaagccatgagggagtggagatatctgaagatgtgttaacactgttaaatattgaaggtgagaagaatacataataataaaagaccatattgtcagcaccacaagacagggtgaaaaaattaaaaaataaataaataggccaggcgtggtggctcacacctgtaatcccagcactttgggaggctgaggaaggaggattgcttgaggccaggagttctagactagtctggataacatagtgaatcctcatttctacaaaaaccaatgtaattaatttcaacattcgagtacccaggtctcactgataccatgaatactattaagttgtttctcttggaaagtactgagatatctctcttcaaacttcttgaaaatcttttttggaggtacataaagttaattttattagggatttggtaaatcaactaattgtaaagaacattcgaatatgttgctgaatgctaaacataaagtttaagaaacttcacccttaataatggaactcatattctagttcaaaataaatattacaatcaactagtaaccttagaaaactattagacatcgttttttatatagcactattaaatcagtggtaacacatggccaactaacaaaagaaacgccacatagtcaattggtgatgtctggattatctgaaagcaatttaatactcagcatattcttggtactgaaatctgctaagtaatattaacctaaacataattgaatcaaaggtaaaacaatattgcccaaatgtagaatgtgacattttaaggaaggtacaaaggacatggtgttttgggtcagaaagatcagtctgaatcccaactccatgatttactaattgtttagccttgggcaaggtggcttaatctcccaagcctcaatgtcttcatctgttaaatgaagctggttccctcggatttaagagaatctatcttcacagtgtctgtcatgttcatgatagcacaaggttagttctcttcttccctttgctgaaaataatacaatcattattaaatggattggaaaatgaaattgttcatcttaggggccaaaagagcttaactgcattcaagcagggaagaaatagccaatcagtaaagaaactgatatttgattctgatttgggggcgagggggtggaaggctggggaagagaaacaagagaaatatgatattgccagagaaagaaatgtaaagaggttttctgtagaaaacctgactttattaacttaggtttgctgtttatttttaactctttgtcctcatacaatctatgtgggtatcacaagtacaccattttgctgctaggtatcatagtgtacaccaaccccacttaatacatgattaacaaacaggctttttttttttttttttgagacggagtctcactctgtcgcccaggctggagcgcagtggcgcagtctcggctcactgcaagctctgcctgctgggttcacgccattctcctgcctcaacctcccaagtagctgggaatacaggtgcccgccactatgctcggctaattttttttttttcgtatatttagtagagacggggtttcaccgtgttagccaggatggtctcgatctcctcaccttgtgatccacccgcctcggcctcccaaagtgctgggattacaggcgtgagccaccgcgcccggccaggaatggaatattaaggccactcttagaagtgatttctacatttaaaaaaaataggttaaatagcacaaggttagttctcttctcctgccctttgctgaaagggatgccattagtctctttttatcattgacgcgaaccagctgacaacttgcaggactgtgttcttttaaccagtaccagtatataactggtaaatgttatgacaactcaaagtgcatctttgttcaaactaggaaagttttttttttttttttttgagatggagcctctctctgttgcccaggctggagtgcagtggcgcgatctcagctcactgcaacctctgcctcctggggtcaagcaattctcctacctcagcctccgagtagctgggattacaggcaagtgccaccatgcctggctaatttttgtatttttagtagagacggagtttcactttgctgaccaggctggtctagaactcccaacctcaggcgatccacctgcctcggcctcccaaagtgctgtgattacaggggtgagccaccgtgcctggcaggaaagttttaaatagctactatgctataaagtattatgctacgtcatcaatcagggatctataaaaggacttagagaagttattcatgcacagaattgaataaatctaccaaaaaagaaaaagaaaaggacttagaggagttattcatgcacagaattgaataaatctaccaaaaaagaaaaagaaaaggacttagccctgaagtttaaaacagttatttagtagaggtgcaagtcaggttagttctgcaagttagccctagcaacatgaaagtcacagggacaatccagttttagaattggcacatcatttagaaatggcacctcaggccaggcgcagtggctcatgcctgtaatcacagcacttttgaggccaaggccggtggatcacctgaggtcaggagttagagaccagcctggccaacatggcaaaaccctgtctctactaaaaaaaaatacaaaaattagctgggcatggtggcacatgcctgtcatcccagctactcgggaggctgaggcaagagaattgtttgaacctgggaggtggaggttgcagtgagccaagatcccaccactgcactccagcctaggcgacagagcgagactggaaaggaaaggaaagaaatggtacctcacaggcaatacagggaagaccctctttaagattggaaagggagataagggagctcatgttatttcactacctattaggatcactacattatctgtttatccttgttaagttttataaaagtagatgaagaagaggtgagacttttctctctggttttacttccttgcattagagaaattcagaagaaaggtatttgcatttgcaactaacctgtcaaagaatgctaattggaaagcaaaatcaaatctcccttcaaggatagatcatttgaattagagaatattcataaaatggagtattagcaaaaaaaaaaaaaaaaaatgagctgctgatacacacaacataatctctgaaacgtaatgtgccaaagatgacaaagttgagttcaagctatgtgattccatttatgcagagttcaaaaacagacaaaactgttataatagatggcaaaacagtgaatgccttggcaagaggggattggttggaaagtagcaggagagctttctggggtgatgtgttctgcatgttgatggggtgtttacacagttgtatacacttgacaaactcattgtaaacttaagatctgtacttcttactgtatgcaaattttaccttaataaaaaatcctctcctttgtcatacaacatctgtcttccggaacttctttacaaatcatactcctaagaatctaaatcttgaagatttattttttatcctaaaacctgatgtatttgccagggaattaacaaagatagtgataccgactgcttttaagtaacttctgtagttttaaaaaattaattcataatagaggtacagattttcagggtacatgtgataattgacacattcatacaatgtgtaccaatcaaatcagggtaattgggatatccatcacctatttatctccatgtggaaacgttcaaattattttcttgtatttggaaatgtggaacttgtgtagttgataagcaaatacaaagtcctttgggagtactgtgcccagttaagtgggaggaaatcctcattaaaaatttcaaactaaatatacaaggtacaaaacaagttaaatatggtttttttttccattatgccctctgaattatttttaccagttgagttattaccagtagcttgactcctgactaagctcaaaccagagaacagaacttttagtgaaaatgctttaaacatgtaaactaatattactgtttgatgatcatcatttccattgaaggcaaatgttaagggatcaaatgtgggcaatgggatgttaagaaaatgtgcagctaacaaacattaaatgtgactcattgcagatagaggaaatttttggcctttttttttttttttttttttttgagatggagtctcactgccattgcgcaggctggagtgcagtggtgccatcttggctcactgcaacctccacctcccgggttcaaacgattctcttgcttcagcctcccaagtagctgggattacaggcttgcactaccatgcctggcttattttagtatttttagtagagacggtgtttcaccctgttggccaggctggtcttgaactcctgacctcaggtgatccacccaccttggcctcccaaagtgccaggattacaggcgtgagccactgtgcctggcctggcctaatatttaacagaaggatcatattccaaataattcaaaaagtacacccatcagctaaaggaattttacttgttataggcagtctcttattcctagcagaaaacatacgaaaatatttcttgcaagtaatgtgggtgcacaaagccttcagaaacaatttgaaggaaagattgacagtaacaagaatttcacttaaaaaaaaaaaaaaaaagacagcatctcactatgttgcccaggctagagtgcagtggcaattcacacgtgtaaccataacccactgcagcctccaactcctaggctcaggtgatcttgccaactcaggagtagctgggactacaggtttgtgccactgcatctagcaaatttcattttttttttttaaagactgttaacaggctggagtgcagtggcacgatctcagctcactgcaacctctgcctcccgggttcaagtgattctcctgcctcagcctcccaagtagctgggattacaggcgcacgccaccacactcagctaatttttgtatttttagtagagatggggtttcactatattggccaggatggtctcgatctcttttttttttttttttttttttgagacggagtctcactctgtcgcccaggctggagtgctgtggcgcaatctcggctcactgcaggctccgcctcccaggttcacgccattgtcctgcctcagcctcccaagtagctgggactacaggccacgcccggctaattttttgtatttttagtagagacggggtttcaccgtgttagccaggatggtctcgatctcctgacaccgtgatccacccacctcggcctcccaaaaagtgctggcattacaggcacacgcctccacgcccagctaatttttgtgttttttagcagagactgggtttcaccacgttggccaggctggtctggaactcctgacctcaagtgatctgcccgcctcagcctcccaaagtgctgggattacaggcatgagtcaccgtgcctggcctgaacccctactttaatagcaagcttggtcccaagttttaagctatgattggtttaatgccaaatacctagaggctgactgccaaaacctcaaagcgattcacctaaagacagttcaaacaggaacttagtacacaggaatgaactgctgtcattcaagtagccactgtgtatgttacctttatcattaacttcttcttgcccttgcacattgaatgaaaagggcaagcactatttggtctcttgatctttattaaaaatcctgaatgtagaggttcatagttctaataataattgacgtttcccccaactctactgttcacataaaaccacataactgtgatctagttatttattattcagcatccctaacttcctatagggttcttatttttgtttcctaaggttgtcgtatacattatacaaaagacttgcatgccatatgcaagcagatgacgtttgtgaatcccttatgtgacagagcttattagatccatccaacaaaccttttggtagatggttccagtacctgatacaaaaataaaaggattgtacaaaaaagggcatggtttttgcttgttacaacacaggtaattacaaacgacaaatccttcaaaagggaagatgacaacttttattgttattacaaaagcaaatttaatttgtcatttgaataattgcaagagcagactaagggcttaatcctcacacaggcaccaagtcaggcacagtaggtagctacaaatcgtaagaaaaagctttctttcctacctagagcactcttccatgctttggaattaggctaaaaaactcaacaaacctgatcagttccctttaatcctgttttttttttttttttttaaatgagatctaggtattaacctgctgtctagcgaaaactagtcactaagtcctggcctgagagatacccacatttcctttagaacaaacagaactaatacctgtgtacatttctgagagcctgatgtgtgagtccttaaaatgtagaccttgcaggaggcttagacctcagtttcacctaatgcatgtggaggaaatggaggtgagaatagtcacctgaagagtgcaagcgctccagctccagcacacacactcttccctgggcagcaggaaaaggaggtaacaaggacttgggctgacatctgaagcactaagctaatgtgcctggtagaggggagcctcaggaagcacaagatgtcattccacctgtgctgtccacaaacctgaggtttccacatcgttttaaagggcacagtggcaaatgtgacaaggcagaaaacaataaccatttcaaggatcacttaaggaatcctggtgttttctgcctaatcagaagtagtaccaacctgcttttcccttatattggagaacataaaggttttaattaatctccactcccacaccttcaggcccttataataatccttagtaaacaactcagctagcattattgtttcaaggaagcataggattagaggtatgtgagaagtgtatttattgaagggaagactcagtaagttctaggatattaaagtcaagaatatcctagagccaaaaaccaccaaaagttgaaccaaatctacctgaactgaactgatagtaaactgggtcaaatggaatccacggaattactactggaaaataaaaacacttcctattctttctattcctattcatttactatgaaacctaatctaaccaactgactgctaaatgtaaagctagttaagtcttttgtgcatgtgcaattacacttacttaacaagatgctgccatggcgagatctctcacgaaagaaacaagatcaaggatgtactagatggcatctgctagaatcactgaaaaagttagctgcaagaaataaaagcctattatttggagatagataattgtcccctgaatccactggttgttctcttccttacctatgtctgtgaaaggattaatggcacagtttgataaggtaagccaacaatgaatataacatttaaccatcctaaaatcagagctatagtgctataaccacatttttcacaaagggttttaaagttgaaagttgcctgatgttaagacctgtaataaaactgcgtattttccccttgactaccttaaatccctacccaaagcaatgaagctatcatccatgaagtagcagtccatgaggaagtccatgccagtaagaaaaggtgctagagtgctgttatgtgtaatagtcatcaaagatcacggagtaattccagtcattactagtgttcctgcagatcgccaagggagcttagctgatttttttccaggttcatcttgggagcagtttttgatcataggttcaacttttttcttgggttgcaaaactgcatctggctgcaagtctaacccaaaatattcgcagcgtatcagctgagaggatgccggcaactgttgaactacatcacagttcaaagtcccatattgtgagagcagtacttgtagtttatgtaaccagcaaatatgagttacctcgttacagtgaacaacctgcactgttagagtttaggaacttttgacattcggttatcacatatttcaaagattttcaactcacaaaaaaaaaatacatgggcttaattactcagtaacactttactatttgtcacttaatctcaagacaatacacactcagtccaactcttttggtttgattttacatagattttcacttacttctgcaaattaaaaacaagaaatgagtgctgtatttccccctctcccacagtaagaaacaagggtttaaaatggcaattacttagatgtttatttcaatatttcttaaattcactttattaatttaaaaaactaaataatcgcatgaaagttatataaagaacatcattaatgtgaaaagatgcaagaaaaaaatcattctagtagagcaacgttagagaacaaatgcttaggtaataccctaaatatgcagccaactaccctatttttgcactgttgaccatataagcacgtttgcatttgcagaaaacagaatgacagcataggaatttgtattgctctataacggtccaacatctccacataatgccaagttcaccttagacattttatttacttatccaaatgaacagcctgtgtaagcaggattgaaaatgcatcaactttaaaaagatgagaacaattttcaaagcccatagaacttatgttgctggttaattttagcactgaaatttcttttgaataatctaatcttgcaaatatgcaagaatccagtggaatttttacagttacatttgtatttgtatgacctgttactttttagaggtaggcccttcacagttgatatccaagttacttaagagtcttggcaacatgcacataatagtctaacagtgtaaatgttttagtagcaaacataacttattttttaaaaatgtgttctatttagaaagggaactcttatctctggaagtgatttccgtggctcttgaacttttaaatattcattaaaattcaagcaattgctagtatttgtttttattaacatggaattacaaaaagaactattatgttttgattaaagctcctatattttccagaaaaataaaagcccagagatttgcagacataataaaatctatttaaatttcatgcaatagccataattatagttttaagaatctgtaggacaataactttgctctgtccataagatgtagcctcattcaagaaatgaatgggaatttcacagttaagaaaacactaggccaagtgcggcgcctcatgcctgtaatcccagcacttttgagaggctgaggcgagtggatcacttgaggtcagaagtttgagaccagcctgaccaatagggggaaacctcgtctccactaaagatacaaaaattaactgggcctcgtggagggctcctgtaatcccagctactcaagaggctgaggcaggaaattgcttgaatccgggaggtggaggctgcagtgagctgagatcgagccactgcactccagcctaggtgacagagtgagcctctgtctcaaaacaaaacaaaacacccattagattaagttttatgttctgtgactggaaatacagtctgtctaggcttttcttttctgaggagcaaaattatagggaagagacttgtcattaaatatacaaagtatcttatttagagagaaatcacaatctaaaagaggctatctttgatcaatggcaacactcaacatcaagggggctttggataaacccacaaattgcctccattcctcatttattctcatgaaaaatttcaaagtcatgataattatagcagagagtcattcaatctaaaacccacacaatgctgcactgtggttcatcaaaaacatggttagcaaatttcagctttacacttaagaaaactcagtcaatttcaaataattgagataaaacttataccctgcttgattctgcttatcgctgataattttagtctgttcagattctgatgattctaaatattttcatttagttgctaggttgagatttagctttaaccagcaaggatcatccaacctttaaagttactgatacaaagagtaaactgagtaacttgtagaagtggcacttgcaactgatacggttttcatactagaggcatgcagctctatttataaatactaccagaggaatttttgccaggtctcaaacatgctttatttgttgttaattccactaatttaacaagttaatggaattttctctaggggtacaatttcattacgctttacttataaaaactacagtatgctgttcttttattttaaaacaacttactgtgttcaagaaatcatgttacaatataaattggcaaaaaaaaaaaaaataaataaataactaaaagacctagtaaagcagtgtcacatttgcataaagggatttaactgcatgtatgcattaaccatcaaaagaaggggtcaaactaatcctttcctttaatacaaacttgaacgctgtgaatgtctcatttatagtgggtagggaaagagtttataaaagtccaagtaataaaatgtattcaattacttgggaaagttaaaaagctaatgcaacaatgttacatccagataaaaaacattattcaaaagcaattcaaataccgaaaaggatttcaaattgaatattttattaacatggtagttgcctttgtaacatgtgcacacacactcgcacactcagaatgatctgcctgggggaaaaatactaaatatgcctaaggggaaaatgaaaaataaaaaaattcctgtaggttttcattattgtaggcaattatgtccacatcacttacaaagctattgccaaatctgtccaaggaagcagagtttgaagtgagggctagggacaggaatcttgggaaaaattcaacagtggcatagcagagctctcaatatgagaaagctgacataatgtggacttttgctgtgaatttcctctttgcaaaatatggggagaggtttatcaatgggcagaaaataagagaaggcggtgtgaagtaggcttctgcagtcaattttcctcacagtattgtgcagggtcatcaagaaaatgcttagtctttctctggaaccagtttcagaacttttccaattgcaatggtcttacctagaaatgaaattttaaaaaaatctttcagtagttaacagcaagtctatataagatattaaaacttattattttaaatcacaaaaatattttttacaatgtaagttactaattaactagctttactgccaaacccatgatacttctatttaggtagtcttaataagagggtcttatttgggggggctggtaaagagatggttccctgtatcaaaaacctatctccccccgtaccccccaaacaattctcctgcctcatcctccccagtagctgagatacagatgcctgccaccacgcccagctaatttttgtatttttagttgagacgggatttcaccatgttggccaggctggtcttgaactcctgacctcaggtgatccacccgcctcagcctcccaaagtgctgggattacaggcatgagccactgcataaagacagagtcttactctgtcacccaggctggagtgcagtggtgcgacttcagctgactgcaacctcctccttctgggttcaagtgattctcctgcctcagcctcctgagtagctgggagtataggtgcttgccaccatgcccattctaatttttatatttttagtagaggcagggtttcaccatgttggccaggctggtcttgaactcttggcctcaggtgatccgcctgcctcggcctcccaaagtgctgggattacaggggtgagccaccacactgggccaaaaaacctctttggattaaaaataagaaaagggaatatccgtatttgtggaatatccacccagtggagtactattcagtgatacaaaggaataaataacatgttacatggttgaacctcaaaatcacactaagtaaaataaactagacaaaggaccacataatttataattctatttatggagtgtctataaaagacaaattgaaaaatggttgcctggggtggaggtgggaataaggggtgattatgaacaggtgtaaggtttctttttaggtgttctaaatgttctaatattagtatatggtgatggttgtacaattctgtaaacatactaaaattcattgaattacatacttaaaacaggtcaatttcatattatggaaattgtatctcaataaagctgctaaaaaaaaaaatcccaaaacctatccttaagtaactgtgaaaaggcacagcaatcaccactgactacagtgcagtgaacacgtccttctggtagtaatcctgtggactgaaaggatacaaaacccattgggtcttgtggaaaacctaaaagccaagttagcttttttttttttttttttttttttttttttaaagccaagttagcttttaggaaaaaataattctagggttaagaattcctgctacattaattgcttttcttctgtcttcctgattttatcaggttctgagtggtaaactaaaactatcattttgttatattaataagataaacccaataaccagttttactatcaaccagaagagttctgggcctttaaagtaaaataaacactgtctttatacaatttcatccaatgtaaagttcaggaactgtattcatcaccagggcttagcacagttcctgacactttgtagatacaaagtagtttttgctaaatggaattggaatgaacatgtgaaatgactattctgtatttcaatggaactataaagttttatgtaaagtcttctatagtcttaaaatggttatctaagttagaaatattaacagctgggccgggcacggtggctcacgcctgtaatcccagcactttgggaggccaaggcgggcggatcacgaggtcaggagatcaagaccatcctggctaacgtggtgaaaccccgtctctacaaaaatacaaaaaattagccaggcatggtggcagcacctatagtcccagctactcgggaggctgaggcaggagaatggcgtgaacctgggaggtggagcttgcagtgagccaagatggtgccactgcactccagcctgggtgacagatcgagactccatctcaaaaaaaggaaaggaaagggaagaggaaagggaaagggaaagggaaaggaaaaggacaggaatattaaaagctcataaggaaacgtttcataacaatcattttgtttttatgccaaagaacttcatgaccccaagatgggaatgttagttgttctgcgtcacccagaggtaggcagaaatggatgcacacaaaaggtcacaaagattagacctctgaaaaattaggtgtaaaaaaaaaaatcaatctctatgttccttttaatcgctagacatattacaaaggattacatcatagaaatatcttagtaaacaaaatagccctccaaatccactactcacaaaacatcaaaattaagattcttcacgtagagcattactagatttggcattactactaaagcacgtggtcaattctgttcaatacattcaactcataaaacactcatacgaataagaatgtgaatcgaagttttctgtgaacctgttgcaatgtgtactgtactgagatgatgaagatgaccaaagctaggtatcctggatatactactagacgtcagtttaaaagctcttaccctcatctcttaaggtgaaacgacccatctgagggaagtctttaaaggtctcaaggcagatggttcctgctgtccttaagcgagcaatgcatacttgatcttgtttgacaaaacggggtcgggtcttacttttttctcctgattttttgtctaccaagcagattaaggcctaaccaagaaaagagtatgagaaaatcagaataatgccaaataaaataatctttaagaacaggtgtagaaataaaagtgcatcactgttgctgattagaaattatgaagataaaacagtattaaaacagaaataaaccaattatcttaaactcactgttatttccacctcctcaatacaggtatgaatatgcagcaccgcattatagcctgggcagatgatggatttgtgctctataatcactatctgtcaaacaaacacacacattcttatctttagccttagggtaaataagaattcaatgttctcaagcgccatataaatcccaagaattagtgttaccatctcactaggacatcaacttaagtgatttttgtgttagaggtgataggtttgtcttactaattttgttcacaggatgggtcaggctgcttgaactcaaagcatgaatttcagtatcttatcctgtatttatcttcttggcaagtccctggtcaactttcaaaatacggcaggctggctgggcgcagtggttcacgcctgtaatctcagcactttgggaggccgaggcggcaggggggccggggggatcacctgaggccaggagttcaggaccagcctggacaacatggtgaaaccctgtctctactaaaaatacaaaacaatcagccaggcgtggtggtgggcgcctaaatcccagctactcaggaggctgaggcaggacaatcgcttgaatcccggaggtggaggttgcagtgagccaagatcgcgccactgcactccagcctgggtgacagagcaagaccccatctccaaacaaaacaaaagacagcaggccaactttcttatctgggaagactttccttatattccccaaggaactaagctaatttttaccgctcagaagctacctagatgtaaacttatccagctttatccatttctcaatatccaaggtccagtaaagtaaacaaccttacatctggcatcaaaatctaacttgattagttgtcataccttagaaaagaactttaaaaaattctgttattcacaccagtcacttactctgtcattctcccagggaggttagattgttaataacagggaaacctgtgtgatttcttgtctggaaagctatgtgctgtcaatgagcacataaaccatgacttccacagtaactgtgctctggtcaaagtgaatattagatactgtagaatgtatcatcaggagatcaaacataaaaaggaacttacaaagaatactccttatccagtaagcacttgtaccagcttgaagaccttgtatgaggtgcctattgtggttatgatatataagtggcttataatatttccattccccttctctacactaagatgggttaactggcatgtcacaaataatcaggacaaaaggcactgatattctaatttcatttagacattaaaacccactatgacaacaacaataatttgtttacctgggcatcaaatgtgcgtccagaatgacaaagattattaggatcacaaagtataaaccctggaagaatctcctcttcttcaattcctttcagtctgattttgaggttttcacctggggctacggtatcagtctctacatcatcggaaagtattccaagaacttccacgttgtgctttaaaagaaaacaagactggaggttttctgacacattcactgcattacgcaacataaaatgatctgaatgtctgtctgctcaataaagagttgcaagatttgactgtaaacacttatgtttgtatgacataaaatcttagcctagatatgatcagcaaaaatcatatcctagaagtataactgccaattaaagtattaacgtgtcaccttttaaatatcacattctaatcatttccaactagaacactgtatacactagcatttgcctttttttaccttttcaaaatcgaaaacacaatttaatatttggatttcagttttatggatataatttttattattatggaattctatgaaggatttaataaacctgtcttctattacctatcaatctccaaatatcggaattatgcactacttaaaaattattgaactaagctttaaaagtctatcaactatttaatgaatacatcatttccttttggtgtaatgaaatggtctggaattagatagtgatgatggctgcatagcattgttatttttttattttgagacagagttttgctcttgttgcccaggctggagtgcagtggtgcgatcttggctcactgcaacctctgcctcctgggttcaagccattctcctgcctcagcctcccaagtagctgggattacaggcacccaccaccatgcctggctaattttttgtatttttagtagagacgaggtttcaccatgttggccaggctggtctcaaactcctgacctcaggtgatccacccaccttggcctcccaaagtgctcagattacaggcgtgagccactgtgcccggcctaaactctttgtttctaacaaaatagtccacggagctgggtagtccacatgcctttagccccgctacttggaaggctgaggcatgaggactgcttgagcccaggtgttttaaggctgcagtgagctatgatcacactaccgcactgtagcctgagtgacacagcgagaccctgtctttaaaaaaaaaaaaaaaaaaagtttttaatgtaaaaataaaatagttatggagcctccagttctgatgccagtattgctcctcagtactgccagtgctggctgtggcagcaaggtgaagcaaaagaacaagtgacctgagaggagatacacgggaaatttaccatcagtgacatttactacatcaataatgctatgcaggccaggtgcagtggctcacgcctcagcattttgggaggccgaggcgggtgatcacctgagatcaggagtttgagaccagcctggccaacatggtgaaaccctgtctctactaaaaatacaaaagaaaaaaaacaattagcttggcgtggtggcaggcacctgtaatcccagctactcaggaggcttgggcaggagaatcgcttgaacccaggaggcagaggatgcagtgagccgagatcgtgccactatactccagcctgggcaataagagcgaaactccatctccaaaaaataaaaaataataataataataataaaaaaaaggccgggcacagtggctcacacctgtaatcccagcactttgggaggccaaggtgggtggatcacaaggtcaggagttcaaggccagcctagccaagatggtgaaaccctgtctcgactaaaaatacaaaaattagccaggcgtggtggcaggcacctgtaatcccagctactcgggaggctgaggcagagaactgcttgaaccctggaggtggaggttgcagtgagctgagatggcgccactgtactccagcctgggccacagaaggagactccgtctcaaaaaaaaaagaaagaaacaagagtttagaagtcactcacctaaaaaacaatctgtatcggctgggcgcagtggctcacgcctgtaaccccagcactttgggaggccaaggcaggtggatcacgaggtcagaagttcaagaccagcctggccaacacggtgaaatcctgtctccattaaaaatacaaaaatgagctgggcatggtggcacgttcctgtaatcccagctacttgggaggctgaggcaggagcattgcttgaaccgggacctgggaggtggaggtcgcagtgagccgagatcacaccactgcactccagcctgggctacagagcgagactccgtctcaaaaaaaaaaaaaaaaacaaaacaaaaaacaaaaaacaatctgtatctcagaacagtttcataaaatatcaaagtaaaaaataaccaatttttaatttaacccattaattacttactgtggtaaaatacatgtaacaaaatttaccatcataaccattttaggtgtacatttcaatagtacacctaaattaaatacatttaaaatattgtacaaccaatattcagaactctgaaatcttgttatcttgcaaaactgaaactccccgttcacccgaaccctggcaaccaccatcctactttcaggtgacaaatgtgactattccaggtacctcatttaagtagaatcatacggtatttgtctttttgtgactgttttatttcacatagcataatgtcctcaaggttcattcatgttgtggcctgtgtcagaacttcctttttaaggctgtgcaatattctattacgtgtatgtaacacgctttctttatccatcatcctttatggacaccagggttgcttccaccttctggctactgtgaataatacatgtatgaacatgtttatacagatatctgagactcttttgggtatatactcagaaagagtattgctggattatgtgggaaatctatgtttaattttttgaggaactgctatattttttcacggcacttggcacaattttacatgaccaacagtgcacaagggttccaaattctccacatccttgccaacacgtgttactctgctttccaaaaaaaagtttttaattgagatgggatctcacacatagtgagagacccagcctggtctcaaaactcaagtgatcctcctgcctcagcttttccgaaagtgcagggattataggcataagccaccatgtccagccctgtggatttgatttttatttccctaatagttagcagtgctaggcatttcttcatgtactttttggctgtttgtacatcttctctggaaaaatgtctattgcagtcctttgcccatttttgaattgggttgttcaggttttctgttgacttgtaggagttcttcatatattctagatattaaccccatatttagatacatgattggcaaatgttttctctcattccgtaggttgccaaccccatgaattttttattgtaaaagtctggcctcttttttatttgatatttgagacggagtctcgcactgtcgcctgtgctggtgtgcagtggcgtgatctcagctcactgcaacctccgcctcccgggttcaagcgattctcctgtctcagcctcctgggtagctaggattacaggcacccgctgacacacttggctaattttttgtatttttagtagagacggggtttcactatgttggccaagctggtctcgaactcctgacctcgtgatccacccaccttggcctcccaaagtgctgggattacaggcatggcccacccaccagctgcctctatgtcttttaaactattctagctctgttccactgagattcaggaggactaaactgaagtgagtttttgaggcttgctcaactctaggacattctatacctgcctagtgattagtatcaagtgatagcttccacagagaacagctactttctctatactagttactaaggcccctcacttgcaaatatgtctgggcactaacttcacttatgtttagagaatcatacttttttctattctggtaaaatataagtaataacattcaacttttaaaccattttagtttgcaattcagtgccatctagtgtattcaccatgttgtacaatcaataccactatctaattctaaaacttcattgtcccaaaaaggaaatcctacacccgttaagcagtcactccttactttccctccttcagccccttgcaaccaccaagctgccttacacttccatagcttttttttttttttttttagtaaaggtctcgttctgttgcccagcctggagtgcagtggtgtgatcagagctcataaatcatagcaaccttgacttcctgggctcaagcaatcctcctgcctcaacctcccaaatagctacgaccacaggcacgtatcaccacaagtggctaattttatttttcacagagacagggtctccctatgttgcccagtgtggtctccaactcctgggctcaagcaatcggtccacctcaaacttcgaaagtgctaggtgttagccaccatgcctggctcatctccataatttttgggacaactctacagacaaaactgagtaagtaagggctgggtgtggtggctcaagcctgtaatcccagcactttgggaggcccaggcgggcaaatcacgaggttaggagttcgagaccagcctggccaacaaggtgaaaccctgtctctactaaaaccacaaaaattagccagatatggtgatgcatgcctgtaatcccagctacccgggaggcggaggttgcagtgagccaagaatgtgccactgcactccagcctggcgacagggtgagactccatctcaaaacaacaacagcagcaacaactaactaagaactcaacctgagaattattttcactcatatgttagcctccaagttgcaaagataataggaaaaagtaggctttaaaatgtaaacattttagaagatactatatattctcatctccaatgcacaaggcatcaagaaaccagataatacaatttgtaaggtgccaattatgtctaaatattacatttgataatggattctttttctaatttactctgcctggagttagcatggtaaataaattctcactgaaatctagcaaaatctccatctgaaggtactgatgactcaagtctgtggtcctgcataagcaacatctttggagctgttagagaagccctgcctcaggttatctgcaaatctcagcaactgaacagtcaaaaatgacacaaaggaggccaggcatgatggctcacgcccgtaatcctagcactttgggaggccaagatgggaggattgtttgaggccaggagttagagactagtctggtcaacatagtgagaccccatctcaatttttatttaaaaaaaaaaaaaattagccaggcagagtggcacaagcctatagtcccagctacttgggaggctcaggtggcaggattgcttgaaagtttgaggctgcaataagctatgaatgcgccactgtactcctgcctcggtgacagaagaagaccctatctcttaaagaaaaagaaaaaaaatcaataaatagataggaaacagcataaccgattcttaccttgtttggcatcatcacaagctgctggcctttacaaatagatcctgattccagctttcccaggaccacagtgcccatatcctgatcaaatgtaaaataaaatccagtttcagacttcttggtgctgtataacagctcaatagcccaaagtgaaattctacactgcttattcataaaggaaaatcatttgcttaagtagaaggcttaggttcatcttaaactcagtaacaaatactctataataatttgtgtcataagcatatgtatgatcatattaataattcagtatgcctataatttaaaaagaaaatggcacaagctggatgtggtggctcaagcctataatcccaacactttgggaggtggaggtgggtggaccacctgaggtcaggagttggagaccagcctggccaatatggcgaaaccccatctctactaaaaatacaaaaaaaaaaaaaattgccaggcacggtggaatgcctgtaatcccagctactccagaggctgaagcagaagaatcgcttgaactcaggaggcagaggttacagtgagccgagactgaaccactcgactccagcttgggtaaaagagcaagactctgtctcaaaaaaaaaaaaaggctgggctcagtggctcacgcctgtaatcccagcactttgggaggccgaagcgggtggatcacaagatcaggaaatcgagcccatcctggccaacatggtgaaaccccgtctttactaaaaatacaaaaattagctgggtgtggtggtacctgcctataatcccagctactcggaaggctgaggcatgagaatcgcttgaacccaggaggcggaggttgcagtgagccgagatcatgccactgcactccagcctggtgaaacagcgagactccatctcaaaaaaaaaaaaaaaggtgcagaaaacaacacagaagtttatgttggaagatctgaactgtttgtacaaattcaggttctcctgatctctaggcctgtttcctcatatataaaattggaaaaagcaatacttgttaaagaaatttagaacggagctaattaaagaataatgtatttgaggaggggaaaacattacatacattgataccgcaaaacttaaaaattcaagttggaaatccagttaaaaacaaggaagtttattttttttaagacgaacatccagtgctggtgaggctgtggtaaaactaacactcatgctgctagtggtgacagaagttagcacagtatttttgcgatgctatttaccaatatgcatcaactttaataagaaaatcctttgagcccagcagttacatctatgagtttatcactaagatatgatccctggctcatcgggaaacagctaaaataaactaaacttgttgaataaattatggtctatctataccactaatataaagccattaagaaaaagacatcaatgttatgttgttaataaagtttttggaccgggcatggtggctcatgcctgtaagcccagcactttgggaagccaaggcgggcggatcacctgaggttaggagttcgagaccagcctggccaacatggtgaaaaccggtctctactaaaaatacaaaaaacaattagctggatgcggtggcacacgcctgtagtcccagctactcaggaggctgaggctggagaatctcttgaacctgggaggcagaggttgcagtgagctgacatcacaccactgcactctagcctgggtgacagagtgagactccgtctcaaaaaaaaaaaaaaaaaagaaggccaggtacggtggctcacgcctgtaatcccagcaccttgggggaggccgaggcaggtggatcacaaggtcaggagatcgagaccatcctggctgacacagtgaaaccccgtctctactaaaaatataaaaaattagctgggcgtggtggcgggagcctgtagtcctagctactcaggaggctgaggcaggagaatcacttgaaccaaggaggcagagcttgcagtgagctgagatcgcgccactgcactccagcctgggggacagagtgcaagattctgtcaaaaaaaaaacaagaaagaaaagaaaagaaaaaaagttttcaaaactagaaacaaaatgcacaacaatgatttcccctcccaggaaacccaatttctttaacattttgggtaccttgtacttatccacaattggcagcctgattggtccatcaactgatctattgaagttcggcaaattatccagatatggaataaacggtaatccactgagaacataacaacaaagccattaaaggaagtcaacataaatatcaaaatgttaagttacatgactataaacagcttctaataatattttcattctactcatgtattcttcccattcaaccactttattatccatttcatctcacttattccacagaaaactattataaaactgctcagtataaggcttcctcataaacttattaaaatttagagaaatattttatagcaaatagcctacatgtaataaattgactatattactttttatggacttttccagctatgaaaccaagattctataaaataatttcccctttaaacatacagtattggctgcgtgcagtggctcatgcctataatcccagcactttgggaggccgaaaggcaggtgcatctcttgagcccaggagttcgacaccagcctgggcaacatggtgaatctgtctctactaaaaatacaaaaatcagccgggtgcggtggcatgtgcctacagtccctacgacttgggaggctgaggtgggaggatctcttgagctgggaggcagaggttgcagtgagccgagatcatgccactgcactccagcctggttaacagagtgaaaacctgtttcaaaaaaacaaaccaaaaaaaagaaacacggagttcaagaataaactcgtatttatggtcatttgattttcaaagagggagccaaatcaattcaatgaaaaaagaatagtcttttcaacaaattgtgtgtaaacaattaatatacaaaaacaaaacaaacctacacatagaccttacatcttacacaaaagttaactcaaaatcaaatacatatctaaatgtaaaaaacttcaaaaataaaaccttttgtgcttcaaaggacaccatcgagaagtgaaaaaaggcaatccataaagtgggagaaaatacttgctataatcatattgtagctgataagggactggtagccagtattaaaaagaactcttaggactcagtaacaaaatgacaacccagtttaaaaatgggcaaagatcttagtatttttaaagccaaggttacatttaatattttcttaaattacttataaagatatatgctcaaaagcatatgttaacatgttactcagcatatgtctttataagtaatttaagtaataacatccttttcctttttaaaaaaaggaaaaaacagttacttacatgtaccaaggacagaaatccgactgctctttgagatttgctccagtaagtcctgagcagggcataaagtgaatgtcctttttgggattgaagccaacttttttcaaaaatggcactagtttctccttacattcttcatatctgcaattataatgtaaccaaaataactcaattataatgtaaaccaagaactctagtttcctaagtaaacagattaaggtttagaaaaaccctagagaaaaagtcgtacaataacaaaaccatccttaatcccactaacataaaataccagacatctacgctcacctctcattgctccaatttactgttggatcatccatcttattaattagcacaattaggtgttttacacctgctgtctttgccaacattgcatgttctcttgtctgtcctcctttttcaaatccagtttcaaactctcctttcctggctgagattacctaattccaagaaaggaaacagtttactccttcgccttcaggcatacccttatggcagtaaaacatctttcctttcagttatatcacgagtttttttttttttttttgcaagaaaatagaagcaaacgagttatgacgtacctgcttttgaatgtcacaaatcaaacaatgtctagatgcttccaatcccccacattcccaaaatctagtatacctgcatattttaaaattccaacatttactttctagctattgtaactacaaaggaaaaaaaattgtgatctactaccagtacattgtgaaaagcgcaaaatgactgaagaccgtatgaaacagatggtttcctattcattttttacccatggtgcctaacggtgggcttggcatttaatggagactaagttctgacatggtaatagataatagcaacaggagagaaaaggtgaaacgtattttcagaagtaaatcaaattttgaagatttcttgaagagagattagtatgatgaaaactgtgaccgtgtacatcattatatttcactgcaacctgaatttgagcttttagaagataaattcaaatttaaagatataagcggggctactaacaaatatacagatggactggaaatgtctttcttaccagcacagccaaatcagcttgagaggcaccaccaatcatatttgggacaaaactcttgtggccaggggcatctagaattgtgaaatgcttcttttcggtttcaaaataggcacgacccacttctactgttttacccttgtctcgttcttcctgatttgtgtctaaggcccaagacaagtacctgaaataatttttaaaaaaagaacaatattcctaagaacatcagagtttttaggatattcttcaccattaaagatataatggatgacacacaacacctaaatcacgaacaagattggtgaaatgaaaattgagccgggtgcggtggctcacatctgtaatctgagcactttgggaggccaaggcggcggatcacaaggtcaggggttcgacaccagcctgaccaacatggtgaagccctgtctctaccgaaaatacaaaaattagctgggtgtggaggagcccacctgtagtacttaggagactgaggcaggagaatcgcttgaacctgggaggaggaggttgcagcgagccaagaccgtgccattgcactccagcctgggcgacagagcaaggctccgtctcaaaagaaaacaaagaaattgaaagaatagggctgggcgcagtggctcacgcctgtaatcccagcactttgggaggccgaggctggcagatcacctgaggtcaggagttcgagactagcctggctaatatgatgaaacctcatctctactaaaaatacaaaagttgggcatagtggtgcacacctgtagtcacagctatttcgaaagctgaggcaggacaatcgcttgaagctgggaggtagaggttgcagtgagccaagatcgtgccatcgcactccaggctgggcaacagagggagactctgtctctcaaaaaaaaaaaaaaagggctaggtgcagtggctcatgcttgtaatccaagcactttgggaggccaaggcaggcggatcacctgaggtcaagagattgagaccatcctggccaacatggtgagaccccatctctactaaaaatacaaaaattagctgggcatggtggcgggcgcctgtagtcccagctactcgggaggctgaggcaggagaatcgcttgaacccaggaggcggaggttgcagtgagctgagatcgcgccactgcactccagcctggtgacacagtgagactccgtctcaaaaaaataaataaataaaataaaactgaaagaatgtattattttgattcaaacccttagagcttttatataaacgcagtcaattataccatctagaactttatggcaagttgactacacagaaagactaactacaaatgccaatatcactgtgtgttaagtgataatgagctcccttattacttcatttttatactcacatggcacaaaatacaacacaaataatggctgtcttgagagttaaagggtaataataaaacttttttggatggatgctgtggctcacgcctgtaatttcagcattctaggaggctgaggcaggcagatcacaaggtcaggagattgagaccatcgtagctaacacggtgaaaccctgtctctactaaaaatacaaaaaattagccaggcgtggtggcgggtgcctgtagtcccagctacttgggaggctgaagcaggagaatggtgtgaacccaggaggtggagcttgcagtgagtggagatggagccactacactccagcctgggcaacagagcctaggtcgtgcccggcacccccacccctcttcttctttttttttttttttttttttttttttggagatgggagtcttgctctggccaggttggagtgcagtggcaccatctcggctcactgcaacctctgcttcccaggttccagctattctcctgcctcagcctcccaagtagctgggattacaggtgcccaccaccacgcccggctactttttgtatatatattttttgagatggagtttagctcttgttgcccaggctggagtgcagcagcaccatctcggctcaccgcaacctccgcctcccaggttcaagtgattctcctgcctcagccccccgagtagctgggattagagcatgcgccaccatgcccagctaattttgtatttttagtagagacagggtttctccatgttggtcaggctggtctcgaactcctgacctcaggtgatccgcctgcctcggcctcccaaagcgctgggattacaggcgtgagacactgtgcccggccatttttgtagttttagtagagacagggtttcaccatattggccagggtggtctcgaactcctgacctcaggtgtgatctgcctgccttgcctcccaaagtgctgagattacaggcttgagtcaccgcgcctggcccaataaaagttgttttccttttttctttttttttttttgacatggtgtctcactctgttgcccaggctggagtgcagtggtgcaatctcggctcactgcaacctccgcctcccgggttcacgccattctcctgcctcagccttccaagtagctgggactacaggtgcctgccaccttgcccagctaattttttgtatttttagtagagacggggtttcaccatgttagccaggatggtctcgatctcctgacctcgtgatccgcccgtcttggcctcccaaagtgctgagattacaggcttaagccactgtgccaggactaaaactttttaataaaataaaaaataactgtcctcagatatttttgaaaactgaaagccactaacgcaccatgtgggagcaatggttacttgctaaaaattgcttcaatatcacactgccaggcaaaaattcatataaattcaaaccatccgtaatagtgggcattaatttagcttacctcatcatcttcacagcatgtcctcaattttttataacaacactgactagcatttctcccgcttattttagaggaatataattttattttaaaaaaatgactgtcaatatcccattgaggtaaggcttgctaactttttaaaaataaaagtaacaaggttagaaaacaaaaaagttgactgtctcaccattcaaaggcaaccactgtcaataattccattccattttatttccagcatttatttatataatggtcatatcttaagtacagggatgtttcctgcttccccccaactgccaccacaacgcaagttctattcatggttactataaattatgtaaatgtaagttttcagtggttgcaaaatcacccaattaaatggatggtttatagtattttcaacaagtctatcaccagatatatggattgtttccaaatttctctgtgtaagttattaaagcattaggaactcatctactgtgtattatgaggagaggggaaatttcctttgttgtgatacgattttagacttcaacaatttatattttaacaggctccaaaagcactaagtgggcatcgtctccttaaaagtaatttataagtgtcataaaagtttactataccaagtttctctgtttttctctttagcttctctttcatacttttcaagcgtccttttgtcaaccattccagtcaaatacctgaaaacatttaaagaaaaaaaaaagtaaacaattactcacaaattactcagtggaattaggaaaacgtgaaaattgtcgaaaatttcaacgtcagaaaatagttattttatatgtgtgtgtctgtctaaaaaaatataaaatatatatataacatatataacatatttttatataaaatatattacacatttttatataaaatatatatattacatatatatatatatttttttttttgagacagagtttcgctcttgtcatccacctggagtgcaatggcacaatctcggctcactgcaacctctgcctcctgggttcaagtgattctcctgcctcagcctcctgagtagctgggattacaggcacccaccaccaaacccggctaatttttgtacttgtagtaaagatggggtttcattacgttggccaggctggtctcgaactcctgaccttgggtgatccacctgccgcagcctcccaaagtgctgggattacaggcgtgagccaccacgcctggccatattttttttttttttttgagacagggtctcgctctgtcgcctagggtggagtgcagtggcgtgatctcagctcactgcaacttcctcctcctgggttcaagcgattctcctgtctcagcctctcaagtagctgggattacaggcgtgtgccaccatgcctggctaagtttttgtatttttagtagagactgggtttcaccatggtcaggctggtctcgaactcctgacctcaagtgatctgccagcctcagcctcccaaagtgctgggaatactggcatgagaaccaccacgcctggccagaaaatagttaaagtaaaggaaccactggtggatgctaaaattatggaaagtgtaagtggaaaaaggatatttacagtctcgaattaacagacaaagtggcctggtgtgatggctcatgcccgtaatcccagcactttgggaggctgaggtgggaggatcccttgaggccaggagtttgagaccagccagtgcaacacagtgagaccatctccacataaatattaaaaaattggcctggtgtggtgatgcatgcctgtattcctagctacttgggaggctgaagtgagaggatcacctgagcccaggagtgtgaggttacagtaagctatgattccaccactgcactctagcctgtgtttaagagcaagaccctgtctctaaaaaaaacaaaaaatcaggccaggtgtgatggctcatgcctgtaatctcagcactttgggaagctgagttgggaggactgcctgagtccatgaggttgaggctgcagtgagccatgattacacaactgccctccagcctaaacaacagggagaccctttctcaaaaaaacaaaaaaaacaaaaaaaacaaaaaataaaaaatggccgggcacggtggctcaggcctataatcccagcactttgcgaggccaaagcaggcggatcacaaggtcaggagttcaagaccagcctgaccaacatggtgaaacctcatctctactaaaaatacaaaaaaattagccagacgtggtggtgcatgcctgtaatcccagctacttgggaggctgaggcaggagaatcatttgaacccaggaggcggaggttgcagtgagccaagatcacaccactgcactgcactccagcctgggcgatagagattctgtctcaaaaaaaaaaaaaaaaaaaaaaaaaagaaaagaaaagggaaaacaataaccttatagtggacaatcttgacagatgacaccttaaccaagtaatcatgactaatttcaccagtaataaggaagttttgatgaatgactatggttataagatgtcaacatcagggcaggatgaatgaagggaacttcccgtactgtttttgcaaccattccgtaaatctaaaattatttcagaatatagtaggttttgttttttgtttttgtttgttttttttaagtaaatataaggtgggcatggtggtgcaagcgtgtagtcccagctacttgggaggctgaggtaggaggatcagttgagcacaggaatttgaagctatagtgcgctatcatcctcccccctataaatagccactaccctccggcctgggcaacacagcgagaccctgtctcttaaaataaatatagttttatttttattttttatagaaatgagggtctcactatattgtcctggctcttcttgaagcctgggctcaaatgatccttccgccttggcctcccaaaatgctaggattacagatatgagccaccatgcccagccaagtaaatttaaaaataaaataacaagtaaatgtaaatgtaggtactatagaaaagaaaaaaaaattgcaacaatgttgtctaggcaagtaagtcttattacttgtcaaaatgagataataatttcaaaatagttcgttagtaatgcatacttccttgactcaatccaattcaaagctctcctttccctatagctttcatctgtgttctccacgtagacatctatagtgcagtgcacctaagcatttgcatgtagaaacccagtgtgacgccaccaaaacttacagcccatcagcaaaaaatatacactgtcctgaaacataacatcatatggctgtgacacttcaaccacagagacctggggaaggacccctgtttaacagcctgtcttagagtctctgttgtggaaatgttcaaaagtaactggcaagattaccaatgatgattagccaggtgtggttaatcacacctgtatgccagcactttgggaggcagtagaggtgggcagaccacttgaccccaagaggtcaagaccagcctgggcaatatgatgaaacaccacctctacaaaaaaacacaaaaattagccaggcttggttgcatgcacctgtgatcccacctgcttgggaggctgaggtggaaggattgcttgagtccaggaggtcgaggctgcagtgagccaaaatcatgccactgcactccagccttggtgacagaatgagaccctatctcaaaaaaaaaaaaaaaaaaaaaaaaaaaaaaaaaaaaaaaatttaactaggcaagatgatggcaagccctctaggtcctctgatgacacagttcaaagaaatgggtctaatttagagaagcaattaaaaatttaggactttttagttatcaagatttgtcaatactaaaatgcattactaaaggccagccacggtcatttcatacctaggaaatttctataatacgatcaaaaaattatcttagcattttagctagtctacctgtcttttattaaatccatatacatttaaggagctgatgaatgaggaaaaaacagttcccccattcaccagattcaagagctggttgtcattattcccatgtatgttatatgcaaaggagaccaagtttcccataatctagagttctgtgttcattttttatttttaaaaaatgtaaaaagctttcagaaacacatttaacactagtaataatcacattacaaaaactactacttttaaaaaaattaaagtagagacagagtctcattgtcttgcccaggctggtttcaaactccagacctcaagtccagtgatcctcccaccttagcctctcaaaatgctgggattataggtgtgttccaccacaccaggccaaaaatcacttcttaacatcagtattgtgtcccagtaattttatttttaatttttctttgggggacctgttttatctcctttgtgtgactgtatgaaggtttacaatgcctaaaattcattacatcaatttaactctgttatttaacaaaagatacagacttacattatttgtcctccaatggttgacttgccagcatctaaaagtaacatcaacatgcaaaccataggttaaaaccaaaaaccaatggctaaatatgcaaacaacagcaccctttaacatacataattaaatcttccatatgaatttggggcataaatcctagttcattacccttctccttttgaaaatgagcctcaaggctgggctcggtggctcacgcctgtaattccagcactttgggaggccagcgagggcggatgacctcaggtcaggagttcgagaccagcctggccaacatggtgaaaccccgtttctactaaaaatacaaaaattagctaggcgtggtggcggccgcctgtaatcccagctacttgggaagctgaggcaggagaatcgcgtgaactcgggaagcagaggttgcactaagctgaaatcacgccattgcactccagcctgggcgacaagagtgaaactccatctcaaaaaaaaaaaaaaaaaccacttaaaaacactttactgataaagaattttttaacagattactccgaaagcacagcggcaacagactataaattccccaagagaagtttccaagagcaaaagcagctgaagaactgtgaactagattcaggtgcttttcctttcacttacagcaaatgaggtatgtgctcctttacacctttttttccccacgagacggaatcttgctccgttgcccagagctggagtgcagtggtgcgatctcacctcactgcaacctccaccttctgggttcaagcaattctcctgcctcagcctccggagtagctgggattacaggctcatgccaccacacctggctaatttttgtatttttagtagagacggggtttcaccatgttggccaggctggtcttgaactcctgacctcgtgatgtgcccgccttggcctcccaaagtgctgggattacaggcgccagccacagtgcccagccgctcctttacactttcaaaagagttcttgctactaaaagaaggggtacagtgtttcatatctggggggaaggcagagatagctgaaatgaaagacacataattctgtattttttttctcacaattctggggataggccagataattagagaatatctgagtaaattaaataaatttgttcttttgttttttgctaaaccagcaacctggcaagcatccagaagttactccaaattattgatttcctgcttcacacaaaattatctggtaaggtcaatcccattaaaattaacaagttaactgaggttcacataaaaaagggcacattttctaagatactgatatataatactatgctgaactaccatcaatggtcaatagactaattatatgttacgtacaatatactgaagtttttcttccagcatctatgccgttacagaattattcatttgcctaaacttcaggaaaaaagtacttgcaattttttgccagctaaaaaaaatcagcaagttaaaaatcaagacattttcaattaatttccttcagtttcactaaacatctccaggtagctaaaaaggatgttctatgttttatgtatccagtaactttaattgctatgagagcagcttacctacgtgcccaatgaatactacatttacatgctctttcttaggagcacctggcggtgcaaccacagacttaggttttgggatttcctcttcctcctccatcatttcatgggcactttcctctggcggccttccatctcccaaggaaccaccccctggctctgcttcacttatttcttctttgtgctcccatgattcttctggagacatttctgtctctccattttctactgaagaaagacattttaacttagtattctgaaaaagacttacaatctatactttaaaatacactagctttaaaacaacaaatggaagtttgcatatgtagttccatttcctaatgcctagtgacacataagcaggaaaacctctttcatagcagaaatgggtgacagctttcaaggcagactcactgctggtatcacatcagagggcactgactcacaggctgagattgctattttagcaaagcttcattttcataatggcaaacaaaatgcaaacaagagttctaacattcccaacagcctagttattccagtgttgagacaccctgatagtaagaaaaaaaggaaagtttaaaatcgtgacacacgagaaatatgaaaggatttaggaaatattttctttttcctcttaaactaataaaactttggcatcaactttaatcacgctgagaacgtgaaacccttaagaataaagttataaaaaggaagaacatttttcaccaagaaaacagaacgtgtggccgagcatggtggctcacacctgtaatcccagcactttcggaggccgaggtgggtggatcacgaggtcaggagttcgagaccatcctgatcaacatggtgaaaccccgcctctactaaaaatacaaaaatttgccagttgtggtggtgtgcgcctgtaatcccagctactcaagaagctgaggcaggagaagcgcttgaacctgggaggcggaggttgcagtgacccaagattgcaccactacactccagcctgggcgacagagcaagactccgtctcaaaaaaagaaaacagaacaggtacaggtatttaaattgacttgaccattcctccactcaattttatttgcaatcattaagtttatcaaggcagtgttagtgcctagtttgttctactttctaaatactaatagcaaagactcaatgtgtcttaaatgtaggcattacaataatcgtaacttacataatgcaccttaaatcttgagagtgaaagagtttcatattactgtattaatatggtcagaaattttcttaccaataggttctgaaagttccatgctaacagctgaatttgaacctagacaagagattgaaatataatatatatttaccaaacagtatctagctttacacaccatatagacaacctaatgttttctcaagtagactttcaaagagtacatcattaccttcacacaatgactgttcctcttgagaggattccacaggtgctgtttaacagaaagaagttctattaaaaattgatacttatccatccatttcacttatcttttaatatgcagtaaaaacagaagttcaataacacgacacaagcctcaatcaataaccccagatcaatggcagctaactcaggccttcaagttagaagtctctgcttaacctacttttcaaaattctactaattacagccaattttgaaacattttcagtagtttcaatgtattcataaaaacatgcttattcttttgatttgctttataaaccttttcttcacagatactgtcaaagtaatttgcagctcagcacagatcaaattagagatgtgctcaacaaatacacatctacttcccgtgattctctctaggtaacccagcccaagaaagctgtgattagccctttttttttttttttttttttgagactgagtttcactcttgttgcccaggctggagttggagtgcaatggcacgatcttggcttaccgcaacctccatctccccggttcaagcgattctcctgcctcagcctcctgagtacctgggatcacaggtgcatgccaccatgcccggctaattttgtatttttagtagagatggggtttcgccacgttggtcaggctggttttgaactacgacctcaggtgttctgcccacctcggcctcccaaagtgctgggattacaggcttgagccaccgcatccagcctgtgattagccctttttaatattccatactcatgttatcaaaatccctgaataaattagatacctataagataaatgacatgtgtataaagtcctgaaacatatataagccattaaaaatatctgcagaaaaggtgattccaatgatgccagttttttcctatactagaactctaaaaccaagcaacaatccagtttccagttgccacactgcaaatttacttatgacattactggaagagatgtaggagaaatacatactaataaccaaatatctaagtctgctttttggattttagtttgtcagatacagacaaacctaaattatactccaatatgaacgtgcccctgctttaaagaatctccacgacagaaaacgatactaaagaattaaatcatatgaatcatgcacagcaagtatgaaaaaataatgaatttgtaacctgtaaaatcattgcccggaaaggatcaatacctgtaagagtcaagagaaagtgttttgggcccaaccttcaatagcatcaaatgttgagtaaagtaatttcctgtccctgataggtaaaggacaaccaaattgttttctttttttttttaagtgacaggctcagactgtcacttaggaagatctttttcttgcagcttaaactacatgaactagagtgggcaagaccccacaggcaggaagacccacatcaccactgcaagaaagcatgccatggagacaaccaagcaatacaactaggaggggatgggggctacacctgacaggagttgggagaaagggagagtaaaaggtctaagatgaccccaagctgtgggatgagcaggacattaacaaacaggggggaaacgcatttgaacctggtttggaaggaggcagaaactgtacttcaacacaatacagattaacttttttttgcttttccattttcaagaaaagtttaaggataaggtaaggaaaaattactcagttttcagaggaagccaggtagtactgagagtatcaagttcacaggccaccctaagaaggaggtgactgcatggggtacttctcagagcctggaactgagctgactcctaggtttaactcctggcttattacaagctgtgcctgcacttattccactgaaattgtggaaatgatataccatctacctgagaggattgttgaggagtttatgggaggaaatgggagaataatttgtttagtgtcagttaaagaactcctggcgtattcaacaaatgtgtctccatctgctatgtaactactccaactcaatcctatcaatatgtattgagtatcagccaggcacggtggctcacacctgtaatcccaacactttgggaggcggaagcggggggatcatttgagttcgggagttcaagaccaacccggccaacatggcaaaaccctgtctctactgaaaatacaaaacaattagctgggtgtggcatacacctgtaatcccagctactcgggaggccaaggcaggagaatcgcttgaacccgggaggtggaggttgcagtgagccaagatcacgtcactgcactccagcttggacaagaatgaaactccgtctcaaaaaaaaaaaaattaataaaaatgaatacatatatatatgtattgagtatctattatgggccagacaaggataaaagtactcacaaatccatattgtgtagggagtgggggatggagggggtagcaatttgctttaactaatttttattgagccctaagtgccgactgctagctcattcccaccaaaagccttaggaaacagatcctgtaatcactaccatctaacatacaggcacatcagaatcaactgcaggcatttccaagttatgcaagtgccatcttccccttcctcagatagtccctgctgaaaatcagtgtacaagtaaactaagctctgacggacacacagttatgatgtactgcgtatcttaaggcaggaaaatgacgggtgtggtgggcttcctcaccactctcaagtgtatcactaactgtaacagcttttcaaaacaaaacagtacttacacctgaccacttagttcctggcaccaactattagatttacaatacagatggctcctcaacttacaatggattgtaagttgcaaatgggttgggcatggtggctcacacctgtagtcctaaacctctgggagtccaaggtgggaggatggcaagagtttgagaccagcctgggcaacatggcaaaaccccacctgtaccaaaaaaagaaaaacaaaaaacaaaaaacaaaaaactgtcgggaatggcggcatgcgcctgcagtcccagctgctccgggggctgagcctgggagggtcaaggttgcaatgagacctgactacaccactgcactccagcctgggcgagagagtgacaccctgtctcaaaaaataaaaataaaaccgatatatttctaccctatcttcatacatacacagtaaacctttacttgttcattctactctggtcttattcatgactcacataacatccagattttactggctactaatgagcctgggcttagaattttccgaggttgaactgttcatggctaggaaatagatgattagggtgtaatttctcacatcctacatggttcacagctgctagtaaaggaagttagaaccctctcaaggaatgaaattacagtttcaaattttccagtgttatctctatgtttagaaacacacctttattaactatttaaaaatggaacaattttttctaagtgggaaagctttcagggtttaccactgagtgcaactgccatgccccaaattacaaggaaaaactaagtttgagaccagcctgggcaacatggtgaaaccccatctccacacacaaaaatatatatatatatatatgaattaggctagacatggtggctcatgcttgtagtcccagctactcaggaaactgaggcaggagaatcgcttgagcccaggtagcagaggtcgcagtgagccaagattgcaccaccgcactctagcctgggtgaaagagtgagaccctgtctcaaaaaaaaaagaggaaaaactaggctgggcatggtggctcacatctgtaatcccagcacttctggaggtggaggcgggcggatcacctgaggtcaggagtttgagaccagtctgactaatatgaggaaaccccaactctactaaaaacacaaaaatttgccgggcacggtgtcttgtgcctgtaatcccagctacttgggaggctgaggcaggaagctacccgggaggcagaggttgcagtgagctgagattgcaccatcgcactccagcctgggcaacaagagcgaaactccatcttaaaaaaaaaaaagccaggcacggtggctcatgcctataatcccagcactttgggaggccgaggcgggtggatcacaaggtcaggagatcgagaccatcctggctaacatggtgaaaccctgtctctactaaaaatacaaaaaattagccgggcttggtggcgggcacctgtaatcccagctactcgggaggccaaggcaggagaatggcatgaacccgggaggtggagctggcagtgagccgagatcgcaccactgcactccagcctgggtgacacgactctgtctcaaaaacagacagagcaggactctgtctcaaaaaaaaaaaaaaaaaaaaaagaggcaaaactaatagtataatttataataaaggaagattaatgacttgactgtggtacttggtacattaccacaaattttaaaacatgaagtgaagactttaccagagaacagcagaacaccagtactgcctgtgatacacatgataaactggaactggatcttttttttttttttaagagatggagtctcgctctgtcgcccaggttggagtgcactatcgcagtctcggctcactgcaacctccacctcctgggttcaagcgattctcctgctttaagtcccgagtagctgggactataggcgtgtgccaccacacccagctaatttttgtagttttagtagagacgggggtttcacgatgttgccaggctggtctcaaactcctgacctcatgtgatctgcctgcctcagcctcccaaagtcccgggattacagtcatgagccaccacacctggccttaaattttttatagagatggtgtttcaataggttccccagactggtctccaactcctgagctcaagcaatccacccacctcagcctcccaaagtgctgggattacacgtgtgagccaccgcgcccggcttccaagacattttaatcaccccaaaaggaaacccgtattcatttagcagttactgcccatactctctcctagcttctggcagccaacagtatgtctgttttctgtctctgtggatttacctcttctgaatacttcatgtcaatggaatcatagaatatgtggtgtttgtgttgcttcaccataatcaaattttaactatcaatccagtttcaagccaggcacggtggctcatgactataatcccagcactttgggaggctgaggcagacggaccacatgaggtcaggagtttgagaccagcctggccaacatggtgaaaccccgtctctactaaaatacaagaattagccagggtgatgacaggtgcctataatcccagatactcaggaggctgagccaggagaatctggcaatcttgaacctgcgaggcggaggttgcagtgagccgagattgcaccactgcactccagcctgggcataacagtgagactctgtctcaaaaaaattaaataaaataaaaattagctgggtgtggtagcacatgtctgtagtgccagctacttgggaggctgaggtgggaggatcacttgaacccgggaggtggagggaggctgcagtgaaccaagatcgcaccactgcactccaacctggaccacggtgtgagaccctgtctccaaaaaaaaggaaatgttttagaactacatagaattgctggttgtacaacacagtgtgaatgtactaaatgccactgaattgttcactttaaaatggctttatttatttgtttgttaattgtttatcaagacgaactattagcccacatattcatgtgtcgtagttcaggaacacgagtcagtgacaaacttctaggtaattcaacctgaagaaattctttatattccaagattactttaaactgaaagataccagccttcctcatctgctcaaaatctcataatttctgcagaaatctgcatatgccttctttcttggttcacccacaccaaactcatacaaagctgcaacccccagggacaccatgaatgctccaaacattgaaatcgcagacgcttggccagaaggccacacatctgaggttttggcaacacttcgggagccatggtagttactgtccttgatacgtatgccaacctcaacaccaacatcattcctgactcattttattttattttattttatttatttattttgagtcttgctctgttgccaggctggagtgcagtggtgcaatctcggcttactgcaacctccgactcctgggttcaagcgattcccctgcctcagcctcccgagtagctgggactacaggcgcgcgccaccacgcctgggtaattttttgtatttttagtagagatggggtttcaccatgttggccaggatggtctcgatctcctgaccttgtgatccgcccgccttggcctcctaaagtgctgggattacaagcgtgagccactgcgcccagccagttttatgttatgtggattttgcttcaattttttaaaagagtgtacaatttttttttaaagctatgatcatgggtcaaaggacttgaatatggagaatcctacttggccagcatatcctcacagcatacgtcagtcaaggccacagacatcatggcaggtaaaaaaaaaaagctacgttttgattcaagttacatgttttaaacacaaatgtttggctaagtcttaaaaagtgcttgatgcatgtatttcataaatcagcaatttaaattcatactgctttagatacaaaactaatcttcaagccgggtgtagtggctcatgcctgtaaaaccaacactctgggaagcaaggcaggaggatcacttgaggccaggagtttgagaccagcctgggaaacacaaggagacttcgtccttacaaaaaatttaaaaatcagccgggtatagtggcacaggcctgtagtcccacgcaggagaatcactggaacctgggaggtggaggctgcagtgagcggtgatcacaccactgcactccagcctgggtgacagagtaagaccctgtatcaaacaataacaacaaaacacaggcatcctgagtgaaactgtagttttgttagccaaatgggtgttcattaaagaaaaatacaacttcggatctgtcacagaagtgtctcacattgcatgaaagtaagaaatatgtgtgacaaaattctgtccaagtttctgtagtgatggaaatgttttatatctgtgctgtgacatgatagtcaccagccacatgtggttattaagcgctggaaacatggctattatgactgaggaattgaattttaaatttaattttaataaatttaaatagccacatgtggttctcgattacactttggataacagttctagctcaaggattctccttaattgtagtacacacttgcctacctaatcccccatttctatcccattccctgtccatcccctaccctgaagggctaatgatcactcccctaggacatgacacctctttaaattagaggcacacatggggaccaggtgcagtggctcacacctgtacctgtaatcccagcactttgggaggccaaggcgggcagataacttgaggtcaggaatttgagaccagcctggccaacgtggtgaaaccccgtctctactaaaaaattaaaaattagctgggtctgctggcacacacctgtaatcccagctactcaggaggctgtggcgggagaatggcttgaaccggggaggtggaggttgcagtgagctgagatcactgagtcactgcactccagcctgggcgacaagagcgagactctgtctcaaaaataagtaagtaaataaataaataaattataggtacacatgtatcttagttcttgttccctagattgtagacttccagaatgaactgtgggtggatgacttttttctctacttcagtagtctcaacaagttggcatgatgtattgtatagaataaatacacaatcaatttttactgaattactgtgttttcctttgattttcacactggttccttccagtcacatcacttcattttttcacttttcttttttctttttgaaatggagtctcactctgtcgcccaggctggagtgcagtggcacaatctgggctcactgcaacctccacctcctgggttcaggcatgagccaccacaactggcctcacttcccttttctgaccaggacccctagcctccatctgtacattcattgcatttccattagggctcaagagagtgaaaacaattttaaatgtgccaactttctaagaaggggttagggaaacactacactcaggagatgttgggccagctgtggtggttcccgcctataaacccagcactttgggaggccaagctaagagggttgcttgaggccaagagttcaagaccagccagggcaacacagtgatgctctgtctctacaaaaaaaaatgtaaaaatgagccaggcgtggaggcatacaactgtagtcccagctatttaggaggctgaggcagaagaatcacttaagcccaggaggttgaggccacagtgagctatgattgtgccaatgaactccagcctgggcaacaatgtgagaccctgtctcaaaaaacaaaattaaagaaagaaaattttaaattaactatgtggttcatactatattcccattggattatgccagggtggtaacgataaaaaagcaagattcatttaactcagaaagaaaattaggctaagataataaatccagcagccaacaagtcttaataataggcacttatctggtaagatcacatgagacaatatttcttgaatttttttaatgtaaatccctccaacaacaaagaacgatcccatctctgaacaaaaatttgcaagctgaggtttttctttttttctcctgtagacaatactgaaaaacagtaaaagcaaacaccagaaagaagtctacagaacacataaaacaatgtggatggttttgccttaattacctaacactctaaaaataaaaaggctcggtacagacagtggtgaacagagctgttttaaagtattttacatcaacacttgctaaaatgtaaaaagaagtaatttcaaaatattgctttaaatcagagcactgcctacttatgacaaatgtcattctgctactactgagacagaacacagagaaatgccatggtccaagctcacaggtccagtttctggagagtctcagtctactttaatacaaaatcacaaggaaagcactagcagtcactactagaataaactttgaaatgacctcgattccaagcctcactcctctcatggatatgactgacctaagttatttagctttactgagcctttattttctcatctgtaaaatgggtcaacagtacctaacctcaagagaatgttgtgaagactaaataactgataaggggtggtaaatgctcaataaatttattacagcaagcacttcaaagccccaaaataatttcaaaaacctttaagaatgaaacattaggcaaatgccagggccactctcagaaaactacacgctagttgtagtaattagctccaggcatgcccttcccgccccctgttattaaacagcatgatgtggcagatcaagcactaaactagcaggtagcaaatctgcattctagactcaatggtgtcattaactctgtgagtgaccttaggcatttacttagcatttctaaggctccagttcctttatctgaaaatgaagaggctgtacaactgctagggtcgtatccagcgctaacattctaagaacctctttattcggacacaaaagcaatgccacattatcaacctgatcagactttgcatagagtaactaaaattccattatgtttttcaaacaaccctgaaagacagtcttatgagctacaacctaactacttcaaaaacaatttgaggccaggcgcggtggctcacacatgtaatcccagcactttgggaggctgaagtgggcagatcacttgaggtcaggagtgcgagaccagcctggccagcatggcaaagccccgtctctactaaaaatacaaaaattagctggggatggtggtgcacacgtgtaatcccagctacctgggaggctgaggcaggagaatcgcttgaaccaggaaggcagaggttgcagtgagccaagatcgtgccagtgcactccagcctgggcgacatagagagattcatctcaaaaacaaaaaagaaacaaaaaaccatttaaataacatttaaaatacacaaaccaaaaccatttcagataccctcaaaaaagtacaaaaataacagaaacagccgggtgcggtggctcacacctgtaatcccagcactttgggaggccgaggtgggtggctcacttgaggtcagtagccaccaagaccatcctggccaacatggtgaaaccctgtctctactaaaaatacaaaaattaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggagactgaggcgggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaatacaaaaattagccaggcatggcggtgcgcacctgtcatcccagctactcaggagactgaggcaggagaatcgcttgaacccgggaggtggaggttgcagtgagccgagatcacgccattgcactgcagccggggcaacaaagggagactccatgtcaaaaataaaaaaataaccgaaacatttttctgctaccaaaattaaccacctaaaggcaatggacaagtagtatggtaacatactggagttctacagaaatattcaaccaggaaattacccagtgacattctgcagaatgcgctttttttttttcaagtgaagcgacatacaattacctagtgggaatgtggtttggaagtgagtgtcaccactgttaggtcaggtgctcgggaaagccttattaagtgttcttctctctttgaaagtagaattatgatgggaaactggttcaacttagagtactgtaacaactaggtttccttagaacaaagccatttacgaaggagccatataaatctacagtctcggctcactttgttaaactctactgaaaacaaggcagaaacttctaagccttgaaatgaatcaacaatcaacagctaaaaactgtcagttttcttgattgttctgaggacctcagatccttcaactagtagccaaattcttgtctcccgaagatattttaaaaccaagggtagaatgatgaaattctaaacatgccccaatagacacactagccagactcatagtaactgaactcactgctgtttaatacgaaatagacaagtactgtaaaaagataaccagtgctctaccttcagcactctcgacaaacttaaaaatacaaaacttggccaggcacagtggctctcgcctgtaatcccagcattttgggaggccgagacgggtggatcacttgaggtcaagagttcgagaccagcctgggcaacatggtgaaacctcatctctactaaaaatacaaaaattagctgggcgtggtggcgggcacctgtaatctcagctacttgggaagctgaggcagaacaatcgcttgaacctggggaggcagaggttacggtgagccgagttagggccactgcactccagcctgtgacagagcgaaactccatctcaaaaaacaaaaacaaacaaaaaaacttagccaggcgtcatggtgggtgcctatagtcctagctactcaggaagctgaggtgaaagatcacttgagcccagggatttgaagttacgatgagctataatcacacaattatactccagcttgggtgacaaagtaagatcccgtctctaaaaaataataagtaaaaagttttttaaaatacacacaaccttggtgatcaggctttggctgcaactctggcccaggaggccagaaaaaaaaatacacacaaggcattcgcaaagaacagtgagcagataatagataaatctttagttttatgagagtgacaagactgagaggttttacgtaagggattgctgttctcggctttgaaagccttctctacactctctgcagggctcacttaccacactgtgacttccactagagtacactgggcatctgatccctttctagattccttcaggaccacaatttattcatcttggtgttatttcaagtgcctagcatagcatctttcattcagtggactggtaaatgtttgttaatgagtcgctagtacatatatctgagcaaaaccagaaattcgcatttctggaaaaaaattccattccaatactgctaactcaacccagaaggttatcaaatctctttttcattcctttctcttcaaccagaaagaaaatactatctgaacactttcagacatttcttccccagcaaaccaaagcaagcaaatcaaggcttaaactttgtcgtctacattacttccttaacttgttcaaactgaaattgctgtcttttcacgctgtgcaacttcagaaaaggtaaaaaataaagaacagaagaatgcaataagatatgtactgacagcactacgtaatacctgctccaaagagggtttttacaccagtcaaaaattctaacagtttaaacaactgctcaacttggcacagcacagccctagatgatgccttcgcttcttccctaaatcctcagtctcaagccattcatacgtgtaaaaccatgaaacaagagacaaaaaggtcagccatggcaggagaagtaacgaaaggcagtgtttactactgtgatactccagggatactgtggggcctctcctctaccccatctgctgtcccactgaagcctaaaaacacctttatatgagcactgttcttgcaggcacttcagtctcaaaaacacattctcaaatacagaatcttacctattatctacctcaacagatagaatttaacatattaataaagtgtaagggcctttctggattaaacaaccattactttgatttggaatcctctctactctggtggccctgaagaggtcacttctgagatgttccagcttaaaactgagaatattctaaaaagcatctgccaagtggtgatggttgcataaccttacaaatatattaaaagccactgaactgtatgtacactttacttttctttttggacagtgtctcatttggtcacccaggctgagtgcaatggtgccatcatagctcactgcagcctccagctcctgggctcaagagatcctcccacctcaacctcccaagtagctgggactacaggtttgtgccaccacacccagctatttttttttttttttttttttgagacagagtgtcaatgtcgcccaggctagagtgcagtggtgtgatctcggctcactgcaacctccgcctcccagattcaagtgattctcctgcctcagcctccccagtagctgggactacgggcgcgcaccaccatgcctggctaatttttatatttttaatagagacaggtttcgccacgttggccaggctggtctcgaactcctgacctcaggtgatccgtccacctcggcctcccaaagtgctgggattacaggcatgagccactgcacccagctgtatttttttttttttttttttttttttttttgtggagacagggtctcagtctcactatgttttatggaggcctcaggcaatcctctcacctcagcctcccagagtgttgggtttataagtgtgagccaatgcgcccagcttgtacagttgaaaagggtgaattttacagtgtgtaagttaaatgtcaatcatttaaaaaaaaaaaaaaaaaaggccaggcgcggtcacacctgtaatcccggcactttgggaggccaaggcgggcagatcacctgaggtcaagagttcaagaccagcctagccaacatggtgaaaccccatccctgcaaaaacacacacacacaaaatagctgggcatgatggcaggtgcctgtaatcccagctactcgggaggctgaggcaggagaattgcttgaacctgggaggaggaggttgtagtcagccgagatcgtgccattgcactccagcctgggcaacagagcaagactccgtctcaaaaaaaaaaaaaaacaaaaaaaaaacctcctcttccaataaataaggcattcagcaaatacggaacactacaaaacagaatgtttctctttaaaattcaagttccacaatacaatctgctaagttttggagacagtgcctcctccaagtaagtactgagggctgctggttttattccatgcttgtttcttaatggcagtgagttctgagaagcattaaaggtgggatgatgcaaagaacaccacatcattactttagaagctctggctgttctaaaaagttcaagtaaccctaaaattactaaaccagtttcttatctaacaataaaaaaaactaggtgcaaattgcaacttaaatacatcctatcagataaaatgcttgttctaatatacattaagccttgtcttctatatttttattcacttggggacctcactttttaaggagaatctcttggccaatttacttggctctagagaactgtgcttaaatgaattacacttaattacacttaaatgggttccacttaattatttcttaaggaacctatattctttagttttcaaagagatccaaggtcaatactgaatcccaaggtctgactctccaggctccttcaacagctttcccggcatgcagtttaaaaacacacccagcacaaatttcggctatggcttaactaaagaacagaacatgctagccctattgtccacttcctcgctatcaaaaaaaccttgcaaactttttggttccccctttgtaagttccaatccaggtgttatttcctatttatccccctgctttttataagcactgattgttctccgatgctggctttttatggacttaatagtctggaacatgcaatccaacagtctcaatataaccctggacctcaacttagaaaatcagttcttttccaaatagacatcctacataggataattttttaaaaacatgaactggcattttggtacaagcaattggtaaagtcggtaacaccaaaatagttttttgattaaaaacaagaaagttgaccatgctgtacggattctcttactgacagctacttccctacaggttttcgcatctccaatttctagcactgtcaaagagaaaaagattaggtgtaactacaaattagcaactatcaggaagagagaaagcccgcataagaggtaatacctagtcaccaacagtgaccattctagaccaaggttggttatccccggatgactcgctggacaggctgtaaatggagtcctgagtctagtcagagtggtgctggtggctccacagaaaggaggaagagccaagaaagaaaatggctggataaacggaatctgcaaagtaaggtagggaatgggcacttttaggagctgagaagtgaactaggttaggcagtcaaaatggcttgatgtaagtcaagaattacaagctaagcttccttattcaagaggaaaacattgtctagagccgtaccaccctgaaagtgctcgatctcctcaaaagaaaacatcaaccacccacacaaataaatgccactgtcaacaaaaccaccaaatcaaccgtgctgacgtacatacgtcatcagagtgtttctccagacactatccctttaccacgaaagagcaaacggtgacaaaagtttctgtagaaaccaaactcctggagcacttttataatgtccacttatctaagaaccaccacaatacagaactttaaagagagaaatcaacaatatgttctcacttaaaatgcgctggatgtcatgacccaccccactaacgtcctggctaaatgatgaaaggacgttcagccttttccttcctttttcattttctctttaaggaaacactgatagttcctaaaataagcaccattaggaagagaatacttaagttcactcatttgacattcccacaaaatcagtacctgaaagcaagctacctaccacaaaataagcaccattatgagaatacataagttcactcaccggatattcctacaacgtcagcacctgcaagcatgctacctacgacttaagcaacccctaagtacgggaagatgtttaaaaaccaaagttaactcgaaattttatggattagaaaatgtatgtctactagctacggtcagaaagacacgtgagaactattaaattataacaaatgctcaagtgtctgaagaaatagactgaactactgatgcacgaacacagtgagttattccaagcaatctgaataaggtcaacgattttacagcaatgaaaattctctaaacgtgtcgctgacaaaggataaaagtgtaagcttcactttaaaaagacacaaatcaatatagtctcctatcacacattaagtgaggaatcctaactttgtggcactttgtaaactttagaagcgtacacaatgctaagggtaaaacagatcttggtattgatagccaagtttctgcccgatcacaaggctgcaatgcatcttgggattccttcaggacggttgggggccacggacagtttaaaccgtaattacagtttcaatagtagaaaacgcagcagaagacgctctctcggctgggcctaaggtgaaaggaaaactcggccattcgtcctccccaactcctgggatctctaaacgcccacccaaatgactcctggctccatctgtcctcattctgcgcctcgtggcagggatccgccgcggcccccactccgttccatacggttcccatctcaagtgggtaactgcggactccagagcagggcaggggcgcggaggggcggcactcgggtccgggtctttgggcgcgctgcccgctgtccgctccccgcccggccaccgccgcgggccgccccgcgaaggccggctcccgggctcggggcgccccacccaggcagacggcgccactgtcagcgccccacgtgccgaccgggccccagggccgcgcgcccccggaccgcacccctacgccatgtgggctccggcgcccggccggacttcctcccgcgtcccgggcctttacccgcacggcctcccgcgccgctgccggctccgtggttattggcggcgccgccaactgggggtggcggcgctgccgggccccgcaggaaggacggcacgaactcggcggcgtggacgttgggcacgaagggcttggcgttgacgttgagttgccggctgaaggccgcgctgaggttctcccgctgggcctcggccgccgccgccagggagccgccgccgccgcaagggcccggcccgggggcttccatgtccgcctggtcccagcagtcaggcgccgagtcgctgctgctgctgccgctgctgctcccgccgccgccgccgccgccgccgccgccgccactgcccggatccatgatcgggggggccgtgtgtgtggtggacagagagcgggaaatggaggcaggggcgcccggccggagaggagtgggcaacgctgactgagggaaggcggcggggcagaagggccgggagctagcgacaaagatccccggcgtcgccgcggcagcagctccagtcccgactccacactcgcgacgacgacagaggcggcggcggcggcagctcaaccctcctcctcgtgtgtgtgagcggatctcctcccacccaaccacctccgacggcctcacagccaaccccacccccggcgcggattgacccctcgccgccacccgtaccttcgcctcggtagttctctgttctggccgcccccgtttccggctatttagcgcggcgggaggtggaactacaagttccggcagcgcccgcgctaccccgctgcggttttcccgggggccgacgggagtcgaagttcagggacagggcgcaaccggaagcggctccggctcccggcaggcaacgcgaggaggcggaggtctggtggccgctcggcggccccacctgtcacctggtgggggggcagcggcaggccctggttggtgcagctctgtgctgggccgaagaccgagagtattttagcccataggaggggtccactctggcctgctggacacaggctgggggaaaacggacagcatctataacatggggaagaaaaatacactcagctcccgaaaattcttgtactctcttttcaccacctttcctgcgttctctgcctcacagtctccgtaccttattctctctccaccttctttctcctcacccccagccagattttgcccttcatttcaaagccggtgcagattgcaaagctgatttcattttatgtaatcatttcgtggaagaaacaataaaaccgtgagatattccggcttaaaactgcagtgtggctcataaagcgctggggcccaggctctgcccaggcagaagggattgttaactggaaaatttcaatgactcaccgtttgtttgactagtcatataaagccttcacccaaatttttccatcctttcctcctccccgccaaagggtttgcaaattaaacagaggattgccgtattccatggtgtatccggcttacctaacagggttattttggtgagtctagcttccttatgcaccattacgtgaagtggtttccttttgaatggtctgatttgctcaagaattcccatagtacttttcatcgactgcatcttacacttacagattaggtaaacctgggaaaagaacaaaagcaaacgagaaatacttaagagttcgcatttaggcccttcatgaagtaggaaaaaatgttgctctgagtacctgttaagctttcctgtaattcacccatgtggagcccaagacagagaaaaacatattgttagtatttttctgaaaggagtctagacagggtgcaactaatctgcctagaaattacagactaaagaagcacatacatagaatagatgtttctgaacaaccttaggttgttaaaaaaaaaaaaaacctaacaaaatccagatctagatctgtattttaattttcttttttcttttttttgagacggagtcttgctctgtagcccaggctggagtgcagtggcgcgatgtcggctcgctgcaagcccgcctcccgggttcacaacattctcctgcctcagtctccggagtagctgggactagaggcgcccgccatcacgcccggctaattttttttgtattgttattagagacgaggtttacaccgtgttagacaggatggtctggatctcctgacctcgtgatccgctcgtctcggcctcccaaagtgctgggattacaggcgtgagccaccgcgcccggccgatctgtattttaattttaaacatctgtattgtaaagataaaagagaactcagcctaatgagataggtcaaaaacgaagctgtcaagtatttttcaaaagagtcctaggctacagtaatttgaatttaatattaaactaccaagctttagggattaaaaaaacacataccggccaggcgcagtggctcacacctgtaatctcagcaatttgggaggccgaggcagatggatcacgtgaggtcaggagttcgagaccagcctggccaacgtggtggaacccccgtctctactaaaaatacaagttaggccgggcgcggtggctcacgcctgtaatcccagcactttgggaggccaaggtgggcggatcacgagatcaggagattgagaccatcctggctaacacggtgaaaccctgtctctactgaaaatacaaaaaattagccgggcgtggtgtgcgggcgtctgtattgccagctactcaggaggctgaggcaggagaatggcgtgaaaccaggaggcggagcctgcagtgagccgagatcgcgccactgcactccagcttgagcgacaaagcgagactctgtctcaaaaaacaaacaaaaaaagcgatccacctgcctcagcttcccaaagtgctgggcttatcggtgtgagccaccacacccggcagagtttgcctctgcttaataggaagttttggttatagcctattattatacctgaagacctcactgaatcatacttaacaatgtccattttaaagttggtattaagtgactgtcagatttacagagaacttaacaactgttatgaaaattagaacttcatttatgcgagacctgtattgctattgaataaaagattttcatcttatattcacaagaaaaaatacaatgtgttctaaatgaaatgccttctctttccagattttcactccccacccacccacccctaagaaaatgtcaacacaatcagctgactcaaataatgaactacacatccttctctaagcattttgtctttgaatactactctcctccatgtagcactcctacagcactgaatgatcactttctcataggttagttcttcacatctaattgaattagcagagtttccttctgcctggtactttttctagggacaaaggcagaaactgctcagactgctgcttagaaaagcagttgatgtcattaatttccttgtctctgaataggataattatggatattcaggaaaaaatccactccattggttttccaaagctttgacctgccaaacagagctccagcggaaaagggaaaagtctttcttgttagttgtgctaagttgtgtgtaagttgtgcgacttgagggcagggtcttaccttaatcttctttacatttccactgcctagtgtaatgcccggtgtataaaaggtgcttaatcaatttagctgggatgatactgtcctttgatactcatttaagactgctgacacatagggctaataattttatttatttatttattttttaaataacttgagactcttgagacagagtctcgctctgtcgcccaggctagagtgcagtggtatgatctcagctcactgcaacttccacctcccaggttcaagcgattctcccacctcagcctcctgagtagctgggattacaggtgtgcaccaccacgcccagctaatttttgtatttttaacagagacggggtttcaccatgttggccaggatggtctcaatttcttgaccttgtgatctgccctccttggcctcccaaactgttgggattacaggcgtgagccaccacgcctggcctgtatttttttttagtagagacagggtttcaccttgttggccaggctggtttcaaactcctgatctcaagtgatctgcctgccttgggctcctaaagtgctaggattacagatgtgagccaccgcacttagctattttaatttaatttaattttattttttgagatggagtcttgctctgttgcccaggctggagtgcagtggagcaatcttcacgcactgcaacctctacctcccaagttcaagcaattctcctgcctcagcctcctgagtagctgggattataggtgcccgccaccccccctccccaaccccctggtaatttttctatttttagtagagacagggtttcaccatattgcccaggctgatctggaactactgacctcaagtgatcctcctgcctcagcctcccaacgtgctaggattacaggcatgagccaccacaccccaccccaggactaataatttagaaaacttaggaaaaatcagagtttttcctactctcacacacaagtcaccgctcaacacagagtacagtcctctctgggtagaggaaggggattagttccaggagcccttcagatacaaaaatccaaccatactaaaatcccacaatctatactgtgtgtatgaaaggtcagccctccctacacttgagttcctgcatcctgagaatcccgtctttttgatcctcatttgattgaaaaaaaaaatccatgtgtaagtgggaccctcgcagttcaggctcacattgtttaagggccagttgtactccaccagtaagtgagggagtttctacccaccaccaaccaattcttcaacagacaccaacaggataagcaatcatttcactcaattctgacattaaccagagttaggacagatcccacaagttaagggatcagtcccacaagactgcccccacttccaatgccaataacaggttccacattgtgacctgtgcttctgaccaactggctatgaattgggggttcccatgaccccctccatgggttcagggaatttgccagagtggctcacagaactcaaggaaacagggcaaacacggtggctcatgcctgtaatcccagcactttgggaggccgaggcaggcgaatcacctgaggtcaggagtttgagaccagcctggccaacatggtgaaaccctgtctctaccaaaaaaatacaaaaattagccggttgtggtggtgggtgcctgtattcccagctactcaggaagctgaaggcaggagaatcgctcgaacatgggaggcagaggttgtagtgagccaagtgctccaccacactctagcctgggcaacagagcaagactccgtctcaaaaaaaagaactcaaggaaacactttacttacagttacccataaaggacattacaaaggatacagaggaacagccacgtggaagagatgcacagggctgggaaggggcatacagttcctattctgtctccaggtgtgccatcctcaagggtcctccacgtgttcagcaacccagaagctctctgaaccctgtccttctgggtttctatggaggcttccctacatagccatgactgattgtatcattgcccgttgctgattaactcaaccttcagcccctctgcccaccgagaggttggatgtggggctaaaagttccaagcttctaatcatgacttggcctttctggtgaccagtcgtcttctaggagcccatcaagagttgcatcattaggcagggtgcggtggctgatgcccagcactttgggaggccgaggcaggcagatcacctgaggtcaggagttcgagaacagcctggtcaacatggcaaaaccctgtctctactaaaaatacaaaaattagctgggcgtggtggcacacgcctgtaatcccagctacttggaaggctgaggcaggagaatcgcttgaacctgggagatggagtttgcagtaagttgacatcaccccacagcgctccagcctgagtaacagagtgagatttcgtgtcaaaaaaaaaaaaaaaaaaaaaaaaaaacagaaacaaaaaccaaaacaaaacatatacaaaagaaacaaaatacatgtaggccagatgctattacctgctgaagccctccctgttcaaaatgcggatgaggaaagcttggagatgtgttaaagatataatagccagctgggcgctgtggctcatgcctgtaatcccagcgctttggaaggttgaggagaggggatcacctgaggtcgggagttcgagaccagcctggccaacatggtgaaaccccgtctctcctaaaagtacaaaaattaggccgggcacagtggctctcacctgtaatcccagcacttcgggaggccgaggcgggcggatcacttgaggtcagcagtctgagaccagcctggccaacatggtgaaaccctgtctctactaaaaatacaaaaaaattagacagccatggtgatgcacacctgtaaccccagctactcaggaggttgaggcacaagaatcacttgaacctgggaggtggaggttgcagtgagccaagatcattccactgcactccagcctgggcgacagagtgagaccctgtctcaaaaaaaaaaaaaaaaaaaaaatcagcggggcatagtggcacctacctgtaatcccagctacttgggaggctgaggcaggagaatcacttgaacccgggaggtggaggttgcagtgagccgagatcgtgccactgcactccagcctgggcaacaagagtgagactacatcacacacacacaaaaaaagagttgtatgattagaacaaaagacactcctttcacctaggaaatgccaagggattaggagctctgtgtcaggaacccgggtcaaataccaaatattagaacaaatgatgcacctagcacctctattgctcaggaaatgtcaagagttttagaacctctgtgccagaaactgggggcagagcccaagtatatatctcttactatatcacaatagcactatgaccttttttggcaggcttctttcacttagcataatgttttcaaggttcatccatgttgaagcaggcatcagtacttcatcccatttttttttttttgaaacagagtctcgctctgtcgcccaggctgctgtgcagtggtgcgaccttggctcaccacaacctctgcttcccggattcaagagattctcctgcctcagcctcccgagtagctgggactacaggcatgagccaccatacctggctaatttttgtatttttagtagagagggggtttccctatgttggccaggctggtctcgaactcctgaccttgtgatctgcctgccttggcctcccagagtgttgggattacaggtgtgagccaccccgcccggccacttactcccttttaatggctgactaatattttattgtatggattttaccacaatttgtttatccgttgatggacaaattgcttttgtaacttaaagaagtcaaaaataaaaggttaaacaagtgagatcacagtaaagtgtgtagtctagttagttgtgctgtcttaatgtcaatgtcctgaattttgatagtgtactatagttatggtagattttactgttgggagaagctaggtgaagggtacttgggacctctctaccatttctgcaacttttcgtgagtctgtaattatttcaaagtaaaaagttaacgcagggtgcaacggcttatgcccgtagtcccaactactcaggaggcggaggtgggaggatcgcttgagtacaggaggctgaggctgcagcagccctgttcataccactgcactctagcttggatgacagagcaagaccctgtctcagaaaaaaaaaaaaaaaaaagatcccatgtgaaattattcagactttcagacttcagcctgggttcccaagtctttaccaaaatattttttctgtcttccttgattcaatttgtttggggcaggagtacagttgggaaagggggaatttttttcagctttgagaatttaaggctgggtatggtggctcatgcctgtaattgcaacactctgggaaactgaggcaggaggagtgcttgaggccaggagttcaagaccagcctgggcaatatagcaaaaccctgtctctacaaaagataaattaaaaaataaaaaatataattttgtccgggagcagtggctcacgcctgtaatcccagcactttgggaggctgaggcaggcagatcacgaggtcaggagatcgagaccatcctggctaacacagtgaaaccccgtctctaccaaaaaaatacaaaaaattagccgggtgtggtggcacgcacctgtagccccagctactagggaggctgaggcgggagaatcgcttgaacctgggaggtggaggttgcagtgagccaagattgcatcactgcactccagcctgggcaatagagtgagactccatctcaaaaaaaaaatatatatatacaattttataaatatacaacagtataaatatagaacagtaaaaagaatcaccatcactcacaaacttacctggaatctcaagattgccttttttttttctttttctgaaacagggtgctgctctgtcatgcaggctgcagtgcagtggcatgaacttgactcactgcaacctccacctcctaagctcaagcaatcctcccacttcagccccccgagtagctgggattacaggcacgagctaccacacctggctagtttttttgtattttttgtagagatgggattttgccatgttcgctgatctctaactcctaggtcaagccatccgcccaccctagcttcccaaagtactgggattacaggcgtgagccactgcgcctggccgattgccaattgccaatgcctcaacaccttctttcatgttttaaataaacaatttttttatttaaataaataaatgagaaataaaacaatcttttttcttttgagatggcgtctcactctgtcgcccaggctggagtgcagtggcacaatctcagctcactgcaacctccacctcccgggttcaagtgattctcctgtctcagcctcctgagtagctggcattacaggtgcacgccaccaagcccggctcatttttgtacttttagtagagatggggtttcaccatgttgaccaggctggtctcgaactcctgacctcaggtgatctgcctgcctcggcctctcaaagtgttgggattacaggcatgaaccactgagcctggtctggtgagccaatttttatatttgttatagagacaagagagacaagagtctccttatgttgcccaggctggtctcgaccccctggcctcaagtgatcctcccacctcagcctcccaagtagctaggactataggcatgtgccatcatggcgagttaattttttgtgtgtttttattgtctcgagagagagtcttgctctgttgctcaggctggactgcaatggcgtgatcttggctcaccgcaacctccacctcctgggttcaagcgattctcctgcctcagcctcccgagtagctgggattagaggtgtgtgccaccatgcctggctaattttgtatttttagtagagacagggtttcgccatgttggtcaggctgctctcgaactcctgacctcgtgatccacctgcctcggcctctcaaagtgttgggattacaggcatgagccactgagcctggcctggtgagctaatttttaaatttgttatagagacaagagtctctcttatgttgcccaggctggtctcgaccccctggcctcaagtgatcctcccacctcagcctcccaaagtgctgggattacagatgggtgtcaccgcacctggcctctgaggaggatttcattataaacctgccatgaagggagggaatccaattttacgagagggtgtagcctggtgaggcctggatgacctccggaggcaggggcttgtgcctgggctgaggcctaagggacaatgggcagacatgaagttgccccaggcagagggtacagtgtgggcaaagtcaggaagtggcagggcttggatcactccaggaagagagaggagtcatgtgtcacaggagctcgagacccagagagggaggcaggcaggcaggcagggaccaagcttgggcacagccaggaaggcaggacagggcatggtggggccaatggaatcattacccaagacggggattttcagggaaacagcttagataaggccaggtgtacagtagctcccacctgtaatcccagcatttggggaggctgaggtaggaggactgcttgagcctgggagttcgagaccagcctaggcaacatagtgagaccccatatccacaaaaaatttaaaaaaggagtttgtgttcctgtagtagcagacttgggaggttgaggtggcagtatcacttgagcccaggagttcaaggctaaagtgagctgattgagccattgcactccagcctgagcaacagagagatatgctgtctcaaaggaaatacaaattaaaaaaccagccgggcatgctggcgtgtgcctgtagtctcagctacttgggacactgaagtgggaggatcgcttgagcccaggagttcaaggctgccgtgagctatgattgtgcctctgcagtacagcctgggcgacagagaaagaccctgtctcttaaaaaaaaaaaaaaaaaaacttagataagaggatgctgtgcctccctgggggtcttcagtcacccatggtcctggcaagagaggagggccaggagagagcttcacccacctgctgtcctgcccatgtgacatccgcaggtgctgccatggccacgactgttgttacactcgagctgaggaggccggctgcagccccaagacagagcgctactcctggcagtgcgtcaatcagagcgtcctgtgcggtgagtccccagcagcaccatgccacccaccccgagtatcccctgggcaccctggcatagccagatgacttccgtgcccctgttgcaataaccactgcctccaagtctccatagaccaccccttgggtatatctaatgtaagtgatatttattttatttattttttgagtcagtctcgctctgtcacccaggctagagtgtgctgatgtgatcttggctcactacaacctctgcctcctgggttcaagcgattctcatgcctcagcctcccaagtggctaggactacaggcatgcaccatcacgcccagctaatttttgtattttttcagtagaggtggggtttcaccaagttggccgggctggtctcaaactccccacctcaagtgctctgcccgcctcggcctcccaaagtgctgggattacaggcatgagccgtggtgtctggccctaatgtgagtgatctttaacactgagcacttgaaaaagaaaaccctgaagaaacctaattctttgatgtctggacgacaaggaagaagatagaaatggcatcagataataaacagtgtaaatgtttatcagaaaggggctggtggtcgggacaagtaggaggatcgcttgagtccaggagtgcatctctacaaaaaagttaaaggattttttaacattggccaggcgtggtggcacacatctgtgatcccagctacttgggaggctgaggcaggaggattgcttaaagcccaggaggttgaggctgcagtgagctgtgatcgagccactgcactccagcctgggtgacacagcaaaatccagtctcaaaaaaaaaaaaaaaaataatattttacataaccaaccacttctaaagattaaaaaaaccccctatgattaacaacctcaggtccctcaggcaatcataccagatatcaaaacaaagcaataacataaggactgcagtatttattttatttttatattatttatttattctttgttagtttgtttttggagtgtgggttttgttttgttttttgatttttttattttgttctactcagttttattcttattgctcaggcttgagtgcaatggcctgttctcagcttactcaacctccgcctcttgggctcgggtgatgatggttccacctcagcggccctccgcctcttgggttcgggtggtgattccacctcagcggccctccgcctcttgggttcgggtggtgattccatctcagccgctctccacctcttgggtttgggtggtttttctgcctcagcctcctgagtagctaagggaggtgtcttgagattatcatccgctgagggtggagctgagggtggaaggggagtgagcagacactcgggaggtgtcttgagattatcatccgctgagggtggaaggggagtgagcagacactcgggaggtgtcttgaggctcagggagttatcagttatagaatgttgttgagttggaggaggtggctggtggcccatcctgttttttaaagtttcagctgtgaggtagggccagtagggcaatcctgaagaatgacgatgctccgctgccgccattctgacctgtagggccaaaggagggaatgttttcacacatattcatttgatggacaaaattaccgccaccaacacagtctgcaccttctgttgctggtgatagatttttgcacctttccatcctccaggtttcaaaatagcagtatcagtgtcataatatcacccttccactgagtactgccaacagctggagggtaaagaaaagtcactgggacacactgttgtctccacatgccactgtgtctgtctgcaaatgtaggcaggctggggtcctgccccagggaagacagagtcataacagagtaataaagaagcatgtttgagacacaggagtgtctatgtctatcctcattcctccctcacagccatcaccagagcatgtttcttgcaccaggtcaacagacagtaagagacagtaagagaggcatgaaaagcccattgtccacacatgttgcagcttctttttggagaatgttttccaggccttttatgttctgtctctgattctcagaactctgcaaggtcagtgtgaccaccctgctccaaatctaagaaaacagaggtttccagaggaaggagaaattgtgcccagggtcacacagcttgcaagaggcagagtggaagttgattccagctctgcctgcaggaccctctcatttcccctctgtttcccttcttgacaaaggatcttcttcactctggaggtgccacccatgagaacaaagagctctggagagatgtggattcctgaagagctgcaggggaactgggagagggttttctgacagaacaatctcacctcaagaagtcagttaggcatggctgtaatatttcttttcactcccaggtaataccaaattgtaagtgcactaggacataaagaatacttttgtccatggaaaaatgaggtgggaattctaaacaaagcaagttttaaaactgtgtttcacttcaagtgtacaagtcccatcacgtgtaatcataggactcggcagcttttgaaggtacagaggccacacaagaaccagcttagctgagcatcatttaaggccttcatttggaattgtccctgtgggtaataagttacattcactcttcactagtttacagtcagggcccatctgctattacaaatacggaacctctgacacttagaatattagatcaggggccccactgggtggggatgaaggtgtttttgcgcaacacggttaccaacagggatgggactgtgatgcttgtaggcagcctttctctctgccatctccctctgcagggcttgagcacagagctgtagggagaaaaatgtatccatgtcctgacctggcagactatgtccaaaagcaaggaaaacaagcaaacttacccagttgcaaagagcctttcttgcagaaggggggatctgaaaaagccaacacatgagaaattgaatgttgagagagtctaagggccgtggcatcatctgcatcagcactgaactatcctgcaactgcagggaggaagctccttactttgcatttgtggtagtcctctgcccgccgccgcaactcttgcgcacgttgaaacattttcctatggattacaatcactttcatcagataaagcaccactttcaggatgattttaaataatctgccatgtttctgttatcctcacaactgtacccttacacaatctatctctacctagaaaacgtatttcagatggctataagagtacagtctgagccggtcacggtggctgacgcctgtaatcccagcactctgggagggcggggcggatggatcacgaggtcaggagattgagaccatcctggctaatacggtgaaaccccgtctctactaaaaatacaaaaaattagccaggcgtggtggcaggcacctgtaatcccagctactcgggaggctgaggcaggggaatcacttgaacctgggaggcggaggttgcagtgagccaagatcacgtcattgcactccagcctgggtgacacagcaagactccatctcagaaaaacaaaaacaaaaaactgtacagtctgatccaaactgttgctgtattgattcctcctcttgcttactgcctgctgacttctgagatgatagtttccttccccattctcagtacatccctaattcatccttcattgagcatcttttatcataaagctgtattctctttgtattaatatctttaccgtgtttcacagggcagaaacagctgggcttataaacaggcatagtccttttgaaggatgtggttgatcctacaacaacacactttcctaaggatgacaacaactcaccccacccctagaatggctggtatgaaccgagtttccacacagtctagctggcaatggggtcaggagccgttttgctacttcacatcttttggtcactggtaaatattaaggtactttgttttctgttttgtgaactctctctctctctcacgatatgtcttctgaccatttgtttctatttctgcatttactgggtctaaacattgtacaaaggttaaaaacaacactccaatgggcgtttcccaagagggtggggttcagtttctgaactcacatgtaggtgtgtatttctttcatatccaatttcccattttcctctgcctctgacacctgcctctccttttctgcatgctcacattctttcacgcttagtttcctcagattagaagggagagaaatgcacacacatgatccaccagcccgtgtgggattccctctgcccttctggcatctgaaggctgtgattcaaagatcccccctgcaaccttcccacaaatgaaccaactgattctcacaaccgaagggagaattgacacctcccattgagggacaaaaaaaagtcacactctggcctgctggcaagtcacctgtcatttccagctcatcttcatagttccatagttagtcctattctttagtaaatataaagactattaaaagcttc

SEQ ID NO: 37 - DNA, 150319 bp, Homo sapiens
aatatgtccctgagtaagaaatagtttcagaaccttctgggaggaaattcccttaaaggaggaattttccttctatatagacactggaggaaaagtctctagctagaggccaattatactgtggcttagcagtgatagcgtaacctctcgagataaaccaacccagctcgtgagctgtggggtacctaccaggaaggacatcttcgcctcgtcagtactctcgatgccttttgtgtcaaatttgccttgctggaggctgctgtgcatgatgttcacggcacttgtcaccccgcgctggatgtcctggaaggtggtggcaggaaagcccatccgcagcttattacacagaacatccctggggggcaggattgcatagaggaattgacagtgctcaacttggccaccaggacagaagggccagtcttcaccactctgacccagcagcacaaggtgctcttttagggggaataaccagtccttaagaccactgtaggagacctgaggagccagggtatgaaagtaaccagcaccccgtcaaggacactgatgtgacaagaacatacaggggagactggccaatctctactgttcatgaggcttttagccatcaccactgcactcccaacaaagctgtgcggcttagtgaacgcagtaccatgtaggagttgagaacaggttttgagtcactcagttctggattccaccactgactcctaagtggtggatctttgacgaggacggaatctccctaaagcacagtttcttcatctataaaacagagctaacagttcctacttcatagggttgttattaggacctcaaaagcgcaggagattagcatagtgctgggcctgtagcaatggtacctattggtggtattattcatctgaactgcctgttctctttcctacgtctaagggcccatagctccttcagtctagtccagggaacagaaatttggcccatgagatatatggctgaccaacagcttcctggagccaaggatactatcttagggataggagctgatgtcctgtatagaacttaactagaatcatgaggacaaagggcagaaacaaatgggcctcaggaatcaacaggaagggcctttctgcctagaaaggagaaagggagtcaactgtacctgaagtcagactccagctctgtggtggcgaggttgatcatggcacagagacagtcaatgctggagctggacagagcccgcccaatgcacttcttaacaatgtagaagacatcatccaccatgctggatgtcagctggcccttctcataggtgtccagagccacagcctacccaaaaggcaaagccaacactgagggtcccagttgtgcatgtcatgttctagatgattctgggtacactggccctagctctgctcccttttctgtaccttgtccatgtttctcccaacatggcgtgcatcctccttgtcaaaatagcttacttccctattgatcactaggtgaacaaattaaatatttcgggccttagccctgcagagatccattacctggggagtgtaagatatctgcaggggccctacttccctgaggctccttacccacaaaccttcagggaggtagggaacaagtgggctccctgaagagctgagctgagctgttcttttttaattcttgggaaggaagtcctagctgggtatacaaagaacacaacgactccaaagatgctctctaaacatacaaagtggtaccactcaatctgcatgcaagagtattctcaaagcaggaccaataaatatgacatgcctcagccatttccctcagcctggcttcttggaccggaagccccatttccaagagatgcgtcctatgtcctaccttattgacagtctccctcatgaagtactcctccatggtaacatataagccaattagctcctgcatggtacagctcaaaaggcagttattgaggagtttgtccagacacttctggtgctctaggggacagccaagaaaggaatactcattttttttccccaagggaaacagagcaacttttttcattttttcaggttcctttatagtctttctttgaaatatgtacatattttacatcgttacaatcatgatacagatagcaattttgaattctgttttaaaaaagtatatcataaatattttccatgttttcacctaccttatttttcatgactatgtggcatttcatcaggtgcataatccacattttaaaaactactttttttatttttaactattttttttttttgagacggagtttcactcttgttgcccaggctggagtgcaatggcgtgatcttggctcaccgcaacccctgcctcccaggttcaaacaattctcctgcctcagcctcccgagtagctgggattacaggcatgcaccaccacgcccggcaaattttgtatttttagtagagacagggtttctccatgttgaggttggtcttgaactcctgaccttaggtgatccgcctgcctcagcctcccaaattgctgggattacaggcgtgagccaccatgcccggccttatttttaactttcatgttgtttcatgtgaaattgagaaaataaccactctatttttagacacctggttatttccaaatgttttgccattactggagataacagaatatcacaataattggagattatagtgaatacttttgtatgaaaaactttttactccttttccattattcccttaggattaattaataggagtcaaaagatgtaagtttccatggcaaagataaaaatatattggatatagaatatttcattctctacaccagtactgtccagtagaatttctgtgataatgaaaatattctggtcaggtgtggtggctcacacctgtaatcccagcactttgggaggccaaggcgcgaggatcgcttgggtccaggagttttgagaccagcctgggcaacacagcaatactctgtctctacaaaaaataaacaaacaacaagaaaagagaaaatattccgtatctgttatctgatatagtagccattagccatgttagcgattgagcacttgaaatgtgatgaacataacttaggaactgaatatttttttttttattaaatttttttttctcagaatccagctgagaaagatgaatttaaaattttatttaattgtaattaaatttgaatttgaatttgaattcatgaatggctacgtattgggcagcacagctctgaatagtgatagtcatcattattgcttttcagtcttttggctaagatcaagtgatagtcatcactgacattgacaagcgaactccaaatgagcacacaatttcctttatacactgattctgtaatgcccctgccacatattattggcacaagccatgcagaatgccacagatgctgggtgggtctcaagtcccagcccaaagaaccctgcatatatttgcccagcaggatttttatttttttaaatttttttcctttaattcttactttagtagccagcaggaattaaatggtcatcttaaaaacctagcgagtcaatctgtaaatgaaattggactctggcatgccttttaaacaatttatttatttttgagacagagtctcgcttgtcgcccaggctggagtgcagtggcgcgatcttggctcactgcaagctccgcctcccgggttcacgccattctcctgcctcagcctccagagtagctgggactgcagacacccgccaccacgcccggctaatttttttgtatttttagtagagacggagtttcaccacgttagccaggacggtcttgatctcctgaccttgtgatccgcctgcctcggcctcccaaagtgctgggattacaggcgtgagccaccgcgcccgacctaaaaatttttttaaatgtttatcttttattatttaatttaatttaatttaattttttagagatggggtttcactatgttgaccaggctggtctcaaactcctgggctcaagcatccttcctcctcggcctcccaaagttttgggattatgcgtgagccaccatacccagtcaaaatttttatcttttaatatagtgacagggtcttgtcatgttgcccagactggtcttgaactcttgagctcaagcgattctcctgcctcagcctcccaaagtgttgggattacaggtgtgagccactgcacccagccccctttcttatcaatgtcaattattccttgaaaaattgtgactgggggaactgggagactgagagggatgagaggattcctgtacattatatactctttttttttttttttttttttgagacagagtctggctctgtcacccaggctggagtgcagtggcgtgatcttggccctatgccccccagggttcaagcaattctcccgtctcaacctcccgagtagctgggactgcaggtgtattgcaccacgctcagctaatttttgtatttttaatagagatggggtttcaccatattggtcaggctggtctcgaactcctgacctccggtaatccacccgcctcagtctcccaaagtgctgggattacagatgtgagccaccgtacctggcctatgtactctttaaaaacaaaaaaagaacacttcattgaagtataatttatatcccataaaatttaaaacagggcaccagtgtcctcatctgtaaagtgattagatggcctcaaagatctagtccaattctaaaatccagtaaatttagatttcttcctgggagtcaatttgcctacagaccaccaggggctaataagttccaattgtttccttaataagagatttgtggcttaactattaagaaacactgccaattatacctcaaccctccccaaaaatatgggaaacgtttttaccttgctttacttcctctgaggccatggagtctcccacctcaaaatcagagctaatcctcttcttgaggaagcgtaagtatagctcactgcgggcattcatcagggtgacctcagtcaggatggggtccagttctctgagacacatggagcagaaggaataggacgacaatggattaccttagacacaagagctacagggcaaagagagtcccaaattccccctccccactgggcccataaggaaaagctctgccagatggccctcctagctctgctggcccaattagaatcagagatagctgtcaatcacattttccatttacctgcttcacctaaatcattcactccctaaaattctgccagacctaaataaaaggttgggagatgtgtcttcttttctttacttttttttttgagatggagtcttgctctgttgcccaggctggagtgcagtggctcgatctcagctccctgcaagctccgcctcctgggttcacgccatttctcctgcctcagcctcctgagtagctgggactacaggtgcccaccaccatgcccggctaattttttgtatttttagtagagacggggtttcactgtattagcgaggatggtctcgatctcctgacctcgtgatccgcccgcctcaacctcccaaagtgctggaattacaggtgtgagccactgcgcccggcctattttcttttctttttgagacagagtcttgctctgttgcccaggctggagtgcagtggtgcaatcttggctcactgcaacctccgcctctaggttgaagtgagtctcatgccttggccacatgagtagctgggattacaggagtgtgccaccccacctggcagattttttttttttttttcagatttttgtatctttagtagaattgggattttgccatgttggctaggccagtctcgaactcctggcctcaagtgatcctcctgccttggcctcttgaagtgctgggattacaggcatgagctacagtgcctggcctcttttgtggtttgaataaagattacctatgaccaggcatggtggctcacgcctgtaatcccaacactttgggaggctgaggcgggcggatcatgaggtcaagagattgagaccatcccggccaacatggtgaaaccccatttctactaaaaatacaaaaattagctgggtgtggtggcgcatgcctgtagtcccagctactcgggaggccaaggcaggagaatcgcttgaacccgggaggcggaggttgcagtgagccaagatcgcgccactgcactccagcctggagacacagcaagactccgtctcaaaaaaaaaaaaaaaaaaaaaaaaaaaaaagaggccgggcgcagtggctcacgcctgtaatcccagcactttgggaggctgaggtgggcggatcacctgaggtcgggagttcgagaccagcctaacctaaccaaaacatggagaaaccccgtctccactaaaaatacaaaattagccaggcatggtggcacatgcctgtgatcccagctactagggaggctgaggcgggagagtcgcttgaacccgagaggcggaggttgcagtgagctgagatcacgccattgcactccagcctgggcaacaagagtgaaactccgtcttaaaaaaaaaaaaaaattatcagtgtctcatgtgaaagaaaactctccaatctctaatttagccctggcaggatgttaggaaataccattaaactgccctacacccattcatttatcctgatgaatagccaaaataatcttgaaaaatacaaagttggaggaatcccactttctaatttcaaaactaactacaaagccacagcaatcaagactatgtggtactggcatatgaatagatatatggattaatggaacagaactgtgagtccagatggttgactgattttcaatgagcgctaggacaattcaataaacaacgaagggtcttttcatcaaattgtgctaggacaactgagatccacatgaaaaagaatcaagttgaacccctacctcacataatataaaaaaattaacttcctttgcacactgaagtccaagaggtcttttctttctttctttttttgttttgagatagggtcactgtctgtctcccaggctggagtacagtggcacaatcacagctcactgcaggctcagcttccctgggatcaggcaatcctcccacctcagcctcccaagtagctgggattatagacatgtgccaccatgtctggctaatttttgtatttttggtaaagacggggtttccccatgttgtccaggctggtctcaaactcctgggctcaagtgatctgcccacctctgcgtcccaaagtgctggggctacaggtgtgagccaccttggcacctgaccccaagacatctttacaaacataaatctggtcatatcatatagtttccatacctctcagaatacaagactcttaacagcctgactctaatgatctctccatatccaccatttcaggctctcctctactctttgaacttcagctacactggccttctttcagtttttaaaatacacatgacctttgcacatgctttccttgctctatctggaatactcctcacatcttaactcctacttactctttttttttttttttttgagacggagtctcactctgtcgcccaggctggagtgcagtggcgctatcccggctcactgcaagctccgcctcttgggttcatgccattctcctgcctcagcctcccgagtagctgggactacaggcgcccaccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccaactcctacttactcttaaggtctcagatctaaggtcatttcctcaggaattatttcttcaactttcccatactaggctacatctctttatgacatgctgtcctgcaccctacactcagtatatcacagtggctgacagcatccactctagagtcagactgcttggattccatttctcaccgccattttctagctgcatgaccttgggcaagtcatctgacctctccagccttcagtttcttcctctggaaagtgtttatggattaaatcagtgattttctactgagggcgattttattcccagctcccccattcccctacccatacccccctggggtattttagcatctagtggatagaggccagggatgctgctaaccatcttacaatgcgtagaacagtccccacctaacaaaaaattatccagtcaaggctgggtgcagtcgttcacgactgtaatcccactactttgggaggctgaggcgggcagatcacctgaggttaggagttcaagacctgcctagacaacacggtgaaaccccctctccactaaaaatataaaaattagccagacatagtggtgagtgcctgtaagctcagctactcaggaggcagaggcacgagaactgcttgatcctgggaggcggagattgcagtgagccaaaattgagccactgcactccagcctgggtgacggagtgagtgagattctatttaaaaaaaaaaaaaaaaaaagaggccgggcatggtggctcactcctgtaatcccagcacttgggaggccaaggcgggtggatcacaaggtcaggagtttgagaccagcctggccaagatggtgaaaccccatctctactaaaaatacaaaaatttgccaggcacactggtggggcgcctgtaatcccagctacttgggaggttgaggcaggagaattgcttgaacccgggaggcgtaggttgcagtgagctgagatcatgccactgtactctagcttgggtgacagagcaagactgtctcaaaaaaaaaaaaaaaaaatccagtcaaaatgccgttagtgcagaagttaagaaaccttggattaaatgatttaatatttgttaagtgttcagaatagtgtctggcatacagttgacattacatatgtattagctattgctattatctactttatagaccatagatgccacgaagaaaaaattatgtttgcttgctcactttgcttgttgccatatcaaggactagtatctggcacatgtgtactcagtaaaactttggttgaatgaatatattttacgtttggattttcttttttttttttttttttgagacagagtctcgctctgtcacccaggctggagtgcagtggcacgatattggctcactgcaacctccacctcccgggttcacgccattctcctgcctcagcctcccaagtagctgggactacaggcacccgccaacacacccagctaattttttgtattttttttttagtagagacagggtttcaccgtgttagccaggatggtcttgatttcctgacctcgtgatccacccgccttgggctcccaaagtgctaggattacaggcgtgagccaccgcacccactggattttcttctaagaagcacatgttatttttattgtaaaaaagtaggctgggtgcggtggctcacacctgtaatcccagcactttgggaggctgaaggcgggcagatcatgaggtcaggagatcgagaccatcctggctaacacggtgaaaccccgtctctactaaaaatacaaaaaattagccgggcgtggtggcagacgcctgtagtcccagctactcaggaggctgaggcaggagaatggcgtgaacccgggaggtggagcttgcagtgagccgagatagcgccactgcacttcagcctgggcgaaagagtgagactctgtctcaaaaaaagaaaataaatgaaataaataaaagtttggctggatacaggggctcatgcctgtaattccagtgctttgggaggctgaggcagggggaatcacttgagatctggggttcaagaccatcctgggcaacatagcaagccctcatctctaccaaaaattaaaaaattggccgggtatggtggctcatgcctgtaattccagcactttgggaggccgaggtgggtggatcacctgaggtcaggagtttgagaccagcctggccaaaatggcaaaacctcatctcagccgggtgcggtggctcatgcctgtaatcccagcattttgggaggctgaggtgggtggatcatgagggtcaggagatcgagtccgtcctggctaacacagtaaaaccctgtctctactaaaaatacaaaaaaaaaaaattagctgggcatggtggtgggcgactgtagtcccagctacacgggaggctgaggcaggagaatggcgtgaatccaggaggcggagcttgcagggagccgagatcgtgccactgcactccagcctgggtgacagagcgagactccgtctaaattaaaaaaaacctcatctttactaaaaatacaaaaaaattaaccgagcgtggtggcacctgcctacagtcccagctacttgggaggctgaggcaggagaatcgctaaacctagcaggtggaggttttggtgagtcgatatcacaccatgccactgcactccagcctgggcaacagagcgagactgcctcaaaaaaaaaaaaaaaaaaaaaaaacaaaaaaaaaaacatttagctgggagtggtgactgtaatcctagctagtcaggagctactcgggaggctgaggctggaggatcgcctgagtccacgagttggtggttacagtgtgctgtgattgtgtcactgtaccacttcactccagcctgggaaacagagaccctgtttctaatttaaaaaaaaaaagtaaaagtttaaaattttaggatagtagttacctttgtgggaagggaagaggagagtcactctgggggcttcaaaagtgtagtcatgctacataagaatattttggtcagaaatgaactgctgggctgggcatggtggctcatgcctgtaatcccatcactttgggaagactttgggaggtgagaggatcacttgagcccaggagttcgagaccagcctaggcaacatggcaaaacctcgtctctacaaaaaatacaaaaattagcccagcatggtggtgtacaatatgtgtacaccagctactgatatgtgtcccagctactcgggaggccgaggtgggaggattgcttgagcccagaaggtcaaggctgcagtgagccaggatcataccaccgtactgcagtctggcctgggcaacaaaataagaccctatctcaaaaaagcaaaaaaaccccaaaacaacaacaaaaaaaaactgtatcggtatacacaagagggttcccataatattataccttttctatgtttctatggtacagtacataatactgtacctcttctatgtttagatatgtttagatatacaagtacttaccatcgtgttataattgtctatggtattcagtatagtaatatgccatgcaggtttataccctaggagtaatagtttgtatcatatagcctaggtgtgtagtaggctaagtacaccctacgatgttgacacaatggaaatcgtctaatgatgtatttctcagaatgtactccagttgttggcagggtatggtggctcatgcctataatctcagcattttgggaggctgaggtgggcggatcacttaaggtcaggagttcgagactaacctggccatcatggcaaaaccctgtctctactaaaattataaaaaattagctgggaatggtggtgcacgcctgtagttccagctacttgggaggctgagggaggagaatcgcttgaacctgggaggcaggggctgtagtgagccaagataatgctactgcactccagcgtgggtgacagagtgagactctgtctcaaaaaaaaaaaaaagtattccagtcattaaatgacacgtgattgtactgattataatttattatttatttattttttgagacagagtctcgctctgtaacccaggctggagtgcagtggtgcaatcttggctcactgcaacctccgcctcctgggttgaagtgattctcctgcctcagcctcccgagtagctgggactacaggcacgcaccaccatgcccagctaatttttgtatttttagtagagacggggtttcaccatattggccaggctggtctcgaactcccgaccttgtgatccgcctgccttggtctcccaaagtgctgggattacaggtgtgagccaccgcgcccggctgattatgactgattacacaatttatttatatatacttttgttcatatgatacattgcactgaaaaataagagtaattgataaaatattttaaaaacatagaccacattgtaacagagtagtctgaattatattacatgattaccaattcaaactcctgtgggctgaagaagagagaaggattattaccttggttcgattttttctgttgtagaatttctcatcaggttgttctgaacatgccggaactgcaacataccacaggaatgagaatattcttccccacccccacatctattggcctcttgctggtcactccaaacttttggcatacaagaacatttagatttagtttgtttaccaggtttaccttcccttcaagccagcagtgggctttcaggatgacaggccaaagatttgtttttgggttggatgctaataatactcacctctattactgtgcttaaaagtcatgctaatggtgttccaatagactactgtttatagtctcctagtctggagttctagaaatacaattgtatgaggccactcctatttctatgtcgtacttttactttctctgctcaaaagaaggaaaaaacaaagttctgaaaaagcaaacgttatctttaacatcttaggaatgaaggggaaattggagacaattacttggacacttaataggacctcaagaaatagaattgtcattatatcattagagggcactgttgcacattttgtgatagagaactggtttactacttctgctgtgttcttttcaggaagctctttttatttccgttttggtcttgaactgaggccatcatcatctcgacaacacctcaagtccaaagtaagctgtcaatgggcaagatgcaggccagtgtgcgcttagcatttatttttctcctgtctgcaccttttttttcactttttcaaaccctacaatttattctactcagtgttcctcgctaaagctgctaccaaaccctacctgtagcttcccctgctcacctgctggtggtagtccctttgcttgatgaacttgtctaccaccttctccacctgtctgtcacattccacctgcagatatttgatcagggtatagagtctccctggcccataataggtctccactattggctggtgggtctccacaatgcgggcaatccctagaagggaggaagcaatagggttatattccaagtattcttcctacaaaataaacttgctcccatccaggactaaccgaaggtctagctcaatccttttggctgcttcactttctaaaatgaacacaaataggcctagtcaatgctaggggttgctaggcaaatatgttaaatatgtacagtgcttggtacaccagcaggcatttggtaagttacattgatactgttttctacagcagcatctttggaaatcagcatcactcgctttccagtaatttattttagggttaaatttattcgtacagagtttggggtttgagggttaggtaggatcaaaacactggagagactctaatctttgctaatcaggcactgaatctggaagttatttaattctccaatcaattaatacacaataaactacatgattaaattaaagtcatcaggctagaagggtgagaagaaaggctaggatgcaggtgtcatatacagtctccagtctctctagagcggagaaagaggctcaccttcaaacagaagagtaagtgtatctgcaaagatgactgcagctctccgatcactcatgtctgtccccagcaccatgagcagattctcctcagctttactggccacctaaaaaaggagaaaacccacacacattcctcagaaaggtcaccctcataccaggtatatctcagttttccaaaaatcctcccattgactttcttttttttcacatttcccttgatgtctggaagcccaggcagcacagaggaaactcccttgagggacagtctgagcctcaggcaggacaaggaaagtgagcatggtgtagctcctcttccattattttcttctcttggaaaatatggactgccattagccaagggagagagtccccagtttcaacaatcttctcaaagggtaactttctattattttttaaaataagacagaaactcactctgttgctcaggctggagtacaagggagccacagtcatagttcactgtggccttgaactcctggactcaagtgatcctctcacctcagcctcctgagtagctggaactataggcgagagccaccatgcccggctaattttttaaaaatttctgtagagatggggtcctgctatgttgcccagactggtctggaactcctggcctcaagcaatcctcttgcctcagcatcccaaagtgttggaattacaggcgtgagccattatgcctggcatgttatcattaacagtgctttctcaagcacgacaaaacctgggtactgcagaagggacttttactggattaaaggtagaagccatttctaggtcccagatgtcaaagtatactgataaaaaaagtaccatagagcaggtttcctttttttttttttttgaaatggaatttcgctggtcgcccaggctggagtgcagtggcacaatcttggctcactgcaacctctgcctccccggctcaagcgattctcctgtctcagcttcccgagtggttgggcttacaggcacccgccaacatgcccggctaatttttgtattttttagtagacacagggtttcaccatgttggccaggctggtcctgaacctctgatctgaggtgatccacccgcctcagcctcccaaagtgctgggattacaggcgtgagtcaccgcgcctggcctgtattttgtttttaattaactttttagaatgagtaaaatgcacacttaaacattccaaaggaacaaaggaatattcagtgaaaagtggttcttcttctaacctgtgtctcttaatttcccaattttcttcagaggtgaccattgttaacccttccaaaagaaatcctctgcttatacaaatatatcttgattgctaactccctcattttaaacaggaatgacaacatattgttttgtgccgtttaacaaaccacatgttacagaataaaatatgtcagcacttagggaacggtatcatttttcttaacggcataataatggtctgataatttttttgtgggaggggagtgacacacacagacatatagctaaaaaacggccaggtggggtggtagtcccaggactttgggaggctgaggtgggaggactgcttgaggccaggagttcgagaccagcctgggtaacacagtgagaccgtttctataaaaaaaaaaaaaaattgcaacgcatggtggcatgtgcctgcagtctcaactgcttgggaggctgaggcaggaggattgcttgagctttaagagtgattcagactgggcgtggtggctcacacctgtaatcccatcactttgggaggccgaggtgggcggatcacctgacgttgggagttcgagactagcctgaccaacatggagaaacccagtctctactaaaaatacaaaattagctgggcgtggtagcatatgcctgtaatcccagctactcgggaggctgaggcaggagaatagcttgaaccagggaggtggaggttgcagtgagctgacatcatgccattgtactccagcctgagcaacaagagtgaaactccatctcaaaaaaaaaaaaagagtgattcaacttgtcagagaacttgcattttaatttcacatgctttcgcctggtctgttggaaatgaatgtgcactggcagatgtcttggccatgcctggtacacagtaggctggcaacaggtgtgttgaatgaacacatgcatccagtcctgcatggctacacagcaagggcaggaaggggagtcatatccagaagagagaaagtatccacagaaactggatccatccagtgccccaatctgcaggcagacagccacacaattatcctgccaagcaatcagggtccatacctgcttgcaaaggtactccgagaactttcttaatccctcctcatgcaaacccagcagtgggaagatcttgaagaagcgctccacctggggcagatcaccttccttggtggcaatggcaaacttctctgccacaatggctttgagacgttgctcagcttcctgcagcaatttcaggttggcatcaatcatgctccctgctcaacagggagaaaatgaaaattcaagtaaagaatagtactgtggcaggtccatgccactttgtgtaatactattcatccagcaaatacgtattaagcacttaccatgtgcaagatgctgtgctagtaatatgcatgattacaagatgaatcagccctgatcctaccatcacagaagttaggatcaggtagaagagatagtttgtgcacaaatcaagatgatgaaatacagtacatgatgtgtcataagaaaggtgccaaagtccgggcacggtggctcatgcctgtaatcccagcactttggaaggccgagatggctgaatcacaaggtcaagggattgagaccatcctggccaacatggtgaaaccctgcctctactaaaaatagaaaaattagctgggcatggtggcatgcgcctgtagtcccagttactcaggaggctgaggcagaagaatcccttgaacctgggaggcagaggttgcagtgagccaagatcatgccactgcactccagccggcaaaagagtgagactccgtctcaaaaaaaagaaaggtgtcaaaaagtcacatttctggttaaagtaatcagaaaaggcttcctagagaaggtgacatcccacctctcaaagatgggcaggattctgatacctgcacaggagaacaaacattccaggcaaagggaatgaaagacatgaatagaagcagaaagatgaaaagaatatttgcagagtattccaagtagcatattccttggcatatggaggagcttgagaaatacttgcacaatgagtggatgcataagtgaataacattaaacaagtctagaaaaacagagtgtgtaaagatcatggaagatctaaaatatcaggctaagaatttcattttatgagtaggcaatatggccaagtgcaaagaacccgctggccagagaatcagtagatctggattcagtttccttttccataaaatgggaatacagtagtctcttcttatctgtaggggatccattccaagaccgttatggatgcctgaaaccatcgacagtactgaaccttaaatatactatgttttctcccatacatacatacctacgataaagtttaatttgtaaattagacatagtaagagattaacaataatatataataagatataacaacataccatgataaagttatgcaaatgtggcctctctcttaaaatatcttactgtactgtacttacccttcttgtgatgaagggacagacagggtggtacaagattttatcacactacttagaacagcaagcaatttaaaactagtaagatgtttatttctggaatttttccttaatatttttggactaaggttgaccatgaataactgaagctgcaggtaactgaaatggcagaaagtgaaaccacacataggggagactgctttaacaaagcctgccccaggatggtacaggacctacgtatggcctattaccagacaagaaaacttcctggctgggcgcagtagcttacacctgtaatcccagcactttgggaggccaaggcgggcagatcaccagagatcaggagttcaagaccactctgtccacatggtgaaaccccatctctactaaaaatacaaaaaacattagtgaggtgtggtggtgtgcacctgtagtcccagctactcaggaggctgaggcaggagaatcgcttgaacccagaaggcggaggttgcagtaagccaagatggcaccactgcaccctatcctgacaagagcaagactccgtctcaaaaaaaaagaagaaaaagaaaaaagaaaacttcctaaaaactgatgtgtttttattggtcgagtctgcttacttcagattacagatgattttaactaaactaaaaaccaacagtttcggatgctgaccctctttgccctgtcggctgagctcaatgaccgacttgtccaggcacaagtagcgatgagtatgtgctgcagcctgctcataatcttcactcctcaaagcagtctgaactccatccatgcagaacttcaggtccaagatgtcatcagctctctgaatggcctgatagaggcggttctgcaaaaagatttggtacttacaaacaatgtcctattctttcaaaaacacccctcaagaaggtagggagattcaggagctgaatctgatcaaccatatgtcaatagcaatctcacaaacaccaccactactgttaacgcaactgttattgatgatgatcaagaccattgacagatatcatacaatgttaataacgtgatcaaatcattctctctttttttttagacagagtctcactctgttacccaggctggagtgcagtggcgcaatcatggctcactgtaacctctgcctcctgggcctaagctatcctccacctcagcctcccaactagctgggatcacaggcatgtgccaccatgcctggctagtttttgtattttttgtagaggcagggtttcatcaatgtttcccaggctggtctcaaactcctgagctcaagctatccgcctgccttggcttcccaaagtgctgggattacaggtctgagtcacagagcccaactttttttttttttttcttcttgagacagagtctcactctgttgcccaggctagagtacagtggtgcaatcttggctcactgcaacctctgcctcctgggttcaagcaatcctcccacctcagcctcccaaatacctgggattacatgtgcacacaaccacaacctgctaatttttgtaatttttgtagagacaaggttttgccatgttgcccaaacccaggctggccctgaactcttgagctcaagcaattcattctcctcggcctcccaaagtgctgagattacaggagtaagccagcacgcctggcctacttcattttcttacctaattgccctggatagaaccatacagccaccaactcactattaaggtttttttagaacatgcttgcgccaggcgtggtggctcacgcctgtaatcccagcactttcggaagccgaggtgggtggatcacgaggtcaggagtttgagaccagcctgaccaacatggtgaaaccccatctctactaaaaatacaaaaattagccaggcctggtggcgcatgcctgtaatcccagctactcgggaggctgagacaggagaattgcttgaacccaggaggtggaggttgcacacgctgagatcaagccattgcactccagcctgggcaacagagtgagactctgtctcaaaatcaatcaatcaatcaatcaataaataaataaaacatgcttgcttgttctagagacatagtaagagaagacacccttgtcttgttcctcatcttagggggaaagaatcacacgtttcaccagtaagtatgatattagctgagggttgtttttttaaaaaatttttgtaggacagggtcttactgtgttccaaggtttggtctccaacttctggcctcaagagatcctactgctttggtctcccaaagtgttaggattgcaggcatgagccaccacacctggccagctgtggtttttcacagatgctctttatcaggctgagaagttcccctctattccaaatttgttgagtgtttctaccacgaaaggatattgaattttgttaaatgttttcttctgagtctatgaggtgatcatgtgttttttgtccttttttctattaatatggtgtattattaggatggtgcaaaagtaattgcggtcttggccactacttttaattgattttcagatgttaaatcaaccttgtgttcctaggataaattccacttggtcatagtatataatcctctttatatattgctagacttgctttactagggttttgttgagttaaatttttttttttttttgagacagaatctctctgtcgcccaggctggagtgcagaggcgccatctcggctcactgtaagctctgccttctgggttcacgctattctcctgcctcagactcctgagtagctgggactacaggagcctgtcaccaccactggctaattttttgtatttttagtacagatggggtttcacggtgttagccaggatggtctcgatctcctgaccttgtgatctgtccgccttggcctcccaaagtgctgggactacaggcgtgagccaccgcgcccagccttgttgagtacctttatgtctatattcataagagctactggtctgaagttttctgtgatatttttgtctggctttgttatctcacattagatttctattgaatggtgctcttctaatctctaatgtggtagcttttttttttaaatagaagctggtatttattaacttatttatttatttatttttaatttgcaactccactctgcaactcaggctggagtacagtggcatgaccttggctcactgcaatctctgcctcttggggttaagcgatcctcctgccttagcctcccaagtagctggaattacaggtgtgcattaccacacctggctaatttttgtattttttagtagagacacggcttcgccatgttgcctaggctggtctcaaactcctggactcaagcaattagcctgcctcagtctcccaaagtgctgggatacaggtgtgcaccaccatgtccagctaatttttgtattttttgtagagatggggttttcccatgttgcccaggctggttttgaacttctgggctcaagcaatcctcctgttctggcctcctaaagtgatgggattgtaggtgttagtcaccacgcaaagccccatagacattttgatgttgtagttagtagagggcagtaaagaagctattggccaggcaaggtggttcacacctgtaatcccagcatgttgggaggccgaggcgggcagatcacctgaggtcaggagtttgaggccagcctggctaacatggcgaaaggtggaaggataacttgagcccaggagttcaggaccagcccggggaacatggcaaaaccccatctctacaaaaaatacaaaaactagctgggcatagtggtggatgcccgtagtcctagctcctcaggaggctgaggtgggagaattgcttgagcccagggagttggggctgtagtgagctgtcattgtaccactgtactccagcctaggtgacagagcaagaccctgtctcaaaaaaaaaaaaaaaaaaaaaaaagcttgatgtattaccttggccaggtcaagctgacgaactttgctggacacattctcagccaggttgcaggtaaaggtgatcattccagccagctgctttgcatctccctcaatcagctgcagattaggactggagaaatacattgttagcatacacataacgatagggcagagaagagacagaaacttttttttgcatatggacactatgtcttctacttctttcatacctacctgtaactcttagctcagtttgctctatactcagctttttctcaagaacgtttgactgtaaactcagacctatacctgataaaaaattaactcttttttttttttgagacggagtcttgctttgtcgccaggctggagtgcactggcgcaatctcagctcactgcaacctccgcctcccgggttcaagcgattctcctgcctcagcctcctgagtagctgggactacaggcgcgtgccaccaagcccagataatttttgtatttgtagtagagacggggtttcaccacgttggccaggagatggtcttgaactcttgaccttgtgattcagcctcccaaagtgctgggattataggcgtgagctactgcgcctggccaaaattaacttctaaaaccaataaagacacacctaaataggtacagtcaaagaactagagaacaaattctctcaattgctaagtgagcataagatgcactaaccagtaccatgtgagaggatggtgagatcaaggaacaatttttgtttttgtttgagacaggttctcactctgccactcaggctagaatgcagtggcacgatcatagctcactgcagtttccaacttctgggctcaaatgatcctcctgtcttagcctcctgagtagctgagactacaggcgcacaccaccatgcccaactaatttatttatttatttatttttatttttttgtttttgagacagggtcaaaagtgatcctctagatgaggcctcccacagtgctggaattacaagcatgagccactacacgcagccagggaacaatttttatgactaacaaatatacccagtctgtaaaaatggtggttctcggccgggcatggtggcttactcctgtaatactaacactttgggaggccaggcgggcggatcacttgaggtcaggagtttgagaccagcctggccaacatggtgaaaccctgtctctactaaaaatacaaaaattagctgggcgtggtggcacatgcctggaatcccagctactcgagaggctgaggcaggagaatcgcttgaacctgggaggcagaggttgcagtgagccgagatcatgccactgcactccagcctgggggacaaaaacgaagctccatctcaaaaaaaaaaaaaaaggtggttctcaaacttgagctgtgcattagaatcacttggtaggcttgtcaaaacacatcttcctggaccccacccctagactttctgattttgtaagtttggagtggggccctaggatttgcatttctttttttttttttttttgagacggagtctcgctctgttgcccaggccagactgcggactgcagtggcgcaatctcggctcattgcaagctccgcttccccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccgcccgcctcggcctcccaaagtgctgggattacaggcgtgagccaccgcgcccggccaggatttgcatttctaacaaggtgtgatgctggtacaactggtccaaggactgtttgaaaaccatcaaactaatacccttaggtgttcactttatcttgagataataccctttacatttcaagctgaactggtgtttataacagaaagtttaaaaaatggtcacttgtccaattgaccctgttggaatttacattagctcttgctgagatgcacagactcaccccattcggtggagagtgaccatcttactttcaatggtgttttgctgttccaaaagagcatccagctctctctccaccactttctgaaacacagagaaacatcctgtcagcagaatgatcagaaggaaccttaagagttatctaatccaatcacttagctgaagggtgaatctcatttccaagtccttttttccttccactatgttctccttagactttaacaatgcttcattttgcacttatgttgcatgattgttatcttacgtatatcttattccacctggcagatgagcaccataataggaagaaataaacttttaatcagtatcattagcatagtgcctaatacaggaaggcatttaaaatacaatgcctggccagcactggatcccaaagtaatcccagctctttgggaggcccaggtgggtggatcacctgaggtcaggagttcatgaccagcctggccacatggtgaaaccccatctctactaaaaatacaaaattaggctgggcgcggcggcttacgtcggtaatcccagcactttgggaggccaaggcaggcggatcacgaggtcaggagatcgaaaccatcctggataacacggtgaaaccctgtctctactaaaaatataaaaatacaaaaaattagccgggtgtggtggcgggcgcctgtagcccaagctgctcaggaggctgaggcaggagaatgacatgaacccggggggtgggggggggggggggcggagcttgcagtgagccgagatcatgccactgcactccagcttgggcaacaaagtgagactccgtctcaaaaacaaaaaacaaaaaacaaaattagctgggtgtggtggcgggggcctgtaatcccagctacacaggaggctgaggtaggagaatcacttgaacccgggaagtggaggttgcagtgagccgagatcgtgccatttcactccaacctgggtaacaagagtgaaacgctgtctcaaaaaaaaaaaaaagaaaatacaatgcctaaacaaaaaacaccacacacatcttgctgaaatgaaatttccagtgacagttaccaaaatttttcttcttggtgcatagtcagtagccaggggttataaatataattatctctcattcaagccatttattgtgcaacctcaatttatgtaacatttttatgcttcggttttttcatctgtaaaactaggatagcaataccaatctcactgggctgttgaatgagtcaaacaggaaaccacacaaagtgcttaacatggtatgtggcatatagttcaacaacagccattaaaattaaccatacatttttattttttgcgggggctcaagtgctcttcctaccccagccccccaaatatctgtgactataggcgtgcacaaccctggtccactgtttaatttttttgtagccacgaggtctcactatattgcccaggctggtccccaactatctgctattgcccaggctggtctccaactatagctcaagctatctgcccatctcagcctcccaaagaactgcgattagaggcatgagccacttgtgcccaggcagctatacttttttttttttttgagacgagtttcgctctttcacccaggctggagtgaagtggcctgatcttggctcactgcaacctccctgccctggggttcaagcgattttcatgcctctgcctcccaattagctgggattatagacgcccaccatcacacccggctaacttttgcatttttagtagagactaacatggtttcgccacgttggccaggttggtctcgaactcctgacctcgggtgatccacccgcctcggcctcccaaactgctggtattacaggcatgagacaccaagcccggccatatacatttttattaaaatcgttctgtaggttccagaggaaaacgtcctcttgacagtcatggaatacaaatacagtacttatatcattttgtctgtaagatttccataattttccacccaacatattaaatgactgaatgaatgcgagcttaggaatgttaagtcaagatactaaattttttttttttttttttttgagacagagtctcactctgtcgccgaggctggagtgcagtggtgcgatctcggctcactgcaagctccttctccctggttcacgccattctcctgcctcagcctcccgagtagctgggactacaggcgcccgccaccacgcccggctaattttttgtatttttagtagagacggggtttcactgtgttagccaggatggtctcgatttcctgacctcgtgatccatctgcctcagcctcccaaagtgctggggttacaggagtgagccaccgcgccaggctttttttttttttaagagacacaattttgctcttgttgcccaggctagagtgtaatggcgctatcttggttcactgcaacctccgcctcccaggttcaagcaattctcctgcctcagcctcccgagtagctgggattacaggcatgcgtcaccacacccggctagttttgtatttttagtagtgatggttttcaccattttggtcatgctggtctcgaactcctgactcaggtgatcctcccgtcttggcctcccaaagtgctgggatggcaggcgtgagccaccgcgccccgcaagatactaaattttaaaacacatcttgctgaggccagacaaaaaaagccccacacactaaactagccaggcacggtggtgtgcgcctctggtttcatccattctgattgcagcacaacagcactccagcctgcgcaacagagagcggccctgtttctaaaaataacaaaacaaaacaaaaaacaccacacacatcttgctgaaaaacgtatcagaaactgctagagttagtgcaagtttatacttgaaaatactcaaagatatcaacgatcacctctccctcaggctgaaactgccttttgtgctcaactttgctagaagtttggtctgggaaacagctgacaagcttagagcttagatctcttttgactagcaaggaacccaactgacattcgaaagtgaattgacagcatcgagttgccactgaaaattaaaggaggcaggaaatagaacgttatgaactgaaaggaattggagaatagtccacacccctcatttgataaaatatcaagggtaccagagatgaagtgacttgtccaagattagagaattgtgtctgagtcttaaaagctaaacctctacaaagatgtgcatttgaccaaaacgctaaaatcacacccccaaatcactccccacaagaggaagtcttaaaacgcttcaagaagttaatctgcaaaggcttccctcttaaataacaggatgagagcgtttcataatttgtaaattaagccaatgcaaaagggcgcttattattttgagaaccaagcaatttggcaaatactctcagactaactttactcccgtggagaaactggtgatcatggatcagggaaatcaacgggggtctagggaggagaggctgcagatcgcccaggtatcagggaagacaagctcggcgcgtccgacagcgtgaaaagagttgacaggactactcatatacccgactagcttccgcttctttgttttcccgcttttttgtatcccccagcaaggagagtttcccacagcccggatttcccgactgaaggctcccactctccctagatcctccatgaaaaagaagaggctcgaccccgcacctcctcgccgcagagccgttcgtatacagcctccagctcctgcagctctgtcagggagcgaatgagctcagcggagatttcggagcagcggccacctcccaccccctcagacggctgctgcacccctgacagcttcggaggcgaatcaaggtccgccatcttggtccccattcggcacttccggtcccgcgaggccccctcttcgttggcgcctatttggggctgcccacagaagtgcccaatgaactctaatggttttttttttttaaagtctacttctaaaaacgtattaattttctattctcctggaaaaagcaaagcaataaagcatgtttaaataatttgtaatgccgtgtggaagcaagacggaagcattttttaaaaattatatatattcttcaggcgcggattgggtgcctttttccgccgcgcgccaccagaatgtccctgtcttgaggtctaatggcggacgccagtatgttggagttggtggtggcttaagttttgaagggaggtagcatccgttggatatccacaccatccttctcgctgcagggtaaaaaaacagcctggagacttccccgggcccggggaggcggagaccggccatatggaagggggacccgagactttggcgggggtcacgggcagtctaggcccgagaggctggggaccaggaggaggtaccgagggatggttgaggcgccaaaacggcttcctgcagttatctctcgcttccatccacagtgtgggaacatattctatctcaaaatagggctcgtggagattgcttttaacttctggggactctgagacgggggaggtgtgacaagcagcgggaggcatggatgtctccctctgggtagagtaaatggtacaccgaggggaagatagaaagatggagcgtgttaaaagcgtaaataacggaaacagtctttagagccaagactccggtttgaatttgtattttggtagttgggcaacttgtctcctcctctgaacctctattttctcgtttgcgtaatggaggacagagtttaaatgcgatgatgtttccttggaggatggagaagatgcagtgagcaatcatacaagctttttgtaataatggtaaacagacgtgggggaagttttttttgttttgttttgttttgtttttgtgacggagtcacagtctgtcgcccagactggagagcagtggcgcgatctcggctcactgccatctctgcctcccgggttccagcgattctcttacctcagcctcccgagtagactagctgggattacgggcgcgtgccaccacgcccggctaatttttctttttttgagacggtgtctcgctttgtcgcccaggctggagtgcagtggcgcgatctctgctcactgcaagctccgctttccgggttcacgccattctcctgcctcagcctcacgagtagctggaactacaggcgcccgccaccgcgcccagctaattttttgtatttttagtagagacggggtttcactgtgttagccaggatggtctcgatctcctgaccttgatccacccgccttggcctcccaaagtgttgggattacaggtgtgagacaccgcgcccggcccagacgtgggggaagttttaaagcttaccaaatttatctggtatgtattttttgtttgtttgttttgtttttgagacgaagtctcgctgtcgcccaggctggagcgcagcggcttgatctcggcttactgcagcctcctcctccttggttctagctattctcacgcctcagcttcccgagtagctgagattaaaggcgtgtgccaccgcgcccggctagtttttgcatttttagtagaggggttttcactgtgttggccaggctggtctcaattcctgacctcaagtgacccatttgcctcggcctcccaaagtgctgggattacaggcgtgagccaccactgcgcctggcctcgtatatagtttttctagtactggactgatcctccgaaatgcaccttcctccacgatccaaagttaaggtgtcgctggagaacctgaatccaactagatttgggaaaaaatgaattccaaaggtttgtaatggattgtatcagttataaggaaaggggaaagtagactgttttgatcagctacaaaatatgaaaagtaacttgcggggagctgttcagggattcagaagcagctcctagcttcctctcttttgctttttttgttgtttctccactccctggtctttcaacatcggtccttttcgttcatgttttactgtggtcctagaacgttaaacatataccttagtctatgggctgggcgcggtggctcaacgcctgtaatcctagcactttgggaggcggaggcgggcggatcacgaagtcaggagatcgagaccatcctggctaacatggtgaaaccccactaaaaatacaaaaaattagccgggtgtggtggcgggcgcctgttgtcccagctactcgggagcctgaggcaggagaatggtgtgaacccaggaggcggagcttgcagtaagccaagatggcgccactgcactccagcctgggcgacagattgagacgcctcaaaaaaaaaaaaaaaaaaaaaaaggaaaaaaaaaagatataccttagtctcaagtagaaaattttatatctctcaggacccatttctagcctggagcattgatcttgccaccctgcttttgctcagcccagaaagttatttatgaggacgtttactcataattctctcttctcgtttaacaataaaatcaaatatgtatgttaattctatactaatgaccttggatttctcaaggtcccgtgctttttatttatttatttttttttttgagatgaggtctcattctgtcgcccagcctggagtgcagtggcatgatgttggctcaccacaacctccgcctcccaggttcaagcgattctcctgcctcagcctcccgagtagctgggactacaggcgcacagcaccatgcccagctaatttttgtatttttagtagagacggggtttcactgtgttgcccaagctggtctcgaactcctgacctcgtgagccaccacgcccggtcacatatgttgtttcttaatagggcttgctctgctggttctgctgtcttcatccagaatttcccatacagaaatgtctgttgaagtaatagtctcccagctatttttctgttttctgttttcttagctttcttggactccgtactgttggtgtaaccaaggcctggaggtctgggtggctcaggtttcctgcagccatgtttctgtacaacttaaccttgcagagagccactggcatcagctttgccattcatggaaacttttctggtaagttctctcgttaccatcttttgaaattttaagtgaattaatacatatcttgcttagtctcttgtgcaggaaatgttttccatttatgacaaaacagttgttggtaaatgtaaacaattcaaattatgagatgaggtgttaagttctggtgcattatctgttacctatttcagatgcatttcctagttcacaaattgtgtaatgattcttgtcagggcacacttttcttggctgcttacctagtgccaagtcgtgtgcctattgctgtaagacatactgagatgtgtaagacctgatctttgatcttgaatttgacatcaggttgggtaaaaagaatgtctgaaggtgtttgtctggttatcagagagtaatttaaataaagggaaggttggaccttggtttggtgcttgaagagatagaacttttgtatgagagaaaagggaaaatgcagtttaggtagggagtgctgtctgcatagaaacagataatttgcttacgtttaccatgtggggaatatttttgtaaagatggattaaggctaggtttgaattgtgtgaaatttcaaatattggattaggaaatacaaagttactgaaagtgaggtactaatgtttataaaataaaaactttttcttgccatttgcagatttaacatttttgagtcaatccaagtaatgcaggaggttcatgattgtgtagagtaagacataattttgttgaggtttaactctgaatacttaatgtggtactgaatacttaatgtggtactgagaggcagcctaactgaccacacagcattcatatttcatgttgttattttctctgatcctcattatggctcttcctgcgggtttgagtcttcatttgggtaatttagttattctttgctgcatttgattaaggaaatacgtatatgggaatttggagatttgtgactgacttcactatgtaatgcaatgaatctcagctggagtttggatagaatttttgaaagcacgtttttgttttttgtttgttttgtttttgttttttgtttgttttgtttttgtttttgttttttccttgaaacagagtcctgctctgtcacccaggctggagcgcagtggtgtgatcttggctcactgccacctccgcctcctgggttcaagcgattctcctgcctcagcctcctgagtagctgggattacatgcgtgcaccaccatgcccggctaatttttcatatttttagtagagatgaggtttcaccatattggccaggctgatctcgaattcctgacctcgtgatccacccaccttagcctcccaaagtgctgggattacaggcatgagctactgtgccctgctgaaagcacatttttaatactaattttatctttcaaattccttttccaattcagtcttcctttttatctaaaatgatggagaagttttcttttttttttttttttttttgagacgtagtcttgctgtgttgcccaggctggagtacagtagtgcgacctcggctcactgcaaactccgtctcccaggttcaagcgattctcctgtgtcagcctctggagtagctgggattataggcacgtgccaccacacctggctaatttttgtatttttagtagagatgggatcccaccatgttggccaggctggtttcaaactcctgacctcaagtgatctgcctgcctcagcctcccaaagtgctgggataacaggtgtgagccactgtgcgtggccttttttttttttttttttttttttagagacgatatcttgctgcgtttcccaggatggagtgcaatggcaggattataacccactacattctctgaactcctgggttcaaactgtcctcccacgtagctgggactagaggcacaggccatcacacctgactaatttttttttgagacggagttttgctctgttgcccaggccggagtgcagtggcacagtcttggctcacagcaacctctacctcctgggttcaagcgattctcctgccttagcctcccgagtagctgggattacaggcatgtgccaccacgcctggctaatttttgtatttttagtagagacggggtttcaccatggtggccaggctgggttctggttgtttatgatctttattttttggtgatctaggaaccaaacaacaagaaattgttgtttcccgtgggaagatcttggagctgcttcgcccagaccccaacactggcaaagtacataccctactcactgtggaagtattcggtgttatccggtcactcatggcctttaggctgacaggtggcaccaaagactacattgtagttggcagtgactctggtcgaattgttattttggaataccagccatctaagaatatgtttgagaagattcaccaagaaacctttggcaagagtggatgccgtcgcatcgttcctggccagttcttagctgtggatcccaaagggcgagccgttatgattagtaagtgatttactctacttgctgtatatgcctagtttaggataacaatgctgtgctcttggtggtgtgccagtgccaattaattacttatgtgggtttggcatcatgtttggatttactctaggtttaaagttgcatttcctttttaaaagagttgcattttcttttaaaacaatgggaaaaatcttaacacacctttctacttcccatctagttggaaatgggtgtttttcaatttctttttctttggcaaaaagactacaatgaaatgatcttatgttattagacagtgaatatcgttgctttcatcagcctgaagtgatgattcacattcatgtctcttctctgataaattcttgaagaaaatttttgtgtgtctgatcaggcctctagagggcagtcataaatcgttagatctatttcagagaataaggctaatgataattttatgaattactgtttttcagtatccttaaatgtaggactcattaaaaaattttgactagttagtgggatatttaagacctgtattaggaagaagggggccacaatgatgccattgtctttaaaaaaatttatttatttatttttaagagatgggggtctcagccgggcacggtggctatttatctttaaaagagatggggtctcagccaggtgcggtggctcacacctgtaatcccagcactttgggaggccaaggtgggaggatcacttgaggtcaggagtttgagaccagcctggccaacatggtgaaacccagtctctaccaaaaatacaaaaaattagctgggtgtggtggtgggtgcctgtaatcccagctacttggggcaggagaatcgcttgaacccgggaggcaaaggttgcagtgagccgagatagcgctactgcactccagcccggacgacagagtgagactgcatctcaaaaataaataaataaataaataaataaataaataaataaataaataagagagagatggggatctcacaatgctgcccaggatggtcttgaattcctgggctcaagcaatccttccttctgtcttggcctcccaaagtgctgggattacagacttgagccactgtgcccagctccactattgtctattctttttttttttttttttcaaatgaggcagagtttcgcacttgttgcccaggctggagtgcagtggtgcgatctcagctcactgcaacctttgcgtctcaggttcaagcaattctcctgccccagcctcccaagtagctgggattagaggcatgcaccaccacacctagctaattttttgtatttagtagagacaaggttttactgtgttagtcaggctggtcttgaactcctgacctcaggtgatccacccacctcagcctcccaaagtgctattctgatgatagaaaacagaatcctgagtttttatacttgtagagttactgctgttaataatgattaaaagaaaagcatgatgtgactctagctgttctataagtctctcttctcattatctgggaatcttgtatgttttatctccttcaactacaggtgccattgagaaacagaaattggtgtatattttgaacagagatgctgcagcccgacttaccatttcatctcccctggaagcccacaaagcaaacactttagtgtatcatgtagttggagtagatgtcggatttgaaaatccaatgtttgcttgtctggaaatggattatgaggtaatggggaccctgtctctttgcgtttctttcagtcacctcagtgtttttttttaagattgttttccggccgggcgtggtggctcacgcctgtaatcccagcactttgggaggcaaggctggcggatcatgaggtcaggagatcgagaccattctggctaacacagtgaaaccccatctctactaaaaatacaaaaagaaaatagccgggcatcgtggcgggcgcctgtggtccagctactcgggaagctgaggcaggagaatggcgtgaacccgggaggtggagcttgcagtgagccgagatctcgccactgcactccagcctgggcgacagagtgagactccatctcaaaaaaaaacgaaaagatcgttttcttccttgtgcatacctttttttcttttttttgagacagtcttgctctgttgcccaggctggggtgcagtggcacaatctcagctcgctgcaacctctgcctcagcctcctgagtagctgggactacaggtgctgccacaacgcccagctaatttttgtatttttagtagagatggggtttcactatgttggccaggctggtcttctgaccccaggtgattggcccacctcagccttccagagtgctgggattataaggcctgagccacctcacccaggcccagccccttatgcatatcttaattctgtcctgctagcagatcttcatattccaaatgccttactgaaattctttgggatgcttcagaggttaagcaactatttaatagtctttctctgatttaagtaatctccctatggaaacaagatatttattgggaaaagcttcatgaaaaacttgaagctatgtttaaggtattttttcacagaacatactattgttttcctttaacggaaggcagtatcctctagtagagagctccctggatccagaatttggagattgcagttctcgttctagctctgccattatcttatagcataaactttgtcaaactatttggcgtcagccaggtgtggtggcatgtgcctatagtcctagctgcttgggagcctgaggcccaggaattctaggctgcagtgagataagattgtaccactgcagtcgtgtacagtggctcacgcctgtaatccaagtttgggaggccgaggcgggcagatcacctgaggtcaggagttcgagaccagcctgaccaacatggagaaaccccatctctactaaaaatacaaaattagccaggcgtggtggcacatgcttgtaatcccagcaactcgggaggctgaggcaggagaatcacttgaacctgggaggtggaggttgtggtgagctgagatcgtgccattgcactccagcctgggcaacgagcaaaactccgtctcaaaaaaaaaaaaagatcatacctctgtgcactgcagcctgggtgacatagtgagaacctgtctctccaaaaaaaaaagaagacatttgtggacttctgtttcctcatttgtaaattggagtcctgatgtcctttccagatcttcgattttatgctgatgattagtttttatgccactattctctgtaggaagcagacaatgatccaacaggggaagcagcagctaatacccagcagacacttactttctatgagctagaccttggtttaaatcatgtggtccgaaaatacagtgaacctttggaggaacacggcaacttccttattacaggtacttttctttcagagctgctttgtacccttttacttggttcattttatgcccaaacctaataggttttacttaaagggtttgggaattaatccatttgttgtgaacctgaataccttatcttttggacaggttagaagttcatgtggtggagtgattttaaaaagtgttggggataaagactgcctagctccttaataactcatattctactgagggcagggaagagaagttgaagggagcagtcagcttggaatattgattactgttagttgctgtgacagtttggctgtagtcagtctttgcctctcattcaaacctaactctttcaaaagccaaacaaaatggacagaccccacaagatggaacttgtgaatttgaaaacttaaacaaaatagaaatatttttgaagacgattaccagattgatccaaaaataaattaagaacttcaatagaccagcgttagagaaattgaagcagtagtccaaagtcactctcccaaaagattgaggtccaggattttcaggaaagcttttatcttcttgttgagggacatatatgtattccgttttaaaacaagtttctcggctgggcatggtggctcacgcctataaccctagcactttaggaggctgaggcaggagcatcacttgatctcaggagtttgagaccatcctgggaaacaaggtgagatcttgtctcaatgaaaaagtaaatattaaaaaaaaaagtaaaacagatttctctagagtagaaaaagagtaaatgctactgtgccgctctctgagtctagtatgactacagtatcaaaactagggatggacagtaacaaaaaaaatttgcaggctagttcatacggttgtagataggaaaagctaacattccagcaaatcagattcagtgttttaaatgcacatagctaagtaacgtttttggaggagctaaaaaatggaaaatattttcatggttggaaatcagttcaccattggaaaatacacgttactaattgattatattaaaagactaaatgagtacagctacatttgtggtcatctgcatttcagcaggcttggggaaaactgatctagttctattttgaatcatttgcacttcaactgatgtctaaaataagatgttgtttggggaagatactggagaataaaaataaaggacagcacttacctttgttaatacgttaagcagatgaatttttgatcacacatctcattacttgtaacatattaccatacctttcatttacaagggctttttcattctttcaacacatttttattgagcctttgcagtcagtatgtgctaagtcagtctgctggatcttgggacttcagtggtgaaaaattagacgtggtgccgcctttgtgcaagattgagtctggtggtgaatacagataaataaccaaaacaattaccagaaactgtgccaaatgccatgacagcacagagaagaggttccctaaacagggaaaggaaacgaatgtgttacagaaagcttgctggagtctctaagctgagatctgagggctagttagaagttagctaggtgcagttggagtgggagaggaagtttcagttgtaggcaaagggaacagcatttacaaaagcctaaatacaagaaataacatggtccattcaaataattaaaagctcattatgatttaattattaagggactggggtaggagtaggggtggggtgaaagctactgaaggattctaagtagggaaataatctgataggttgacaaccttagaaagattaattgcttacattttggctaatgaaatggaggatattaagactgtaagaggggagactgatgaggacattaagagatactggtagctgctaaggaggtagaatcaatagggctttgggaggagagagaattgaaggattatactcaggtgtctggtttggtctgttgatggtagtattctctaaggtggagaatctaggaggtggagcagggttgggaaggaacttgagtttgtttatgaacatgctgttactttattttatttttattttatttatttacgttcttgagacagaatctcgcactgttgcccaggctagagcacagtggcacgatcttggctcactacaacctccacctcctgggtttaagcagttctcctgcctcagcctcccgagtagctgggattacaggcgcccaccaccatgcctggctaatttttgtagttttagtagagacgggatttcaccgtgttggccaggctggtctcgaactcctgacctcaggtgatctgcctttggtctcccaaagtgctgggattacaggcatgagccaccatgcccagcctgaacacactgtattttaaaaataccggtggaaggtccatgtccagtaggtgatttgatgtattataggtctgaagatggggtctgaagatgagaactgcatttgggcttggaggtaaacatttggatacgttatccaggctgagaccaaaccttccatgtaaacacaaactgtgcttcatccttatctaccatgaacataagggaggagaaacacatgaaatgtttcttagcatcaggcacattaccatcatcaagttgtgctgaaagagaggaggagttgaaagctgaagaaattcatgtctgagtcaaagtcactgctaagttttattttctctcacagttccaggagggtcagatggtccaagtggagtactgatctgctctgaaaactatattacttacaagaactttggtgaccagccagatatccgctgtccaattcccaggaggcgggtaagatctttgatataagaagagagagatttgtgtttaatttttgtgattacagtgtagtctcttagtttgttaccaatttagtttttttgtaaattaaaaaaaaaattcagtgaccctggggcagggacgtaaatgttgtttttaataaagctggtgaaatattttagtaaaagccaaacaaattctcttagaaagggaattaaaactaatctaatttctatttcagaggaacctgtggacaattattaatttgaaattcctgaatgtttctagtttggagaaaccaggcatatttgttagagataggttgccttttattctatttggtttttttttttttccaacatttttattttgaaaattccaacatacagaaagtttaaaaacaatgaacaatgaattcccacatgccttttagattaatccgttattaatattttgctacatttgttttttctttctcatgatatatccatatactttctaggctaagcaatttgaaaagaagttacaggcattatgatgcctcactccagtaatcttctaagataatggctcccgagaacaaggacattttcctacattaccagattgccaatatcatacccaagaaattgtaacattttgtgtagtatagttaccttatgtatagtttatattcatatttctctcattatcccaaaaagttcctttgtaattaattggcctttagtctcccttagttcaggatatttccctctcacctttttttcttttttttttgagatggagtcttgctctgttgcccatgctggagtgcagtgttgtgatcttggctcactgaaacctctgccccccgggttcaagtgattttcccacctcagcctcccatgtagccaggattacaggcatgcactgccacacctggctaaattttttttgtatttttattttttgtattttatttatttatttatttgagacggagtctcgctctgtcacccaggctagagtgtagtggtgcgatctgggctcactgcaagctccgcctcccgggttcacgccatttctcctgcctcagcctctcgggtagctgggactacaggcgcccaccaccacgcccggctaatttttttttttttgtatttttagtaaagattgggtttcaccgtgatctcaatttcctgacctcgtgatctgcccgcctcggcctcccaaagtgctgggattacaggcgtgagccaccgcacccggccttttttgtatttttaatagagacggggtttgccatgttggccattctcgtcccaaactcctgacctcaagtcatctgcctgccttggcctcccaaggtgctggggttacaggcatgaagtgccctgccagtctgggctaattttctttctttttttttttttttttttttaagatggtgtcttgctctgttgcccaggctggagtgcagtggcgcaatcttggctcactgcatccttgacctcccagtctcaagtgatccttccatctcagcctcccaagtagctgggactacaggcacctgttaccatgcccagctaatttttatatttttagtagagatggggtctcaccatattggccaggctggtatcgaactcgtgaccttgtgatctgcctgcctcagcctcccaaagtgttgggattacaggcgtgagccactgcgcctggccagctaattctcttatagtctgtcccatagtttgtttcctcatgattatattgagtttaatatttctgatataattactacatagggagtgatgtataagtgatacatattctccactatgtcacacattgtgtgtacataatgttggtttatctgattgagacattaaattggtcactttgttaaggtggtgcctgcccattgtcttcattgtaacggtattgtttcttttttggtaactgataatggaatttgatggtgatctttgagactaatgaatatccctcttcctgagactagtgaatatccctcttccccggcgtcttttcacctggtggttttggtgtggattctttgaatcatttactgccatctctcccctcaatcccctggattatttatttgctgttaaatatttatctgttctggggttgaactttaggatttaatttaatgtaatatgtagtacgtaagattccagcaattttagaaaaccttagaagaaatttggcaagttaaattcttcttgttaagggataggaagtcactaagttgattagacattgagcacctaactgtgccaggcactgtatttggctttgcaataacaaagtctaaaacttcttgcagagcagagcttactcggtgggagaaatagaaactgttggaaacgttaaaaaacgcaaggcaggtgcagtgatgtgcctctgatccccagctacttgagaggctgaggcgggaggatcccttgagcccaggagttagagaccagtctgggcaacatagtgagaccttgtctttaaaagaaaaaaaattcaaagtcatacctaaggaggtgccttttaggaatcaggcatttgatgtagaacagggtaatttggatggagcagtgtttcacagcctgaaatgatgactctttaaaaaatttcatgtctcttctctgacatttttctctggacacagtttttgccttatgaatctgatcaggctgtagagtggaattgggactcttttggttacccagattttattagatatttatattagaattttgagctgtggggttccagtgctctggctggcaggacactgtggatcaaagcttgtgcctttaggcctttaatgtcatttgtaatccctattggtaaagtgctgaattccagaactaagaagtacccatttctaagacattgattgtgtttttgactttgctagaatgacctggatgaccctgaaagaggaatgatttttgtctgctctgcaacccataaaaccaaatcgatgttcttctttttggctcaaactgagcagggagatatctttaagatcactttggagacagatgaagatatggtaagtagaccatggatggaccagtatagctactctatgagatgagataggcaagacaggtaatactttacaagttaaaaaaatgagaacttagaaagtagttgcccttggaaccggtatatgagtatagattttctctctggttatcagatttttggtctagtaatcttacatacaatataagagcggcaatgccacttgtagtgattatttttaggtgaagaagatagtgattatttttggtgtgaagaagataaaggtctctgtttctgctgaaaactggtaataaacatgatctgttacttgttttatcctatggacgagctctgtgagttgttgggcaatttcttagatagctgtttggatcaggaattggcaaacatttttttgtaaaggccacatagtaaatacttgcagcttttgtgagctacgtagtctccgtctcaattactcaactctgccattatagtacaagacagccacagccagtaatgattggcatgactggcccatgagccggagtttgttgacccctggtcagatatgaaatacagtattttatttgctactcagcctgtgctgtcttataatacggggctcacttcactttgtttgtacaccagaatgtttcttttctcaccaggttactgagatccggctcaaatattttgatactgtacccgttgctgctgccatgtgtgtgcttaaaacagggttcctttttgtagcatcagaatttggaaaccagtgagtaatccttctgttaccctagttcaccctggttgggataaaagttggcagcagaagctgggtgcagtggctcacggccataatcctagcactttgggaggctgaggtgggtgaatcacctgaggtaaggagttggagaccagcctggccaacatggtgaaaccccatctctacctaaaatacaaaaattagctggacatggtggcgggcacctgtaatcccagctaccggggaggctgaggcaggagaatcacttgaatctggaaggtggagattgcagtgagctgagatcacgccactgcactccagcctgggtaacaagagcgaaactctctctcaaaaaaaaaatagttggcagtaggaaggtgcggctttgaggcttagggagcttttcacaagaatgtgttagttctttcaaaagaagtttgttctatccttgtagagtctttctttttcttaccttcctttattttagtggcttcgggcagtacctctgtaggtatctccagaactatctttagatttgatgtctcttctgagctttttgctgaatatttcatcaaataaatttttttttttttttgaagtggagttttgcccttgttgcccagactggagtgcaatggtgtgatctcggctcaccgcaacctctgcctcccaggttcaagcaattctcctgcctcagactcctgagttgctgggattgcaggcatgcgtcactatgcccagctcattttgtacttttagtagagacagggtttctccatgttagtcaggctggtctcgaacttccgacctcaggtgatcgcctgcctcgacctcccaaagtggttggattacaggcgtgagccactgcgcccagcagtacttaaatatttcaataagtatttatttgatgaaatggccaggcgcggtggctcacgcctgtaatccaagcactttgggaggttgaggcgggcggatcacctgaggtcgggagttcgagaccagcctgaccaacatggagaaaccctgtctctactaaaagtacaaaatgagctggtctcaaaccagctggccaagctggtctcaaactcctgacctcaagtgatccatccaccttggccttcccgaagtgttgggactacaggcgtgtgccaccgtgcccagccgagccttcttagctttttggggttttttttggttgtttgtttgtttaagacagagtcttactctgtttcccaggatgctggagtgcaggggtgcaatctcggctcactgcatcctcgacctcccaggctcaaggtgatccttccatctcagcctcccaagtagctgggactattagcaaggtgcatgcctggctaatatatgtatttcttgtaaagtctcaaacttctggacttaagcaatccaagcaatccacctgcctcagtctcccaatgtgctgagattacaggcttgagccatagcgcctggctgatatttgtccctttgtgtctagctcattttacttggcataatatttagaaaattcatgtttaaaaaaaaaaagaaagaaaaagattcatgttttggtagcctgtatcagagcttcgttcctttttgtggcggaataactcattgtatgtacatactgcattttgtttacccattctgctgatgtacacttggattgtttctacctttcactattgggaacaatgctgtggtagatgttgctgtgctaatacctatttgattccccatttttaatttttttgggtatatatgtaggagtggaattactgggtcatggtaattctgtgtttaactttttgagaaaccaccaaactttctcatagcagccacaccattttacattcccaacagcagtatatgagggttccagtttctccacatccttgccaacttgttttccacgtttgtgattatagccatcctgctaagtatgcagtggtggtatgaagtggtagctcattgtggtttgcctttccccggtgatgagtgatgttgagcatctttttgtgtttattggccatttgtgtatctttggagaaatgtctattcaaatcccattgcccattttttaagagttgtctttttatttttgagttctctatgtgttctgggtactagacccttgtcagaaatacgatttgcaaatattttctctcattttgtgggttgtcatctttcttcctttgatgcacaaaagttttaaattttgataaagtccagtttatctgtattttctttgttgcttgtgctataaataaaatactcactgcacttcccagatcttttccctgaattgttttgaaacaaatcctagctgtcgtacttagtgataacacctaaaaataataacaatagtatcttaatataatcaaatagcttgtgctttatgttgatgccagacattatcgtcaggcagagaactcgttaccgaaagtttctctcctctgcttcttcccagttacttatatcaaattgcacatcttggagatgatgatgaagaacctgagttttcatcagccatgcctctggaagaaggagacacattcttttttcagccaagaccacttaaaaaccttgtgctggttgatgagttggacagcctctctcccattctgttttgccaggttggtgggcctttccagccccttccacaatagatctaaagttaaactgaggtctagtctaagaaatagctttattagtatttccatgaactcgccagtgtgtaaagcagttagaggtagaagtttgagcacaaaaaaccattaataagtcctcgggctttttttcccataatgacaaaactcacgtttaatgtaaaaatgcagatcatattcctgtacagcttgcaggggaggaaaaaatcagaccatacaagaagtgagaagtaaaagtcctccccgtaatcttctcacctgtccgctccattgagccatattgcttgtattaacaacttcttgtgactgcttctaggtgttttctctgcatttacaatcatgtatatgtttatgtgttatatctttttctttttaaaataagtggattcatatactccacagtattctgtggttgacctcttgtcatgtaacagtctacatatagctgtatttatttaattttaccacagttcctctttaaaatagttctgagacattgggatcagttggtaacaggtagttttgaatcacattctcaaggaggaacctgaagtggctcagaatggagtttgtgtctctcattgctggtgctcagttgtgacagccaggaatttgatcatgttgctgcatcctcaattgtcagggtttgagtgaccattagggaccacctgtgtagttgatcacacttctgatgggagaggagtttgttcactgggtactggggaaacaagtcagcattcagacaggtttaattaaacccatctgaaattaattgctttgttcttcctttctgagaaacgattagtcttgagggcaacagaaaataaatgtgactaatttctttttttttcttttttttttcttttttttttgagatggagtctcgctctgttgcccaggctggagtgcagtggcgtgatctcggctcactgcaagttccgcctcccaggttcacgccattctcctgccttagcctccctagtagctgggactacaagcgcccgccaccatgcccagctaattttttgtatttttagtagagacagggtttcactgttaactagccaggatggtctcgatattctgacctcgtgatccgcctgccttggtctcccaaagtgctgggattataggtgtgagccaccacgcccggccaagtgtgactaatttctaatttgatttttagtgatttttttcaccttcattggaatttgaataaataatgtgtgtaaatagtttattcatcaagaataaaattagccaggcatggtggctcatgcttgtaatcccagcactttgggaggccgaggtgggcagatcacctgaggttgggagtttgagaccagcctgaccaacatggagaaaccctgtctctactaaaagaaatacaaaattagccaggcatggtggcgcatgcctgtaatcgcagctacttaggaggccgaggcaagagaatcgcttgaacttgggaggcagaggttgcggtgagctgagatcacaccattgtactccagcctgggtaacgagcgaaaccccgtctcaaaaaagaaaaaaaaaaggccggtcacgatggcttacacctgtaatcccagcactttgggaggccgaggcgggtagatgacctgaggtcaggaatttgagactgtcctggccaacacggtgaaaccccgtctctactaaaaataaaaaaactagcagggcatggtggtgggtgcttgtaatcccagctacttgggaggtcgaggcaggagaatcgcttgaacccaggagatggaggttgcagtgagcttacacagtgccactgtactctaacctcggtgacagagtgagactctgtcttaaaaaaaaataaaataaataaaatgaatgggaagttaaagtgtgtatagcagggcttcttaacatttctttctgccatggatctttttgctagccaaagcatctggatccgatctgaataatgttttactgtttttttgtgtttttttttttaatttttttttgagacaagagtctcactctgttacccaggctagagtgcagtggcacagttacgactcactgtagcctcagcctcctgggctgaagcgattttcccacctccgcctcctcagtagctgggactatagacacaagccaccatacccagctaatgaatgatatttttaaatgcatatgaaaatatgcatagaatcagaatagcaaaatattttttaaagttgtggaaaacagatgtgctttactgaggttttataaataataagatgatacacttaaaatgggtgtgttaattttttttaggagactggtgtgatggctgtataccctcagtactcacatgtgcgtctgtgttacagtagactccattgctctgcagagagagtaaagaattttcatttgaactgtccagtttgtcaaaactacaatacagatcattcacctcttttcacatattgatcagcagataattgtattggaaagcagctggatgtctgggatactagagaatcagagttgtgtttgaaaacagcactggagacattttttcctctaactttttctctgtgcagatagctgatctggccaatgaagatactccacagttgtatgtggcctgtggtaggggaccccgatcatctctgagagtcctaagacatggacttgaggtaaggttgcaatttctagataatctgcagggtttggagggaagcactgacaaagtagtttatgggtttactctgatgttgtcaaagacatagttaaggtgtctgtgaaaaagtatgttctttctccctgacttccccgaagtttatacttcagattttctttctttttgtctccaaaacagggtctcactgtgttgcccaggctggtgtgcaatgacatgatcttggctcactgcagccttgacctcttgagctcaagtgattattctgcctcagcctcccaaagtgttgcttacaggtgtaagccactgtgcccagcctgtgcttttttctattcctcaacttgttagcatgatagcccacatggtcactagtcatgacatggaggctaggaaatctatatggaacatttcactctctgtatacatctagtcttagttaaatcaactatatcaatgctatatatatttttgtatcttattaaatttattccttattactatatactcctaaatagcatactttttatttatttattcatttatttttgagatggggtcccactctgtctcccatgctggagtgcagtggctccatcatggctcactgcagccttgaccttcctgggatcaggtgatcctcccacctcagcctcctgaataactggggactgcaggcacgtgccacaacacccagctaatttttgtactttttgtagagacagagtcttatcatgtttccctggctggtcttgacctcctggggtcaagcaatctgcctgccttggcttcccaaagtgctgggatcacagccgtgagccaccgcacctggccaagtagcataatttttagtgtttctgcaatgtttcaccaaagtgggtagatcataatttatttagtgaatcttttattgctggactttttaggtaatgtggacactaaaagttatcttcttgaatcccatattctctgtgtatcgtagtcctaatgttaatgctttctagtgagggccctgaacttgaacttgttaggaataaaataaaaagcttcctataacagtttgttttgagcgcttgggaatggcaatctgagctctcaagaggcctgctacctgtttctgtaaatttttattggaacacgcccaagataatctgggttttgaattctggctctaccacttaatagctattactaagtttttgtttcttctgttaaatggacttaataatggtacctgccataaagaattatgtgaattaaatgagttgataacaaacaaagcacttagcttaaggtatggcatgaagtgttcgataaatgttagctgttaacattggtgtttcagggaatttgaaaatgttttgtctctgccaaaatatattcatcagttcaccaaaatttcaatgactcagacccaatttagagccataggtctggtttttggttttttgttgttgttgtttttgtttttgtttttttgagtgcagtggtgagactttgcttcactgtagcctccaacgcccagtctcaagcaagcaattctcccaccttagcttctggagtagctgggactacaggtgtgcgccatcacgcttggctaatttatttatttatttttggtagagacagggtcttgctattttgccagggctggtcttgaactcctgggctcaagtgagcctcccacttcaccctcccaaagtgttgtgattacaagcgtgagccaccgcgcctggccaagagccattgctcttgattcgttagttacttatttctcattggatcctagtgagcatatgatgaaagctagtgctttacacaaaaaatgcatatgtgcggctgggcacggtggcgcacgcctgtaattccagcactttaggaggctgaagcagctggatcacccaaggtcaggagttcgagaccagcctggccaacatggtgaaaccccttctctactaaaactacaaaaatgagccgagagtggtggtgggtgtctgtaatcccagctactcaggagactaaggcaggagaatagcttgaactgggaggtagaggttgcagtgagccgagatcacgccactgtactccagcttgggcaaaagagtgatactgtctctaaaaaaatgcatatgtgcattaacagaaaatttttgtatagtgtaagagataaatgactcaagaatcattttttagtttcctgctacttctctccccacttcaaatctatagacaaacctttgttatatataaaaatattttctgaggtgggcagatcacgaggtcaggagatcgagaccatcttggctaacacggtgaaaccccgtctctactaaaaatacaaaaagattagccaggcgtggtggcgggcgcctgtagtcccagctactcaggaggctgaggcaggagaatggcgtgaacccgggaggtggagcttgcagtgagccaagatcgcgccattgcactcgagcctgggcgacagagcgagactccgtctcaaaaaaaaaaaatttttttttaaattgttgaacgttgctttattcctttatgtctatttgttacaccttgttgtctaactagattgtggtctcaattgagccagggtgactgacagttttacatttggtatagactatagcatagttgacagttgaattttattgatgatgaagttcttaggtcttccttctaattataccagtaaactaggaaaagggctagtctttctgtgaatatacatgaattcttcctataagatgtgggttacacgttatatataagtggctagtttattgtctctagatcatttaaaaacattcaataattttaattttataatgattttaaatttataaaaaaattgcaaagacagtacagagagttcctgtataacctacacccagttttcccctctagatcattttgaatttggcttagatgttttgtttactcttatgtttgagaacctataggacatgtagagaatcattcactcttgactttaaggagcataaaaatctaatcagaaagacaaaacagttagtaccctaagaggtggtgactgatttctttcttttttttggagacggagtctcgctcagtcacccaggctggagtgcaatgatgcaatctcagctcaccgcaacctccgcctcccgggttcaagcgattctcccgcctcagcctcccgagtagctgggattacggcacccgccatcatgcctggctaatttttatatttttgcagagacgggtttcaccgtgttggccagctggtcttgaactcctgacctaaggcaatccacccgcctcggcatcccaaagtgctgggatttcaggtgtgagccactgggcccagccggtggtgactgatttctatgagtgcttatagaagggagaggtgactgccagccaaggggataagggaataattttgttaaaggaggtggcatttgaattggtccacatgggatttggccttatgggagctggggaaagaaaggggatgctaatttagatggcctgattgattcccagtggttactgctgttctgaggatgatcaaggcatattgtacttgaaggaaaggggtatggttttgcctgcagcaactgtaccctctcagacatcctgtaacttttgcttaagactgtcatggggattgccactaagaaccagcctgtttggttcttagattcttctttcactaggtggtttcatcctttaaatacagcatacgttgtgaaccctgcctttgagaccttattttttgatgtgattgtaagcaggtagctgagttgcatgctcactggatctgtggcttccctcttctcctgtcaggtgtcagaaatggctgtttctgagctacctggtaaccccaacgctgtctggacagtgcgtcgacacattgaaggtaagcagctttttcccaatagtcaaaatgaggatctaggtgccattgacatagaaggcttgaaaggctgcgttcataatacttctgtatcatttcatttagcaccatataccagaaactttctggcccaacactgtttttgaggctcttccgttcaggatgccttcacctaccatttctttttgtgcaggtgggaaagggggaacataggttggctgttatattttagtacataaaggtttcagaatcatagagctgtcaaatgtggtattgactttatattcataaaggtactggtttcatctgtaagaggtatgatatgagggaaagttgtgctttttcattcttcttcaactatattcttttaaattgttttgaaaccacagtgaaattgaaggtggtgttctaggaattaagagatttgggaaagcttgttagtcaatcttgctagtgcttaaggaaagcagagtggaattgagtggaattcgaattttagtgtgagtagaaaagcggggatggggaaggagaagggagtttgagctcctggatataaatggtcacctgatcctaaaactttgaaagtaataggagaatgcctagtagttactgcaatagcaggaaagtcttgtgacaattgaattgcagcctcatagaaagaaagctcagtctcattttcccttgattcacattggagctacgtttttctcttgttctctcaggaatgtgggatgggtgagtaacatcatccttgctagcagacaggtttttcaagaaaacagctgtaattctgcctgatatttagatattctgcctgtatgaaacagattgaaggagttgggagacatgtaggaggaaaacaacttactattagtagaatactcatttttgtggatttaattttcattgtaggcatttgaatcatatccaagttgagtagaaagggaaaattgtgaataggaaatgggtaggcttataagctgaagagataattattaggcacctggttttatgtgtagtatctacatagaagttggtccgtgttggtgttttactttggcttggtggcttgttgatattcatggcccttgaaagcattgcctagactgtttgaattagaaacacgttttaagataacctattgtgttctttctttttttcttttaactttttaaataaactttttattttaaaacagatttagggccaggtgcggtggctcatgcctgtaatcccagcatattgggaggccgaggtgggcggatcatctgaggtcagagtttgagaccagtctggccaacatggtgaaaccccatctctactaaaaatacaaaaattagctgggcgtggtggtgcaggcctgtaatcccagctacttaaggggctgaggcaggagaatcacttgaacctgggaggcggaggttgcagtgagccgagattgcaccactgccctccagcctgggtgacagagcgagactccatgtcaaaaaaagaaaaagaaaagagatttaggtttacagaaaagttaactctcacttttatgaagaagacaggaagttataggggttgagtgtctcaagacacagtctaggtaatggggacagaatatcctggcttctgaatctcagttgaatgcccattttgattaactgcagtgagattctgtgggtcttggtggtttctttcaggataagtttagtttttgagtgcccaccatgtactcagtgattaagatagactctgcctcagagcacttgccatctaaaaaaagaagacaagtatacaaaagtgttgtgtgttgtgatgtggtgaaaggcacaggtacattgctgggaggggttaaaggagagggcatgtgtttgaaggtcagggcaggctctttagagggacagcatttgctaacttagtgataggccgtttgttgcattatggaacttgtagttgaacatttttctcctttattaaatgttagaagtcttggaaaggactatatcctgctaaattttactctttaggtactgtaatttgggagtcacctataaatacaggtcgggttctgttggttcactcactttccagatacccgaagttactattgagtgaacattccttctgcctgcacatgcagcagtcttccaggcaaatactaaccttggctggtacttggtgatgcacactaccaataccaagcctttttttctcttccacaggtggctggtgaaggtgctgatcaccacaggtgtgtacctaactgctagggtcgatgtggggtcttatagtttatccaaggagagggacctgcacaaaatattgaggctgccctgatggtgtctttcagagggtaactttgcagttggatgtcactgggcataatagtgctgcacaccatctgcctgtgcatcagatggtctgaggcaggagtctgcctctctacttcctcccacagaatttgtcatatatggttaatttgccttttactaagctaaaagagtctctagctagagaactttagcttcatactctcatagagttgtacattccaggtgtactgactgaaagatcaggaccgagagaaagcttttgagtatattcaggacttgctgaagcaagataagtatcagatacccttgtctatgaagtgagagggagttacttgagcttcaggtatctggatggtcgctcactttaccttttggagtgagctgctggttgagccttaaatcctaaggcaaggcaagtagaagaaaaaagcattccctcctctggggtccttagcagtgttcagacagatgggagccctgttgaactgtgacctaaagatacagtctcatacccttatggattcttcattgaggtatgaactattgttttttaacatgagacttgaattccttagaatgcagtgtggatggtacagttcctagtcatttaccttgactaaagcttggctttgttctgaactccagcgttttttttaaaatagtgttttgggctgggcgcggtggctcacgccaacactttgggaggctgaggtggatggatcacctgaggttgggaatttgagaccagcctgaccaatatggagaaaccctgtctctactaaaaatgtaaaattagctgggtgtggtggcacatgcctgtaatcctagctactagagaggctgaggcaggagaatcgcttgaacctgggaggcggaggttgcagtgagctgagattgcgccattgtactccagcctgggcaaccagagcgaaactctctccaaaaaaaaactaataaattttttatagaattggggtcttgttatgttgcccaggctggtcttgagctcctgaactcaaatgatcctccctccccagcctcccaaagtgcttgaaccaccgtgcccagcttggactccaacttttaatctgcagtcactctagtacataagaattaacctgctgcaagtcctcttcactgtagaaggaaggggtagaagttacaatgtgcttggtattcacagggcagtgtttattttgaggaagtctgtgatgtaaagcagctttgagatgtcgttggctctcccacttgttgaattgtctagcaaaagtatgaccctatttaagttcactgagcatttattctcttatgtttgagtagtctgaagtcttggtcgaaggaaaggcacccctcctcccttctttgccccattctctcccatgaaagtcaaaagttgtgtggtctgtcttttggaaggtcaccttttccccttggtgaagatctgagaccagaaatcctggccagttacagccttttgttgtttggctttaatttgctttgacacagcttttagggttattaggtttcagtaatgagaacatgggaaatgatactgtattcatataatattaaaattaaacaactgttatttttacacaacaaaaatttccagtacaaaaactgagaactggagtaaaggttccaaacttggtgttatgtagagatggattttggttttgttgaaagctactgagacatccatttcagagataaccatgtccttacttgttttatgatagtgagtagtgcttagtcttacaaagccatcttataagacgttcccaaagcatttgatatatgttgacagttctagcaaaataaccaaaaaccaagtatctagcttcttgtcctgtattattccttatgatttggaaattgaacctttactctgtggattcctggtctaaccattagagcatgcccattgggaaagatctttaatccttgtttttcagccaccacagtaggtacatatatatgcaatattaactgaaacaaaagtttcacaaaacagtaattatcctactatatatgaagcaacttcataaattacatttatttctgttatgaagtgcctattgtgcaacacattaaattgattttacgtcctgctaatagggcagaacactactgtaggccatgccaatgatacatcttttttgtttgttttgagacagtctcattctgtcacccagattggagtgcagtggggcgatctcggctcactgcggcctccgcctcccgggttcaggcaattctgctcagcctcccgagtagttggaattacaggcgcccaccaccacacccagctaatttttgtattttattttatttattttttagtagagatggggtttcaccctgttggtcaggctggtttctaactcctgatctcaggtgatctacccaccttggcctcccaaagtgctgggattacaggcatgagccatcatgcctggtcgaatgatacatcttcatttgacccctgcttctgtaaagaatgctgattctgcagaactgatctagtaaccttaatctagctgaacctcatttgaagtcatcagaaccaaaagtatgcccttcatgtgggtgggtgggtggaccagccctgtggcattgagctcttgacaagtgcttaggcagacgggtcctatagctgctactgctaggagtgagtcagccactacattgtgtggtgccttgtcttgttctgtcctttttttttaacctgatttctggttaagggggtgttaaaacaaaaattcaaatgtaaactaggaaaatctcaactcttttaaaaaattagcatgcctttagtcaacatttatcaagctttacgccaaacgtactggatggggacacttgcagaagctgttgtatgttgtagggtgagatacatggaaaatagatggcctttatgggatctgtagaagaaactgagggtttctggtatacctcaagtcctctgacttccttgagaaactcattagtgtttattcaactacatttaattagaaaaagcaaattctaataggattgctcatgaccacaggattgttctgtttctaaatagtgaaaaaccagagaggtcacagaataacaatataaacaacccccaccctccatttcctggttatctagttttcttacatcattcccattgggactaggattctcagcttccaaccctagaatgagttagtctcacagaggcttaagtaatctctattttattcattagagcttgtgttcatttctacataagctgcttttggaagaagttaggggtctttcctagttagaaggagtatctcttcttaggaaggggttgtgtgattgacaactggcacaaataaatgaagctctagctcagtatgttcatgtatcaatattgtagtatttaaaatgtcctcatgtctccgattctcttgctttgtcctctcacttctttagcagatgtctcaagaaaatattgaggaagcagagtatatctgtaggctcttctgacccctagttttcttctggatcattttgctctgtgtgcatgtgtatgtgtgtatgtgtgtaataactacacatagaagaactgccttggaaggtttctgaagagaactcttagtgtttcatttggctttgtaattctaatgagttcttatctaaccaactcccttcttttctttttcagatgagtttgatgcctacatcattgtgtctttcgtgaatgccaccctagtgttgtccattggagaaactgtagaagaagtgactgactctgggttcctggggaccaccccgaccttgtcctgctccttattaggagatgatgccttggtgcaggtgagggttctcagagcttacctacttggcctgctttgttctttcttggccttcattgtgatgcaggctgctgtgttcatgtctcttcaccctcaccttccagcaagccttaggggtagggaacatatgatttgggcacataatatccctctctgtatttgccatttttctgttacagagccacatcactgcagctttcatctctaataaagatctttataagtgttttgttaataagctttgaacttctttgaagtggacactgcaaaacatgaactatttaaaagttgaccttgcctgaggcctactaactcttttgtctttgattcaactggtgcctcaaatgcagtggccccaggtctgattttagtgacagatctgatagatgtgagggtcattctgagtgatgaatcaaattgttaaagtcaggtttctttctgttactgactctaggtctatccagatggcattcggcacatacgagcagacaagagagtcaatgagtggaagacccctggaaagaaaacaattgtgaagtgtgcagtgaaccagcgacaagtggtgattgccctgacaggaggagagctggtctatttcgagatggatcctgtatgttattttatcattcactgtgggacttattgtagggaccagagggaaagatgggcattgtagtctagtcatttagatgatagtatggtgaaatcctgtctctactaaaaatacaaaaattagctgggcgtgttggcatgcaccttgtagtcctagctactcaggaggctgaggcaggagaattgcttgaacccgggaggcagaggttgcggtgagctgagattgcaccactgcactccagcctggcgacagagcaagactccgtctcaaaaaaaaaaaaaaaaaaaaaaagcgagctggagtgacagtgttcacaaaccagtttggtcccttacagagatggggaaaaggggtaatttgatgtctaattctaggtagagttatgaaatcccctcttagcagtgaaacacttgctcctcctgcatttcactctctacttttccaacaaatatttggcatagatttaatttctgcagtctgaatccatttcagaaaacttctatatggaaggatgttcagtacacttaattctcttgctctcaggaggtctctagtgtggccaaatttgtagcctgcctgtacctttggttgagatttctctgtctttaaccatatttgaattcccttcacccagaatattcttgtaaaacacagacagttttatatgtctccatttcctgagaacaaagttggctcagaaaatttgtggcacattgaccttgtcaaaggtctgttcattctcttattgatggaagatactcattttgcttgctgtgagcctgttaacttcagtcttgagaactcaggtagataaattcttgtcatttactatagtaagaggagtgagaggaagcagaacaaaatacaacagccctccttcattctctggatccagggttttggggtgaattggagcatctagacccatccctctgtagttttgaccttgctgtgtctttcctcctgtagtcaggacagctgaatgagtacacagaacggaaggagatgtcagcagatgtggtgtgcatgagtctggccaatgtaccccctggagagcagcggtctcgcttcctggctgtggggcttgtggacaacactgtcagaatcatctccctggatccctcagtgagtgacactctgagcttcaaggatcatctggttggaacctgagcatctggctcctgatgtctatctctgagatccactcctgatgtctatctctgagatcagctgggttagaacccagaatccatacctgctgcttctcttgtcattgcagtgtgtttcaggagtttcctgctgtggtttaaggatatgatctgagactacagaaatgtttctttggcttaagcctcaactcctttttttaagttaacaaccaagactgcataaatttgacttgctgcaggaccctaggtgacttttcaggaggtgtgctttgcttaattacctttgccattatcttctttgacaaaaggaggaaagcatgatcttcccgaagcttattctgaaattgggtgtaactaataactcagtactctcttagaactcactccccgggttttttctgtgcataaggaagtactttttcaatcctagaattagatttctctgggtatgtttttttcctaaaattgtcattttctgtgtttttatgatttttctctccctctcaggactgtttgcaacctctaagcatgcaggctctcccagcccagcctgagtccttgtgtatcgtggaaatgggtgggactgagaagcaggatgagctgggtgagaggggctcgattggcttcctatacctgaatattgggctacaggtaagagatccagaggcccacattgtggacattaggccttctgtacgtttcacacactcctttgtttgataacagggattttctctgcccatggtttcagatcctcaccttatgaaaagtgaacagtgtcactctgggttccacttttctcagctctttaattcgaacaaatcaggctgagaaagaaatattttgataaagagtcttcacatctgataaatgctgtttgatagctactctaagtcagaactggatgggttcctgaaggatcaactgtagttcccactattcactagtttcaaaagcagcaatgaatacctctcagttcataattggcttcattagcaataaaggacccctaaatgttccctgttgtcaaagttgctgagctctttgtgccgtgaagaaaaggtgtgctttaacgctaagatagtgtcaggattcttgatcatatgcttttcattttccttaatgattattgactcagacatctaagtaatctagcccaggtactttttgctttttaattttacttcctaatttagaaatctcaaacatagccagaagttagagagactaatacagtgaacttccatgtacccagtttttttgggagagggttgttgttatttttttagttttttttcttttgttggatttttatgggctgccacatgggttttcggtctatttttttcttttttagttttaacagctatcagcaacattctgctgttcttattttatcttttccctggactattttaaagcaaatccaagatctatcatttcatctataaatacttgataatgtagttccaacagatgtctgtttttgtaagatactagtattatcatgctcagcaaaatataacaatagttccttattaccatgttccagttttccctgttcttctttcccccaatgtggctttatagttggttgtgctcaggacctcagcatagcagtctacgctttttccatttccttcatctttctttttatgtctcttaaactgttctaccccattttgaagtattacaagatcagatcatttgtcttgtagaatttcccaccttctggacttaataaagtcattccttatgtgttcaagttcctgtatcctctgtatcaagctggtgggtagaattagaccatgccatccattagaaatgtaaggtgaactacaggtgtaatttaaattttctagtagccacgaacaggaaaaaagtaattttaatgttttttttttttctttaaaaaaaaatagagatagggtctcgctgtgttgctcagactggtcttgaactcctggcctcaagtggtcctcctacattggcctccaaaagtgctggtgggaatgcaggcatgaaccaccgtgcctggccagttttaatgttttattaactctgtatatctgaaatcattctaacatgtagttaatataaaaattgctgagctatttcacctttttttctctcttttttaaaccaagtctgaaatctggtattggcactttacacttagcagtcttagttctctttaaaattttatttgtctttatttaaaaaaaatttcttccttgacacagagtcttgctctgttgcccaggctggagtgcagtggtgtgatctcagctcactgcagcctctgcctcctgggttcaagcgattctcatgcctcagcctcctgagtagctgggtttatggtgtgcaccactacgcccggctaatttttcttgtttctagtagagatggggttttgccatgttgctcaggctggtcttgaactcctgagctcaagcgatccacccgccttggcctcccaaagggctgggattacaggtgtgagacaccatgcctggtcctgtctcagttctgactagccacatgtggcttggggtagctatagtatcggatattgcagaagaagaagttggttagattcagatttaattattgggggagggggacaggaatacttaataggtggtgctgtttactcctgttgcatcacgtcaggaggagtgtagtgtctggttgtcccactcacagtgatgttgggatgtttgtctgtatctgtgttaaagttcccgtcaaccctttacttacagctattacacacattgcctaggttcattctttcattagtggttggaaaatgatttatttctttttggatttaattagttggaattctaaagacaaaattcgcatcatttctttgcttactataagtacggttcatacaggaaaaggataaataatttttttcccattgttcacctgttttcagagtaaggagtgagggccacagcactcctttcagtggggcccagtaaagtgggttttttgctgttttttagagtaacattggtcaggtgctgtggctcacacctgtaatcccagcgctttgcgaggctgaggtgggtggattgcttgagctcaggagttcgagactagcctgggcaacatggcgaaacctcatttccaccaaaaatacaaaaaatagttgggaatggtggctcatgcctgtagtcccagctacttgggaagctgaagtgggaggattgcttgagcctgggaggtggaggctgcagtgagccaagattgtggcactgtactccagcctgggtgacagagtgagaacctgtctcaataaataaataaataaaaatttaaaaaaatagagtaacatcataaacttgtggatttttatacatttgtgctgaaaactcctttttttttttttaaacagagacagagtctcgctatgttggccaggttggtctttagctcttggcctcaagcagtcgtccttccttggcttccacagtgctgtgattacagatgtgagccacctcacctggcttctttttttttgaggggtgcgggggggtggtaaattgactcattctagaaaagtgggaatttctatttgaagttagttcttttgtccttttaacatgaccccactatttgtaggggtttccttgccttgttgcacaataaagtatccccacatgtgtctggaacattcttgcccctgccccaaactagtcattccttttaggaaccttgttcctttaagaggaaatgctgtttagggaccatggtctttgtggttatttaattatttatttgaaatatacagtagtgaagaaggatttaatatacttggtaaaaagaaatattaagaagatatagtgaaaaataagtgtgtatttacttagtagatgctccataactttggatgattaagtgatttactgagagaatgaaatgaatggctatcggattattaggatcttttttaaacacccaagtcatttctttctatctgctctaatttcttatgtgaagtacccaagggagaggttttcccatcatagctgataagcttccatcaggcttcacctgctcctctccttttgattagaacggtgtgctgctgaggactgtcttggaccctgtcactggggatttgtctgatactcgcactcggtacctggggtcccgtcctgtgaagctcttccgagtccgaatgcaaggccaggaggcagtaagtaatgaaggttggggacaggcaacatctttgggattttagtggcaccatctgagaacaatctttgctgtaagcttcactgtcactaatttgccactccatcttgattggtttccttcatgtgagaagtcctgagttttcctaacctagagcttcctcactggggctccatcgcaccatgtcatgatttggttatagctgggtagagatatcgatccctttagccctctggctggtcaaatagggctggaaacctcccctctaggacaccactagccatgagaattctcaggttttatcccagtcttagatcagtgtcacgtttactacctaatgtgaaagagactgggaaacattgtgtcctttgtagttaagaatgttagtgtttctgggcactgtgctaattgattccatttaattctgttttttgttgtttttttttttgagatggagtctcactctgtcgcccaggctggaatgtagtggtgcaagcttggctcactgcaacctccgcctcctgggttcaaccaattgtctttcctcagcctcccgattagctgggattacaggcgcatgccaccacgcccagctaatttttgtatttttagtagagatgaggtttcactatgttggccaggttggcctcgaactcctgacttcaggtgatccgcctgccgtggcctcccaaagtgctgggattacaggcatgagccaccgcacctggccttcattccatttaattcttgcagctgtccagccttgtggtactgttttcattttacacacgtggaagcaggcttagagagatgaaatggtgagtctagatcatatggctcgtagcccatgcttttcacatatgctaagccatagtgcctctctctagccctctttttcttaagatagcctgttatatttctagaatatcttaggatactctgcagactgaaatttggggatagggcttttggtcagcttataccatatttgtattttttcccaaaccttattggagctgggttttttttttcccctcaggtattggccatgtcaagccgctcatggttgagctattcttaccaatctcgcttccatctcaccccactgtcttacgagacactggaatttgcatcgggttttgcctcggaacagtgtcccgagggcattgtggccatctccaccaacaccctacggtgagtgagtctcatgtttgaagctcagcaggaagcctttctgccaagggctcagactggttctgccagagtgttggaggaggctgtgaagaggtggcagagagccgacttcaccatgaagcttgtgtgttgcaattgaaaccttcatttggctcagcattttagtacctgagagccaagtttcggtgttttagcttctgttaagattttcaaggccaagctttaatacagtccaatcttcctgagatttcagatttttgttttctagcaaaagggtattgccattggattagttttagagcaagtattggatcactgcattgataacctttcttactctgtcttgtcatttgcggtattaaatcttaaatgttaacctatctataagttatttagacctttttcaagttgacaaaactgttcttcctggtaatattgatgtgaagtttgagcactgtatgtaatattctttgcaagatggaaaagaacctaaaataattcagtcagtttggcttcctcaggttttggggggcttttaaaattaagccaccaaagttgttcacatcctggttataactattggctgttcataatgaaactatggcctcttgatagattaatcactattgcttatcaaatgagctcccaaaatttctttgcaacaactttcagggtcttttcatggtcattgtcctttttctttccgtcatctttgtatttatcttctgctccagcagaattgatctccctgcactgctctacatcacttaatatttttttaatctctacctgtgctagaatgcttcacccacatacatacctgcctgtcagtgttccccttgtcttttaagccagccttgttgtagcctcatctgtggcccctacctcctgaattgctatagatttagacaatcgctacagatttttaggctttcctagcagcagaacttacttccccccaaaactaaatcagggaaggtgacttatgagacataaaagcagagttcttggcaggcagtttatttttttatttaattatttttatttttaagttttttttttgagacaaggtcttactctgttgtacaggttggagtgcagtggtgtgatcatggctcactgcagccccaacttcctgggctcaagctatttctgcctcaacctcccaagtacctggtgggactgtaggcgcatgccatcatgcctggctaatttttgtgttctattttatagagacaggatttcaccttggtgcccaggctggtcttgagctcctgggctcaagagattctcccacctcagcctcccaagtagctgggactacaggcgtgcgccaccatacatggctttttttttggtattttcaacagagttggtgtttcaccatgttacccaggcttgtcttgaactcctagccttaggtgatctgcctgctttggcctcccaaagtgctgagattacaggcgtgagccaccacacgcagcccctatcttttttaatgtagagaataaactacaaataaaactccatcattagagatcgggtaactatacttttcagagtacctgggttctgctcattttgcacatagtttggcttatgtgtacatctctgtcccatttgacagaaatttgtaggtcccttatttgctgtctcttgcattgtcatagttttcctgaactgaggtgatttttgttcacaaaggtatccactttattttatgaagcacagtcactacaaataccatatatgtttaggtaattgcagtgtttcacaacaaatttgggattgggctctttattatcattggagtgattaaaaaaaaacttttgacaatcgtttgtgtttcattggtaggaactagaactgctgtgaattgtggtagggtgttgccaaatgggaaggcccttcctggatctctgtgtctgcatcgcagagttttctagagtaggaggctgttgtttaatgttgcctaatgccaacgttagagctccagggattgacgtgtttgctgactgctcaaagtctatttcaacaccagtttctgggtccgagtgagtattaaataactgccttgcttttttgtcataggattttggcattagagaagctcggtgctgtcttcaatcaagtagccttcccactgcagtacacacccaggaaatttgtcatccaccctgagagtaacaaccttattatcattgaaacggaccacaatgcctacactgaggccacgaaagctcagagaaagcagcagatggcagaggtaatgagactaacgttcaggggttctattaaaagatgtgtgaaattatgttgaaaagtttaaactgcccggcactttgggaggctgaggtgggaggattgcttgaggccactagttcgagaccagcctgggcaacatagcaaaactgcacctctattaaaaattttaaaagatagcctggtgtgttggtgcactcctgtagtcccagctacttgggaggctgaggcaggaggatcacttgagcccaggagttcaagactgcagtgagccatgatcatgccactgcataccagtggcactctggacacgagactctatcaaaagtttaaactcctgtaattgttagtatattctttgtttttaaagatctaggcttttttcagcttttttaagcagaggcctttgccccaaagtacttcattttagagcctttcttgtaacccaggactatactctgacctccatttattcacaattaagttccctctctgaaacagaattctcccgtccttgagcttccaaaatagactgtatttcctttatttgggcccaaaagagacagctttcatgttctccacaacaccagctctttctagaactcattgcctagcagaaaccaaatagctacaaccacgtagaactgtatccatccttaaagagtggagacagagtagttttagtaagggaaatcagatgggttggatagaaaagtggagtttccgttgtcatttttctcaagccactagtccaatatttgtcacagctattgttatttttggtgttttctactaatatgtaaccagcaatgtctggatttccctttctgatcttctgtcttccctagtctgtacacctctccctttaatagtcatgtcgggaaatcctggctgggatggctgactttgctgctttatgtattgagaaccccctggagtgttcttgctacctatcctcttctcagccagcccctacctctgagcacgccaactcagttactcgtttttttgggtttaggaaatggtggaagcagcaggggaggatgagcgggagctggccgcagagatggcagcagcattcctcaatgaaaacctccctgaatccatctttggagctcccaaggctggcaatgggcagtgggcctctgtgatccgagtgatgaatcccattcaagggaacacactggaccttgtccagctggaacagaatgaggcagcttttaggtaagcagcccaggacagtccagggtttggcaggctggaacaggagctctctgagttttgactaaggccttactcttgcttcttattctgtgtgtagtgtggctgtgtgcaggttttccaacactggtgaagactggtatgtgctggtgggtgtggccaaggacctgatactaaacccccgatctgtggcagggggcttcgtctatacttacaagcttgtgaacaatggggaaaaactggagtttttgcacaaggtaggaatctgccagtggttctcctagattttaagtcccattgaattctctcacttttgcttatgttatggatcaggtcttttggggaccagctccttgattccaatctctctcttaccagcacatggaaaatgctggggccttctagctgcagtgatgttcttgtgcctgtgcattccacaggaaggctttgtgctaaccatccataatggggagatagatgcacattcaattggtctctttcttactgttttaataagcaggcaacaatttgtgaccaaaattcagcagtttaaataattaatattctggctgggcgcagtggctcatgcctgtaatcccagcactttgggaggccgaggcaggcagatcacctgaggtcaggagttcgagaccagcccggccaacatggtgaaagcctgtctctactaaaaatacaaaaatcagccaggcatggcggcacgcacctgtaatcccagctgctcgggaggctaagacaggagaatcgcttgaacccgggaggcggaggttgcagtgagccgagattgcgccattgcactctagcctgggtgacaagagtgagactgtcaaaaaaaaaaaaaagatttaatattcttttccacctgcattctctgggaagttactgtttaatgggtacagagtttcagtttgggaagatgaaaaaaattctggaggtgatagttacacaacagtaaatgtgcttaatgccactgaagtgtatacttaaaaatgactggctgggcatggtgtctcacgcctgtaatcccagcactttggaaggccgaggtgggcgggtcacctgagctcaggagttcaaaaccagtctggtcaacgtggtgaaatcccatctctattaaaaataaaaaatcagccaagcatggtggtgggcgcctgtaaccctagctattccagaggctaaggcaggagaatcacttgaacccaggaggcagaggttgcagtgagccgagattgcgccactgcactccagcgtgggtgacagagcgagactctgtctcaaaaaaaagaaaaggattaagatggtaaactttatgttatgactattttaccataatttttaaaataaaaagaatattctcttctccacaatgacagcatgtggattccttcaaccctaccataaggggagtatcctctaagaaatacttcatagacccttttgcatattaaatttgtctctcctttacaactgagatgtcactaggctgggtgcagtggctcacgcttgtaatcccagcattttgggagtctgagtcgagcaggtcacttgagcccaagagtttgagaccagcctgggcaatgtggtgaaactcagtttctacgaaaaatacagataattagtcaggcttgatggcacatgcctgtagtcccagctactcgggagtctgaggtgggaggatcacctgagcccaggaagtccaggctatagtgagccatgattgcgcctgccacagcccttcagcctgagcagtagtgagaccctgtctcaaaaaaaaaaaaaaaagtcacttttcactagcatttctttcctgtccctccacaaattacagtcacttggctactaaggcttcactgttgaaataacaccagttaaacagagcacaagctctggacagcagtcgtctggtaccagaacttcttgtcagttacagcattgatccctctactgagtgaatgcagcatgcggaacttgttcaccccaacacccagattcattagcaaaataagctcactggtgtgtttcttaatgataggctcctgtggaagtaggcatttctgggcagagaggtgaggcctgtgtctggctggcatttataatagctgtattacctgcttttcctctatagactcctgtggaagaggtccctgctgctattgccccattccaggggagggtgttgattggtgtggggaagctgttgcgtgtctatgacctgggaaagaagaagttactccgaaaatgtgagaataaggtaagtgtgctggcattggtgctgagatctagctcatgtgtcaagggtgggggcattggtggggtggtgggcattgagttttaaaatcttatctttattaggacttgttgtgttaccccaattccagcttcagaattatgcccttgtttttttgttttttggtttttgagacggagtctcgccctgttgcccaggctggagtgcagtggcgcaatctcggctcactgcaacctccgcctcctgggttcaagcgattctcctgcctcagcctcccaagtagctgggattacagatgcgcgccaccacgcctggcaaattttttgtatctttagtagagacagggttttaccatgttggccaggctagtctcttaactcctgatctcatgatctacccgccttagcctcccaaagtcctgggtttacaggcgtgagccaccgcaccggcccttgagttttgagaggagcaggagtagagggatctcatttcttgacttaccaaacaagaaccagctttctatcttgctagcttctataaggaaagtaaatgtgagagttaggcatatatttgcactatattaaaagctatttggctcttttttcccacctagaattcattgctaactgctggtttttggtatttgctgttctgctgaccctacgtatgtcatacggaaagctgggctttctttgggttctgaaccccaagattacacccaccatcactattgtctttgtttttcccagcatattgccaattatatctctgggatccagactatcggacatagggtaattgtatctgatgtccaagaaagtttcatctgggttcgctacaagcgtaatgaaaaccagcttatcatctttgctgatgatacctacccccgatgggtcactacagccagcctcctggactatgacactgtggctggggcagacaagtttggcaacatatgtgtggtgagttgatgttgttaacttgggttacagtgatgtgtaggaaagctggctcagtttcttgtgggtaaagccaaggaggaatcaaatctgagaagtaaaaatggatataaaattccatcctactaaagctaactctacaagcaatctgttctttaagccttcttactagtcttttggatttttctctgtggtttatctccctcctccctattgaacgtgatttaatgataggtttagtttgagctaatggctaatatttctttttacattttataagaactttggaatgtctgttatctatgttgtgtggttttggttttacccttagctgtgttaaactcttgctcatgggtcgattcttttgagtttcttgctcctcagacacagctcctgcccaccagagcaggtgcaggacacgtgggctcaggcctctgtctaggcagtgcccctgtggctgacttgcaaagacctggccagacctgttgcttggtgactcaggtgagcaggtccgggccccagcagtgtgacttgtgtcacttccttgtaggtgaggctcccacctaacaccaatgatgaagtagatgaggatcctacaggaaacaaagccctgtgggaccgtggcttgctcaatggggcctcccagaaggtaagattgcagaatgggccccagggagaacactgcttagcacttttcctgttgccctcactgaagaaattgcctttggtgaattattcatagtgcacacgactgtgctgagtgctgtccgtccacagtcctttcttaccaatctgcaaaaaatctccttggagagtagcgagtttcttagagagagtccattcccagtcctctgctctgaggtgtgtcctgggctttactttctcctgtaggcatgtgctgctttaatagagcatctctggactttcgggcaaatctattttagaagacaagcctagtgattgctgttttctataattttctttgtgttttccttttttatggcaagcttgataaatttaacaaaatgattcttatcgtaagaaatgatgaacagtaactttagcatgttttatgaggcattaagctttaagtaaatgtgagaattttaaaatatttgtagggtttaataatttttggatttattgtttgtttttgagacaaggtctcactcagtcgcccgggctggagtgtggtggtacaatcacagatcactgcagcttccacctcctgggctcaagtgatccttcccactcagcctcctgagtagctgagactatagtacatgccaccaaacctggcagattttgtgggtatgggtatacgagacctcactgtgttgcccaggctggtcttgaaatcctgggctcaagcaatcctcccacgttggcctctataataatttttggatgttaatagatgatgaaatgtgccttagggagcactgcttgcccttgggagtccagggaggctcctgagggtgcacacagtcactagtctgtttgtgactcacaggcagaggtgatcatgaactaccatgtcggggagacggtgctgtccttgcagaagaccacgctgatccctggaggctcagaatcacttgtctataccaccttgtctggaggaattggcatccttgtgccattcacgtcccatgaggtgagagcgcccacattactctggccttgacttttaaggttgtttcttggtgctggatctacctaagaggtcaaattcatttgtccccacatataattaataatgttctgggaattataaagtgacagaagtacttggggagataggaatcttgattctcccgcacccagggaaggccatttggtttttttttttttttttgcgacggagtctcactgttacccgggctggagtgcagtggcgcaatctcagctcattgcaaactccacctcccaggttcacgccattctcctgcctcagcctcccaagtagctgggaatacaggcgcccgccaccatgcccggctaattttttgtatttttaatagagatggggtttcaccgtgttagccagggtggtctcgatctcttgaccttgtgatccgcctgcctcagcctcccaaagtgctgggattacaggcgtgagccacccgcgcccggccaggccgtttgtttttatagtgtcccagggtttgcttcagtctgatgcgagtttacaaggttagcctgagcccagagctttagaactggactccacagactaggattgccaggattgatgggatgatccctcctggggcacacactgccatatggaatcaactctaggtttgccagagtttggcatgttttattccagccaaggaagctgggatcaggaatctgacctcacaaaccattctttatgtgtggcattctctcttgcactgcagacaacatgtggtctccttttggggtttaactatcgtgttgtagcagaaaaacctgtgattatcagaaagtgattagatatttcccgtgtgtttgtgtagtaaaaatgaatggcttgtctgttcgttgtgcttgtggaaactctagactagttgaaatcacttctcagtgacagattttttgtttcttctgccaggaccatgacttcttccagcatgtggaaatgcacctgcggtctgaacatccccctctctgtgggcgggaccacctcagctttcgctcctactacttccctgtgaaggtaggttgggggaatctgagctgaaaagggagatctgagaaaggagcagcacagggagtggattgatgggaatagtaccagggagggtgctcccctcagggcagaccacagccagagcaaaggcttcacctgcttctgccaatctgaactctgagtaccaagagtcaacttaagatagtgttcctggatctacaagtggggttcaagtatcgagtggagaataaaaagttttcccggtctgggcgtggtggcacacatttgtggtcccagccaatcgggaggctgagccccagattttgagagtgcagtgagctaagattatcccactgcactgcaacccggatgatagggtgagaccctgtctcaaaaactaaaaaataaaaacagctttccctacaagtgctgctttagcatgtgccattttctttgggcatctcaccattttttttctttctgctttctccatatcttagaatgtgattgatggagacctctgtgagcagttcaattccatggaacccaacaaacaaaagaacgtctctgaagaactggaccgaaccccacccgaagtgtccaagaaactcgaggatatccggacccgctacgccttctgagccctcctttcccggtggggcttgccagagactgtgtgttttgtttcccccaccaccatcactgccacctggcttctgccatgtggcaggagggtgactggataattaagactgcattatgaaagtcaacagctctttcccctcagctcttctcctggaatgactggcttcccctcaaattggcactgagatttgctacacttctccccacctggtacatgatacatgaccccaggttccagtgtagaacctgagtcccccattccccaaagccatccctgcattgatatgtcttgactctcctgtctacttttgcacacacccttaatttttaattggttttcttgtaaatacagttttgtacaatgttatctctgtgggaggaaggaggcaggctgtggtgggactgggtagggtatagtatcactcctgagttccactgctctagaatctaaccagaaatagaaacctagtttttaaggtgactggcatccatgtgtcttgttctggagatgaggatgtaggtgggaggtttgaacccaagttagagcaggaagaactgagtagactccttccttccagataccgacttggacttgcggcactctgtggctccccacccccaggtctgtggtggtttctttgttttttcctggttctttttgctgtgctgatgaaacatgacctcaataaccatgtgtatacccacccctcttcccactgggtattgaggaagggtggctgattcttcctcctcttctactctgaggatgttagtatggggattttagcatgaattctagctggggagtcttaacagatgccccttttactgatacagcacctaaagcgatctttggctccataggaccataggaagggtcagtacagaagaacctagatactgccctgcccctgagaactgtgtatatgtggggcctgtctgcagcacccatctcaggtgggttccagagggcctttagggtataatgagagcctgttaggtggaagaggcccagttccagaaatgttccagcccacccctgagaattcctcctgtttagttgtgtgggaagccctcgtcttccaggctgtccttgcgccttgaacctggagaagtgagctcactgttctcaatacttcacaaatgtaaaactttctttcgtctgcatgtgctcagccatctaaattgagcaaatgatctggtgagcactgggttagaatcaggaatggtggaatacaatctgaacctctcagagcccagaacagagggttcctgacactgtgacactgtctcctggaactaagtatctcttgaatcatgacttggttttagatcagtcaagagagacccaggttttgccaggaatcgaatccctaaataacatgtttttttctcacttagctcatgaatttgcatagtagacagtagttctgaattagattttgaaaacctaatttcagggctcattttttcctgtggccctaaatccattctatcaaattgtgtgatactgacatgcagtcatctgaggaactcagcgtagatacttgagcagctcctcgcctcttttctaactcaagtttgactaaaatacatacactccgtacagaaggtagggggttatgtaagaaaggaaaacctaatctatggaatcaggagttgtcaccaccgagcttcctctggaagtctgcccatcagcttgcttgttctctgttaagaggaagggctaggacaaggatttgggcttgaatatgtggaaaggaattttcatagttgttgctgcaggacctacaaaagtttaaaattagattggatgtgactcaatgacaagtcccatctgtgtaattgttaaggggacctgattgactcctgtggtttgattgagcaaccaggtaaatagagacctctctccagctttggcaaaacccatcagaggctgctgcagaactcagacagagggatctgcccttgggtttgcttccatcctgttccattgctaagcccttgtgacttggatcctaggactgaaaagtttttagctgcctcagctttcccctgaccttactggcagaggttctgcagatgtttcctttggaagatctcttgccaagaatagcattcctttggaggaggggggttctagttggaatgttgcttttcttggttagtgtaaatgtattgctagtgagacagctgccggcgctggaaaaggctcgtctcacagggagagtgctggtccccagaatgtgtgctgttcccacgctgctgcctttcttgagcttgttagaggaaagccagaaaggcattcagatgggatcagtctggctttcaaattttttttaattcctaagttctgttttattttttaattttttaaaaaaaattttattagagacagtctctctctcttgcctagctgggagtgcagtggagtgatcatagctcactgaggcttgaactcctgggctcgagcaatccacctcagcctccagagtaggggagactacagatgtgtgccaccatactcagctaatttttaaacttttgtagagacagggtctccctgtgttgcccaggctggcctcgaactcctgacctcaaaaaatcttcctgccttggcctcccaaagcactgggattataggtgtgagccattgcgcctggtcataaattcttgtttttttgtttgtttgtttattagagatggaatctctctctcttgaccaggctagagggctgtggtgcgatctcagcccactgcaacctctatctcctgagctcaagcgatcctccttagcttcccaaatagctggaactacaggcatgtgccatcacgtccagctaatttttgtatttttagtagagaaggttttaccatgttggacagggtggtctcgaactcctggcctaaagtggtccacctagctcagcctaccaaagtgctgtgattacaggcgtgagccaccatgcccagcctctaaattctgttttctattcaaagtaaaaatgacatgtgtttgagtcatccacttgctcatttgcatatggaatattgtatgtgaatattttattacacccttaaaattaattttcaagggctatatgtagagctcagaagaaacatctctgctgctgaaatcaaacctggtccaaaaaacgtcacaacggaggaaaggaatagatggctctcgaggacaagatagggactcttaaaacacctgcttggccatggttgattgacatttgagtgatctggtagcccaacacaccctgtgaagttcaggtgaactgaaatgggcaggtgtaggctacacaccagtctgaaccagcacaaccaagagttgtttctcttttttttctttttctttttcttttttttcttttttttttttttttttttgagatgaagtcttactctgttgcccaggctagagtacagaggcacaatctcggctcaccacagcctccgcctcctgggttcaagcaattctcctgcctcagcctcccaagtagctgggactacaggcatgcaccaccatgcctggctaatttttgtatttttagtagagatggggtttcaccatgttggccaggctggtttcgaactcgtgacctcaggtgatccacccaccttggtctcccaaagcgctgggattacaggcgtgagccactgcacttggccaggagctgtttaagccatcaggagacatgctgacccactagaagaggctgctacgctcatttcttccacaaacgtttactgggcacctaccatgaaccaccacctcccagctctgttctgcacccagaggttggaggagagtttataaccaggcagtctctgtcgctgtgaggttggtggtgaggtgagtctgccagagggcctgccaccagtttcagaagagcctgcagcctgcatctgatttcctcagccacaaccttgggacttcaggaaaaatcagaaggtcccaagtctgaaaaatgaagaggtggggagtgggcagcaggggttttaggtcaggaaatggtaggaaacctgtagttgtggctcataatcctagtgggatattagaaccctcttcatttgtcagaacagattcctggggtctgctcccaattattcacacggtggttcatgcctggtaatcccagcactttgggcggccagaggcaggcagattgcttgagcccagaagtttaagaccagcctaggaaacagaccccatctctacaaaaaattcaaaaagccgggcgtgaagccctgtttttttttttttaaaaaaagagtctgctggtgatgtctgggcatgtgtctgcttcacagtccagtgttatgatcagtagctgtgatggacaatgaacattgctgcttgttcaaaatgaagaaaaaaaatatcaaagaaaaccaggtttggaagtttcagatttggaaaaggagctgggccagcccatctggaatagctgaggggccctgttagccccaccctaccccaccccacccccgtatgcagcatctctggcggtgcccagaggcaagcccccttcagtttcccacctctcactctgccttccagagcctagtcaagttttaaattcccaggtccactcagcagaacttgctcccttctctgactgcagtctcataatgaaaggagaggtgctttcagttgggtcatttggtagcgtttaggcttagaagttactaatttggagccgtgagtatatgtgtataagctagtaacacgtgatggtcaagggaagtactaccatttcctgtgggttattagggcctccagctgttatgaggacacactggggaatctcagctttagggagtcgatgatgtaactggagaaaggcaatgctgccctcataaagcaatcagaaacgagattccacctgccaaatgccaagaggcagcaaagtccatgaagagagcactgtatacagtcagatgacctgggctcactagcctctaagcatagtcttggtttcctgcctgtaaattggtagaataagactgatttactgggcctggcatggtggctcacacctgtaatcccagcactttgagaggctgaggcaggaggatcccttgagcccaggagtttgagaccagcctgggcaacatgacaaaaccccatctctccaaaaatacaaaaattagccaggcatggtggtgcacacttgtagtcccagtaattagggggctgagacaggaggatcacttcagcctatgagtttgaggctgcagtgagctgtgattgcgccactacactccagcctggatgacaggacgaaacctgtctcaaaaacaccaaaaaacaaaaaccggtctcctggggtcatggtagcacaaacgcacatgactgagtgctcaggggttctgaggcttgtccgctgacctggggctctggccctgggagatctgggggacctgctgtcctatatgtgatgctttgaaagaaaggggcatcattccaagccaagaggccccagagagggcaccgtgcggtgttcaggcttctgtgaggccccagtgagatcctgtggctgtgcccccatcacctccacccactctgccctcccactagctgcccaacggatgaatcaacgccttggcagagttttccagcagggccttgcagagagtgtgtgtgacctgtgtggccactgccttggggacgggtgaggagttagcctggaacattccagcgtgggcattattgtcctgttgcaagttcagggcaaaaccaggaatccagttttgtcgatccaattgagaaaacatttcatgaacaactacttgtggcatgcattggcactcggaataaagcgcactattgtcactaggttggcatttctttttcttcttttttttgtttttttatttttgagaccgagtctcactctgtcgctcagggtggagtgcagtgatcttggttcactgcaacctctgcctgctgggttcaagcaattctcctgcctcagcctcccgagtagctgggattacaggcgcctgccaccacgcccggctaatttttgtatttttagtagagatggggtttcaccatgttggccaggctggtctcgaactcctgatctcaggtgatccgcctgccttggcctcccaaagtgctgggattacaggcgtgagccaccgcatccagcaaggtcagcactccagactaggttggctgtggaagactgggtgttaataaggggttcctaaatccaggattctgtgctcacattcagtgaaacactacagactcccctcttggatagtttgaggctttgaacacagccgttctcctatcctcccccactggcccatccctaatgaatccaaatgcagtctagtaaaatcaggaagcctgctatgaaaacttgacagagatattgaagatgcccctgcagttgcccactctgacccaggtgaagggagaatggctgtacctttggtgatggtgctgagggaaaggacctcaactcccgtaagtgctgggtctgaggccacgtgttacaccaggacaggtcctgtgtccctcaggaaaacctggctttggggtcagacctcagtaaccagctggggaatcttaggtaagattctctctctctctctctcaatctctctttttttttttttttttctaagaaaagagacagggtcttgctctgtcatccaggctggagtgcagtggcttggtcatagcttagtgcagcctcgacctccagggctcaagtgatcctcctgcctcagcctcccgagtagttataactacaggcatgagctaccatgatgcctggctaatttttaattatttatttatttgcagagatgggggtctttctatgttgcgcaggctggtctctaactcctgggctcaagccccagaaaaggggtgaggaatcttacccaaggccaggcacagtggctcaagcctgaaatcccagcactttgggaggctaaggcaggaggattccttgaggccagcagtttgagaccggcctgggcaacatagggagacgtctgtatctacaaaaaaataaataaataaataaataaataattagctgggtgtagtggtcccagctacttgggaggctgaggtgggaggatcgattgagcccaggaggtcaagaccacagtgggttgtgattgtgccactgctctctagcctgggcaatagagtgagacattgtctagaaaaaaggcaaggcatgccgggtcatgcctgtaatcccagcacttgggaggctgacatgggcggatcacctgaggtcaggagttcaagaccagcctggccaacatggtgaaaccccatctctactaaaaatgcaaaattagctgggcatggtggagcgtgcctgtagtccctgctgtgaaactccgtctcaaaaaataattaaaattaaaaaaaagattattcaccttttggagctcatgtctcttcatctgtagactgggtaactcattggtgctcaacagggatgatgtatcagagaaaggccttttcttccacctaatggacccccagtcccacacacacacacaaacacacacacacactccagtcaccaccacatcactcagttttgtgttttgtttcgtttttttagagacaggatctcgctatattgcccaggctggagcacagtggttattcacaggtgcagttgcagctcactgcagcctcgaactcttggcctcaagagagtctcctgcctcagccccctgaggctcatgtcactacacactacacccaactccccatcacctggcttttagttttatgagacgaagcttttgtctaggccgagtgttctggagaggagctggggtagtcccttagaacagtccaagctgcctgggagccagggcctgggtttgggggacttcttgtagtcaactggctggcgccctcagtcagagcagtcccctggcgggtcctctgggttgaagactccctcctacttcacagtccaaggcaggcgggggccacgtggccctgccccgcccctgctggcttcggttcctgagcagagctgcagtggcctgctttccccgcccttctcatcagacgggaagcctggactgtgggttgggggcagcctcagcctctccaacctggcacccactgcccgtggcccttaggcacctgcttggggtcctggagccccttaaggccaccagcaaatcctaggagaccgagtcttggcacgtgaacaggtaagaaggcagcaggctttctctcctatgcctggctttcctctgcctctgacggcctggcttccccaccccgattctgctgctgcttcactgatcccaggaagagggacctgagctagacttgacaaagacagtcccagccaagatgctctgaagtatgcctcagagaagtatatctcagcagaactgtctgctctgggtttcaatttttaacctttgccttcatcagccttgcaggaaaaagccgatccacataaccataaagcaagtcacttctctgtgtgtgcccttcagagtttagtcaattgacaaacctacattctcaaatggttggcatgggccgtggggcgctgctccactatatattgccgtaggtctttggaccttaatgtactgtgtgtgtggattatcacttgcatgtattactttatcaaaaattaattgacttggccaggcgcagtggctcacgcctgtaatctgtaatcccagcactctgggaggcgagcggatcacttgaggtcaggagtttgagaccagcctggccaacaagatgaaaccctgtctctactaaaaatacaaaagttagccgggtgtggtggtacatgcctgtaatcccagctacttgggaggctgaggcaggagacacacttgaaaccaggaggtggaggttgcagtgagccgagatcacaccactgcactccagcctgggtaacagagtgagactatgtctcaaaaaaaaaaaaaaaattaattgattttaagttctttaaaggaaagaggcaaaaaagtcaacagcataggtaagtctttctcatgcaggtgggatttctgaaattaaaatgaagtgttctgcttttaaactttgcatttttttttttttgagatggagtcttgctgtgtcgaccaggctggagtgcagtggcgtcatctcaggtcactgcatcctctgcctcctgggttcaagcgattctcctgcctcagcctcctgagtagctgggattacaggcacccgctaccacacctggctaatttttgtatttttagtagagacgggctttcaccatgttggccaggctggtctcgagctcctgacctcaagtgatccacccacctcggcctcccaaagtgctgggattacaggcgtgagccaccacgcccggccaactttgcacttacttttaaatgcacataaaccaactaactagatgttgttttaaggtccacgtggtattcaccaagttaacagacccatccctggacgggcagcctctgtccgctgatgaagttgagttgcttctaggtgttttgcaatgaataattcgacttttctggacaactctgtggaaataactttttttttttttttggtatttgaagttattgttttttccccccttttccttggagtgtattctgcatccagaatgaatactctgggccaagggcaagaacatttttgaagctcagctcacggtatgtgtggggtcagctcactcatgagaattacgggactaatttactaatttccagggccatggtggcagaatgggctgggcaggggatttgagatctctgggatttctcaggaaggggacagagacagtctaacgcagtggttaggagcttggctttagaaggctgactagtctgggtttgtatgcagtagctgcctgaccatgaacttccaccacgtaacttcattgtgcctcagttagttcatgtgtaaaatagaggttataaaacttgttaggggccggacatggtggctcatgtctgtaagcctagcactttgggaggctgagatgggtggattgcttgagcctgggatttcgagaccagcctgggaaacatggtgaaaccctgtctctacaaaaacaaaaaacaaaaacaaaaacaaacaaaaactttttagggatgttggaagtcagagatcctgtttgtgaagcatctagcataaggtctggtgcttaacaagcacccctggaggccccctcttccccaagcctggggctttaactagccaggcaaaattgataaggtcaagtacatcttcttggcccagagcctattcttacccagcttcatcgtaactagagtgaaaggcttcattgcctgtttgaggatattttgactaggcctctgtctgtcccaaggatggcaggtggagcatcaggctcaggcctccctctgggggacccccaagctttcatccccctctgttgtcacatctggatgccaccattcttatctgtcagccaccctcctcgacatgcaggtttaagggatccttggacagactggagagtttctggaacatctgtgggttcacctgcccagccccagcccgctgtcaccggggtaggttacgcacatggctcagcagaaggagcgtaggctctggagctggtcgggctggattccggtcctggccacaccactttccacatgtgggcagtgactggacctctccgacccccagtttcctcatttgcagaatggatgtgttaatacctgtggcctagaattacgtgagatcacacagataaagcagttggccccaaggagcccttaccgtggaagtcaaggctgcactccagagccttcaggaaggtactggaattagccataaaggacaggcagaaaatccatgtgttcattttctcagacaacaaacactgattgggttggccagccctggtgctgggaagcagggagagacatgcacaagatgcctctctgctgttgacacaggcacactgccccctgctgcagaagcaggagagacaatggcccagtcagcctgggtgcttgggaaatggctccatgcttaaggatgaggaacaattgattaggcagagattggaaggaagctggcatagcaggcctggaagccgagttgagtttggagaagggagagatgtttgggagacctgcagggctggatgtagggagcggcggagtgggagatgagatgaggggaggtggtagggatacgattttgaagaacttcgaagatcaagtgagaatttggatttgatttcaatgacaaggagttttttgttgttgttgtttgtcttttttgagacggagtcttgctctgtcacccaggctgaagtgcagtgtcccgatttcagctcactgcaaactctgcctcctgggttcaagtgattctcctgcctcagcctcctgagtagctgggattacaggcacgcgccaccatgcctggctaacttttgtatttttagtagagatggggcttctccatgttgcccaggctgctgacctcaacagattcacctgcctcagccttccaaagtgctgggattacaggcatgagccaccgcacctggcaatgatgagatttaagcaggttttgagatgcctgttcttgcggcttcgagggacgaagcgagtgttagcagctgatgttgttggtggcctggtatgcctccagccttcccctgcatctcaggggctctaattgtgctcaaaataaataactgcaaagagaggggttctcaggacaggcctgggtcagggaagcctggcctgggagttggggccctgggtgctgggttctggtcccagccccaccaccagagcatgtagatctttcctcctgcctcagaggaggactctgtcacccaggctggagtgcagtggtgtgatctcggctcactgcaacctctgcctcttggggtcaatgattttcatgcctcagcctccccagtagctggaattacaggtgtgcgccaccacgcctggctaatttttgtatctttagtagagatggggtttcaccatgttggccaggctgatctcaaactcctgatctcaagcgatccacccacctcgacctcccaaagtgctgggattacgagcgtgaaccaccgtgcctggcccagggcaattaggcttcttacagctctttccttccagggttctgtacaatgtttctggaagccacagctccccttcccctgcccccaaggcaatactgtcctgtggccttccctgacccagccgtaggagggagagacatctcgtcccagatgggcagtgtggcactttgaccttgagagagactccatggaagtctgagaactatggcctccaggtgtgggacgatcctagggtggttctgggctccagctgtcatgcatgcttgcgtgtgagggccacgtctcataagtaaggggcagtgtcccctgggaactgggctgcaactggcctgggaacctgcttcctgagcttcccaggggctgcctggacagctccgtctgtgcatcccagcacgcctggaaaacagccaggctttccccttggcatcctttccatactgggggatgtggatgggtcgagacttgcctatagctagaaaggttcaggtcaaaatgatgaattggaaaggccaaagacttccaatgtggacttcccagcagccactgggaaaagtcagcgctctgctgcagagctttctggggtgctcatgcctttcccagcatgagaaagtccacactctggccaggactccaccaccaagtcccagctgccctttggctttgtcacccaggcatcttctcaattattcccttgcctctttcccaagagccagcactttgctgtttccttgtcttcctgctttctctctctctctctttttttttttgagatggagccttggtctgtcagcgaagctagagtccagtggcatgatcctggctcactgcaacctctgcctctttggttcaagcgattctcctgcctcagcctctggagtggctgggattacaggctcctgccaccacgcccggctaatttttgtatttttagtagagacagggtttcaccatgttggccaggctggtcttgaactcctgacctcaggcaatctgcccgctttggtgtctcaaagtgctgggattacaggtgtgagccactgtgcccggccatcttaattatttttaaggttaagaaaatccacgttgtaccacagatctccagaacttttttcatcttgccaaacagaaactctctattaaatgactccccaaactccccatttccctacccccaacctctgggcaccacctttcagatgtctgtctctatgagtttcactgctgtaagtgcctcatgtaagtggaatcataatcatacaatatttgtctttttatgactggctcatttcacttagcataatgtcctcaaggagtcttgctctgtcatccaggcttgagtgcagtggcacaaacatggttcactgcaggctcaagcgatcctcccgcctcagcctctcaggttgctgagaccacaggcaagtgctaccatacctggccaattaaaaaataatttttttgaggctgggcgcggtggctcacgcctgtaatcccagcactttgggaggccgaggcagatggattacgaggagattgagaccatcctggccaacatgatgaaaccttgtctctactaaaaatacaaaattagccaggcctggtggtgcgcacctgtagtcccagctactcaggaggctgaggcaggaaaattgcttgaatccgggaggcagatgttgcagtgagctgagattgtgccactcactgtactccagcctaggtgacagagggagactctgtcttaaaaaaaaaaaaatttttttttttttagagacagggtctccctatgttgcacaggctcgtcttgaactcctgggcttaagcagtcctcccacttcagcctcccaaagtgctgggattacaggcgtgagccactgcatccagcctccttgttttttttttttttgagaccgagtctcactctgtcacccaggctggagtgcagtggcgcaatctcggctcactgcaagctccgcctcccaggttcacgccattctcctgcctcagcctcccaagtagctgggactacaggcgcccaccaccatgcccggctaatttttgtatttttagtagagacagtgttttaccatgttagccaggatggtctcgatctcctgacttcgtgatctgcctgctttggcctcccaaagtgctgggattacaggcatgagccaccgcccccagccctggcctccttgtttttaagactgaatgaaaccctattgtatgtatatacaccatattttgtttatctatttacctgtcaacagatacttgggttgcttccatctcttagctattgcgaataacgcttctacaaacatgggtgtacaaaaatcccttcaaggcctggcctggtggctcacatctgtaatccagcactttgggaagccaagacggatcacttgagtccaggagttggagatcagcctgggcaacatggaaagacttcgtctatacaaaagataactggtggtgtgtgtgcctgtagttccagctacttgggaggctgaggtgggaggattgcttgagccctggaggttgaggctgcagtgagctgtgttcgcgccactgcactccagcctgggtgacagagcaagacccagcctcaaaccaaaccaaacaaaaacaaatgtgttaccactcagaggagccttagtcctaaggctctgccaacccctcccgtggtgaggggcagagtggcgtggggtagatgtggggtagagagaaatggcaggcaccgtcctggacctgtcctccagcctggcattgcacatctgctgctcactgaacgctcacagctccttgcaaggtgcaactgagtctcccccattttacagatgaagaaatcgaggtacagggaagtctcccagcttgcccacggtcacgcaggcgggaggtggcagtgatgagatgtgaccccagatgggctgtgccctgattcacctgtggcggccacctggtttggtcaccttgctggagggccccctgctttcctgcaagataatccaagatgttgcgggctcatttgggggctgccgagctagccctggggccctgctcctgcctgcgtgagatggaggcccctcccagaatgctagctagtgtcagggtcaagtaggtcagggggatccaggggctggggttagtcttgcaactctcaggggtggtctcctttggagtcactgcctcctccctagccaggccctgggtggagatcaatgctggaggccctagggtggccactgagccaccctagtgacacagcgaggatttgtggggatgggggctgctgagagcaccacacagccgcagacagcgctgagttttgcttttttttttgagacagagtctcactctgttgcccaggctggagtgcagtggcacaatctgagctcactgcaagctccgcctcccgggttcacgccattctcctgcctcagcctcccgagtagctgggactacagacgcccgccaccacgcccagctaattttttatatttttttagtagagacggggtttcaccgttttagccaggatgatcttgatcttctgacctcatgatccgcccgcctcggcgtcccaaagggctgggattacaggtgtgagccaccgcgccccgctgacagtgctgagtttgaatcccagctctgccacctgccgcctataggaccttggcagagtcaccatgcctctccagtcctactttcctaagcttaaaatggggaaaaatacacaatctgcctacaatacactaccccacacccttcaggatggctgctatcaaaaaaaaaaagaaagaaagaaaatagccgggcgcagcggctcatgcctgtaatctcagcactttgggaggccgaggcgagcagatcacttgaggccaagagtttgagaccagcctggcaaacagggtgagatcctggctccactaaaaatacaaaaattagcgggctgtggtggcacacgcctgtagtcccagttactcaggaggctgaggaatgagaatcacttgaacccaggaggcggaggtctcagtgagcagaggtcgcgccactgcactctagcctgggtgacagagtgagaccctgtctcagaaacaaacagaaaacaatatgtgttggtgggatgtggaggaactggcaccttgagcacagttggtggggatgttaactggtgcagctgctgtggaaactagtttaactggtgcagctgctgtggaaactagtttagtggttcctgaaaaaattaacaagtagaggccgggtgcggtggctcatgcgtgtaatcccagcactttgggaggctgaggtgggtggatcacctgaaggtcaggagttcaagacccaagaccagcctggccaacatggcaaaaccccatatctactaaaaatacaaaaattagccaggcgtggtggcacatgtctgtaatcccagttactcgggaggctgaggcaggagaatcacttgaacctgggaggtggaggttgcattgagctgagatcacgccatttcactccaagcctgggcaacaagagtgaaacttcatttcaaaaaaaaaaaacattaaaaatagaatcaccatacaatccagcaatcccacttctggatatataccaaaaagaactaaaagcagagtctcaaagagatatttgcccacccatgttcatagcagcatcaatcgtagctaaaaggtaaaagcaattcaagtgttcatcaacagatgaatggaaaaacaaaatgtgccgtaaatatacacaatgtggtatgattcagccttacaaaggaagggaattctgacacatgctacaacgtgaatgaactttgaggaaatcaagtgaaattagccaggcacaaaagataaatactgtatgattctacttatgtaacggagccagagtagccaggttcatagaaacagaaagtacaatgtttctatggtggttgccaggggctgggggtggggaaggaggaatggatataaagttttggttttataagatgaaaagttctggaaatggatggtggtgatggtaacacaataatataaatgtatttaatgccactgggaaaaaaatgctagctgagagcggtggcaaaaatgctagctgagcgtggtggcgggcaccagtaatcccagctactcaggaggctgaggcaggagaatcgcttgaacccgggaggtggaggttgcagtgagccaaggtcacgccattgcactccagtctggggaacatagtgagactctgtcacacacacaaaaaataataataagaaaagaaaaaaatggttaaaatggttaatttttttttaacttttgttttagattcgggggtacatgtgcaggtttgttacacaggcaaactcatgggggtttgttgtatttcatcacccaggaattaagcccagtacccaatagttatcttttctgttcctctccctcctcccaccctccaccttcagatagaccccagtgtctgttgtcccctctatgtgtccctgagttctcatcatttagctcccacttataagtgagaaagtgcagtatttggttttctgctctgtgctactttgctgaggataatggcctccagctccatccatgttcccataaaagacatgatctcattcttttttatagatgtggtacatttcaccttatgtgtttttttaccatgatttttttttttttttttgagacagagttttgctcttgttacccagggtggagtccagtggtatgacctcagttcaccgcaacttcagcctcctgggttcaagtgattctcttgcctcagcctcccaagtagctgggattacaggtgcccgccaccacgcccagctattttttgtatttttagtagagatggggtttcaccatgttggccaggctggtcttgaactcctgacctcaaatgatccgcctgcctcggcctcccagagtgttgggattacaggcgtgagccactgcacccggccttaccatgatttttaaaaacaaacgaaaaaatagtagatcctttacagggttcgtgaggacaggatgaggcaacgcatgtgaactgtgttattagcctcaggtctgtgggaatacaaggctttctgccttcggggaggtgttgctggagagatggacagacccacccaggggaggggcgtctgtgtccctgtggaagtcattactccattcagcagaagctgctcacggcgggagagggctggggttcagggaatccttcctggagccgtgatggggccctgcttgggggattcctagcatgtgtgggatgggcagattccagacattggaaagtccctggcagaaaaatcactcccactaaggggcagttgtagggaagagatttgggctcacgctagagaactcatgatcagagatgtctgcatgaggaacagaggctgctttgtggattggggagctccccattagcggaggcaggtaaggaggtgcctgtgcgaggtgggggtggagccaaggctgtgtacctccgacgctgtgcacctctctgatgggacccagtccagacaaaaattgtatataacaaacccttgtaaaggtggtgctcgggtcagagggagggggcagccgggtgggaaggcttgtcccaggtctagcccaatagtgcggaagtagctggtgctgttttcactgggccaggtgctgtgttaagctgaacaggcttgatctcaaatcctcaccatagccctgtgcggtaggggctgtcaacacctgggaaccaaggctcagaggttaagtcacctgcccaaggttagccagcagctggcgttgctgggattcgaacccaggcagtccggcttgagccctccatcctgggtggaagtctcccaaacccgtccccccgcaagctggcctctccctgcccccgcccctggcagtcagttcctggggtcaggggtgccctgccacccccacagtacagatgtagctgctgtgccctccccgtcgtcagtgcgctgcccctccctctggctgccttcacactgtcagcgctggctgctctgtgcagtcagacccggccccggccccagcctgctcgggtctccggggtctcaggacagcactgtggggaccatgccaagcgagactgggagagccaggctccgtgtcactcagtgccttccttctcctgccattcaacgagacactcctaataactctcttgcaggcctctaagtctgtcccatagctgttgagctgattttgccttttgtgcaactgtgttttccaactcagctctctgggtgccaagaccttgtccacatgattcaatctgtccaactccaacctggcccctgataggccataaataccattcctgatggcagtgatccagtgccctcctttgtccccagagctgaggcaggatgaccaccacgcttatagctaggacagagggtgactctggcagggacagcagtttatccagaatgacccagttagccgggcgtggtggcacgtacctgtagtcccagctactcaggaggctgaggtgggaggatcgcatgaacccaggaggtcgaggcttcagttagccatgatcacaccattgtactccagcctgagtagtggagtgagatcctgtctcttaaaaaaaaaaaaaaaaaaagaatggccctcaccgtcctcccaccctgcccctgttagcttgcctggcagtcaccttgtatggaggcacagggagctgtcatttacctctgtgccaggcagggtgctcagccctatacaggcaccatctccccggattcttacagggcccagctggtgacgtgcagctgatattcccatactgcagatgaggaaactgaggatcagagaggttaagtcatgcctaggagcctggcttctcccttccccctgctgttgccctgaggctcggtgctggggctgggctggggccaggctggggccaacggcagtggtgtttgtgctccttgctgcttggaggagcaaagtgcatttgatctttctcttctcaccactgtcctgggtgggggccctggtagtactaggtagtgatgaagaagctgcttagggtctcctccagggttccacagtgggaaggggcatgggggcggcggggaggtggtggtccttctactccccccaccacctgctccaggttcattcttgtctctaccatactgggtcactccatagccctcctcctggcttcccaggccccactaaagccatacaatgcataaaggccagcagacctgctggcccggctgaggctgggctggggccaggcactttccagtgtcttgtcacaggcaggaaacctttgttggatgatgtcactggagcgggtgcctcctgttctactcgccctcgttcttctccccagtgcaccccaccctgaccgcctcctgaggtgtaatagaaggcccctcctctctctgcccatgagaatcaggtagcaacataacttttgactctcatgctgctgtgggttctgggacccttaacccaaccctggaaggtgtggctgtaatccccagaggaggaagcttggcaggctcagggttctgagacttgaatcctgggctgtctgcctgcaaagcctataccagttgctgaataattattttaaaaatagcttttaaacttccttaaaaaaaatcagtagacttttacaaagcagttttatttatttatttattggtttattttttctttttctttttttgagatggagtctcactctgtcgtccaggctggagtacagtggcgcgatctgggctcactgcagcctctgcctcctgggtgcaagcgattctcctgcctcagcctcctgagtagctgggattacaggcacatgccaccatgcccagctaatttttgtatttttagtagagacggggtttcagcatgttggtcaggctggtcttgaactcctgacttaatgatctgcccgcctcggcctcccaaagtactgggattacaggcgtgagccaccgtgccggccctattttttaaatttttcttaaaaacacagttttattctttttctttttttaataaatagagacggggtttcaccatattggccaggctggtctcgaactgctggcctcaggcgatcctcctgtgtcagccccctaaagtgctgggattacaggcatgagctactgcgcctggccctattgtccattttttaactgggttgtttgttttcttattgttgagttttaagagttctttgtatattttagatacaaggtctttatcaatatgtcttttgcaaatattttatcatttttcctagcaatagtgtcttttgcagagcagaagcttttaattttaataaagtctaatgtcaattttttatttcaaggatcgtgcttttgatatatagaaaaacatcaccaaacccaagatcagctagattttcttcctatgttatcttctagaagttttatagttttgcattttatgtttaggttcaagtttcattttgaataaatttttgtgaaaggtctaaggtctaaggtcagaccttagaatcaagatttcttagtacctagtttgttgttgttgttgttattttttgagacaggatctcactctgttgtcaaggctggagtgcagtggcatgattgtggctcatagcagtcttgaactctgggctcaagtgatcctcccacctcagcctcccgagtagctgggactacaggtgcatgccaccatgctgggctattttttttgtattttttctttttttgtggtgatggggtcttgctgtgttgcccagcctgatctcagactcctgccctcaagcaatcctcctgctttagcttcttggagcactaggatcagaggtgtgagctagtgtacctggcaatatctagatttttttcttgcaggtggatgatcaatcattccagcaccatttgttggaaagactatcctttttccattgaattgcctttgctcctttgtcaaagatcagttgactatatttgtgtgagtctattcttggttccctattgttccactgatctatttgtctgttctttcaccaataccacactatcttgattgctatagctttaagtaagtcttgaagtcagggagtgtcagttctctaattccattcttcttttttgtgttgtccttctaggtcttttgctactctgtgtaaactttagaatcaacttgtagatattacaaaataactttctgggatttttattgtgttgcattgaatctacaaagttggggagaacaaccatcttaacaatattgaatcatcctatccatgaacatggaatatctctccatttatttagatctttgctttctttcatcagggttgtatagtactcctcatacagatcttgtacatattttgttagatttatagtgaagaattttatttttagggtgctaatataaatggcattgtgctttcaatttcaaataggtaatatgtgcatacagtaaaaacattcaatagagagagattggtttatagtgaaaagtggcttcctctacttctcattccctaggcctccattcatctatccaaagacagttactgatgcctggttcttatgggtccttccaaagattgtatgtgtatattcaagctctaatctaattcaagctcaatatctaatcctcacaagaattctgcctggcaggtcttattatctctgagggagggtcaagggcccaaagaggactttctggggaggactctcttcctcttcaagagctcaagcagaacacactggtcctgccaagatctaggggcagggctgctactgctcaaggccagaggaaacaggttttggaagggagggcttcttgccaagccagtgggtacagatgaggaggaggtgaggaggaggctttgggaggctgccagtctactctgggcagattcatatcaaatattctaggccttgggaaaccctcatatttccaggtggctgcatttcaatttatctctctctctctctctctctttttttttttttttctgagacagagtctccctctgtcgcccaggctggagtgcagtggtgcgatctcggctcactgcaacctctgcctccagggttcaagcaattctcctgcctcaggctcccaagtagctggggtaacaggcgcccgccaccacacccaactaattttttttctggtatttttagtagagatggggttttgccatgttggccaggctggtctggaactcctgacctcaggtgatccgcccacctcggcctcccaaagtgctgggattacaggtgtgagccaccgtgcctggcctgcatttcaatttcttagttctgtttcctctctagttttcttctccttcttctttctcctctaattccttctccttctttttcttcttctgagacaggatctcactctgtcaccctggctggagtacatgactcactgcagccttgacctcctaggttcaattaatcctcctgcctcagcctctcgtgtagctggaccacaggtgtgcaccactgtgccctgctaatttttatttttaatagtgatgggttctcactttgtttcccaggctggtcttgaactcctggactcatgtgatcctcccacttcaacctcccacagtgctgggattacagacatgagccactgcgccagggctcctctctcattttgtaggaacattcttctggggagtagtctaaccttgtttggctgacctcaggagaaatgggatttgtcttagtctgtttgggctgccataagaaaatccggctgggcgtggtggctcatgcctgtaatcccagcactttgggaggccgagacagatggattacttgaggtcaagagttcgagaccagctgggccaacatggtgaaaccccatttctactaaaaataaaaaattagctgggcgtggtggtgtgcacctgtagtctcagctactcaggaggctgagacaggagaattgctggaacttgggaggcagaggttgtagtgagctgagattgtgccactgcactccagcatgggcgacacagcgagaccccgtctcaaaaaaaaaaaaaaagaaagttgtatagactgggaggcttgtaaacaacagaagtgtattgttctagagcctgggaagaccaagatcaaggcgctgacagatttggtgtctggtgtgggcccttgtcctaggcggctgtcttttccctgtagcctcagaggcaggaggggtgagggatctctctggggtctcttttataagggcactaaatccattcaaaaggcccaccatcacgacctcatcatcttccaaagacttcaccttctaataccttcaccttgaggtgatgaattttgggggagacacagatattcagaccatagcagcatttatttatgccaagactaagactgcccggaaaggtggctagggcatctccagaggcacaaagaggaccgtggtcatgacaggctgtgatatggagccagggagcgtgagttgctgcaaagcaggcatctgagtggcagatctgggccaaatcaacttctccccacgtcttcctcccaggctggaggtgactgtcttccacatggcgttgggcacactggcatcccatttcccaccactgcctcagaaactggagcccctgaagccacgcatatgcctctctgtacccgtcccccacaccctgccaaaaatatttgtgcccagttgcagtgggggtagagcgactattgcctgtgtgtgtcatgcttatagtaatggtagcttaccactgactgcaaatttcattccctctttattaaaaaaattggttttttgtagagacaaggtctggctatgttgcccatgctggtctcaaacttctggtctcaagtgatttcccttggcctcccaaagtgctgggattacaggcatgagccaccgcgaccagcctcatttccattttacagaggaggatgggactctgaagccagacctgtacttgtacccataatactccattgcctccacagggtcccagcacccagggtataggcacgctcagtagaggccgtccccagctcaacctgtttgtatgtggatcacttgagcagctcaggtgggtgcctgctgcttaaccctcctagtgaactgagccccttctcctccgttgtgctctggggtagttcccaagtgacactgctttgggccattactgacttccttatttcctaggggcccatctcctaaagtgaagttaccccctcacagagttcagccagttttttagctttttttttttttggagacagtgtcttgctctgttgtccaggctgtagtccagtggcacgatcatggctccctgtagccttgagctcctgggcttaagcgatactcctgcctcagcctcccatgtagctgggaccactggcacatgccaccatgcctggccaagtattaattttttcgtagagatggggtctctccatgttgcccaggctgttatcgaactcctgggctcaagtgatccttctgccttggtctcccaaagtgctagggttaaaagtgctggggttataagtgtgagccactgcctctagcccagttttttagttcttgttacaaattgccaagtaaggactaatccagaaagactggagtattttgtcaatgaacatgtttcaaacatatgtatctcttacaaaatgcagctgtttaattcctaaaggcagaatgtgttttcttacatgatgatgtacactctatacaaatgtaagcagtgtgttttttagcccctgcatctattaaatggtatccattttgttgtcaaggagctgattctttatatagctgtccctctccagaataggccaggaaatgcctgggtggcccaggccctggagatgcagttctttttttttgagatggagttttgctcttgtcgtccaggctggagtgcaatggcgcgatcttggctcactgtaacctctgcctcctgagttcaagctattctcctgcctcagccctccaagtagctggtagctgggactacaggtgcccgccaccatgtctagctaattttttatatttttagtagagacggggtttcgccatgttggccaggctgatctcaaactcctgacctcaggtgatctgccctcttcagcctcccaaagtgctggtattacaggcataaggcaccgcgcctggttgaagggacagttccttaaagggtctgagatgcttctccatcttggcatggctcaaaccgtctgccccccagaacttcctgccaggcccttccaggcacaccatcctccattagcgacctcttagaggtcaccttcctatatcacaggacttgagggaatggttggtgtcctggcctctagcttttgcctccagttcaccttgcatattagtatttcataaagtaatgttttcctcaggccgcgcccctgctcaagaacctgcactgctcctggtgcttctgtcaactaaagaaaaaaaaaatcaatcttttggctgggcgcagtggctcacacctgtaatcccagcactttgggaggccaaggctggcggatcacctgaggtcaagagtttgagaccagcctggccaacatggtgaaaccccgactctattaaaaatacaaaaattagccaggcatggtggcgcatacctataatcccagctacttgggaggctgatgtaggagaatcgcttgaacccaggacacggaggctccagtgagccgagattgcaccactgcactccagcctgggcgacagagtgaaactctgtccataaaattaaaaaaagaaatcattcttttaaagaatgaaaattagttttattcagaagttttactgaggacgatagacggatgcctgcagtccaggagcagttctgtcagactgctctaaggcagtgtttcagctcatagctcaagcataggcagtgggggttcagaaggtgcaaaatcacatcaggcctgctcagaagttacattaaagtagaatcacatcaaggttgagtgtaagagtccatccggttatagattagaggcattatcactaaccttgtaagatgttatctcatgttcagcaaaaggcaaggctagggtcatgcatgttttaaggaatatactgactcaggcaagagatggtgggggtcaagtgctctatcctgttttgtcttcaagcatctttctggagagccgcacgttgtcagagagccaaggggctttgtgaaattctgctggcaagcagaaatgagcaaataggccttcttaggtttattactttgtcttatacctgttatgtcaagaactgtttctttctttctttctttctttctttcttctttctttccttctttctttcttttctttctttctctctttctttctctctttctttctctctttctctttctttctttcttctttctctctctctttctttctttaacaaattctcatggtgagatctaggctcactgcaacctttgcctcccgggttcaagcgattctcctgcctcatcctccaaagtagctgtgactacaggcgtgtgccaacacgcccagttaatttttgtattttttttttttttttagtagagacggggtttcgccatgttggccaggttggtctcaggtctcgaactcctgaccttcaggtgatcgcccgcctcggcagtccaaagtgtgctgggattacaggaatgaaccactgcacccggtctttttttttttttttggagacagggtcttgctttgtcgcccaggatagagtatagtggtgtgatcacagcttactgaagcttcgacctcctggccccaagcaatcctcctactttagcctcccaagaagctagaaccataagcacacactactacacctggccaggtttttaatttttaattttgtagagatggggtctccctatgttgcccaggctggtctcaagttcctgggctcaagtgatgctcccacctcggcttctcaaagtgctgggattacaggtatgagtcatggcacctgaccctgcttggcttccaagtccctctgtagtctggccttgtcctggctgtccaatgtagagtcccctgacaccctgacacggcttctctgtcccagacaaacccaactttctccttgatgtcctgagtgtctgctatgtgagcttcatctccattctttgttcactttatccccacttctctcttcacatgtcttctctcgttcctattttccacccttcagcctctagtgtaagtctctacccctctctaccccctgccacaaagcctgcttgaccaccttggtcaactctaatccatcccttctccaatcacctctttcatttattgtccacaccacagagattagccttgaactgttttgtagatgttctctggattggccttgaagatcatcaactaccctatgatttccataaaggcagagaactgaatcccatgtctaggatggtgctaggcacatggcacctgcttaccaaacattgacagaacacagcgctgcacatggaactattctgtaagccccaagcaagacatgaaatgcacagtggggctcttagtcttaccacattctactaattctaacttccccctatcttagcatcccctctgaaattaggatcaatggtgtatcataatttaattggcagtttccccacatctttctcaatggtgcataaaataatgtgcattttacaatcagtcgtgcattaggcttgacgaaatgaggtgtaactggttgatatgacaatatgttggtagctgtttctggcttggacgtggaaaaaagtatttgggagaaacagggaatgctgggagagatggggatgctgggagaaatgaggagatgctaggagaagcaggggatgcgggagaaatgaggggatgctaggagaagtaggggatgctgggagaagtaggagatgctgggagaaatgagaagatgctggcagaagcagggctgctgggaggagtaggggatgctgggagaagtaggggatgctgggagaagtaggggatgctaagagacgtgggagatgctgggagaagtaggggatgaggggagaagtaggggatgctgggagaagtgagggatactgacagagatggagaatactgggagagataaggaatgctgagagaagtgggggagtgctgggaaaggaggtgagggtgccctactgggcccagagtttctgaatcactctgcatggattcagcattcctcctctccattctcctgtcctctgtgcatgtgctgcctcagagactgactctttatttatttatttaaaaataataaaaaaaaattgtagagacagggtcttgctatgtttcacaggctgttcttgaactcctggcctcaagggatcctcccacctcggccttccaaagtgctgggattacaggtgtgccccaccaagcctagcctgattccttctttttctttttttgagacaaagtcttgctctgttgcccaggctggagttcagtggcacaatctcagctcagtacaacctctgcctcctgggctcaaacaattctcccacctcagcctcatgaatagctggtaccaccctgcccggctatttttttgtatgtttagtagagacggggttttgccatgttgcccaggctggtcttgaactcctgacctcaagtgatttgcctgtcttggcctccccaagtactgagattataggcatgagccactgccatctggccccaatccctttttaatcagaagccagctcctgctgggtttcccagcagccccaggtgggatggggacagagggaatgaaaggctatcttcccttacctgggaggggccttctcatggccctggcagagccaaggatgcctttgtccagttggctgcctggccggagacaaggacactgagctgccagtcccagcccgagcccagacagagagggcttcagggagaccgaagggcaagggccacacactttccagcttttgaggaggtaaagatggcaaacccatccatggtgaagttgaattgctcctctccaggcccagcagctctgggctacagctggagtggactgccctgacaagctcaaggtagggcatgcagctcctgtgttgagactctgaagttgcaggactcaggtctccctgctccagtgccagatcctcatggttgcagtgagccgtggaggccaggctcctttggcctcacaatcaggcttttgagctgcacagaattgctgggctgggggaatgtggtctcttcctttgctttcaaaccattgctgggatgtagagtgacagcaagagcaatctagatttcatacttgctccccaacttgccagctgcgtggctttaagaaaagttgccaaactttctgagctttggtttccttatctttaaaatgagggtgagccgggaacagtggctcatgcctgtggtcccagctactcaggaggctgaggtggaaagatcacttgagccctggaggttgaggctgcagtgagccacgatcatgccactgcactcaggcctgggcaacagagccagaccctgcctcaaaaataaaataaattaaaatgagagtgagaattcctagctttggaattgatgtgtgtgtgtgtgtgtgtgtgtgtgtgtgtgtgtgtgtgtttgtgttgggcgaggggtggtagccatagtagggagggaggattaaatgacataaagtgactaacattaactattaattaactaattatttaatttttagagatgagatttccttatgttgcccaggctgatcttgaactcctgagctcaagggatcctcctgcttcagtctcccatgtggctaggacactaggtgtgcaccatgcccagcagattttattattgttattattcttatctttttccctgtagttattctattccagcggaggtagccttagctttgtcctgggggccaccgccagcatgagtccatgtttcacggcccccaaacatccctgaaatgaggtagcaccatctctgtggcccgccaaccccagccctgagtgggagccccggctgtttttctctcattctattagtttttccgtgagcatctcctatgtggccaccagggagctgggccccgtgactgacatctgcgctgtagttccactggagaaaaaaaagacaaaaaaatcaatgcaaaaacaaggaaatgtaagagacagttcttctcagccagatggaagattagatagtttggagagaaacactataaaacatgttcaaatttagatacaacataataaatataccatttatttattttttatttgttattatttttttgaaatggagtttcgctcttgttgcccaggctagagtgcagtggtgcgatctcggctcaccgcaacctccacctctcggattcaagcgattctcctgcctcagcctcctgagtagctgggactacagccatgggccaccacgcccagtaaattttgtatttttagtagagatggggtttctcacgttggtcaggctggtctcgaactcctgacctcaggtgatccacccgcctcagcctcccagagtgctagggttacaggtgtgagtcaccgtgcccggcctatttattttttagtgtcagggtctcactctgtcacccaggctggaatacagtggcatgatcttggctcactgtagcctcaatgtcctgggctcagatgatgattctcccacctcagcctcctgaacaactgggagtacacacaggtgtgcaccactgtgcccagataatttttaaattttttctgtagagacgggttctcatcatgttgcccaggctggtcttgaactcctgggctcaagcagtcctcctgcttcagcctcccaaagggctgtgattgcaggtgtgcaccactgcacctgcctgattctttctattgctgaggagattccatcgtatggacataccacaattttttccctggttgatacatgttagcagagaagatttgccagcccttgactgtgcctgcctgcattaattgctttaattagtgcagtgaagctctgaggtgcctggaattcagtggggctgctgttccagtgaaggagaaatatgtgaaactatgaatgaatgattgattatttaattacagttgcccatcgctttggaagatataacagcaaatccaaccatgaaccagaatagcaaagcctgtaagccaggccctgggaggggcagggatgtcctccaccagcatcctttgaagagcaagacttgaacccaaaataaaaaaatgtgaggccaaacctgggaacaaacctttgcaaacagggcttgtgtgcccaagactgtactcacaagtggggacctctgcaaacacccatttcccctacaccactggccccatcgaatttgaggaggagtttctcaagttccatttttcagatgagtaaagtgaggcctggagtaaggaaatgatttgctctctaggtcccaagtcaggaaggggaaaccaaaaccaggcatccagcagcctgtgggtgtctgcctaagtccccacagcccatcctctgtctgccaacacatttgaaacaaagatgctctgttcaccaagaattccattttccccattgttctccactagggacacttctgggttagtcaaaagagggactggttcagcccaatccctggcagtggatcagccgtgccaggtctagattggacttaaaatgtcaggagacagaaaggagttaggcaaagtccgataaggagctcccggcctggggcccaggcacaaagtgacgtgcaggatacttccagtaggctaaaggaagagcggggaccgagggcctggggacacagaaaggtagccccttggagaggctggcagcctcctgtggctcaagggataaagtcagagagcctgggggtttgtgtgcatgcatgtgtgtgtgcatgtgtgtgtgtgcatgtctgtgtgtgtgcatgtctgtgtgtgtcaggggtggttctgctgctggtgagggaggaggcaaggcctctcagaaccaggattaggctggtgggggaagggagaagggtgttttgcttattggaaacagcaggtgcaaaggggctgaggccagtcagtcatcagggagagaggtggggactgcagaggtggagatctgactccctggagatcctgggtctgtggagcaaaggatcccgagagccttgacctgggagaggggaaggctgtctgtcctatgagaagaaaggctgttgtgagtctctgacgacaagaggcccctcaggaggttgagaagagtccaggaccctcttccttctcatcaaatgcaagtgtccacttctatgtgattcaaatttttaaataactttttattgtggtaaatacatacatgaaacatgaaacttactagcttagccatttttaagtgtacaattcagtcacatcagtgcattcactgtgttgtgtaatcatcatcgctatccagttccagaacttttcatcatcccaaatgaaactctacccattaaacaactcctcttcccttctccccagccctggtaacctctatgctgctttttgcctttatgaattagccttttctagatacctcagtttataagcaatttaagaaaacagcttattgaagttcttttattattattatttgttacaatgagacctcttctctcttctcttctcttcttttttttctttcatggagtttcactcttgttgcccagaccggagtgcagcagcgcaatctcggctcactgcaacatctgcctcccgggttcaagcgattttcctgcctcagcctcctgagtagccgggattacaggtgcccgtcaccacgcccacctaattttttgtgtttttagtagagacggggtttcatcatgttggccaggctggtctcaacctcctgacctcaggtgatccacctgcctcggtatcccaaagtgctgggattacaggcgtgagccaccgcacctggtttttttttttttttttttttttaacaatgctgaataaaaggagtgatggcagacatcactatcttgtcctgttttagaggaagaaatttacatgcaataaactgcacaaaagtgcatacttgataacttttaaatatgcatattggccaggcgcagtggctcacgcctgtaatcctagcacgttgggaggccaagacagatggattgcctgagcttgggagttcgagaccagcctgggcaacatggcgaaaccccgtctctactaaaaatacaaaaaattagccaggcgtggtggtgggtgcctgtagtcccacctacttgggaggctgaggcacgagaatcacttgaacctgggaggtggaggttgcagtgagctgagatcgcaccactgcactccagcctgggcaacagagcaagactctgtctcaaaaaacaaaaataaaaataaataaatatgtagatcataaatcaagatagtgaacctattaatcactgcccaaattccctcaaaccttcatgcagttcctccctgccgactctccaccctcaaccaaccaccaccctccacccccaaacaaccactgatctgtcttctgtcattttagattcgtttggattttctagattttttttttgagacaagatctcgttctgttgtccaggctggattgcagtggctcagtcatggctcactgcagccttaacctcctgggcttaattgatccttccacttcagcctcctgagtagctgtaaccacaagtatgtgccaccatgccgggctaatttttgtattttttgtagaggcaaggtctcactatgttgcccaggctgtttttgaactcctaggctcagatgatcctcctgccccagcctcctaaagtggtggggttacaggtgtaagccatcgtgcccagacagttctttttattgctgagtagtattctgttgtatggacatactataatttttttacccattcatctgctgatggacatttaggttgtttccagcttttggtgctagtctgtagacacacaattgatttttgttatgtcgatctggtgtcctgaaaccttgctgaattcatttactagctttacagttttatggattccttaggattttgttttcttttcttttctttttttgagacagagtctcgctcagtcgcccaggctggagtgcagtggctcgatctctgctcactgcaagctctacctcctgggttcacgctattctcctgcctcagcctcccgagtagccgggactacaggtgcccaccaccacacccagctaatttttttgtatttttttagtagagacggggtttcactgtgttagccaggatggtcgtgatgtcctgacctcgtgatccgccctcctcggcttcccaaagtgctgggagtacaggcattgagccactgcacccggctggattttctatatagatgatcctatcatctgggaataaagatagttttacttcttcctttccaatatgcatccctccccctttttctggcctgattgcactggctggaatctccagcacaaagctgaatagaagggattagagtggacatcactgtcttgtcttgatcttgatcttggagagcaagcctaagtctttcactgtgtatccataatttttcgaagatgccccttttcaggttaaggaagttcccttctctgcataattggctgagtgtttttattggggataaatgttggattttgtcacaggctttctgcatcactgagatgaccatgtggtttttctttttttttttaattttaatttttaattttttgagacagagtcttgctctgttacctaggctggagtgcagtggcgtgatctcggctcactgtaacctctgcctcctgggttcaagcaattttcctcctgcctcagcctccctagttgttgggattacaggcgagggtcaccatgcctggctaatttttgtatttttagtagagacggggttttgccatgttggccaggctggtcccgaactcctgaccttaggtgatctgccggcctcggcttcccaaagtgctgggattacaggcgtgagccaccttgcccggccggtttttctttttttagtttgttaacatggtgaattatgatgattgattttcttttttcttttttttttttttttttttgagatagagtcttgctctgttgcccaggctggagggcagtggtgtgctctcggctcactgcaacctctgactcccgggtttaagccattctcctgccttagcctcatttgtagctgggattacaggcatgcaccaccatgcccagctaatttttgtatttttagtagggtcagtgtttcaccatgttggcaaggctggtcttgaactcctgacctcagctgatccacccgccttggcctcccaaagtgctgggattatggcttgagccaccacgaccggccttgattttcaaatattaaactaatttttcgttcctgaaattgcatatgggattaggagattaggatacagggatctaggtgcccccagcacatggtgggtctggttccccagtaaaacccagttttgggcctggtcatctggtagagggagggaggaggcacagatcaagggtggggagagggctgacctccagacactatagcctctgccgccaactctgagcagcacaggtgagtcagcccaggtgagccttaggccaaggccgtgcaggcgactgcttcccacagcaggttcaggtggggcaggctctgctgcctctctctcttgcctggagaggcacctggggctcatcatgggttcagtgtgcagacttgcacctcagcctcacgcctcagtctctgcatctgggaagctgggaagcagagctggccccagggaaagctcaggcagcgaggaaggcggggtgtgggggcgggtgttgccactcagacctggttccaattgtgcttcccttctctgtaaaatgggggtaatcatgccttccttccatgtgatatgagctgatggtgacaagccacttaaatacatgagaggaaagcataattcttttattttttatttttatttattttttaaaaattatgtttatttattattattattttttgagatggaatcttgctccgtcgcccaggctgaagtgcagtggtgcgatctcagctcactgcaacctccgcctccccggttcaagcaattctccctgcctcagccttccatgtagctgggatttcaggtgtgtgccaccacgcccacctaatttttgcatatttagtagagacggggtttcgccatgttggccaggatggtcttgaactcctgacctcaggtgatctgcccgcttctgcttcccaaagtgctgggattacaggtgtgagccaccacgcttggcctgaaagtgggattcttgaatcttatgccacagctcgcaagctgttaagtcctgggaccagtgcttttaatctctcagccttagtcttctgtttgtaaaatggagatgatgacacccggaggtgtggggcttccaggataaattaatgtcactgtgcagatcaagcaacaagcaagtgcgtaccaagtgcatggcacagcgcctggcacctgggaaatgctgggggatattaggggatctcacaggtgcccagagacaggtgcactgaggcagagactgtctgggactacagcctggaggtgtatggctgctctgaggggtagggatttatcctgccttggtttcaatttgcagaggcctgttcctgagtgagtgatattacccatgaggccagtgctttcagcaaccccatgaggctggcatggtcactgtgcctcttgcaggtgccagtggggagagagaaactcagatctatagctagaattggaacccagatgcctctggatgttttgagaggtttgcaccatttaaaatgtgaatgtcaggctggacgtggtggctcatgcctgtaatcccagcactttgggaggccaaggcaggtggatcacctgaggtctggagtttgagaccagcctggccaacacggcgaaaccgtctctactaaaaatacaaaaattagccaggtgtggtggcgggcgcctgtaatcccagccactctggaggctgaggcaggagaatcacttgaacctgggaggtggaggttgcagtgagccaagattgcgccactccactccagcctgggcgaaagagcgagactctatctcagaaaaaaaaaaaaaaaagtgaacgtttttccaaggtaggagctgagagagggatctgggagaggagggaggaatcaaagggccaagaaaactcttggtggattctctccttcatccccatcctagtcttgtgcctgttttcctccagcgtctgggagtgccgagtgttcagttgacccagttctccttctctgctggaattttggcatctggcccatgtgtccagttcattcactcagctatgatttgccagaagttatagagtttcctatgtgtcaagcaggtgccaggccctgaggacacaatgatgacaccagaaccaggctctgtccccagaccctgtggtcattcctgtggggagaacgacacacaacacacaactgaatgcagttaggataatgtcgagtggccagtgctgtgtggaaagtgccgcagagggagtgacaggggtggcctggtggccagagaaggcatctctacggaggtgatgtttgagctgacaagaagaaaccagctggggagaaatctcttgtggaatattccaggaagagataaggcaaagtcctcagggagtagccgtcggtgcgggacagtgggtgaagctagggtgaggaggaaggaggggccccctcaagcctgccgggaagccacggagagcagttagggttgattctgagggcagattccaagattcttctggaaatgaaaaaactgcttgcgttctttcccccccttccatcctttgtgattttgggggcttcttctttctttcttctttttgttgttgtttgagacagggtcttgctctgtggcccaggccggagcacagtggcctggcacaatctcagctcactgcaacctccatgtccctggttcaggcagtcctcccgcctcagcctcctgagtagccgagactacaggtgcgcaccaccacgcctgtctaatttttctgtttttagtagagatgggtttctccatgttgcccaggctggtctcgaactcctgtgctcaggggctttgtattttgaaacacatgtgagaggctcttggaactggaaggaagggttggtgcccccagattgcctgaactcgctcttgtatccacttcctagttgctgtgaagggggaggggctgccaggtacggcagatttgtgtccttctccccgccaccttgctggagatacctgggagtttataccattctacacctgcaggggggccactgactgaattaggggtgcaaaagcctgacctctttgcctcaaatagaacaacactgtggtgctatttaaaaacagccttcgggctgggtgcagtggctcacacctgtaatcccagctctttgggaggctgaggcaggtggatcgcttgagctcaggggtttgagactagcctggggcaacatggtaagaccccatatctacacaaaatttaaaaaagttaccagcctgaccaacatggtgaaaccccgtttctactaaaaatacaaaaattagctgggcatggtggcaggcacctgtaatcccagctactccggaggctgagacaggagaatcgctggaacccaagaggcagaggttgcagtgagccgagatcacaccactgcactgcagcctgggtgacagagcaagactctgtcttaaataaataaataaataaataaatagctggatgtggtgacaaacacctgtggtcccagctcttcgggaggagcaggaggattgcttgagattggaggattgcctgagcccaggaggtcaaggatgcagtgagccatgattgcacctctgcactccagcctgggcaatacagtgagaccctgtgtaaaaataaaagatagccttctgtcttgaggttccctcccttcattaatcatgtgaagcccaaagcctgtctcaggctctgcttccaggagagccagcctccaacaggccgataggggctgtgtgttctgtagtctagaaatcggggttctgggatcatggaaccagctgacccctgggggcttttccttccagctttaagagtctctaaagctgtgtgatttcctcaagtcacatagcaagttattggcagagccaggcccacaaactactcacagcctgaaagcactgggggctgggggctgggggctagggggatctgctggtgaatggtgagtatggtgcagaggccaaggcccaagctggaatacggtgcagaggccaaggcccaagctgtggttcatccaaggctgtgctcccagatgaagctctggatctcaggtaaggcccactctgccgtaattactccagagactttagtttcctgaattctgctccctttacctctgtattagaatgattcacactaaagtgtgaaagattgtcagctcagaaccctcccagaagcaatgcatcctgaaaagaaagtgcttgttaacccacatcaatctctaattgaagggactttttgacaggtataaagtgagttggaaaaacgcacacagtgtaaatctggagcctttggggctcaggagggattcctcagcttccccaagatcagcttccccacccccatttctgcttctcccaattagaacacatgttttttgtttgttttgagacagagtctcactctattgcccagggtggagtccagtggtacaatctcaactcactgcaacctctgcctccccggttaaagcgattctcctgcctcagcctcccaagtagctgggatcaccacgcccagctaatttttatatgtttagtagaggcggggcttcactgtgttggccaggctggtctcgaactcctgacctcaaatgatctgcctgccttggcctcccaaagtgctgggattacaggcctgagccactgtgcccggcctcagaccacatctgttgagaaatgcatgtcgtcttcttcaggttcccacagcagggccggtcgaaggggtgtcactggaagtgaaggtgacgcaactgaaaaaataattttgtgagaagtgtatttttgcagaggctggtggtttgaactaatctccctggtaagtggtttatttctccggagagtgaaggactgtgcatgatttagtaaatttccatgccatgttctgaagggctggcatcccttcttggctcaggcaggcttgtagcgtagactggggacatggggttggagcggggcggtttcctgaggcatggcggccacactggatggggcctcacctggtctccacccttactgtacaagtgcccttggcaagtcacttaccttttccaaggcgcagtttcctcatctgtgaaacaactggagttggctattccggaaccttggtactcaaagtgtggtctgcagaccagtggtatctgcagcacctgggagcttgtcagaaatgcagagtccagccaggagtggtggctcacacctgtaatcccaacactttgggaggctgcggtgggtggatcaccagaggtcaggagctcaaaaccagcctggccagcacagtgaaaccctatctctactaaaaatacaaaaattagccaggcatggtggcgtgcacctgtagtcccagctacttgggaagctgaggcaggaggattgcttgatcctgggaggtggaggttgcagtgagctgaggttgcgccactgtactccagcctgggtgacagagtgagactctgtctcaggaaaaaaaaaaagaaagaaatgcagagtccagccaggcacggtggctcacccctgtaatcccagtgctctgggaggctgaggcaggaggattgcttgaggccaggagtttgagaccagcctgggcaatacaacaaggctttgtctcttaaaaaaaaaaattatccaggcgtggtggtgcacgcctgtagccccagctactcaggaggctgaggtgggaggactgcttgaacccaggagtctgaggctgttgtgagctgtgatcatgcccctgcactccagcctgggcaatggagcaaaaccctgtctcaaaaaaaaaaaaaaagaagtgcagtatcccaggccctaccccagactttctgagtgagtctatattttaacaagattccaggtaatgtgtctgtatggcacagtttgaggaacccttctttggagcagactcctcaaatgtggtccttgcaccaccccatcagtgtcatccgagagacaaagcatgctggaaatgcaagttcatgggcccctgacctactgaattgtatgtctgagggaggggcctggagcctgtgttttttaacagcctctccaggtggttcttaagcccgctgaggtttgagaagcatggaagctcagattcaacagtgatgggagccgaggtttagctgtggtgcagctgctgaacacggaacctgttttgtttttgtgctgctttcagaaatgtgcacacacttgcctttcacagcaatttcatgatgttgtttgtccttatctttgctctgcctaagagataactgggttttaagggaagttatgtgaattgcctacactctttgtgtctcacagtgtcttgcaatagcaatattcacataaagcatttctggcaagtgtcagtgagctgttacaggtgataaaacttcttgtaaatatttgttccttgattataaatgacagaggctctgttggaacaggagctggggtagatcttgtaggtcttgcccaaggctcaggagctgatgaactgcaactcctctgttttactgcttagtattttgattagagaataaactcatacggtttcaacatcatgtaaaatagaactatagcaaagagttttcttcctgctcctgtcccataaccggcctcaccgggtaactgtttatattttattgggtctaatctaattagagctgatcctcaggaaaacagaaactcctgatctatggctcccctgttaccccccaaatctctggacttacggtgtatgcatttttgcaacttattttactaccctgacaaaaagtccatcgaattctagacttatttgggttaacaaacatcttcttttaaagatacactggccaggtgtggtggctcacgcctgtaatcccagcactttgggaggccgaggtgggtggatcaagaggtcaagagatcgaaaccattctggctaacatggtgaaaccccgtctctactaaaagtacaaaaattagctgggcgtggtggtgctcacctgtagtcccagctactcaggaggttgaggcaggagaattgcttgaacctgggaggtggaggttgcagtaagccgagattgcgccactgcactccagcctggcaacagagcaagactccgtctcaaaataaataaataaataaataaataaaataaagatacactgtctctgaaaggtgtctgagttgccaatctttcacgctttagtgtgaattattctaatatgttcactttatgcaaatgcaagcatatacaaatatatagatatagatataggtagatgaaagtgccaggcgcagtggcacgtgcctgtaatctcagcactttgggagtctgaggtggggcaaatcacttgagcttaggagtttgaaaccagcctgggcaacacagtgaaatcccatctctaccaaaaatacaaaaaattagctgagtgtggtggtgcacacccgtggtctcagctactcggaagactgaggtgggaggatctcttgagcccaggcagtggaggttgtggcaagctgagatggcaccactgcactccagcgtgggtgacagattgagatcctgtctcaataaaaaaatccgtcccccctcaaactccttccacagatatttatagataaaagctttgccacctctgctgaacacagcttccaacatagaaaacacaccattcagtgtcttgcttgttttactgaatctatcatgctatactactgtgtggtgaacatgcaggttataccatctgctatcacagacgctgatgagatgaaaaatctcatacacgtggcctgttgcaggtgcatactgtatatgcaggataaattcccagaaacggcattgctaagtatctgcatttgtgatttgagagatattgccaatttccactccataaggttaataccaatttgcacttccatcagctttggatgaaaaattagtttgcccgcatcattgccaacacattaaattggatttatatcattggatttttaccaatctgataggtgaaaaacagtgactcaatgtagtcttaatttaaatttgttatgaaaaaattttaatttataatgtgtttaaggcctatgtatttttctatgaccgtcttactcatattgttttgcttattttatttatttatttttttgtgagcaacatgtctgtttatttcacctgggtgcaggcgggctgagtccgaaaagagagtcagcaaagcgtgctggattatcattagttcttataggttttgggataggcggtgaagttaagagcaatgttttgcgggcaggggtggatctcacacagtacattctcaagggtggggagaattacaaacaacctgcttaagggtgggggagattacaaagtacattgatcagttaggtggggcaggaacaaatcacaatggtggaatgtcatcagttaaggctatttttacttcttttgtggatcttcagttacttcaggccatctggatgtatacgtgcaagtcacaggggatgcgatggcttggcttgggctcagaggcctgacattcctgccgccttatattaataagaaaaatcaaaatagtgttgaagtcctggggcggcgaaaatttttggggggtggtatggagagagagtgggcgatgtttctcagggttgcttcaagcaggattaggggtggcgtgggaacctagagtgggagagattaagctgaaggaagattttgtggtaaggggtgatattgtggggttgttagaagaaacatttgttgtgtagaattattggtgatggcctggatatgattttgtatgaattgaaaaactaaatggaataagagaaggagaaaaaccggtataaaaggtctaagaattgggaagacctaggacatctgattagagagtgcctaaggagattcagtatagtcctgccagcaaagattatttatttacttcaagagttaagagtggcagtttggggatagcacgaggagatatcagctgtgatggcttggagaaactgtgtaaaccggcagtgtaaacaagagcagggcatgtatgagtagttgagaacggagaataggagtatgactagacagaagatagtagggatgacaagtttttttggggcacagtctaagttggtctggtgtctggaatgagactggggcctaataaaaaggagcgtctatacaggagcttaaatgggctgtaccccctgtagcattccgaagacaggcctgaattctgagaagggaaagtggtaaaagtattgtccagtcctttttaagttggtggctgagcttggtgaggtgtgtttttaaaagacctttagtccattctacttttcttgaagacggaggaccgtaagggatataaaggtttcactgaatactaagagcctgaaaaactgcttggctgatttgactaataaaggctcgtctgttatcagactgtatagaggtgggaaggctaaactgaggaattatgtctgacagaagggaagaaatgactgcggtggccttctcagaccctgtaggaaaggcctctacctatccagtgaaagtatctacctagactaagaggtattttagttatctgactcagggcatgttgagtaaagctaatttgccagtcctgggtggggcaaatcctccagcttgatgtgtagagaagggagggggcctgaataatccctgaggagtagtagaatagcagatggaacactgagaagttatttccttgaggatagatttccacaatggaaaggaaatgagaggttctaggaggcgggctagtggcttgtactatagcatagcctgcctttgctggtgtgtggtgattaggcctggtggaacctccatcaataaatcaagcgtgatcagggtgaggaacaggaaagaaggaaatttggggaaatggggttaatgtcaggtggatctgagagatacagtcatgggggtcaggtgtggtatcaggaataatgtgggaggccggattgaagtctgggccaggaacaacggtaattgtgggagactcaacaaagagtgagtatagctgaaggagccgggaagcagaaattatatgcgtcaggtatgaggaagaaaatagattttggaagttatgagaaatgtagagagtgagttgagcatagtttgtgattttgagggcctctaaaagtattaatgcagcggcagccgctgcacgcagacatgagggctaggctaaaacagtaaggtcaagttgtttggacagaaaggttacagggtgtggtcctggctcttgtgtaagaattctgaccacgctaaccatgcctagggaggaaaggaattgttttgtagaaggtgctggggtttgagagatcagtcggacagggagatcacgtgtgtttttatgagaattatgcagagataggtaacagatgaggaagaaatttgggcttgattgaagtaatgggggctgtctgtgaagctttgcagcagtacagcctaggtaatttgctgagcttgatgggggtcagggtcagtccaagtgaaagtgaagagaggctgggattaacggtgcaaaggaatagtaaagaaagcatgtttgagatgtagaacagaataatgggttatagaggcaggtattgaggataggagagtatatgggtttggcaccacggggtggataggcaaaacaatttggttgataaggcatagatcctgaactaacttgtaaggcttgtctggttttaggacaggtaaaatgggggaattgtaaggagtttataggctttaaaaggccatgctgtagcagacgagtgataacaggctttaatctttttaaagcgtgctgcgggatgggatattggcgttgagtggggtaagggtgattaggttttaatgagatggtaaggggtgcatgatcggtcgccaaggagggagtagaggtatcttgtgggttaaggtgggggaatacaagaggagacgcaaaggaggctttggattgggaagaagggtggcaatgagatatagctgtagtccaggaatagtcagggaagcagataatttagttagagtatctcggcctaataagggaactgggcaggtggggataactaaaaaggagtgcttaaaagagtattgcctaagttggcaccagagttggggagttttaagaggtttagaagcctggccgtcaatacccacaacagttatggaggcaagggaaacaggcccttgaaaagaaggtaatgtggagtgggtagcctccgtattgattaagaagggaaagggcttaccttccactgtgagagttactcgaagctcagcgtctgtgatggtctacagggctttcgaggcgatcgggcagtgtcagtcttcagccgctaagccgagaagatctgggaaggagtcagtcagagagccttgggccagagttccaggggctctgggagtggctgccaggtgagttgaacagtccgattttcagtggggtcccacacagatgggacgcggcttaggaggaatcccgggctgccggcattccttggcccagtggccagatttccagcacatgtagcaagctcctgtgggaggaggttctggaggaacgcctggccgctgcggttcaggagtttggaagttcttgtgtgctggagatgtggctggggtttgtctcacagtggaggcaaggaattgcaacttttttctattattgtacaccttgaaggcgaggttaattaaatcctgttgtggggtttcagggctggaatttaatttttggagttttatttaatgtcgggagcacattgggtaataaaatgtattttgagaataagatggccttttgaccttttagggtctagggctgtaaagcgtctcaaggttgcagccaaacaagacatgaactgggctggatttttatacttgatgaaaaagagcctaaacgctatctgatttgggataaagaaaaaggagcattcaccttgactatgcctttggctccagccacctttttaagagtgaattgctgggcaggtgggggagggctagtcacgcaacgaaactgtaagccccaccaggtgtgaggaggggaggtgataaaaagatagggtggaggagcggaggctgaggaagaattgggacctagctcagcctggcgaggaggggagaggtcagatgggtctgtagaaaaggaagattagaaagactcagcgacacttggggttgggactgaggggacaggcgggagggaaagaaggaagatttggtacgagttgcattgggcacagagactaggaagggactgatgtgtaaaagaatgcctggacgtcaggcacctcagaccttctgcgtattttacaacaagaattatttagatttgcaggatggaaaaattcaaagtgctattttctggctatttggaactactgtcgagtttgtattgggatcaaggggcattgcagaagaaaaggcacttaggttttaggtcaggtgtgagttgaagaggttttaagtttttgagaacacaggctaagggagaagaaggaggaatggaatgtggaatcttacgtatagtgaaggaggcaagcccagagaaaagagtagagacacggagaaggggtggagggttcttgccctccagaaaagcagagaaggggttggggcacggaaataagggattgagacacagagataagagtttgggtgtggaaataagcaattagggggttcttgccccctaggaaagcgggacttgtcgctaagggtgaaggagaaggggttgaggggtacttgcccctgccccaggaaagcaggacttgccgctaaggttgaaggaccaaggcaggcgtccctgcatggtctgacacccttgaagcgtgcctgtataatcagagaggcgtccctgcaatgattaaacaccaagggaaggctgccttcccagtccgtgactggcaccggagttttgggtccacggataaaacatgtctccttcgtctctcccagaaaatgaaaggaattgaaattaagagaagggagagattgaagagtggaaagaagaaagtggttgagggacagtgagagaggttggagaagagtaagaaggggccgcttacctgatttaaaattggtgatattccttgggctggtcggtctgaggacctgaggtcgtaggtggatctttctcatggagcaaagaacaggaggacaggggattgatctcccaagggaggtcccccgatccgagtcatggcaccaaatttcatgcgcgtccgtgtgaagagaccatcaaacaggctttgtgtgagcaacatggctgtttatttcacctgggtgcaggcaggctgagtccgaaaagagagtcagtgaagggagataagggtggggccgttttataggatttgggtaggtaaaggaaaattacagtcaaagagggtttgttctctggcgggcaggagtgggggtcgcaaggtgctcagtgggggtgtttttgagccaggatgagccaggagaaggactttcacaaggtaatgtcatcagttaaggcaaggaccggccatttacacttcttttgtggtggaatgtcatcagttaagggggggcagggcatattcacttcttttgtgattcttcagttacttcaggccatctgggcgtatatacgtgcaagtcacaggggatgtgatggcttggcttgggctcagaggcctgacaggtttcactgaatactaagagcctgaaaaactgcttggctgatttgactaataaaggctggtctgttatcagactgtatagaggggggaaggctaaactgaggaattatgtctgacaaaagggaaaaaatgactgtggtggccttctcagaccctgtaggaaaggtctttgcttattcagtgaaagtgtctatttagactaaaagttattttagttatctgactcagggcatgttgaataaagctaatttgccagtcctgggcgggggcaaatccctgagcttgatgtgtagggaagggaggaggcctgaataatccctgaggagtagtagaacagcagatggaacaccgagaagttatttccttgaggatagatttccacgatggaaaggaaatgagaggttctgagaggcgggctagtggcttgtactatagcatagcctgcctttgctggtgtgtggcgattaggcctggtggaactgccatcaataaatcaagcgtgatcagggtgaggaacaggaaagaaggaaatttggggaaatggggttaatgtcaggtggatcagagagatacagtcatgggggtcaggtgtggtatcaggaataatgtggggggccagattgaagtccgggccaggaacaatggtaattgtgggacttaaagagtgagtacagctgaaggagccggggagcagaaagtatatgcttcaggtatgaggaagaaaatagattttggaagttatgagaaatgtagagagtgagttgagcatagtttgcgatttttagggcctctaaaagtattaatgcagcggcacccgctgtatgcagacatgagggctaggctaaaacattaaggtcaaattgtttggacagaaaggctacagggtgcggtcctggctcttgtataagaattctgaccacactaaccatacctaggaagaaaaggagttgttttgtaagggattgaggtttgggggattaatcggacacgagcagcagggggagcacctgtgtttttatgaagaattatgctgagataggtaacagatgaggatgaaatttgggcttgattgaagtaatgggggctgtctgtgacgccttgcagcagtacagcccaggtaatttgctgagcctaatgggtgtcagggtcagtccaagtgaaagcgaagagaggctgggatgatgggagcaaaggaatagtaaagaaagcatgcttgagatccagaacataataatggattgtggagggaggtatggaggataggagagtatatgggtttgacaccatagggtggataggcaaaacaatttggttgataaggcacagatcctgaactaacttgtaaggcttgtctggttttaggacaggcaaaatgggggaattgtaaggagagtttataggctttaaaaggccatgctgtagcaggcgagtgataacaggctttaatcctttcaaagcatgctgtgggatgggatattggcattgaacagggtaagggtgataaggttttaatgagatggtaaggggtgcatgatcagtcgccaaggagggagtagaggtatcttatacttgtgggttaaggtgggggaatacaagaggaggatgcaaaggaggctttggattgggaagaagggtggcaatgagatgtagctgtagtccaggaatagtcagggaagcagataatttagttaaagtgtctcggcctaataagggaactgggcaggtggggataactaaaaggagtgcttaaaagagtatcatctaagttggcaccagagttggggagttctaagaggtttagaagcctggccgtcaatactcacaacagttatggaggcaagggaaacaggcccttgaaaagaaggtaatgtggagtgggtagcctccgtattgattaaggcgacggacttaccttccactgtgagagttactcgaagctcggcgtctgtgatggtctacggggctttcgaggtgatcaggcagcgtcagtcttcagccgctaagccgagaaggagtcagtcagagagccttgggccagagttccaggggctctgggagtggctgccaggtgagttgaacagtccgattttcagtggggtcccacacagatgggacgcggcttaggaggaatcccgggctgccggcattccttggcccagtggccagatttccggcacgtgtagcaagctcctggggaaggaggttctggaggaatacctggctgctgtggttcaggcatttggaagttcttgtgtgctggagatgtggctggggtttgtctcacagtggaggcaaggaattgcaactttttttctgttactgtacaccttgaaggtgaggttaattaaatcctgttgtggggtttgagggccagattccaatttttggaattttatttaatgtcgggagcacattgggtaataaaatgtattttgagaataagatggccttttgaccttttagggtctagggctgtaaagcgtctcaaggttgcagccaaacaagtcatgaactgggctggatttttatatttgatgaaaaagagcctaaacgctatctgatttgggataaagaaaaaggagcattcaccttgactatgcctttagcttcagccacctttttaagaataaattgctggacaggtggggaagggctagtcactgaacgaaactataagccagacagggtgtgaggaggggaggtgataaaaggattatagggtggaggaggggaggctgaggaagaattgggacctagcttggcctggagaggaggggagaggtcagatgggtctgtagaaaaggaagattagaaagactcagtgacgcttggggttgggactgaggggacaggcgggagggaaagaaggaagatttggtacgagttgcattgggcacagagactaggaagggactgatgtgtaaaagaatgcctggacatcaggcacctcagaccatttgtctattttacagcaagaattatttagattttgcaggatggaaaaattcaaagtgccattttttggctatttggaactactgttgagtttgtattggggtcaagcagcattgcagaagaaaataaggcgtttaggttttaggtcaggtgtgagttgaagaggttttaagttcgtgagaagtcaggctaagggagaaggaggaatggatggtggaaggttgcccatagtgaaggaggcaaacccagagaaaagagagcatagagatatggagggaaggggttcgggggttcttaccctccagaaaagtgggaaggggggtcggggcatggaaataagggattggggcacagaaataagaggttggggtgcggaaataagggattgggggttcttgccccctagaaaagcgggacttgccgctaagggcgaaggagaaggggttgaggggtacttgccccttccccagaaaagcagagaaggggtagagagggagagaaggagttggggaacttgcccctcccccagaaaagcgggacttgctgctaagggtgaaggaccaaggcaggcatccctgcgtggtctgacacctttgaaacgtgggtgaataatcagagaggtgtccctgcaatgattaaacaccaagggaaggctgccttcccagtccgtgacaggcgctggagttttgggtccaccgataaaacgtgtctgctttgtctctcccagaaaatgaaaggaattgaaattaagagaagggagagattgaagtgtgacgccaagattgaaaggagaaagaggttgagggatagtgagggagattggaaaagagagtaaaaagtggccacttaccggatttgaaattggtgagatgtttcttgggcttgtctgtctaaggacctgaggtggtaggtggatctttctcacagagcaaagagcaggaggacaggggattgatctcccaagggaggtcccccgatccgagtcacggcaccgaatttcatgcgcgtccatgagaagagaccaccacacaggctttgtgtgaccaacatggctgtttatttcacctgggtgcaggtgggctgagtccaaaaagagagtcagcctgttttgcttatttttaaaattacattgttggctttttcttttttatttctatgagctgtttacatattagtgagatcagtcttttgtgcctttgatataaattgcattcagtttagtgtgtctcttttattttattaattttttgttttagtatatacaagtttttatttctatggagtcaaatttatcagtcttttatggtttctgaatgtttaatcataggtaccaaaaccttcccactttaagaaaacacgatgtgtgtgggtttgtttgtttttgtttttgtttttttgaatcagagttttgcttttgttgcccaggctggaatggaatggtgcaatcctggctcactgcaacctctgcctcccaggttcaagtgattgtcctgcctcagcctcccgagtagctgggattacaggcatgcgccaccacgcccggctaattttgtatttttagtggagatggggtttcaccatgttgatcaggctggtctggaactcctgacctcaggtgatctgcccacctcagcctcccaaagtgctgggattccaggtgtgagccaccacacccggccaaaaacatgatgtctcctatgttttcttctattattttatattcaaattttgatccttttggaatttatcctgatgtgtgctttgaggagtaggtctaattttattttttcttccagatgacttttttcagctaaattgagaagctattttatcataagccatttatcatgagctcttttctctgtatgtatttgagtctatttcagaacttgctactcttttccattagtttctctttctgttcatgttcattcaagttcccactgttttgtttattaaggttgataatatttaaaaatatatatgtttcttatagagacagggtctccctatgttgcccaggctggtcttgaacttctggactcaggggatccttccacctcagcctcccaaagtgctgggattacaggcctgagccactaagcctggccctaaaaaatatattttaatatatgaaagggatgttcttccccttatatgttgagctctttcaggctattcttgctcatttttttccatttgaactttaacatctaatatctaattacacaaacacacaggaaagctgaagtataacacacatatagcaaagtaaataaattggaagtatacagcttgatgagctatcacaaagtgaacacacccttgcaactattaccagcgtgtagaagccccccaccagatccccaaacactcactatccctccctccctccaaaggtgcatccctcctctcccctccccctccgctcccctccccctcctcccccttccctcccctcttctttttctttctctttctttgagacaggctttctctctgttacccaggctagagcacagtggtgctatctaggctcactgcagcctctgtctcctggactcaagcagtcctcccaagtagctgggactacaggcacaagccaccatacctggctaatctttttatttttttgtagagatgggatctcactatgttgtccaagctggtctcgagctccagggctcaagagatctgcctacttcagatcccaaagtggtggggttgcaggtgtgagccagtgtgcctggcccttatttcttgtcacagattggttttgctgtgtttttttaaaaaactttaaacacgtgtattcttttgtatctggtttcttttgctcaacattttatttgtgaggtttatttatccacatgccatgaatattgtaacacatggcttttggtgcccatgtatacagatttctgttggatatttacttacgaaagaaattgctaagctgtgggatatgcacacgttcaatttcagaaaatactgccaaactgttctccaagtagatatgtgacaatttaccttccttccagaaatgtctgagaattccaattattctacattgttgcaacacttggatttttttggtctttttaattttattcactctagggtgtgtgtgtagtggtaattaattgtggtcgagcaccttattatatatttattggccatttaaatatactgtcttgtgaaatgcattgggattgctttaaatttatacattaacttcagagaattggacctacttatgatgttaaatcttcccatccaagaacacagtatatctttttccatttgtttaactcttctgtgtcctttagcattgtttacagttttttagtatatatcttgcacatttcttgataagtttatttctaggtattttacattttttgttgttatgtaagtggtctcttttctaactggctagtgtgtgggtttgtttttatttatttatttatttatttatttttttttttgagacagagtcttgctctgttgcccaggctggaatgcaatggtatgatcttggctcactgcaatctccggctcgcgggttcaagcgattctcctacctcagcctcccaagcagctgggattacaggcacccgccaccatgcctggctaatttttgtatttttagtagagatggggtctcaccatgttgaccaagctggtcttgaactcctgaccttaattgatccacccgccttggcctcccaaagtcctgggattacaggcatgagccatcacacctggtcttttttttttttttttttttgagacagggtcttactgtatgcccaggctgaagtgcagtggctcaatcacagctcactatagcttcgaactcctgggttcaaatgatccttccacctcggcctcccgaggagctgggacagcaagcatgtaccattgtgtccaactaacttttgtatttttaatgtatagacagggtcttggtatgttgcccaggctggtctcaaactcctggcctcaagtgatcctcccaaagcactgagattataggcatgagtcactgtacctggcccctggctattgtttatagtagtttgttgattctcttggatgttctagatttataatcatctcatgtacaagtggaaataacttcacctcctcctatttaactcttgtatctctaattttgtttgctgatgtaattgcattggctattaccttctgtgtaatggtagtgagcatacttgtattgcttctttctttagtgggaatgcctctagtgattctaagttatgcaaaatgctggcctttatctgaggttgaggtattttatcatgttaggtaattatccatcaattccttcttttcctgatttttatctaacatttacagatctccagaacctactacagttgtccttttgtatacttgcggaaccggttccagaaccccccaaagataccaaaatccatggacgctcaggtcccttatgtaaaatggcatagtatttgcatataacctacttacaccctcctgtgtaattaaaattatctctaaattacttataataacgaatacaatgtagatactgtataaatagttgttatactatattgtttggggagtaatgacaagaaaaatgtctgtacatgttcagtacagaaacaatcattgtagacctcactacatttttttctttttttttttaatttgaaatgtttgtgcgtacatagtagatatatatatttatggggtacatgagatattttgatacgggaattcaatgcttaataatcacatgagtgtacatggggtctccattttctcaagcatttttatcttttgtgttatgattcagttatactgtttcagtaattaaaaaatgtacaattacattattgactctagtcaccctgttgtgttatcaaatactagctcttattcattctgtctatgtttttgtaccaaccaaccatcatttccacttcctcccacccagcaacaattcttccagcctctggtaactgtccttctactctctatctccatgagtttgttttaatttttagcacccacatacaagtgaaaatatgtaatgtttatctttctgtgcctggcttatttcacttaacataatgatgaactcatgtggttacaaatgacaggatctcattcttttaatggctgaatagtactccattctgtatatgttctacattttctttccttctttctttttaattttttttggagatggagtctctctgtcgcacaggctggaatgcactgacgtgatctctgcttattgcaacatttgcctccccagcgattctcctgcctcaacctcccgagtagctgggattacaggtgtgcaccaccatgcctggctaagttttgtatttttagtagagacgaggtttcaccatgttgggcaggctggtctcgaattcctgacctcaggtgatctgccagcgtcggcctcccaaagtgctgggattacaggaatgaaccactgcgcctggcccctcccttcccctcctctcccctcccctctcctctcctcttctttcttttttcttttttttttctgaggtagggtctcattctgtcacccaggcatgatcagtgcaatcatggctcactgcaacctcagtctcccaggctcaattgatcctcctacctcagcttcccaagtagctgtgactacaggcacaccaccatgcctggctaatttttatatttttttgtagagacggggtttcgccatgttgcccaggctggcctcaaactcctgggttcaagtgatcctctggtctcagttttccaaagtgttgagattataggagtgagccaccaagctcgggtcacattttctttattcatctgctgatgggcactcagtttgcttccaaatcttggctattgtgaatagtgctgcaataaacatgggagtgccgatatgtcttcaatatactgatttcctttcttttgggtatatacctggcagtgaagttgctggatcatatggtagcctaaactacattttcaatttgtggttggttgaaactgaagatgcaaaatccatggacgcagaagactgactgtgttatgttatattaagaagtttccttatattgaaccatccttgcactcttggaataaagtctctttggtttttccagtgtcttgtgcccccagctggagaagctcctttgactgagccaatagctactgtggactgttgtggacatggtctgtggacatggacagggccagtacccataggcctaagtctcctttcctgcagtaaattattggtttgattctcttcgagaaacccagctcaaagtcctttctgttgtcagggagaatagaaattgggttttcccatggagttagaaaaaactacagtcttttccaatttattcttgtttttattaacttttaaaacaaaacaaaacatattaaatgtttttttaatatgttaaaaacaaaaccaaagaatctttatcctgttatactcagctttgtttatataatgttttggaggatgtcccaatgaccttttagagtctctgggctgttataaaactaaacttgggactcacttccctagtttttctcaagaagagtggaaaaataaaaaagttaaaatagttttggccagtaacaaagaaaaacctttaggttcttggtcactggagaatatggtacttaatccctagaagcaggtatacactgggcgggatagcccagtggttaagacggtccctgctgtgcagcttactgttgtgtgtaacctcagacaagttacctcatccctctggtccttcatttcctcatcagtaagagaagataataatattgatcccaggagttcaagaccagcctgggtaccatggcaaaaccctgtctctacaaaaaaaaaattataatacaaaaaattagctgagtgtgctgttgtgtacctgtaatcccagctacttgggaggctgaggtaggaggattacctgagcctggggaggtcaaggctgcagtgagtggagatcgtgccactgcacttcagcctgggtgatagagtgagaccctgtctcaaaaaaaaaaaaaaaaaagagaagataatagttcccaactccagccttgttgggaggcaattagttaatgcttgaaagttccttgggacatggtaagcaccagtgaatatggaggagcctgtggggatgagatcatgctgtagggattgggccaggtggtcttagcattcagcggccatttctgaccttcgctgaccctaatcctcatgcagatatctgcagggtgtgcttagacaaatgacgggcctgttctcaaggtctaggcttctaccatgaagcaaaataatgaagttaaaaacaaaatctccttttgtaggtgtttagcctataggaaccaaaggaatggagctgaagattccttcaggtgggcattttggggaacacatctgtgaatgaatgggaagaggagctgggccaatgctttcggctcctgaccaggtggtcctgagggcttaaactccaaggaagggagtgctcttataagcgggccagtggctttccaatggagcatctgcaaagtgggtctctggggtggtgctgcacagagaccatgtggtgtttgtgtttgagagagtgaagggggtatttttgctgtgggcagaagggacagtttttttgtgacagatgagcaagaagggagagctatggggagggatctgtctgatcagtggccaagtactgcctctcaaggtgaattcagagtagcattgggctggccttcttttgggggttttgtcttatttgatgaagcacgagccaggttggagcctttgtcaccagcttgctgtttccaaccagcaattttctattgttaaaattggagtataacttacttaaaataaaattcttacttaaaatgtgtcttatcaggacatatttttttttgaaacagcgtctctgtcacccatgctggggtgcagaggcacaaccatggctcactgcagcctcgacctcctgggctcaagtgatcctcccaccttagcctccttagcagctgagaccacaggtgcatgccaccatgcctggctaatttttgtatttttagtagagacagggtttcgccatgttgcccaggcatgtctcaaactcctgagctcaagtgatctgtcctccttggcttcccaaagtgctgggattacaagtgcccagactgatttttttttttcttttaagacagggtctcactctgttgctcatgctggagtgcagtgacaggatcatggctcactgcagctttgacctcccaggctaaagcgatccacctgcctcagcctcctgagtagctgggaccacaggtgagcaccaccatgcctggctaattaaaaaaaattattatttttttctctagagacgtggtctccctatgttgcccagtctggtttcaaacttcagacctcaaatgatcctccaacctcggcctcccaaagtgctgggattccaggtgtgaaccattgtgcctggccaaaatacacaatcttaaatgttcaggtgggtggtatagtagtttcccagagcttctgtaagaaagtaccataattggtggcttaaagcaacagaaatgtattctgtcaaagatctggaggctagaaatccaagatcaaggtgttggcaagcccatgatctctgtgaaggcttgaggggaggatcttttcctgtctcttcccaggttctggtgtacaattcctggtgctgtgtggcctgtggacctcactgcagtttctcaatcatcacgtggtcttctccctgagtctctctctttttttttttgagacagagtctcgcattgtcgcccaggctggagtgcggtggcgtgatcttggctcactgcaacctccgcctcctgggttcaagcgattctgctgcctcagcctccggagtagctggaattacaggcgtgcaccaccacgcccagctaatttttgtatttttagtagagacggggtttcaccatgttggccaggctagtctcaaacacctgacctcaagtgatctgcccgcctcggcctcccaaaatgctgggattacaggtgtgagccaccgtgccctgcaatctctctcttcttatcaggacaccagtcattgtattgggcctactaatctggtatgacctcactctaatttgactaatgatgtatgcaaatactctgtttccaaacaaggtcatattctgagattccaggtaagatatgaactgggggcaggcagcactgttcaacccagtacagatatgttttattgacaattatatatacccatgtgaccaccactctaacaaagaagagatagaacatttccaggctgggcgcagtggctcatgcctgtaatcccagcactttgcgaggccaaggcaggctgatcacctgaggtcaggagttcgagaccagcctgaccaacaaggtgaaaccccatctctactaaaaatacaaaaattagctgggtgtggtggcacgtgcctataatcccaggtactcaggaggctgaggcaggagaattccttgaacccaggaggcggaggttgcagtgagccgagatcgtgtcactgaactccagcctgggcgacagagcgagattccgaatcaaaaaaaaaaaaaaaaatttccaaagttccctaatgcccctttccagtcagatccttaccaccaccagccacctgggatagccacagttctgatacctatcaccatagattagtttattggcctgttcttgcattcaaatagctggaattatgtagtgtgcacgcttttgtgtctggttgcttttgctcaaaataatgtttttgagattcatccatgttgctgcacagatcagcagttccttttaatttcagagtaatattccactgtctgattatggcacagttcatacgtccagtcttctgttggcagatatttggatggttttcagttttagaagtgcctatgattcatagtatgaatacagcagcaataggcattcttggtcattcgtcttatggccatagagtttgatttttctaggttaaattctaggagtgggattgctgggtcagagtctaggtatgtgtttaactttgttagaatcgccagtcttccaaaatgacaatcccagcttatactctcaagggtaacgtggagggccccattaccatgcatcctgagaactcaaacagtgattttcttggcgacagatattttctttgctccatagaggggataacccctctgcagaggtttccatcacagagctgtcaagctaaacaccctccagctgctgcagcctaccctgctagtttttgctttgttttcttttgtctcctgctgctctcaggaagcacaaaggcctgttggaggccctttgtctactgtcccagtaccagtgtggatgctccacagtctgttcttgtgctcttgagtccccttgctagtcacaggtcagaggttggaggtcagaggtcagaggtcggaagctggagtccttcagcagaacatcggcagcttccttgagcaggagctgtttccagtgttcaagggtcccattgactggtcccacgctgggtttctttcttgccttctttcacaatcaagtaagtattttgctcacagacctctattgatagtgcaaaaacaacagcaaaaggggaaatgattcaaatataaaagaaaaagcctacgtttttccaaaacccatttttttactattagtaatacgagtgagtaattataacaatagcaaataccaagatagcatgtactgtatgccagctcatgttctaagttttctgtatatagaaatccagtaaatccttacatagccctttgaggtcagaatctcatatcaagcccattttacagatggggaggctgaggcaaaagaggatcctcaccttgcccaaggcaaggtggagtcagagtttgaacccaaaaggtgtagcttcagggtctgtatcttttttttttttttttaatttttatttttgagacagtctcgctctgttgcccaggttggagtgcagtggcatgatctcaactcaatgtagccttcacctcccaggttcaagtaattctcttgcctcagcctcctgagtagctgggattacaggtgtgtgccaccacgcccagctaatttttgtgttcttagtagagacagagtttctccatattgaggctggtgtcaaacacctggcctcaagtgatccccctgcctcagcctcccaaagtgctgggattacaggtgtgagccactgtgccaggcccagggtctgtattttatacctgcatgttttcctttggttcatttacagtctagaaacttaaccacatttatttaaaaaggaaactttgtatcactagcataaatggaagatccacattgcttgacatagatagtaactgtaaaaaatgaatactctgacatagtgtcgtggctcatgcctacaatcccagcacttggggaggctgagaccaggagcttgagaccagcctggacaacatagcaaaccctgtcacacacacacacacacacacacacacacacacacacacacacaaaattagctgggcatgattgagtgtacctgtggtcctagcagtgtgggaggatgccttgagcccaggagttcgaggctgcagtgagcctgattgtgccactgcactccagccttggcaacagagagaaaccctgtctcaaacaaacaaaacaaaacaaaacaaaaaacaaaacaaaacagaatgaagaagaatactctaatataacaacataacatgattctaaatagcacctattgccccttccctattttattttattttttttttgagacggggtttcgttctgtcgcccaggttggagtacagtggcgtaatctcggctcactgcaagttccgcctcccaggttcatgccattctcctgcctcagcctccccagtagctgggactacaggctaattttttgtatttttagtagagacggggttttactgtgttagccaggatggtctcgatctcctgacctcgtgatctgcctgcctcggcctctcaaagtgctgggattacaggtgtgagctgccgtgcctggccgccccttccccatttttaattttttcagtttattttttctttttgcctctagctttgcatggatgatccttccccattttttaaagcagtttgtgcttttggtgtcatatataagaatcaaatcaaagttaccaagattttgtcctagaagttttaggttttacaattaattctatggtccatgtcaagttaatttctttttattatttattttttgagatgattttcttgtttcccaggctggaatggtgtgatctcagctcactgcaacctctgcctctcgggttcaagtaattctcctgcctcagcctccccagctgggattacaggcatacaccatcaggcccggctaattttatattttagtagagacggggttttaccatgttggccaggcaggtctcaaactcctgacctcagatgatctgccccccctcgacctcccaaaatgctgggatcacaggtgtgagccaccgcgcctggccaagttaatttctatatgtggtatgagataagggttgagtttaattttttatatacatatataaggatgtcagatagtttccccagtgttgattgaagagacttctttcctctgtcttctttgaatctgacttttttcagagactgggaggtttgattctcatagttgctgcaaggataaaaaggtataattattttgctatgctctatttaaagcaatcggcacatggtcagcactcagtatataccagttctcagattttgctaactgcttttctgtggtttgacatttaggtggtttccaggtttttttgttttgttttgttttgttttttgcttcaagtgtaaacagcagtgcaatggatatcccaggcattcagctttgttgtcttctttaaaattattttagagtatatttctgggtctttctccatactacaaatcagtgtaaaaagtggacccatgcactctgccagaagccatgggctgcttttgaattagccctgcttccaaccagagggagctctctgggaggtttaaaaactggaatcagactgggcgcgatggctcatgcctgtaaccccagcactttgggaggccaaggtaggaggaccacttgagcctgggagttcaagaccagcctgggcaacttagcaagaccttgtctctacaaaagaactgtaaaacttagctaggcatggtggtgcacacctatagtcccagcaacttgggagaccgaggcagaaggatcttgagcccaggagtttgaggcaacagagtgaagatcctatcaaaaaaaaaaataaagaaaaaagaaaaaaagaaaagaactggagtcatccccttccctggggaaactttcctgccttctgacccccccactctctctctggtcccctggttggtggcttcttatcctcccaatatctgcatatgctttcccatgatattttatacttatttattatttttttgagacaaggcctttctctgtcacccgggctggtctttctgtgtcagccacggctcactgcagcttggacctcccggggtcaagcctcttgagtacctgggactgtgggtatgccaccacatctagctaattaaaaaaaaattatttgtagagattaggtctctctatgttgcccaggctggtctcatactcctgggctcaagcgatcctcttgcctcagcctccgaaaatgctggaattacaggtgtgtgccaccgcaccagcccagtttgtttgtttttaaacaaataaactggtttaagtaaaaaaagtgagtgaatgcagggaaatctatctccatgtaggtagatctggttcaggggtgttgtggtagacacctggctcttagttaggaaatgctgactaaggcgttgccctgttttggtgattctgtggcttgtaaagctggcatggattttcatgttttatttcacctgagaacactccagcttgggagatgcccttgggatatggtgtggcactgagctttccagatgtggtgacattgatcacagataggtggcacccaccagaaatgtacagcccggatccaggagtgtatttgatcaaattcattcagatgtctttgggtcataatgggaaaatgcacgtccagaacccagccaatcttgtttgagaagcaggcatttgaaaacaaattacacgggcctggagactgtctgatttcaggcagaggccagaaataggaggaaagcacaatattgcgtttatatcagacatcttggcaaagctgttgatctgctactgcctctgcttgcctcatggggaaacgcttgatcagaaagcgagatgatgaattagaatatcacaattagcagccctcagtgaattaatggatctaggcattaagtggcattgcctgccaacatcagcaaagagtggagtgcagttgtcacgtgccttctgttgaaagaacacagcaccgcttgtatcgtgacgaagggcttgagcttgaccctgttcccactgcaaacatgcagaaagacaagacagaggagtccaggcgtggtgactcacgcctctaatcccagcacttagggaggccggggtcgaggattgcttgagcccaggagtttgagagcagcttgagcaacatagtgagaccctgtctctacaaaaactaaaaataaaaattagccaggtgtggtggtgcatgcctgtagtccgagctactcaggaggctaaggtgagaggatcacttgagcccaagaggtagaggcttcagtgacctgtgattacgcctctgcactccagcctgggtgacaaagggagaccctgtctccgaaaaaaaaagacagaggaacatgttgaagtggaccatggatctgcaatcaggaaactctaggctgtagaccagggacactttttaaaagaaaaactttagaaagaataaatttaatagtttactatcatgatcaagtattaggtactgtacataattgtatgtgctagactttttgttttgttttcttttgttttgctttgagacagggtctcactctatcacccaggctggagtgcagtggtgccatcgtggctcactgcagccttggcctcctgggctcaagcaatcatcctgccttagccttctgagtacctgggactacaggtgcacaccaccatgcccggctaattttgtattttttatttttgtagggacagcctcttgctatattaccttgtgtcaactgtaatcacagcactttgggaggccgaggtgggtggatcacatgaggccaggagatcaagagcagcctggccaacaagatgaaaccctgtctctactaaaaatacaaaagttagccgggtgtggtggtgcatgcctgtaatcccagctacttgggacgctgaggcaggagaatctcttgaacccgggaggtggaggttgtagtgagccgagatcttgccactgcactccagccagggcgacagagcaagactccgtctcaataaaaaaaaaaaaaaaagttagtttttaaatatatatatttcaatcaattaaagttatttttaagtcaggccttttgcagtatagttgatgtatggtaaagctcatcctctttaagcatacggttggataaatttcaacaaataatataccaacgcttcattcagggtttaaagcatttccttcacctcccaaaattcccctgcgccccttctcagtcaatccccttccccactccccattttgggatgtcaccgatataatttctgtccctggagttttgctttttccagaaaaggctgaatgtacatacagggtatataggtatatactcctaggtatatactcaagagaattgaaagtgttgcctgggcgtggtggctcacacctgtaatcccagcacgttgggaggccgaggcaggcagatcacttgaggtcagaaatttgagaccagcctggccaacatggtgaaatcctgtctctactaaacatacaaaaaaatcagccggaagtggtggtgcacgcctgtaatcatagctgcttgggaggctaagcaggggaatcacttggacctgggaggcagaggttgcagtgagctgagatcacaccactgcactccagcttgggcaacagagcgagacttcatctcaaaacaacaacaagaaaatgttatgcctacacaaaaacttgcacatggattttcatagccatattattcataatggccaaaaggtggaaacagcccaaaagttcaccaaccaagggcactgtatacttaaagaaggtgagcttcactgtccatcaattacacctcaataagcctgactttaaagtaacttcaatggattgaaatacataaattaaaaaaattctttccctccctctctccctccctcccttcctccctccctcccttccttccttccttcctgcctttctttctttttttttttactttttgagatggaatctcactctgttgccaaggctggagtgcagtggcatgatcatggcctgttgctgcctccacctccccagattcaagtgatcttcccaccttagcctccctagcagctgggagtacaggtgcatgcctccttgtccggctaatttttgtattttttgtagagacagggttttgctgtgttgcccaggctggtcttgaactcctgggctcaagcaatccacccccccgcaacctcccaaagtgttggaattataggcatgagccactgcgcctggccaaaattaataatttcaaaatgacactaaaaatcctcattagttattttggaggaagccagaaaacaatacaatctgaaatggacaaagaaaatgtgggatattcatgcaagggagcattatttgacaataaaaagagtaaagtacggatacatgctgtgtcttagtttacctggccttccataaaaaaataccatagaccgggtggcttaaacaacagaaatctgttttctcaccattctctgggctggaactttgagatcagggcaccagcatgattgatttccggtgagggctcttcccttgggttgcagatggccaccttctcactatgtactcacatgaccagttctttgtgtgagtatgggaagagacagagagagagagagacaaagacagagacagagagagtgagcgtactctgatgtctttttttttttttttttttttgagacggagtctcactctgttacccaggctggagtgcagtggcatgatctcggctcactgcaaactttgccctctgagttcaagcgattctcctgcctcagcctcctgagtagctgggattacaggcacctgccactgcgcccgcctaatttttgtatttttagtggagacggtgtttcaccatgttggtcaggcttgtcttgaactccttaccttgtgatcctcccgccttgggctcccaaagtgctgggattacaggcgtgagccactgagcccggcctgatttcttttcttataaaggcattatcccaccataaggaccccatccttgtgacctcatccaaacctaattatctcccaaggcctcatctccaggaaccaccacattaggggttacaacttcaacacatgtattttggagagacacaaacattcagttcataacatgctacaaaatgaatgaaccctgaaaacatgctaagtgaaagaagccagacatgaaaggtcccgtattgcataatcaatcccatttatatgaaatgtccagaataggcaaatccatagagacagaaagaatattagtggctgccaggggctgggaggaagagggaatagggggtgactgctaatgagttcagagtttattttgggggtgatgaaaatgttctgtaattaaataatggtgactgttgcacaacttagtacactaaaaacccacaaagttgtacactttattatttatttttatttatttttatttatttttgagacggatctcactctgtcacccaggctggagtgcagtgggactacctcggctcactgcaacctctgcctcccgggttcaagtgattctcctgcctcagcctcctgagtagctgggattacaggtgcgcaccaccgtgcctggctaatcttttgtatgtttagtagagatagggttttgccatattggccaggctggtctcgaatccctgacctcaggtgatccacctgccttggcctcccaaactgcagggatgacaggagtgagccactgcacctggctgttgcacactttatttatttattttgagacagggtcttgctttgtcacccatgctggagtgcagtggcgtgatcatggttcactgcagccttgacctccctggctcaagtgatcctcccatctcagcctcccaagtagctgggaccacaggcccgtgccactacacccacctaattaaaaaaatttttgttggtagatacgggttctcactatgttgcccgggctggtctcaaagccctgggctgaagcgatcccccggccttggcctcccaaggtgctgggattacaagtgtgagccatcacacgcagcctgtacactttaaaatggtaaattttatggcatgcaaattatatattgatttttaaaaagaaaaaagacttaagatgcacatcagagatttaaaaaataaccagggaaaattgaacgtggattctatatgaaatcatattaaagagttattaatttgagggttgtgtgatgacaatattgtgattatatattttaaaaatccctacatgctggtgaaatggcatgtttgagatttgctttaaaatattcctggaaaaaaaaattgggggatgagtgaagctggaatgacagaagagtgatcatttttttcttttgttttgagacagaatctcgctctgttgccccgactggagggcagtggagcaatcttggctcactgcaacctccgcctcctgggttccagtgattctgctgcctcagcctcctgagtagctgggattacaggcatgcaccaccacacctggctaatttttgtatttttagtagagacagggtttcaccatgttggccaggctggtctcaaagtcctgaccttttatggacaactctgtggaaataacttttttgtttttctattggtatttgaagttgttttttccccttctccttggagtttattctgcctcaactgattcacccgcctcggcctcccaaagtgctgggattacaggtgtgagacactgcacccagccagattgacaatttttgaatctgagtaactgctatatgggggtctgttatactattctaccttgtttcagtttgtttagacaacttccactataaaggaatgaattttttgggtagatggaaatgttttgtatcttgattattatagtaattacacagctctataaatgtgctaaaaacttttagaaatgtatactgaaaagggtaaaatgtagtatatgtaaattagccctcaataaacctgaaaaaaatccccaaactaatgacaactaaatgttctagatacgttagtgtttgtagtgatgctgtaacagcaggggaattgccagggtgaggaggaggaggagggggaggaggagggggagggggaagaggaagaggaggagggaggagggaggaaaaggaggagggaggagggaggaaaaggaggagggaggaggaatgaaaaggaggaagggaggaggaaggaggaagaggaaggagggaagaggaggaagaggaggaagtaggaagaggaaggaggtggaagaggaaggaggaagaggagggaggagaaggaggaggaaggaggaagaggaggaaggaggaagaggaggaggaaggaggaagagaaagggagtaggaggaaggaggaagaagaggaagaggaggaaggaggagaaggaaaaaggaaggaggacgaggaaggaggaagagaaggaaggagaaaggaagagggaagagtaggaaggaggagggggaaagaggaggaagaagagggaggaaggaggaagacgaggaaggaggaggaggaagagaaggaggaagaggaaggaggaaaaggaggaaggacaaggaaaagaggagcagcagcaggcagcgactggggctgagattcagggtgactgcataagggattaacttgaacaacccgtgttctctctataaggccctgcctgcctgctgggcacctcttagggtaagggccagcattctttggtgacaccatggatcacacaatgaagaagatgcccaagtcatacctgctctcccccgatggtgtcactctgtagccattttcccccaccagaggggagacagggaggaggcgaggggatggaagagaactaaatcagagacggaattccagcctgatctgcagagcagacacaatggtccagaccttgcagagtccagaggggcagatgggaggaccacgcacacacgctgagccctgtgtggttgtcgaattttgggagcagccaccagcccacagggtttgaattcctgtcacacttcttacaagccgtatgaccttggacaagtgtcttaacctttctgggcctcagtttcctcattgataaactgagattttgcacttccatgagattgttgtgagagattcagtgaatgtaaagaccttagtcctggccgggtgcggtggctcacgcctgtaatcccagcactttgggaggccaagacagcagatcacttgagtccaggagtttgagactagcctggccaacatggtgaaaccccatctctactaaaaatacaaaaattagccaggcatggtagtgcacatctgtaatcccagctacttgggaggctgaagcaggagaattgcttgaaccctggaggtggaggctgcagtgagccaaaatcacgccactgcactacagcctggatgacagagtctgagactccgtctcaaaaaaattttttttttcttaattttttttttattaatagaactgaggtcttactatgctgaccaggctggtctcgaactcctgggctcacgcaatcctcccaccttggcctcccaaagtgctgggattacaagcatgagccattgcgtccggcttgttttcggagtgggagctcgtctgcttttttaacctgtcctttagcctgagtcattcatggactctaccatggctctcgatgtgtgaactcaaaccacctgttcattccttggtcctgcttttgttcaggccccaggctgccagctggtgtcatcataactcactcatgggccagggccgttcgg

(The sequence listing continues in the following parts.)

We claim:

1. An isolated composition consisting of between 3 and 47 different probe sets, wherein a first probe set consists of one or more probes consisting of 20 or more contiguous nucleotides of SEQ ID NO:3 or a full complement thereof and optionally a detectable label, a second probe set consists of one or more probes consisting of 20 or more contiguous nucleotides of SEQ ID NO:5 or a full complement thereof and optionally a detectable label, and a third probe set consists of one or more probes consisting of 20 or more contiguous nucleotides of SEQ ID NO:7 or a full complement thereof and optionally a detectable label, and wherein each of the between 3 and 47 different probe sets consists of one or more probes consisting of 20 or more contiguous nucleotides, or full complements thereof, of a single mRNA different from that of the other probe sets, and optionally a detectable label.

2. The isolated composition of claim 1 wherein the composition consists of between 4 and 47 different probe sets.

3. The isolated composition of claim 1 wherein the composition consists of between 5 and 47 different probe sets.

4. The isolated composition of claim 1 wherein the probes further comprise a detectable label.

5. The isolated composition of claim 1 wherein the composition consists of 3-23 different probe sets.

6. The isolated composition of claim 1, wherein the composition consists of 3-5 different probe sets.

7. The isolated composition of claim 4, wherein the detectable labels on the probes of one probe set are distinguishable from the detectable labels on the probes of the other probe sets.

8. The isolated composition of claim 1, wherein the first probe set consists of one or more probes consisting of 500 or more contiguous nucleotides of SEQ ID NO:3 or a full complement thereof, the second probe set consists of one or more probes consisting of 500 or more contiguous nucleotides of SEQ ID NO:5 or a full complement thereof, and the third probe set consists of one or more probes consisting of 500 or more contiguous nucleotides of SEQ ID NO: 7 or a full complement thereof.

9. The isolated composition of claim 5 wherein the probes further comprise a detectable label.

10. The isolated composition of claim 6 wherein the probes further comprise a detectable label.

11. The isolated composition of claim 9, wherein the detectable labels on the probes of one probe set are distinguishable from the detectable labels on the probes of the other probe sets.

12. The isolated composition of claim 10, wherein the detectable labels on the probes of one probe set are distinguishable from the detectable labels on the probes of the other probe sets.

13. The isolated composition of claim 8 wherein the probes further comprise a detectable label.

14. The isolated composition of claim 13, wherein the detectable labels on the probes of one probe set are distinguishable from the detectable labels on the probes of the other probe sets.

* * * * *